United States Patent
Siebert et al.

(10) Patent No.: US 12,553,090 B2
(45) Date of Patent: Feb. 17, 2026

(54) MOLECULAR PREDICTORS OF PATIENT RESPONSE TO RADIOTHERAPY TREATMENT

(71) Applicants: Siemens Healthineers AG, Forchheim (DE); The Cleveland Clinic Foundation, Cleveland, OH (US)

(72) Inventors: Matthias Siebert, Marloffstein (DE); Carsten Dietrich, Nuremberg (DE); Heike Wehner, Bamberg (DE); Jens-Christoph Georgi, Oberasbach (DE); Mohamed Abazeed, Willowbrook, IL (US); Andreas Emanuel Posch, Vienna (AT); Andreas Kappel, Glashuetten (DE); Mark Matzas, Nuremberg (DE)

(73) Assignees: The Cleveland Clinic Foundation, Cleveland, OH (US); Siemens Healthineers AG, Forchheim (DE)

( * ) Notice: Subject to any disclaimer, the term of this patent is extended or adjusted under 35 U.S.C. 154(b) by 872 days.

(21) Appl. No.: 17/634,673

(22) PCT Filed: Jul. 31, 2020

(86) PCT No.: PCT/EP2020/071658
§ 371 (c)(1),
(2) Date: Feb. 11, 2022

(87) PCT Pub. No.: WO2021/032441
PCT Pub. Date: Feb. 25, 2021

(65) Prior Publication Data
US 2022/0275460 A1    Sep. 1, 2022

(30) Foreign Application Priority Data
Aug. 16, 2019   (EP) .................................... 19192006

(51) Int. Cl.
*C12Q 1/6886*   (2018.01)
*C12Q 1/6827*   (2018.01)

(52) U.S. Cl.
CPC ......... *C12Q 1/6886* (2013.01); *C12Q 1/6827* (2013.01); *C12Q 2600/106* (2013.01); *C12Q 2600/156* (2013.01); *C12Q 2600/158* (2013.01)

(58) Field of Classification Search
CPC .. C12Q 1/6886; C12Q 1/6883; C12Q 1/6827; C12Q 2600/106; C12Q 2600/156; C12Q 2600/158
See application file for complete search history.

(56) References Cited

U.S. PATENT DOCUMENTS

2008/0166729 A1   7/2008   Kim et al.

FOREIGN PATENT DOCUMENTS

| CN | 107099586 A | 8/2017 | |
| EP | 3778924 A1 * | 2/2021 | ............. G16B 50/00 |
| WO | 2019133697 A1 | 7/2019 | |

OTHER PUBLICATIONS

A Das, M Bell, C Nirodi, M Story, J Minna. Radiogenomics Predicting Tumor Responses to Radiotherapy in Lung Cancer. 2010. Seminars in Radiation Oncology, vol. 20, Issue 3. https://doi.org/10.1016/j.semradonc.2010.01.002. (Year: 2010).*
An Y, Jin G, Wang H, et al. Polymorphisms in hMLH1 and risk of early-onset lung cancer in a southeast Chinese population. Lung Cancer. 2008;59(2):164-170. doi:10.1016/j.lungcan.2007.08.003 (Year: 2008).*
Rizvi et al., Mutational landscape determines sensitivity to PD-1 blockade in non-small cell lung cancer.Science 348, 124-128(2015). DOI:10.1126/science.aaa1348 (Year: 2015).*
Devarakonda S, Rotolo F, Tsao MS, et al. Tumor Mutation Burden as a Biomarker in Resected Non-Small-Cell Lung Cancer. J Clin Oncol. 2018;36(30):2995-3006. doi:10.1200/JCO.2018.78.1963 (Year: 2018).*
Kelsey CR, Jackson IL, Langdon S, et al. Analysis of single nucleotide polymorphisms and radiation sensitivity of the lung assessed with an objective radiologic endpoin. Clin Lung Cancer. 2013;14(3):267-274. doi:10.1016/j.cllc.2012.10.006 (Year: 2013).*
Mateusz, Florczuk et al.; "mi RNAs as Biomarkers and Therapeutic Targets in Non-Small Cell Lung Cancer: Current Perspectives", Targeted Oncology, Springer Paris, Paris, vol. 12, No. 2, pp. 179-200, XP036201139, ISSN: 1776-2596, DOI: 10.1007/S11523-017-0478-5 [retrieved on Feb. 27, 2017]; paragraph [03.2]; 2017.
Eschrich, Steven A. et.al., "A gene expression model of intrinsic tumor radiosensitivity: Prediction of response and prognosis after chemoradiation", Int J Radiat Oncol Biol Phys, 489-496, 2009, DOI:10.1016/j.ijrobp.2009.06.014.
Aerts, Hugo J. W. L. et.al., "Decoding tumour phenotype by noninvasive imaging using a quantitative radiomics approach", Nature Communications, 1-8, 2014, DOI: 10.1038/ncomms5006.
Speers, Corey et.al.; "Development and Validation of a Novel Radiosensitivity Signature in Human Breast Cancer", Clinical Cancer Research, 3667-3677, 2015, DOI: 10.1158/1078-0432.CCR-14-2898.
Scott, Jacob G. et.al., "A genome-based model for adjusting radiotherapy dose (GARD): a retrospective, cohort-based study", Lancet Oncol, 202-211, 2017.

(Continued)

*Primary Examiner* — Stephen T Kapushoc
*Assistant Examiner* — Kailey Elizabeth Cash
(74) *Attorney, Agent, or Firm* — Harness Dickey & Pierce P.L.C.

(57) ABSTRACT

Disclosed are methods of predicting a radiotherapy success in a method of treating a lung cancer of a patient, the use of specific markers for predicting a radiotherapy success in a method of treating a lung cancer of a patient, a database comprising the markers, and a computer program product for use in such a method.

4 Claims, 3 Drawing Sheets

Specification includes a Sequence Listing.

(56) References Cited

OTHER PUBLICATIONS

Chen, Xu et.al., "Plasma miRNAs in predicting radiosensitivity in non-small cell lung cancer", Tumor Biol., 11927-11936, 2016, DOI 10.1007/s13277-016-5052-8.

Kerns, Sarah L et. al.; "Radiogenomics: Using Genetics to Identify Cancer Patients at Risk for Development of Adverse Effects Following Radiotherapy", Cancer Discovery, 155-165, 2014, DOI: 10.1158/2159-8290.CD-13-0197.

Enguix-Riego Maria Del Valle et al: "The single nucleotide variant rs2868371 associates with the risk of mortality in non-small cell lung cancer patients: A multicenter prospective validation", Radiotherapy and Oncology, vol. 136, pp. 29-36, XP055671510, Ireland ISSN: 0167-8140, DOI: 10.1016/j.radonc.2019.03.025; Abstract; the whole document; 2019.

Anonymous; "rs1799977 RefSNP Report—dbSNP—NCBI", XP055671614, Retrieved from the Internet: URL:https://www.ncbi.nlm.nih.gov/snp/rs179 9977; [retrieved on Feb. 25, 2020]; the whole document; 2019.

Pernia Olga et al.; "Methylation status of IGFBP-3 as a useful clinical tool for deciding on a concomitant radiotherapy", EPIGENETICS, vol. 9, No. 11, pp. 1446-1453, XP055324576, US ISSN: 1559-2294, DOI: 10.4161/15592294.2014.971626; Abstract; the whole document; 2014.

Su et al.; "Genetic polymorphisms and treatment response in advanced non-small cellung cancer", Lung Cancer, Elsevier, Amsterdam, NL, vol. 56, No. 2, pp. 281-288, XP022034233, ISSN: 0169-5002, DOI: 10.1016/J.LUNGCAN.2006.12.002; Abstract; the whole document *; 2007.

Enguix-Riego, et al: "S77 ESTRO 37 OC-0153 Multicenter prospective validation of HSPB1 rs2868371 SNP and survival in non-small celllung cancer", XP055671506, Retrieved from the Internet: URL:https://www.thegreenjournal.com/article/S0167-8140(18)30463-8/pdf; [retrieved on Feb. 25, 2020]; Abstract, the whole document; 2018.

Zhao, Shuang G. et.al., "Development and validation of a 24-gene predictor of response to postoperative radiotherapy in prostate cancer: a matched, retrospective analysis", Lancet Oncol, 1612-1620, 2016.

Jin-Yan Liang et al.; "Clinical value of MLHI-negative circulating tumor cells in lung cancer patients:", Medicine., vol. 98, No. 25, p. e15721, XP055671623, US ISSN: 0025-7974, DOI: 10.1097/MD.0000000000015721; p. 5, col. 2, paragraph 2; Abstract; the whole document; 2019.

Ausborn Natalie L et al: "Molecular Profiling to Optimize Treatment in Non-Small Cell Lung Cancer: A Review of Potential Molecular Targets for Radiation Therapy by the Translational Research Program of the Radiation Therapy Oncology Group", International Journal of Radiation: Oncology Biology Physics, Pergamon Press, USA, vol. 83, No. 4, pp. e453-e464, XP028492512, ISSN: 0360-3016, DOI: 10.1016/J.IJROBP.2012.01.056 [retrieved on Jan. 20, 2012]; pp. e460-e461; 2012.

\* cited by examiner

MOLECULAR PREDICTORS OF PATIENT RESPONSE TO RADIOTHERAPY TREATMENT

CROSS-REFERENCE TO RELATED APPLICATION(S)

This application is the National Phase under 35 U.S.C. § 371 of International Application No. PCT/EP2020/071658, which has an international filing date of Jul. 31, 2020, and which designated the United States of America, and which claims priority to European Application No. EP 19192006.5, filed Aug. 16, 2019, the entire contents of each of which are incorporated herein by reference.

REFERENCE TO AN ELECTRONIC SEQUENCE LISTING

This application contains references to nucleic acid sequences and/or amino acid sequences which have been submitted concurrently herewith as the sequence listing TXT file entitled "eolf-seql.txt", file size 16,652,646 Bytes (B), created on 11 Feb. 2022. The aforementioned sequence listing is hereby incorporated by reference in its entirety.

FIELD

Embodiments of the present invention relate to methods of predicting a radiotherapy success in a method of treating a lung cancer of a patient, the use of specific markers for predicting a radiotherapy success in a method of treating a lung cancer of a patient, a database comprising the markers, and a computer program product for use in such a method.

BACKGROUND

The overwhelming majority (~70%) of cancer patients needs a radiation therapy at some point in the course of its treatment. There are basically three forms of radiation therapy in cancer:
External beam radiation therapy (EBRT), in particular x-ray and particle therapy
Brachytherapy (internal radiation therapy), in particular low-dose rate (LDR) and high-dose rate (HDR) brachytherapy
Targeted radiation therapy These can be combined among each other or with adjuvant therapies, such as chemotherapy, immunotherapy, and surgical therapy. Patients respond differently to radiation therapy, depending on cancer type, cancer stage, and form of therapy; with a response rate of ~50% for conventional radiotherapy. This is due in particular to the tumor tissue's inherent sensitivity or resistance to radiation. Furthermore, (irreversible) side effects can occur, depending on the radiosensitivity inherent to the healthy tissue that is located adjacent to the tumor.

To avoid ineffective therapies and (irreversible) side effects, there is a clinical need for a solution that can predict radiotherapy success. This is particularly interesting from a health economics point of view, since such a solution would reduce the patient's average length of stay in the hospital and, consequently, the associated cost. Moreover, the avoidance of inefficacious treatments with potentially adverse side effects would positively influence overall outcome and prognosis. In addition, any solution that speeds up the time of clinical decision support and that provides transparency into the decision-marking process to make it comprehensible to the clinical is desirable.

Existing products and products under development differ particularly in the following features:
Prediction of radiosensitivity/radioresistance in tumor tissue versus radiosensitivity/radiotoxicity in healthy tissue
Universal (pan-cancer) versus tissue-specific (e.g. squamous cell lung carcinoma) prediction/application
Technologies used and measured biological substance
Medical knowledge and clinical guidelines integrated Several platforms exist or are in development to determine radiosensitivity/radioresistance in tumor tissue.

The Cvergenx™ pGRT™ (precision genomic radiation therapy) platform (under development) is based on measuring the activity of ten genes (via RNA) to calculate a tumor radiosensitivity index (RSI, Eschrich et al., 2009, Int J Radiat Oncol Biol Phys, DOI: 10.1016/j.ijrobp.2009.06.014) and its integration into a model to adapt radiation dose (genomic-adjusted radiation dose, GARD, Scott et al., 2017, Lancet Oncol, DOI: 10.1016/S1470-2045(16)30648-9) in chemoradiation therapy.

The PFS Genomics™ RadiotypeDX™ test (under development) is based on measuring the activity of 51 genes (via RNA) in breast cancer tissue and predicts a locoregional recurrence after adjuvant radiotherapy (Speers et al., 2015, Clin Cancer Res, DOI: 10.1158/1078-0432.CCR-14-2898).

The Genomic Health® OncotypeDx™ test is based on measuring the activity of 21 genes (via RNA) in breast cancer tissue (in particular ductal carcinoma in situ, DCIS) and predicts radiotherapy success as well as locoregional recurrence after radiotherapy.

The GenomeDx® Decipher™ test is based on measuring the activity of 22 and 24 genes (via RNA) in prostate cancer tissue and predicts the development of distal metastases after radical prostatectomy and post-operative radiotherapy (post-operative radiation therapy outcomes score, PORTOS, Zhao et al., 2016, Lancet Oncol, under development, DOI: 10.1016/S1470-2045(16)30491-0), respectively.

The OncoRadiomics™ RadiomiX™ platform is based on calculating general, quantitative tumor features from medical CT images and predicts radiotherapy success, among other things (Aerts et al, 2014, Nat Commun, DOI: 10.1038/ncomms5006).

Also, several approaches exist regarding the determination of radiotoxicity in healthy tissue.

The NovaGray® RILA Breast™ test is based on measuring apoptotic T-lymphocytes, induced by in vitro radiation of a blood sample (radiation-induced T-lymphocyte apoptosis, RILA), and identifies patients who likely respond hypersensitive to ionizing radiation and, therefore, are at risk of developing irreversible side effects, in particular fibrosis, in healthy breast tissue.

The DiaCarta® RadTox® test (under development) is based on measuring circulating, cell-free DNA (cfDNA) in blood, particularly the repetitive Alu sequence, as a measure of radiotherapy-induced tissue damage, and monitors potentially toxic side effects in healthy tissue, located adjacent to the tumor, after radiotherapy.

However, there remains a need for efficient markers for predicting a radiotherapy success in a method of treating a lung cancer of a patient.

SUMMARY

The inventors have found efficient markers for predicting radiotherapy success in patients suffering from a lung cancer.

In a first aspect, embodiments of the present invention relate to a method of predicting a radiotherapy success in a method of treating a lung cancer of a patient, comprising:
  obtaining or providing a sample of the patient, and
  determining a change in the nucleotide sequence and/or epigenomics profile and/or expression profile and/or copy number compared to a reference sequence and/or epigenomics profile and/or expression profile and/or copy number of at least one gene selected from MLH1, EP300, BRCA2, FLT1, GRINA, HEATR1, MUTYH, NUDT1, PARP10, PRPF19, KCNJ12, MGMT, PMS2P9, DDX11, EPHA2, GEN1, SETD2, and ZNF208, and/or a gene mutational burden in at least one gene selected from the group consisting of MLH1, DDX11, APOLD1, GEN1, GPER1, POLB, PRPF19, ANKRD30A, AR, BTK, GTF2H4, HEATR1, IKBKE, KAT6A, NUDT19, PARP1, PTPRT, TAF3, TDG, MAP3K1, and SLC9A4, and/or a tumor mutational burden (TMB).

Further disclosed is in a second aspect the use of a change in the nucleotide sequence and/or epigenomics profile and/or expression profile and/or copy number compared to a reference sequence and/or epigenomics profile and/or expression profile and/or copy number of at least one gene selected from MLH1, EP300, BRCA2, FLT1, GRINA, HEATR1, MUTYH, NUDT1, PARP10, PRPF19, KCNJ12, MGMT, PMS2P9, DDX11, EPHA2, GEN1, SETD2, and ZNF208, and/or a gene mutational burden in at least one gene selected from the group consisting of MLH1, DDX11, APOLD1, GEN1, GPER1, POLB, PRPF19, ANKRD30A, AR, BTK, GTF2H4, HEATR1, IKBKE, KAT6A, NUDT19, PARP1, PTPRT, TAF3, TDG, MAP3K1, and SLC9A4, and/or a tumor mutational burden (TMB), particularly a change in the nucleotide sequence chosen from rs1801406, rs1046456, rs3754334, rs7993418, rs16981869, rs72407975, rs67714660, rs56261297, rs2275685, rs2275687, rs1885533, rs1885534, rs1006456, rs2794763, rs1799977, rs3219472, rs1062492, rs11136344, rs11136345, rs2240045, rs4082155, rs10425763, rs20551, rs72846670, rs73979902, rs16906255, and/or rs73144285, further particularly rs1799977 and/or rs20551, as disclosed in the Single Nucleotide Polymorphism Database dbSNP of the National Center for Biotechnology Information (NCBI), as a marker for predicting a radiotherapy success in a method of treating a lung cancer of a patient.

Embodiments of the present invention furthermore is directed in a third aspect to a database comprising the above markers of the second aspect.

A fourth aspect relates to a method of predicting a radiotherapy success in a method of treating a lung cancer of a patient, comprising:
  obtaining nucleotide sequence data and/or epigenomics profile data and/or expression profile data and/or copy number data of a sample of a patient, and
  determining the presence of at least one marker of the second aspect.

A fifth aspect is directed to a computer program product comprising computer executable instructions which, when executed, perform the method of the fourth aspect.

In a sixth aspect, a method of predicting a radiotherapy success in a method of treating a lung cancer of a patient is disclosed, comprising:
  obtaining nucleotide sequence data and/or epigenomics profile data and/or expression profile data and/or copy number data of a sample of a patient, and
  analyzing the nucleotide sequence data using the computer program product the fifth aspect.

Further aspects and embodiments of the present invention are dis-closed in the dependent claims and can be taken from the following description, figures and examples, without being limited thereto.

BRIEF DESCRIPTION OF THE DRAWINGS

The enclosed drawings should illustrate embodiments of the present invention and convey a further understanding thereof. In connection with the description they serve as explanation of concepts and principles of the present invention. Other embodiments and many of the stated advantages can be derived in relation to the drawings. The elements of the drawings are not necessarily to scale towards each other. Identical, functionally equivalent and acting equal features and components are denoted in the figures of the drawings with the same reference numbers, unless noted otherwise.

DETAILED DESCRIPTION

Figure 1:
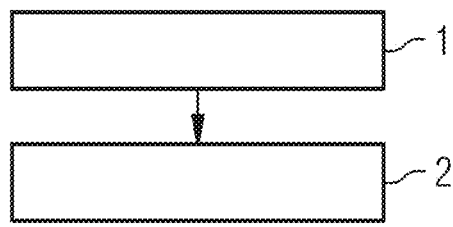
FIG. 1 shows schematically steps in a method of the first aspect of embodiments of the present invention.

Unless defined otherwise, technical and scientific terms used herein have the same meaning as commonly understood by one of ordinary skill in the art to which this embodiments of the present invention belong.

In general, a gene is a sequence of nucleotides (nucleotide sequence) in DNA—which can be copied to RNA, e.g. mRNA—or RNA, i.e. nucleic acid molecules, coding for a molecule that has a function in an organism. The term "nucleic acid molecule" refers to a polynucleotide molecule having a defined sequence. It comprises DNA molecules, RNA molecules, nucleotide analog molecules and combinations and derivatives thereof, such as DNA molecules or RNA molecules with incorporated nucleotide analogs or cDNA.

With regard to embodiments of the present invention, the following genes have the following sequence ID NO: as reference gene, as per the attached sequence protocol:
  SEQ ID NO: 1—MLH1; SEQ ID NO: 2—EP300;
  SEQ ID NO: 3—BRCA2; SEQ ID NO: 4—FLT1;
  SEQ ID NO: 5—GRINA; SEQ ID NO: 6—HEATR1;
  SEQ ID NO: 7—MUTYH; SEQ ID NO: 8—NUDT1;
  SEQ ID NO: 9—PARP10; SEQ ID NO: 10—PRPF19;
  SEQ ID NO: 11—KCNJ12; SEQ ID NO: 12—MGMT;
  SEQ ID NO: 13—PMS2P9; SEQ ID NO: 14—DDX11;
  SEQ ID NO: 15—EPHA2; SEQ ID NO: 16—GEN1;
  SEQ ID NO: 17—SETD2; SEQ ID NO: 18—ZNF208;
  SEQ ID NO: 19—APOLD1; SEQ ID NO: 20—GPER1;
  SEQ ID NO: 21—POLB; SEQ ID NO: 22—ANKRD30A;
  SEQ ID NO: 23—AR; SEQ ID NO: 24—BTK;
  SEQ ID NO: 25—GTF2H4; SEQ ID NO: 26—IKBKE;
  SEQ ID NO: 27—KAT6A; SEQ ID NO: 28—NUDT19;
  SEQ ID NO: 29—PARP1; SEQ ID NO: 30—PTPRT;
  SEQ ID NO: 31—TAF3; SEQ ID NO: 32—TDG;
  SEQ ID NO: 33—MAP3K1; SEQ ID NO: 34—SLC9A4;
  SEQ ID NO: 35—UNG; SEQ ID NO: 36—SMUG1;
  SEQ ID NO: 37—MBD4; SEQ ID NO: 38—OGG1;
  SEQ ID NO: 39—NTHL1; SEQ ID NO: 40—MPG;
  SEQ ID NO: 41—NEIL1; SEQ ID NO: 42—NEIL2;
  SEQ ID NO: 43—NEIL3; SEQ ID NO: 44—APEX1;

SEQ ID NO: 45—APEX2; SEQ ID NO: 46—LIG3;
SEQ ID NO: 47—XRCC1; SEQ ID NO: 48—PNKP;
SEQ ID NO: 49—APLF; SEQ ID NO: 50—PARP2;
SEQ ID NO: 51—PARP3; SEQ ID NO: 52—ALKBH2;
SEQ ID NO: 53—ALKBH3; SEQ ID NO: 54—TDP1;
SEQ ID NO: 55—TDP2; SEQ ID NO: 56—MSH2;
SEQ ID NO: 57—MSH3; SEQ ID NO: 58—MSH6;
SEQ ID NO: 59—PMS2; SEQ ID NO: 60—MSH4;
SEQ ID NO: 61—MSH5; SEQ ID NO: 62—MLH3;
SEQ ID NO: 63—PMS1; SEQ ID NO: 64—PMS2P3;
SEQ ID NO: 65—XPC; SEQ ID NO: 66—RAD23B;
SEQ ID NO: 67—CETN2; SEQ ID NO: 68—RAD23A;
SEQ ID NO: 69—XPA; SEQ ID NO: 70—DDB1;
SEQ ID NO: 71—DDB2; SEQ ID NO: 72—RPA1;
SEQ ID NO: 73—RPA2; SEQ ID NO: 74—RPA3;
SEQ ID NO: 75—ERCC3; SEQ ID NO: 76—ERCC2;
SEQ ID NO: 77—GTF2H1; SEQ ID NO: 78—GTF2H2;
SEQ ID NO: 79—GTF2H3; SEQ ID NO: 80—GTF2H5;
SEQ ID NO: 81—CDK7; SEQ ID NO: 82—CCNH;
SEQ ID NO: 83—MNAT1; SEQ ID NO: 84—ERCC5;
SEQ ID NO: 85—ERCC1; SEQ ID NO: 86—ERCC4;
SEQ ID NO: 87—LIG1; SEQ ID NO: 88—ERCC8;
SEQ ID NO: 89—ERCC6; SEQ ID NO: 90—UVSSA;
SEQ ID NO: 91—XAB2; SEQ ID NO: 92—MMS19;
SEQ ID NO: 93—RAD51; SEQ ID NO: 94—RAD51B;
SEQ ID NO: 95—RAD51D; SEQ ID NO: 96—DMC1;
SEQ ID NO: 97—XRCC2; SEQ ID NO: 98—XRCC3;
SEQ ID NO: 99—RAD52; SEQ ID NO: 100—RAD54L;
SEQ ID NO: 101—RAD54B; SEQ ID NO: 102—BRCA1;
SEQ ID NO: 103—SHFM1; SEQ ID NO: 104—RAD50;
SEQ ID NO: 105—MRE11A; SEQ ID NO: 106—NBN;
SEQ ID NO: 107—RBBP8; SEQ ID NO: 108—MUS81;
SEQ ID NO: 109—EME1; SEQ ID NO: 110—EME2;
SEQ ID NO: 111—SLX1A; SEQ ID NO: 112—SLX1B;
SEQ ID NO: 113—FANCA; SEQ ID NO: 114—FANCB;
SEQ ID NO: 115—FANCC; SEQ ID NO: 116—FANCD2;
SEQ ID NO: 117—FANCE; SEQ ID NO: 118—FANCF;
SEQ ID NO: 119—FANCG; SEQ ID NO: 120—FANCI;
SEQ ID NO: 121—BRIP1; SEQ ID NO: 122—FANCL;
SEQ ID NO: 123—FANCM; SEQ ID NO: 124—PALB2;
SEQ ID NO: 125—RAD51C; SEQ ID NO: 126—SLX4;
SEQ ID NO: 127—FAAP20; SEQ ID NO: 128—FAAP24;
SEQ ID NO: 129—XRCC6; SEQ ID NO: 130—XRCC5;
SEQ ID NO: 131—PRKDC; SEQ ID NO: 132—LIG4;
SEQ ID NO: 133—XRCC4; SEQ ID NO: 134—DCLRE1C;
SEQ ID NO: 135—NHEJ1; SEQ ID NO: 136—DUT;
SEQ ID NO: 137—RRM2B; SEQ ID NO: 138—POLG;
SEQ ID NO: 139—POLD1; SEQ ID NO: 140—POLE;
SEQ ID NO: 141—PCNA; SEQ ID NO: 142—REV3L;
SEQ ID NO: 143—MAD2L2; SEQ ID NO: 144—REV1;
SEQ ID NO: 145—POLH; SEQ ID NO: 146—POLI;
SEQ ID NO: 147—POLQ; SEQ ID NO: 148—POLK;
SEQ ID NO: 149—POLL; SEQ ID NO: 150—POLM;
SEQ ID NO: 151—POLN; SEQ ID NO: 152—FEN1;
SEQ ID NO: 153—FAN1; SEQ ID NO: 154—TREX1;
SEQ ID NO: 155—TREX2; SEQ ID NO: 156—EX01;
SEQ ID NO: 157—APTX; SEQ ID NO: 158—SPO11;
SEQ ID NO: 159—ENDOV; SEQ ID NO: 160—UBE2A;
SEQ ID NO: 161—UBE2B; SEQ ID NO: 162—RAD18;
SEQ ID NO: 163—SHPRH; SEQ ID NO: 164—HLTF;
SEQ ID NO: 165—RNF168; SEQ ID NO: 166—SPRTN;
SEQ ID NO: 167—RNF8; SEQ ID NO: 168—UBE2V2;
SEQ ID NO: 169—UBE2N; SEQ ID NO: 170—H2AFX;
SEQ ID NO: 171—CHAF1A; SEQ ID NO: 172—SETMAR;
SEQ ID NO: 173—BLM; SEQ ID NO: 174—WRN;
SEQ ID NO: 175—RECQL4; SEQ ID NO: 176—ATM;
SEQ ID NO: 177—MPLKIP; SEQ ID NO: 178—DCLRE1A;
SEQ ID NO: 179—DCLRE1B; SEQ ID NO: 180—RPA4;
SEQ ID NO: 181—RECQL; SEQ ID NO: 182—RECQL5;
SEQ ID NO: 183—HELQ; SEQ ID NO: 184—RDM1;
SEQ ID NO: 185—NABP2; SEQ ID NO: 186—ATR;
SEQ ID NO: 187—ATRIP; SEQ ID NO: 188—MDC1;
SEQ ID NO: 189—RAD1; SEQ ID NO: 190—RAD9A;
SEQ ID NO: 191—HUS1; SEQ ID NO: 192—RAD17;
SEQ ID NO: 193—CHEK1; SEQ ID NO: 194—CHEK2;
SEQ ID NO: 195—TP53; SEQ ID NO: 196—TP53BP1;
SEQ ID NO: 197—RIF1; SEQ ID NO: 198—TOPBP1;
SEQ ID NO: 199—CLK2; SEQ ID NO: 200—PER1;
SEQ ID NO: 201—RNF4

A change in the nucleotide sequence relates to a variation in the sequence as compared to a reference sequence. A change in the nucleotide sequence is for example a deletion of one or multiple nucleotides, an insertion of one or multiple nucleotides, a substitution of one or multiple nucleotides, a duplication of one or a sequence of multiple nucleotides, a translocation of one or a sequence of multiple nucleotides, etc. Thus, it also encompasses single-nucleotide variants (SNVs) and multi-nucleotide variants (MNVs).

An epigenomics profile corresponds to the multitude of all epigenomic modifications, i.e. DNA methylation, DNA hydroxymethylation, histone modification, etc., that can occur in a patient.

An expression profile corresponds to the quantity and/or activity of all molecules that are expressed or realized from a gene, i.e. mRNAs, proteins, etc., including the multitude of its modifications, i.e. RNA methylation, protein phosphorylation, etc., that can occur in a patient.

A copy number corresponds to the number of copies of any defined DNA region within the genome. In the diploid human genome, e.g., the characteristic copy number of any gene is two. Deviations from this copy number can occur in a patient as a result of structural sequence variations. These deviations are herein also termed copy number variations (CNVs) and are herein also termed change in copy number.

In the context of embodiments of the present invention, a "sample" is a sample which comprises at least nucleotide sequence and/or epigenetic profile and/or expression profile and/or copy number information of a patient. Examples for samples are cells, tissue, biopsy specimens, body fluids, blood, urine, saliva, sputum, plasma, serum, cell culture supernatant, swab sample and others, e.g. tumor tissue. According to certain embodiments the sample is a blood sample. In this regard it was found that the mutations particularly are not somatic, so that also blood samples, e.g. peripheral blood, are possible as samples. Peripheral blood in this regard refers to the circulating pool of blood within the patient. According to certain embodiments the sample is a tissue or a biopsy specimen which can be fixated or not, wherein a fixation can be e.g. carried out by freezing or usual fixation methods like for formalin-fixed paraffin-embedded (FFPE) tissue.

According to certain embodiments, the patient in the present methods is a vertebrate, more preferably a mammal and most preferred a human.

A vertebrate within embodiments of the present invention refers to animals having a vertebrae, which includes mammals—including humans, birds, reptiles, amphibians and fishes. Embodiments of the present invention thus are not only suitable for human medicine, but also for veterinary medicine.

The gene mutational burden (GMB) is a biomarker that measures the mutational burden in a gene by counting the number of considered mutations and e.g. provides a proxy for the remaining functionality of the gene. This metric can e.g. be used to classify genes into classes with low, medium, and high mutational burdens. The mutational burden is either a natural number (including 0) or a positive rational number (e.g. relative to 1 kbp). The number of the GMB can be entered into calculations for evaluating the probability of a radiotherapy success in a method of treating a lung cancer of a patient. The gene mutational burden in one gene can e.g. differ between patients that do and patients that do not respond to radiotherapy. It is not excluded that patients that do respond differ from patients that do not respond to radiotherapy by one or more specific mutations in a single gene, but do not show a difference in the overall mutational burden of the gene.

The tumor mutational burden (TMB) is a biomarker that measures the mutational burden in all or a subset of all genes by counting the number of considered mutations and e.g. approximates the number of mutations present in a tumor of a cancer patient. This metric can e.g. be used to classify tumors into classes with low, medium, and high mutational burdens. The tumor mutational burden is either a natural number (including 0) or a positive rational number (e.g. relative to 1 kbp). The number of the TMB can be entered into calculations for evaluating the probability of a radiotherapy success in a method of treating a lung cancer of a patient. The tumor mutational burden can e.g. differ between patients that do and patients that do not respond to radiotherapy.

Radiotherapy success can be based on a combination of somatic features/mutations (e.g. radiosensitivity/radioresistance of cancerous tissue) and germline features/mutations (innate radiosensitivity/radioresistance).

According to certain embodiments, a success in radiotherapy with adjuvant therapies, particularly chemotherapy, immunotherapy, and/or surgical therapy, is predicted in the present methods of treating a lung cancer of a patient.

In embodiments of the present invention the radiotherapy method is not particularly restricted. According to certain embodiments, the radiotherapy is external beam radiation therapy (EBRT), in particular x-ray and particle therapy, brachytherapy (internal radiation therapy), in particular low-dose rate (LDR) and high-dose rate (HDR) brachytherapy, or targeted radiation therapy. It is also not excluded that adjuvant therapies are included. According to certain embodiments the radiotherapy method thus also can be radiochemotherapy.

According to certain embodiments, the prediction of radiotherapy success includes a prediction of locoregional response and/or recurrence.

Gene coordinates can be obtained from the following resource: ftp.ncbi.nlm.nih.gov/genomes/all/GCF/000/001/405/GCF_000001405.33_GRCh38.p7/GCF_000001405.33_GRCh38.p7_feature_table.txt.gz.

Before embodiments of the present invention are described in exemplary detail, it is to be understood that the present invention is not limited to the particular component parts of the process steps of the methods described herein as such methods may vary. It is also to be understood that the terminology used herein is for purposes of describing particular embodiments only, and is not intended to be limiting.

It must be noted that, as used in the specification and the appended claims, the singular forms "a,", "an" and "the" include singular and/or plural referents unless the context clearly dictates otherwise. For example, the term "a" as used herein can be understood as one single entity or in the meaning of "one or more" entities. It is also to be understood that plural forms include singular and/or plural referents unless the context clearly dictates otherwise. It is moreover to be understood that, in case parameter ranges are given which are delimited by numeric values, the ranges are deemed to include these limitation values.

In a first aspect, at least one embodiment of the present invention relate to a method of predicting a radiotherapy success in a method of treating a lung cancer of a patient, comprising:

obtaining or providing a sample of the patient, and determining a change in the nucleotide sequence and/or epigenomics profile and/or expression profile and/or copy number compared to a reference sequence and/or epigenomics profile and/or expression profile and/or copy number of at least one gene selected from MLH1, EP300, BRCA2, FLT1, GRINA, HEATR1, MUTYH, NUDT1, PARP10, PRPF19, KCNJ12, MGMT, PMS2P9, DDX11, EPHA2, GEN1, SETD2, and ZNF208, and/or a gene mutational burden in at least one gene selected from the group consisting of MLH1, DDX11, APOLD1, GEN1, GPER1, POLB, PRPF19, ANKRD30A, AR, BTK, GTF2H4, HEATR1, IKBKE, KAT6A, NUDT19, PARP1, PTPRT, TAF3, TDG, MAP3K1, and SLC9A4, and/or a tumor mutational burden (TMB).

According to certain embodiments, the present invention relates to a method of predicting a radiotherapy success in a method of treating a lung cancer of a patient, comprising:

obtaining or providing a sample of the patient, and determining a change in the nucleotide sequence and/or epigenomics profile and/or expression profile and/or copy number compared to a reference sequence and/or epigenomics profile and/or expression profile and/or copy number of at least one gene selected from MLH1, EP300, HEATR1, NUDT1, and MGMT, and/or a gene mutational burden in at least one gene selected from the group consisting of MLH1, DDX11, PRPF19, BTK, GTF2H4, KAT6A, TDG, MAP3K1, and SLC9A4, and/or a tumor mutational burden (TMB), particularly a change in the nucleotide sequence and/or epigenomics profile and/or expression profile and/or copy number compared to a reference sequence and/or epigenomics profile and/or expression profile and/or copy number of at least one gene selected from MLH1 and EP300, and/or a gene mutational burden in MLH1, and/or a tumor mutational burden (TMB).

The present method is especially suitable for predicting a radiotherapy success in a method of treating a lung cancer of a patient, particularly in a method of treating a non-small cell lung cancer (NSCLC), and further particularly in a method of treating lung squamous cell carcinoma (LUSC) and/or lung adenocarcinoma (LUAD).

In the present method the obtaining or providing of a sample of the patient is not particularly restricted but is preferably non-invasive, e.g. the sample can be taken from a stock or a storage, be obtained in vitro, etc.

Also the determining of a change in the nucleotide sequence and/or epigenomics profile and/or expression profile and/or copy number compared to a reference sequence and/or epigenomics profile and/or expression profile and/or copy number of at least one gene selected from MLH1, EP300, BRCA2, FLT1, GRINA, HEATR1, MUTYH, NUDT1, PARP10, PRPF19, KCNJ12, MGMT, PMS2P9, DDX11, EPHA2, GEN1, SETD2, and ZNF208, and/or a gene mutational burden in at least one gene selected from the group consisting of MLH1, DDX11, APOLD1, GEN1, GPER1, POLB, PRPF19, ANKRD30A, AR, BTK, GTF2H4, HEATR1, IKBKE, KAT6A, NUDT19, PARP1, PTPRT, TAF3, TDG, MAP3K1, and SLC9A4, and/or a tumor mutational burden (TMB) is not particularly restricted.

For the determining of a change in the nucleotide sequence and/or epigenomics profile and/or expression profile and/or copy number compared to a reference sequence and/or epigenomics profile and/or expression profile and/or copy number, it is e.g. possible to obtain nucleotide sequence information of one or more nucleotide sequences of MLH1, EP300, BRCA2, FLT1, GRINA, HEATR1, MUTYH, NUDT1, PARP10, PRPF19, KCNJ12, MGMT, PMS2P9, DDX11, EPHA2, GEN1, SETD2, and ZNF208, and/or an epigenomics profile for one or more genes of MLH1, EP300, BRCA2, FLT1, GRINA, HEATR1, MUTYH, NUDT1, PARP10, PRPF19, KCNJ12, MGMT, PMS2P9, DDX11, EPHA2, GEN1, SETD2, and ZNF208, and/or an expression profile for one or more genes of MLH1, EP300, BRCA2, FLT1, GRINA, HEATR1, MUTYH, NUDT1, PARP10, PRPF19, KCNJ12, MGMT, PMS2P9, DDX11, EPHA2, GEN1, SETD2, and ZNF208, and/or determine a copy number of one or more genes of MLH1, EP300, BRCA2, FLT1, GRINA, HEATR1, MUTYH, NUDT1, PARP10, PRPF19, KCNJ12, MGMT, PMS2P9, DDX11, EPHA2, GEN1, SETD2, and ZNF208, in the sample by a suitable method, which is not particularly restricted.

For example, nucleotide sequence information can be obtained by DNA sequencing methods that are not particularly restricted, e.g. Sanger sequencing methods, shotgun sequencing methods, bridge PCR methods, and next-generation sequencing methods.

The methods of sequencing nucleic acids referred to as next-generation sequencing have opened the possibility of large-scale genomic analysis. The term "next-generation sequencing" or "high-throughput sequencing" refers to high-throughput sequencing technologies that parallelize the sequencing process, producing thousands or millions of sequences at once. Examples include Massively Parallel Signature Sequencing (MPSS), Polony sequencing, 454 pyrosequencing, Illumina® (Solexa™) sequencing, SOLiD sequencing, Ion Torrent semiconductor sequencing, DNA nanoball sequencing, Helioscope™ single molecule sequencing, Single Molecule Real Time (SMRT) sequencing, Nanopore DNA sequencing, and RNA Polymerase (RNAP) sequencing, each with or without prior employment of target enrichment techniques like hybridization capture.

An epigenomics profile can be obtained based on specific epigenetic modifications that are not specifically restricted, e.g. histone modification assays like ChIP-Chip and ChIP-Seq and DNA methylation assays based on microarray or bead array, bisulfite sequencing, or mass spectrometry.

The expression profile of genes can either be determined on the level of RNAs, e.g. using quantitative real-time PCR, DNA microarray, or RNA sequencing methods, or on the level of proteins, e.g. using quantitative proteomics methods.

The copy number and copy number variations/changes can e.g. be determined by comparative genomic hybridizations to microarrays or next-generation sequencing methods.

After the determination, the nucleotide sequence and/or epigenomics profile and/or expression profile and/or copy number of the one or more gene can then be compared to the respective reference, i.e. the reference sequence, reference epigenomics profile, reference expression profile and reference copy number. By comparison, a change in the nucleotide sequence and/or epigenomics profile and/or expression profile and/or copy number can then be determined.

However, it is not excluded that the respective information about the nucleotide sequence and/or epigenomics profile and/or expression profile and/or copy number of the one or more gene is already provided together with the sample of the patient, so that e.g. only the comparing to a reference has to be carried out.

In embodiments of the present invention a change in the nucleotide sequence and/or epigenomics profile and/or expression profile and/or copy number compared to a reference sequence and/or epigenomics profile and/or expression profile and/or copy number of at least one gene selected from MLH1, EP300, BRCA2, FLT1, GRINA, HEATR1, MUTYH, NUDT1, PARP10, PRPF19, KCNJ12, MGMT, PMS2P9, DDX11, EPHA2, GEN1, SETD2, and ZNF208, and/or a gene mutational burden in at least one gene selected from the group consisting of MLH1, DDX11, APOLD1, GEN1, GPER1, POLB, PRPF19, ANKRD30A, AR, BTK, GTF2H4, HEATR1, IKBKE, KAT6A, NUDT19, PARP1, PTPRT, TAF3, TDG, MAP3K1, and SLC9A4, and/or a tumor mutational burden (TMB) can be indicative of an enhanced or a reduced radiotherapy success in a method of treating a lung cancer of a patient. This means that a certain change in the nucleotide sequence and/or epigenomics profile and/or expression profile and/or copy number compared to a reference sequence and/or epigenomics profile and/or expression profile and/or copy number of one gene selected from MLH1, EP300, BRCA2, FLT1, GRINA, HEATR1, MUTYH, NUDT1, PARP10, PRPF19, KCNJ12, MGMT, PMS2P9, DDX11, EPHA2, GEN1, SETD2, and ZNF208, and/or a gene mutational burden in one gene selected from the group consisting of MLH1, DDX11, APOLD1, GEN1, GPER1, POLB, PRPF19, ANKRD30A, AR, BTK, GTF2H4, HEATR1, IKBKE, KAT6A, NUDT19, PARP1, PTPRT, TAF3, TDG, MAP3K1, and SLC9A4, and/or a tumor mutational burden (TMB) can be indicative of an enhanced radiotherapy success in a method of treating a lung cancer of a patient, while another change in the nucleotide sequence and/or epigenomics profile and/or expression profile and/or copy number compared to a reference sequence and/or epigenomics profile and/or expression profile and/or copy number of a different gene selected from MLH1, EP300, BRCA2, FLT1, GRINA, HEATR1, MUTYH, NUDT1, PARP10, PRPF19, KCNJ12, MGMT, PMS2P9, DDX11, EPHA2, GEN1, SETD2, and ZNF208, and/or a gene mutational burden in a different gene selected from the group consisting of MLH1, DDX11, APOLD1, GEN1, GPER1, POLB, PRPF19, ANKRD30A, AR, BTK, GTF2H4, HEATR1, IKBKE, KAT6A, NUDT19, PARP1, PTPRT, TAF3, TDG, MAP3K1, and SLC9A4, can be indicative of a reduced radiotherapy success in a method of treating a lung cancer of a patient.

For example, it was found that LUSC patients with higher TMB show a better local response to radiotherapy compared to LUSC patients with lower TMB. However, better results are obtained when combinations of features, particularly with the TMB as one feature, are considered, i.e. at least one of the changes in the nucleotide sequence and/or epigenomics profile and/or expression profile and/or copy number compared to a reference sequence and/or epigenomics profile and/or expression profile and/or copy number of the genes mentioned for the present methods, and/or at least one GMB for the genes mentioned for the present methods.

According to certain embodiments the lung cancer is a non-small cell lung cancer, wherein the change in the nucleotide sequence and/or epigenomics profile and/or expression profile and/or copy number compared to a reference sequence and/or epigenomics profile and/or expression profile and/or copy number, particularly a change in the nucleotide sequence compared to a reference sequence, is determined in at least one gene selected from the group consisting of BRCA2, DDX11, EPHA2, FLT1, GEN1, GRINA, HEATR1, MLH1, MUTYH, NUDT1, PARP10, PRPF19, SETD2, ZNF208, EP300, KCNJ12, MGMT, and PMS2P9, particularly MLH1 and/or EP300, and/or wherein the gene mutational burden is determined in at least one gene selected from the group consisting of APOLD1, DDX11, GEN1, GPER1, MLH1, POLB, PRPF19, ANKRD30A, AR, BTK, GTF2H4, HEATR1, IKBKE, KAT6A, MAP3K1, NUDT19, PARP1, PTPRT, SLC9A4, TAF3, and TDG, particularly MLH1, and/or wherein the tumor mutational burden is determined, preferably wherein a change in the nucleotide sequence and/or epigenomics profile and/or expression profile and/or copy number compared to a reference sequence and/or epigenomics profile and/or expression profile and/or copy number, particularly a change in the nucleotide sequence compared to a reference sequence, of at least one gene selected from MLH1, EP300, HEATR1, NUDT1, and MGMT, and/or a gene mutational burden in at least one gene selected from the group consisting of MLH1, DDX11, PRPF19, BTK, GTF2H4, KAT6A, TDG, MAP3K1, and SLC9A4, and/or a tumor mutational burden (TMB) is determined, further preferably wherein a change in the nucleotide sequence and/or epigenomics profile and/or expression profile and/or copy number compared to a reference sequence and/or epigenomics profile and/or expression profile and/or copy number, particularly a change in the nucleotide sequence compared to a reference sequence, of at least one gene selected from MLH1 and EP300, and/or a gene mutational burden in MLH1, and/or a tumor mutational burden (TMB) is determined.

According to certain embodiments at least one change in the nucleotide sequence is determined chosen from rs1801406, rs1046456, rs3754334, rs7993418, rs16981869, rs72407975, rs67714660, rs56261297, rs2275685, rs2275687, rs1885533, rs1885534, rs1006456, rs2794763, rs1799977, rs3219472, rs1062492, rs11136344, rs11136345, rs2240045, rs4082155, rs10425763, rs20551, rs72846670, rs73979902, rs16906255, and rs73144285, as disclosed in the Single Nucleotide Polymorphism Database dbSNP of the National Center for Biotechnology Information (NCBI), and/or NC_000007.14: g.77040016_77040017delinsCA, as compiled to the Human Genome Variation Society (HGVS; www.hgvs.org/) variant nomenclature, preferably rs1885534, rs2794763, rs1799977, rs1062492, rs20551, rs16906255, particularly rs1799977 and/or rs20551, as disclosed in the Single Nucleotide Polymorphism Database dbSNP of the National Center for Biotechnology Information (NCBI).

The changes as disclosed in the Single Nucleotide Polymorphism Database dbSNP of the National Center for Biotechnology Information (NCBI) are thereby as follows (for *Homo sapiens*):

rs1801406: position: chr13:32337751 (GRCh38.p12, obtained from NCBI) (position 22272 in SEQ ID NO: 3, BRCA2); alleles: A>C (missense variant), A>G (synonymous variant); variation Type: Single Nucleotide Variation (SNV); gene: BRCA2 rs1046456: position: chr12:31101061 (GRCh38.p12) (position 27488 in SEQ ID NO: 14, DDX11); alleles: C>T; variation Type: SNV; gene: DDX11, synonymous or missense variant rs3754334: position: chr1:16125272 (GRCh38.p12) (position 936 in SEQ ID NO: 14, EPHA2); alleles: G>A; variation Type: SNV; gene: EPHA2, synonymous variant rs7993418: position: chr13:28308924 (GRCh38.p12) (position 8579 in SEQ ID NO: 4, FLT1); alleles: G>A; variation Type: SNV; gene: FLT1, synonymous variant rs16981869: position: chr2:17764976 (GRCh38.p12) (position 11290 in SEQ ID NO: 16, GEN1); alleles: A>G; variation Type: SNV; gene: GEN1, missense variant rs72407975: position: chr2:17768673:17768675 (GRCh38.p7) (positions 14987:14989 in SEQ ID NO: 16, GEN1); alleles: TAA/-; variation Type: Insertion and Deletion (Indel); gene: GEN1, intron variant rs67714660: chr8:143991836 (GRCh38.p12) (position 1779 in SEQ ID NO: 5, GRINA); alleles: C>A, C>G; variation Type: SNV; gene: GRINA, intron variant rs56261297: chr8:143992685 (GRCh38.p12) (position 2628 in SEQ ID NO: 5, GRINA); alleles: C>T; variation Type: SNV; gene: GRINA, intron variant rs2275685: chr1:236553659 (GRCh38.p12) (position 4655 in SEQ ID NO: 6, HEATR1); alleles: C>T; variation Type: SNV; gene: HEATR1, synonymous variant rs2275687: chr1:236554626 (GRCh38.p12) (position 5622 in SEQ ID NO: 6, HEATR1); alleles: T>C; variation Type: SNV; gene: HEATR1, missense variant rs1885533: chr:1236555893 (GRCh38.p12) (position 6889 in SEQ ID NO: 6, HEATR1); alleles: A>C, A>G, A>T; variation Type: SNV; gene: HEATR1, missense variant rs1885534: chr:1236555959 (GRCh38.p12) (position 6955 in SEQ ID NO: 6, HEATR1); alleles: G>A; variation Type: SNV; gene: HEATR1, intron variant rs1006456: chr:1236585205 (GRCh38.p12) (position 36201 in SEQ ID NO: 6, HEATR1); alleles: T>C; variation Type: SNV; gene: HEATR1, synonymous variant rs2794763: chr:1236586349 (GRCh38.p12) (position 37345 in SEQ ID NO: 6, HEATR1); alleles: T>C; variation Type: SNV; gene: HEATR1, missense variant rs1799977: chr3:37012077 (GRCh38.p12) (position 18728 in SEQ ID NO: 1, MLH1); alleles: A>C, A>G, A>T; variation Type: SNV; gene: MLH1, missense variant rs3219472: chr:145338378 (GRCh38.p12) (position 9137 in SEQ ID NO: 7, MUTYH); alleles: C>T; variation Type: SNV; gene: MUTYH, intron variant rs1062492: chr7:2251050 (GRCh38.p12) (position 8829 in SEQ ID NO: 8, NUDT1); alleles: C>T; variation Type: SNV; gene: NUDT1, 3'UTR variant rs11136344: chr8:143985257 (GRCh38.p12) (position 8106 in SEQ ID NO: 9, PARP10); alleles: T>C; variation Type: SNV; gene: PARP10, missense variant rs11136345: chr8:143985944 (GRCh38.p12) (position 8793 in SEQ ID NO: 9, PARP10); alleles: G>A (synonymous variant), G>C (missense variant); variation Type: SNV; gene: PARP10 rs2240045: chr11:60903374 (GRCh38.p12) (position 12828 in SEQ ID NO: 10, PRPF19); alleles: C>T; variation Type: SNV; gene: PRPF19, intron variant rs4082155: chr3:47083895 (GRCh38.p12) (position 67488 in SEQ ID NO: 17, SETD2); alleles: G>A, G>T; variation Type: SNV; gene: SETD2, missense variant rs10425763: chr19:21973116 (GRCh38.p12) (position 7022 in SEQ ID NO: 18, ZNF208); alleles: T>C; variation Type: SNV; gene: ZNF208, missense variant rs20551: chr22:41152004 (GRCh38.p12) (position 59395 in SEQ ID NO: 2, EP300); alleles: A>G; variation Type: SNV; gene: EP300, missense variant rs72846670: chr17:21416533 (GRCh38.p12) (position 40147 in SEQ ID NO: 11, KCNJ12); alleles: C>G (missense variant), C>T (synonymous variant); variation Type: SNV; gene: KCNJ12 rs73979902: chr17:21416556 (GRCh38.p12) (position 40170 in SEQ ID NO: 11, KCNJ12); alleles: G>A, G>T; variation Type: SNV; gene: KCNJ12, missense variant rs16906255: chr10:129467401 (GRCh38.p12) (position 218 in SEQ ID NO: 12, MGMT); alleles: T>G; variation Type: SNV; gene: MGMT, intron variant rs73144285: chr7:77040017 (GRCh38.p12) (NC_000007.14:g.77040016_77040017delinsCA, position 77040016 in chromosome 7 corresponds to position 537 in SEQ ID NO: 13, PMS2P9; alleles: G>A, G>T; variation Type: SNV; gene: PMS2P9, non-coding transcript variant According to certain embodiments, the present invention relates to a method of predicting a radiotherapy success in a method of treating a lung cancer of a patient, comprising:
obtaining or providing a sample of the patient, and
determining at least one change in the nucleotide sequence chosen from rs1801406, rs1046456, rs3754334, rs7993418, rs16981869, rs72407975, rs67714660, rs56261297, rs2275685, rs2275687, rs1885533, rs1885534, rs1006456, rs2794763, rs1799977, rs3219472, rs1062492, rs11136344, rs11136345, rs2240045, rs4082155, rs10425763, rs20551, rs72846670, rs73979902, rs16906255, and rs73144285, preferably rs1885534, rs2794763, rs1799977, rs1062492, rs20551, rs16906255, particularly rs1799977 and/or rs20551, as disclosed in the Single Nucleotide Polymorphism Database dbSNP of the National Center for Biotechnology Information (NCBI), and/or a gene mutational burden in at least one gene selected from the group consisting of MLH1, DDX11, APOLD1, GEN1, GPER1, POLB, PRPF19, ANKRD30A, AR, BTK, GTF2H4, HEATR1, IKBKE, KAT6A, NUDT19, PARP1, PTPRT, TAF3, TDG, MAP3K1, and SLC9A4, and/or a tumor mutational burden (TMB).

According to certain embodiments, the present invention relates to a method of predicting a radiotherapy success in a method of treating a lung cancer of a patient, comprising:
obtaining or providing a sample of the patient, and
determining at least one change in the nucleotide sequence chosen from rs1801406, rs1046456, rs3754334, rs7993418, rs16981869, rs72407975, rs67714660, rs56261297, rs2275685, rs2275687, rs1885533, rs1885534, rs1006456, rs2794763, rs1799977, rs3219472, rs1062492, rs11136344, rs11136345, rs2240045, rs4082155, rs10425763, rs20551, rs72846670, rs73979902, rs16906255, and rs73144285, preferably rs1885534, rs2794763, rs1799977, rs1062492, rs20551, rs16906255, particularly rs1799977 and/or rs20551, as disclosed in the Single Nucleotide Polymorphism Database dbSNP of the National Center for Biotechnology Information (NCBI), and/or a gene mutational burden in at least one gene selected from the group consisting of MLH1, DDX11, PRPF19, BTK, GTF2H4, KAT6A, TDG, MAP3K1, and SLC9A4, particularly in MLH1, and/or a tumor mutational burden (TMB).

According to certain embodiments, the at least one change in the nucleotide sequence determined is preferably chosen from NC_000013.11:g.32337751A>G, NC_000012.12:g.31101061C>T, NC_000001.11:g.16125272G>A, NC_000013.11:g.28308924G>A, NC_000002.12:g.17764976A>G, NC_000002.12:g.17768673_17768675delTAA, NC_000008.11:g.143991836C>G, NC_000008.11:g.143992685C>T, NC_000001.11:g.236553659C>T, NC_000001.11:g.236554626T>C, NC_000001.11:g.236555893A>G, NC_000001.11:g.236555959G>A, NC_000001.11:g.236585205T>C, NC_000001.11:g.236586349T>C, NC_000003.12:g.37012077A>G, NC_000001.11:g.45338378C>T, NC_000007.14:g.2251050C>T, NC_000008.11:g.143985257T>C, NC_000008.11:g.143985944G>A, NC_000011.10:g.60903374C>T, NC_000003.12:g.47083895G>A, NC_000019.10:g.21973116T>C, NC_000022.11:g.41152004A>G, NC_000017.11:g.21416533C>T, NC_000017.11:g.21416556G>A, NC_000010.11:g.129467401T>G, and NC_000007.14:g.77040016_77040017delinsCA, further preferably chosen from NC_000001.11:g.236555959G>A, NC_000001.11:g.236586349T>C, NC_000003.12:g.37012077A>G, NC_000007.14:g.2251050C>T, NC_000022.11:g.41152004A>G, NC_000010.11:g.129467401T>G, particularly NC_000003.12:g.37012077A>G or NC_000022.11:g.41152004A>G, as complied to the Human Genome Variation Society (HGVS; www.hgvs.org/) variant nomenclature.

According to certain embodiments, the present invention relates to a method of predicting a radiotherapy success in a method of treating a lung cancer of a patient, comprising:
obtaining or providing a sample of the patient, and
determining at least one change in the nucleotide sequence chosen from NC_000013.11:g.32337751A>G, NC_000012.12:g.31101061C>T, NC_000001.11:g.16125272G>A, NC_000013.11:g.28308924G>A, NC_000002.12:g.17764976A>G, NC_000002.12:g.17768673_17768675delTAA, NC_000008.11:g.143991836C>G, NC_000008.11:g.143992685C>T, NC_000001.11:g.236553659C>T, NC_000001.11:g.236554626T>C, NC_000001.11:g.236555893A>G, NC_000001.11:g.236555959G>A, NC_000001.11:g.236585205T>C, NC_000001.11:g.236586349T>C, NC_000003.12:g.37012077A>G, NC_000001.11:g.45338378C>T, NC_000007.14:g.2251050C>T, NC_000008.11:g.143985257T>C, NC_000008.11:g.143985944G>A, NC_000011.10:g.60903374C>T, NC_000003.12:g.47083895G>A, NC_000019.10:g.21973116T>C, NC_000022.11:g.41152004A>G, NC_000017.11:g.21416533C>T, NC_000017.11:g.21416556G>A, NC_000010.11:g.129467401T>G, and NC_000007.14:g.77040016_77040017delinsCA, further preferably chosen from NC_000001.11:g.236555959G>A, NC_000001.11:g.236586349T>C, NC_000003.12:g.37012077A>G, NC_000007.14:g.2251050C>T, NC_000022.11:g.41152004A>G, NC_000010.11:g.129467401T>G, particularly NC_000003.12:g.37012077A>G or NC_000022.11:g.41152004A>G, as complied to the Human Genome Variation Society (HGVS; www.hgvs.org/) variant nomenclature, and/or a gene mutational burden in at least one gene selected from the group consisting of MLH1, DDX11, APOLD1, GEN1, GPER1, POLB, PRPF19, ANKRD30A, AR, BTK, GTF2H4, HEATR1, IKBKE, KAT6A, NUDT19, PARP1, PTPRT, TAF3, TDG, MAP3K1, and SLC9A4, and/or a tumor mutational burden (TMB).

According to certain embodiments, the present invention relates to a method of predicting a radiotherapy success in a method of treating a lung cancer of a patient, comprising:
obtaining or providing a sample of the patient, and
determining at least one change in the nucleotide sequence chosen from NC_000013.11:g.32337751A>G, NC_000012.12:g.31101061C>T, NC_000001.11:g.16125272G>A, NC_000013.11:g.28308924G>A, NC_000002.12:g.17764976A>G, NC_000002.12:g.17768673_17768675delTAA, NC_000008.11:g.143991836C>G, NC_000008.11:g.143992685C>T, NC_000001.11:g.236553659C>T, NC_000001.11:g.236554626T>C, NC_000001.11:g.236555893A>G, NC_000001.11:g.236555959G>A, NC_000001.11:g.236585205T>C, NC_000001.11:g.236586349T>C, NC_000003.12:g.37012077A>G, NC_000007.14:g.45338378C>T, NC_000007.14:g.2251050C>T, NC_000008.11:g.143985257T>C, NC_000008.11:g.143985944G>A, NC_000011.10:g.60903374C>T, NC_000003.12:g.47083895G>A, NC_000019.10:g.21973116T>C, NC_000022.11:g.41152004A>G, NC_000017.11:g.21416533C>T, NC_000017.11:g.21416556G>A, NC_000010.11:g.129467401T>G, and NC_000007.14:g.77040016_77040017delinsCA, further preferably chosen from NC_000001.11:g.236555959G>A, NC_000001.11:g.236586349T>C, NC_000003.12:g.37012077A>G, NC_000007.14:g.2251050C>T, NC_000022.11:g.41152004A>G, NC_000010.11:g.129467401T>G, particularly NC_000003.12:g.37012077A>G or NC_000022.11:g.41152004A>G, as complied to the Human Genome Variation Society (HGVS; www.hgvs.org/) variant nomenclature, and/or a gene mutational burden in at least one gene selected from the group consisting of MLH1, DDX11, PRPF19, BTK, GTF2H4, KAT6A, TDG, MAP3K1, and SLC9A4, particularly in MLH1, and/or a tumor mutational burden (TMB).

According to certain embodiments, a change in the nucleotide sequence and/or epigenomics profile and/or expression profile and/or copy number compared to a reference sequence and/or epigenomics profile and/or expression profile and/or copy number of at least one gene selected from MLH1, EP300, BRCA2, EPHA2, FLT1, GRINA, HEATR1, NUDT1, PARP10, PRPF19, KCNJ12, SETD2, and ZNF208, preferably HEATR1, MLH1, EP300, and NUDT1, particularly preferably MLH1 and/or EP300, is indicative of an enhanced radiotherapy success in a method of treating a lung cancer of a patient.

According to certain embodiments, a change in the nucleotide sequence and/or epigenomics profile and/or expression profile and/or copy number compared to a reference sequence and/or epigenomics profile and/or expression profile and/or copy number of at least one gene selected from DDX11, GEN1, MUTYH, MGMT, and PMS2P9, preferably MGMT, is indicative of a reduced radiotherapy success in a method of treating a lung cancer of a patient.

According to certain embodiments, a change in the nucleotide sequence chosen from rs1801406, rs3754334, rs7993418, rs67714660, rs56261297, rs2275685, rs2275687, rs1885533, rs1885534, rs1006456, rs2794763, rs1799977, rs1062492, rs11136344, rs11136345, rs2240045, rs4082155, rs10425763, rs20551, rs72846670, and/or rs73979902, preferably rs1885534, rs2794763, rs1799977, rs1062492, and/or rs20551, further preferably rs1799977 and/or rs20551, is indicative of an enhanced radiotherapy success in a method of treating a lung cancer of a patient, and/or a change in the nucleotide sequence chosen from rs1046456, rs16981869, rs72407975, rs3219472, rs16906255, and/or rs73144285, preferably rs16906255, is indicative of a reduced radiotherapy success in a method of treating a lung cancer of a patient.

According to certain embodiments, a change in the nucleotide sequence chosen from NC_000013.11:g.32337751A>G, NC_000001.11:g.16125272G>A, NC_000013.11:g.28308924G>A, NC_000008.11:g.143991836C>G, NC_000008.11:g.143992685C>T, NC_000001.11:g.236553659C>T, NC_000001.11:g.236554626T>C, NC_000001.11:g.236555893A>G, NC_000001.11:g.236555959G>A, NC_000001.11:g.236585205T>C, NC_000001.11:g.236586349T>C, NC_000003.12:g.37012077A>G, NC_000007.14:g.2251050C>T, NC_000008.11:g.143985257T>C, NC_000008.11:g.143985944G>A, NC_000011.10:g.60903374C>T, NC_000003.12:g.47083895G>A, NC_000019.10:g.21973116T>C, NC_000022.11:g.41152004A>G, NC_000017.11:g.21416533C>T, and/or NC_000017.11:g.21416556G>A, preferably NC_000001.11:g.236555959G>A, NC_000001.11:g.236586349T>C, NC_000003.12:g.37012077A>G, NC_000007.14:g.2251050C>T, and/or NC_000022.11:g.41152004A>G, further preferably NC_000003.12:g.37012077A>G and/or NC_000022.11:g.41152004A>G, as complied to the Human Genome Variation Society (HGVS; www.hgvs.org/) variant nomenclature, is indicative of an enhanced radiotherapy success in a method of treating a lung cancer of a patient, and/or a change in the nucleotide sequence chosen from NC_000012.12:g.31101061C>T, NC_000002.12:g.17764976A>G, NC_000002.12:g.17768673_17768675delTAA, NC_000001.11:g.45338378C>T, NC_000010.11:g.129467401T>G, and/or NC_000007.14:g.77040016_77040017delinsCA, preferably NC_000010.11:g.129467401T>G, as complied to the Human Genome Variation Society (HGVS; www.hgvs.org/) variant nomenclature, is indicative of a reduced radiotherapy success in a method of treating a lung cancer of a patient.

According to certain embodiments the cancer is a lung squamous cell carcinoma, wherein the change in the nucleotide sequence and/or epigenomics profile and/or expression profile and/or copy number compared to a reference sequence and/or epigenomics profile and/or expression profile and/or copy number, particularly a change in the nucleotide sequence compared to a reference sequence, is determined in at least one gene selected from the group consisting of BRCA2, DDX11, EPHA2, FLT1, GEN1, GRINA, HEATR1, MLH1, MUTYH, NUDT1, PARP10, PRPF19, SETD2, and ZNF208, particularly MLH1, and/or wherein the gene mutational burden is determined in at least one gene selected from the group consisting of APOLD1, DDX11, GEN1, GPER1, MLH1, POLB, and PRPF19, preferably DDX11, MLH1, and PRPF19, particularly MLH1, and/or wherein the tumor mutational burden is determined.

According to certain embodiments the cancer is a lung squamous cell carcinoma, wherein at least one change in the nucleotide sequence is determined chosen from rs1801406, rs1046456, rs3754334, rs7993418, rs16981869, rs72407975, rs67714660, rs56261297, rs2275685, rs2275687, rs1885533, rs1885534, rs1006456, rs2794763, rs1799977, rs3219472, rs1062492, rs11136344, rs11136345, rs2240045, rs4082155, and rs10425763, preferably rs1885534, rs2794763, rs1799977, and rs1062492, particularly rs1799977, as disclosed in the Single Nucleotide Polymorphism Database dbSNP of the National Center for Biotechnology Information (NCBI), and/or wherein the gene mutational burden is determined in at least one gene selected from the group consisting of APOLD1, DDX11, GEN1, GPER1, MLH1, POLB, and PRPF19, preferably DDX11, MLH1, and PRPF19, particularly MLH1, and/or wherein the tumor mutational burden is determined.

According to certain embodiments the cancer is a lung squamous cell carcinoma, wherein at least one change in the nucleotide sequence is determined chosen from NC_000013.11:g.32337751A>G, NC_000012.12:g.31101061C>T, NC_000001.11:g.16125272G>A, NC_000013.11:g.28308924G>A, NC_000002.12:g.17764976A>G, NC_000002.12:g.17768673_17768675delTAA, NC_000008.11:g.143991836C>G, NC_000008.11:g.143992685C>T, NC_000001.11:g.236553659C>T, NC_000001.11:g.236554626T>C, NC_000001.11:g.236555893A>G, NC_000001.11:g.236555959G>A, NC_000001.11:g.236585205T>C, NC_000001.11:g.236586349T>C, NC_000003.12:g.37012077A>G, NC_000001.11:g.45338378C>T, NC_000007.14:g.2251050C>T, NC_000008.11:g.143985257T>C, NC_000008.11:g.143985944G>A, NC_000011.10:g.60903374C>T, NC_000003.12:g.47083895G>A, NC_000019.10:g.21973116T>C, preferably NC_000001.11:g.236555959G>A, NC_000001.11:g.236586349T>C, NC_000003.12:g.37012077A>G, NC_000007.14:g.2251050C>T, particularly NC_000003.12:g.37012077A>G, as complied to the Human Genome Variation Society (HGVS; www.hgvs.org/) variant nomenclature, and/or wherein the gene mutational burden is determined in at least one gene selected from the group consisting of APOLD1, DDX11, GEN1, GPER1, MLH1, POLB, and PRPF19, preferably DDX11, MLH1, and PRPF19, particularly MLH1, and/or wherein the tumor mutational burden is determined.

According to certain embodiments, a change in the nucleotide sequence and/or epigenomics profile and/or expression profile and/or copy number compared to a reference sequence and/or epigenomics profile and/or expression profile and/or copy number of at least one gene selected from MLH1, BRCA2, EPHA2,FLT1, GRINA, HEATR1, NUDT1, PARP10, PRPF19, SETD2, and ZNF208, preferably HEATR1, MLH1, and NUDT1, particularly preferably MLH1, is indicative of an enhanced radiotherapy success in a method of treating a lung squamous cell carcinoma of a patient.

According to certain embodiments, a change in the nucleotide sequence and/or epigenomics profile and/or expression profile and/or copy number compared to a reference sequence and/or epigenomics profile and/or expression profile and/or copy number of at least one gene selected from DDX11, GEN1, and MUTYH, is indicative of a reduced radiotherapy success in a method of treating a lung squamous cell carcinoma of a patient.

According to certain embodiments a change in the nucleotide sequence chosen from rs1801406, rs3754334, rs7993418, rs67714660, rs56261297, rs2275685, rs2275687, rs1885533, rs1885534, rs1006456, rs2794763, rs1799977, rs1062492, rs11136344, rs11136345, rs2240045, rs4082155, and/or rs10425763, preferably rs1885534, rs2794763, rs1799977, and/or rs1062492, further preferably rs1799977, is indicative of an enhanced radiotherapy success in a method of treating a lung squamous cell carcinoma of a patient, and/or a change in the nucleotide sequence chosen from rs1046456, rs16981869, rs72407975, and/or rs3219472 is indicative of a reduced radiotherapy success in a method of treating a lung squamous cell carcinoma of a patient.

According to certain embodiments a change in the nucleotide sequence chosen from NC_000013.11:g.32337751A>G, NC_000001.11:g.16125272G>A, NC_000013.11:g.28308924G>A, NC_000008.11:g.143991836C>G, NC_000008.11:g.143992685C>T, NC_000001.11:g.236553659C>T, NC_000001.11:g.236554626T>C, NC_000001.11:g.236555893A>G, NC_000001.11:g.236555959G>A, NC_000001.11:g.236585205T>C, NC_000001.11:g.236586349T>C, NC_000003.12:g.37012077A>G, NC_000007.14:g.2251050C>T, NC_000008.11:g.143985257T>C, NC_000008.11:g.143985944G>A, NC_000011.10:g.60903374C>T, NC_000003.12:g.47083895G>A, and/or NC_000019.10:g.21973116T>C, preferably NC_000001.11:g.236555959G>A, NC_000001.11:g.236586349T>C, NC_000003.12:g.37012077A>G, and/or NC_000007.14:g.2251050C>T, particularly NC_000003.12:g.37012077A>G, as complied to the Human Genome Variation Society (HGVS; www.hgvs.org/) variant nomenclature, is indicative of an enhanced radiotherapy success in a method of treating a lung squamous cell carcinoma of a patient, and/or a change in the nucleotide sequence chosen from NC_000012.12:g.31101061C>T, NC_000002.12:g.17764976A>G, NC_000002.12:g.17768673_17768675delTAA, and/or NC_000001.11:g.45338378C>T, as complied to the Human Genome Variation Society (HGVS; www.hgvs.org/) variant nomenclature, is indicative of a reduced radiotherapy success in a method of treating a lung squamous cell carcinoma of a patient.

According to certain embodiments a combination of at least two changes in the nucleotide sequence and/or epigenomics profile and/or expression profile and/or copy number compared to a reference sequence and/or epigenomics profile and/or expression profile and/or copy number within one gene or in at least two genes, particularly at least two changes in the nucleotide sequences above, and/or a combination of gene mutational burdens in at least two genes, and/or a combination of at least one change in the nucleotide sequence and/or epigenomics profile and/or expression profile and/or copy number compared to a reference sequence and/or epigenomics profile and/or expression profile and/or copy number of at least one gene, particularly at least one change in the nucleotide sequence above, and a gene mutational burden in at least one gene that is the same or different thereof, and/or at least one change in the nucleotide sequence and/or epigenomics profile and/or expression profile and/or copy number compared to a reference sequence and/or epigenomics profile and/or expression profile and/or copy number of at least one gene, particularly at least one change in the nucleotide sequence above, and the tumor mutational burden, and/or a gene mutational burden in at least one gene and the tumor mutational burden, particularly at least one change in the nucleotide sequence and/or epigenomics profile and/or expression profile and/or copy number compared to a reference sequence and/or epigenomics profile and/or expression profile and/or copy number of at least one gene, particularly at least one change in the nucleotide sequence above, and the tumor mutational burden, are determined.

FIG. 1 shows schematically steps in a method of the first aspect of embodiments of the present invention, wherein step 1 corresponds to obtaining or providing a sample of the patient, and step 2 corresponds to determining a change in the nucleotide sequence and/or epigenomics profile and/or expression profile and/or copy number compared to a reference sequence and/or epigenomics profile and/or expression profile and/or copy number of at least one gene selected from MLH1, EP300, BRCA2, FLT1, GRINA, HEATR1, MUTYH, NUDT1, PARP10, PRPF19, KCNJ12, MGMT, PMS2P9, DDX11, EPHA2, GEN1, SETD2, and ZNF208, and/or a gene mutational burden in at least one gene selected from the group consisting of MLH1, DDX11, APOLD1, GEN1, GPER1, POLB, PRPF19, ANKRD30A, AR, BTK, GTF2H4, HEATR1, IKBKE, KAT6A, NUDT19, PARP1, PTPRT, TAF3, TDG, MAP3K1, and SLC9A4, and/or a tumor mutational burden (TMB).

A second aspect of embodiments of the present invention is directed to a use of a change in the nucleotide sequence and/or epigenomics profile and/or expression profile and/or copy number compared to a reference sequence and/or epigenomics profile and/or expression profile and/or copy number of at least one gene selected from MLH1, EP300, BRCA2, FLT1, GRINA, HEATR1, MUTYH, NUDT1, PARP10, PRPF19, KCNJ12, MGMT, PMS2P9, DDX11, EPHA2, GEN1, SETD2, and ZNF208, preferably MLH1, EP300, HEATR1, NUDT1, and MGMT, further preferably MLH1 and EP300, particularly a change in the nucleotide sequence chosen from rs1801406, rs1046456, rs3754334, rs7993418, rs16981869, rs72407975, rs67714660, rs56261297, rs2275685, rs2275687, rs1885533, rs1885534, rs1006456, rs2794763, rs1799977, rs3219472, rs1062492, rs11136344, rs11136345, rs2240045, rs4082155, rs10425763, rs20551, rs72846670, rs73979902, rs16906255, and/or rs73144285, as disclosed in the Single Nucleotide Polymorphism Database dbSNP of the National Center for Biotechnology Information (NCBI), and/or NC_000007.14:g.77040016_77040017delinsCA, as complied to the Human Genome Variation Society (HGVS; www.hgvs.org/) variant nomenclature, preferably rs1885534, rs2794763, rs1799977, rs1062492, rs20551, rs16906255, particularly rs1799977 and/or rs20551, as disclosed in the Single Nucleotide Polymorphism Database dbSNP of the National Center for Biotechnology Information (NCBI), further particularly at least one change in the nucleotide sequence chosen from NC_000013.11:g.32337751A>G, NC_000012.12:g.31101061C>T, NC_000001.11:g.16125272G>A, NC_000013.11:g.28308924G>A, NC_000002.12:g.17764976A>G, NC_000002.12: g. 17768673_17768675delTAA, NC_000008.11:g.143991836C>G, NC_000008.11:g.143992685C>T, NC_000001.11:g.236553659C>T, NC_000001.11:g.236554626T>C, NC_000001.11:g.236555893A>G, NC_000001.11:g.236555959G>A, NC_000001.11:g.236585205T>C, NC_000001.11:g.236586349T>C, NC_000003.12:g.37012077A>G, NC_000001.11:g.45338378C>T, NC_000007.14:g.2251050C>T, NC_000008.11:g.143985257T>C, NC_000008.11:g.143985944G>A, NC_000011.10:g.60903374C>T, NC_000003.12:g.47083895G>A, NC_000019.10:g.21973116T>C, NC_000022.11:g.41152004A>G, NC_000017.11:g.21416533C>T, NC_000017.11:g.21416556G>A, NC_000010.11:g.129467401T>G, and NC_000007.14:g.77040016_77040017delinsCA, further preferably chosen from NC_000001.11:g.236555959G>A, NC_000001.11:g.236586349T>C, NC_000003.12:g.37012077A>G, NC_000007.14:g.2251050C>T, NC_000022.11:g.41152004A>G, NC_000010.11:g.129467401T>G, particularly NC_000003.12:g.37012077A>G or NC_000022.11:g.41152004A>G, as complied to the Human Genome Variation Society (HGVS; www.hgvs.org/) variant nomenclature, and/or a gene mutational burden in at least one gene selected from the group consisting of MLH1, DDX11, APOLD1, GEN1, GPER1, POLB, PRPF19, ANKRD30A, AR, BTK, GTF2H4, HEATR1, IKBKE, KAT6A, NUDT19, PARP1, PTPRT, TAF3, TDG, MAP3K1, and SLC9A4, preferably MLH1, DDX11, PRPF19, BTK, GTF2H4, KAT6A, TDG, MAP3K1, and SLC9A4, further preferably MLH1, and/or a tumor mutational burden (TMB), as a marker for predicting a radiotherapy success in a method of treating a lung cancer of a patient.

According to certain embodiments the second aspect is directed to the use of a change in the nucleotide sequence and/or epigenomics profile and/or expression profile and/or copy number compared to a reference sequence and/or epigenomics profile and/or expression profile and/or copy number of at least one gene selected from MLH1, EP300, BRCA2, FLT1, GRINA, HEATR1, MUTYH, NUDT1, PARP10, PRPF19, KCNJ12, MGMT, PMS2P9, DDX11, EPHA2, GEN1, SETD2, and ZNF208, preferably MLH1, EP300, HEATR1, NUDT1, and MGMT, further preferably MLH1 and EP300, particularly a change in the nucleotide sequence chosen from rs1801406, rs1046456, rs3754334, rs7993418, rs16981869, rs72407975, rs67714660, rs56261297, rs2275685, rs2275687, rs1885533, rs1885534, rs1006456, rs2794763, rs1799977, rs3219472, rs1062492, rs11136344, rs11136345, rs2240045, rs4082155, rs10425763, rs20551, rs72846670, rs73979902, rs16906255, and/or rs73144285, as disclosed in the Single Nucleotide Polymorphism Database dbSNP of the National Center for Biotechnology Information (NCBI), and/or NC_000007.14:g.77040016_77040017delinsCA as complied to the Human Genome Variation Society (HGVS; www.hgvs.org/) variant nomenclature, preferably rs1885534, rs2794763, rs1799977, rs1062492, rs20551, rs16906255, particularly rs1799977 and/or rs20551, as disclosed in the Single Nucleotide Polymorphism Database dbSNP of the National Center for Biotechnology Information (NCBI), further particularly at least one change in the nucleotide sequence chosen from NC_000013.11:g.32337751A>G, NC_000012.12:g.31101061C>T, NC_000001.11:g.16125272G>A, NC_000013.11:g.28308924G>A, NC_000002.12:g.17764976A>G, NC_000002.12: g. 17768673_17768675delTAA, NC_000008.11:g.143991836C>G, NC_000008.11:g.143992685C>T, NC_000001.11:g.236553659C>T, NC_000001.11:g.236554626T>C, NC_000001.11:g.236555893A>G, NC_000001.11:g.236555959G>A, NC_000001.11:g.236585205T>C, NC_000001.11:g.236586349T>C, NC_000003.12:g.37012077A>G, NC_000001.11:g.45338378C>T, NC_000007.14:g.2251050C>T, NC_000008.11:g.143985257T>C, NC_000008.11:g.143985944G>A, NC_000011.10:g.60903374C>T, NC_000003.12:g.47083895G>A, NC_000019.10:g.21973116T>C, NC_000022.11:g.41152004A>G, NC_000017.11:g.21416533C>T, NC_000017.11:g.21416556G>A, NC_000010.11:g.129467401T>G, and NC_000007.14:g.77040016_77040017delinsCA, further preferably chosen from NC_000001.11:g.236555959G>A, NC_000001.11:g.236586349T>C, NC_000003.12:g.37012077A>G, NC_000007.14:g.2251050C>T, NC_000022.11: g.41152004A>G, NC_000010.11:g.129467401T>G, particularly NC_000003.12:g.37012077A>G or NC_000022.11:g.41152004A>G, as complied to the Human Genome Variation Society (HGVS; www.hgvs.org/) variant nomenclature, as a marker for predicting a radiotherapy success in a method of treating a lung cancer of a patient.

For the use of the second aspect also the differentiations regarding the specific genes and sequences with regard to treating LUSC and/or with regard to enhanced/reduced radiotherapy success, etc., given with regard to the first aspect apply.

A third aspect of embodiments of the present invention relates to a database comprising the markers disclosed in the second aspect. The database particularly comprises at least one change each in the nucleotide sequence and/or epigenomics profile and/or expression profile and/or copy number compared to a reference sequence and/or epigenomics profile and/or expression profile and/or copy number of the genes MLH1 and EP300, preferably MLH1, EP300, HEATR1, NUDT1, and MGMT, further preferably of the genes MLH1, EP300, BRCA2, FLT1, GRINA, HEATR1, MUTYH, NUDT1, PARP10, PRPF19, KCNJ12, MGMT, PMS2P9, DDX11, EPHA2, GEN1, SETD2, and ZNF208. According to certain embodiments, the database of the third aspect particularly comprises the changes in the nucleotide sequence rs1799977 and rs20551, as disclosed in the Single Nucleotide Polymorphism Database dbSNP of the National Center for Biotechnology Information (NCBI), preferably rs1885534, rs2794763, rs1799977, rs1062492, rs20551, and rs16906255, further preferably rs1801406, rs1046456, rs3754334, rs7993418, rs16981869, rs72407975, rs67714660, rs56261297, rs2275685, rs2275687, rs1885533, rs1885534, rs1006456, rs2794763, rs1799977, rs3219472, rs1062492, rs11136344, rs11136345, rs2240045, rs4082155, rs10425763, rs20551, rs72846670, rs73979902, rs16906255, and rs73144285, as disclosed in the Single Nucleotide Polymorphism Database dbSNP of the National Center for Biotechnology Information (NCBI), and NC_000007.14:g.77040016_77040017delinsCA, as complied to the Human Genome Variation Society (HGVS; www.hgvs.org/) variant nomenclature, as markers. According to certain embodiments, the database of the third aspect further particularly comprises the changes in the nucleotide sequence NC_000003.12:g.37012077A>G and NC_000022.11:g.41152004A>G, preferably NC_000001.11:g.236555959G>A, NC_000001.11:g.236586349T>C, NC_000003.12:g.37012077A>G, NC_000007.14:g.2251050C>T, NC_000022.11:g.41152004A>G, NC_000010.11:g.129467401T>G, further preferably NC_000013.11:g.32337751A>G, NC_000012.12:g.31101061C>T, NC_000001.11:g.16125272G>A, NC_000013.11:g.28308924G>A, NC_000002.12:g.17764976A>G, NC_000002.12:g.17768673_17768675delTAA, NC_000008.11:g.143991836C>G, NC_000008.11:g.143992685C>T, NC_000001.11:g.236553659C>T, NC_000001.11:g.236554626T>C, NC_000001.11:g.236555893A>G, NC_000001.11:g.236555959G>A, NC_000001.11:g.236585205T>C, NC_000001.11:g.236586349T>C, NC_000003.12:g.37012077A>G, NC_000001.11:g.45338378C>T, NC_000007.14:g.2251050C>T, NC_000008.11:g.143985257T>C, NC_000008.11:g.143985944G>A, NC_000011.10:g.60903374C>T, NC_000003.12:g.47083895G>A, NC_000019.10:g.21973116T>C, NC_000022.11:g.41152004A>G, NC_000017.11:g.21416533C>T, NC_000017.11:g.21416556G>A, NC_000010.11:g.129467401T>G, and NC_000007.14:g.77040016_77040017delinsCA, as complied to the Human Genome Variation Society (HGVS; www.hgvs.org/) variant nomenclature, as markers. In addition, the database of the third aspect comprises according to certain embodiments a gene mutational burden in the gene MLH1, preferably in the genes MLH1, DDX11, PRPF19, BTK, GTF2H4, KAT6A, TDG, and MAP3K1, further preferably in the genes MLH1, DDX11, APOLD1, GEN1, GPER1, POLB, PRPF19, ANKRD30A, AR, BTK, GTF2H4, HEATR1, IKBKE, KAT6A, NUDT19, PARP1, PTPRT, TAF3, TDG, MAP3K1, and SLC9A4, as markers. In addition, the database of the third aspect comprises according to certain embodiments at least one tumor mutational burden (TMB) as a marker.

Apart from containing the markers, the database is not particularly restricted, and can be e.g. machine readable, etc.

A fourth aspect of embodiments of the present invention relates to a method of predicting a radiotherapy success in a method of treating a lung cancer of a patient, comprising:
obtaining nucleotide sequence data and/or epigenomics profile data and/or expression profile data and/or copy number data of a sample of a patient, and
determining the presence of at least one marker as disclosed in the second aspect.

In the method of the fourth aspect the step of obtaining nucleotide sequence data and/or epigenomics profile data and/or expression profile data and/or copy number data of a sample of a patient is not particularly restricted, and the respective data can be obtained by any suitable method, particularly in electronic form, e.g. based on an evaluation of a sample of a patient.

Also, the step of determining the presence of at least one marker as disclosed in the second aspect is not particularly restricted, and it can be carried out in any suitable manner, e.g. using sufficient tools for automatically evaluating the nucleotide sequence data and/or epigenomics profile data and/or expression profile data and/or copy number data of the sample of the patient for the presence of the respective marker(s). For example, the evaluation can be carried out with the help of or exclusively using a computer program product, which is not particularly restricted.

Figure 2:
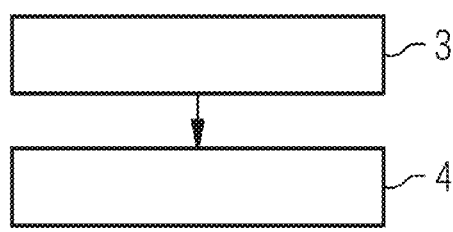
In FIG. 2 a method of the fourth aspect of embodiments of the present invention is illustrated schematically.

In FIG. 2 a method of the fourth aspect of embodiments of the present invention is illustrated schematically, wherein step 3 corresponds to obtaining nucleotide sequence data and/or epigenomics profile data and/or expression profile data and/or copy number data of a sample of a patient, and step 4 to determining the presence of at least one marker as disclosed in the second aspect.

In a fifth aspect a computer program product is disclosed, comprising computer executable instructions which, when executed, perform a method according to the fourth aspect.

The computer program product is thereby not particularly restricted as long as it comprises computer executable instructions which, when executed, perform the method according to the fourth aspect. According to certain embodiments the computer program product is one on which program commands or program codes of a computer program for executing said method are stored. According to certain embodiments the computer program product is or comprises a storage medium.

A sixth aspect of embodiments of the present invention relates to a method of predicting a radiotherapy success in a method of treating a lung cancer of a patient, comprising:
obtaining nucleotide sequence data and/or epigenomics profile data and/or expression profile data and/or copy number data of a sample of a patient, and analyzing the nucleotide sequence data using the computer program product of the fifth aspect.

Again, the step of obtaining nucleotide sequence data and/or epigenomics profile data and/or expression profile data and/or copy number data of a sample of a patient is not particularly restricted, as in the fourth aspect.

Also, the step of analyzing the nucleotide sequence data using the computer program product of the fifth aspect is not particularly restricted and can be carried out e.g. automatically, but also with the settings of suitable parameters by a user.

Figure 3:
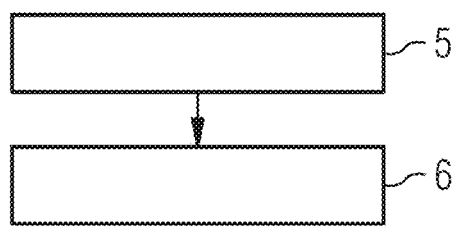
FIG. 3 depicts schematically a method of the sixth aspect of embodiments of the present invention.

FIG. 3 depicts schematically a method of the sixth aspect of embodiments of the present invention, wherein step 5 corresponds to obtaining nucleotide sequence data and/or epigenomics profile data and/or expression profile data and/or copy number data of a sample of a patient, and step 6 corresponds to analyzing the nucleotide sequence data using the computer program product of the fifth aspect.

The inventors have also particularly found that a change in the nucleotide sequence and/or epigenomics profile and/or expression profile and/or copy number compared to a reference sequence and/or epigenomics profile and/or expression profile and/or copy number in a DNA damage repair gene can be predictive of a radiotherapy success in a method of treating a cancer of a patient, particularly a lung cancer.

Particularly this was found for the following DNA damage repair genes:

UNG, SMUG1, MBD4, TDG, OGG1, MUTYH, NTHL1, MPG, NEIL1, NEIL2, NEIL3, APEX1, APEX2, LIG3, XRCC1, PNKP, APLF, PARP1, PARP2, PARP3, MGMT, ALKBH2, ALKBH3, TDP1, TDP2, MSH2, MSH3, MSH6, MLH1, PMS2, MSH4, MSH5, MLH3, PMS1, PMS2P3, XPC, RAD23B, CETN2, RAD23A, XPA, DDB1, DDB2, RPA1, RPA2, RPA3, ERCC3, ERCC2, GTF2H1, GTF2H2, GTF2H3, GTF2H4, GTF2H5, CDK7, CCNH, MNAT1, ERCC5, ERCC1, ERCC4, LIG1, ERCC8, ERCC6, UVSSA, XAB2, MMS19, RAD51, RAD51B, RAD51D, DMC1, XRCC2, XRCC3, RAD52, RAD54L, RAD54B, BRCA1, SHFM1, RAD50, MRE11A, NBN, RBBP8, MUS81, EME1, EME2, SLX1A, SLX1B, GEN1, FANCA, FANCB, FANCC, BRCA2, FANCD2, FANCE, FANCF, FANCG, FANCI, BRIP1, FANCL, FANCM, PALB2, RAD51C, SLX4, FAAP20, FAAP24, XRCC6, XRCC5, PRKDC, LIG4, XRCC4, DCLRE1C, NHEJ1, NUDT1, DUT, RRM2B, POLB, POLG, POLD1, POLE, PCNA, REV3L, MAD2L2, REV1, POLH, POLI, POLQ, POLK, POLL, POLM, POLN, FEN1, FAN1, TREX1, TREX2, EX01, APTX, SPO11, ENDOV, UBE2A, UBE2B, RAD18, SHPRH, HLTF, RNF168, SPRTN, RNF8, UBE2V2, UBE2N, H2AFX, CHAF1A, SETMAR, BLM, WRN, RECQL4, ATM, MPLKIP, DCLRE1A, DCLRE1B, RPA4, PRPF19, RECQL, RECQL5, HELQ, RDM1, NABP2, ATR, ATRIP, MDC1, RAD1, RAD9A, HUS1, RAD17, CHEK1, CHEK2, TP53, TP53BP1, RIF1, TOPBP1, CLK2, PER1, and RNF4.

The DNA damage repair genes therein can be e.g. grouped as follows:

Base excision repair (BER) DNA glycosylases
UNG, SMUG1, MBD4, TDG, OGG1, MUTYH, NTHL1, MPG, NEIL1, NEIL2, NEIL3
Other BER and strand break joining factors
APEX1, APEX2, LIG3, XRCC1, PNKP, APLF
Poly(ADP-ribose) polymerase (PARP) enzymes that bind to DNA PARP1, PARP2, PARP3, MGMT, ALKBH2, ALKBH3
Repair of DNA-topoisomerase crosslinks
TDP1, TDP2
Mismatch excision repair (MMR)
MSH2, MSH3, MSH6, MLH1, PMS2, MSH4, MSH5, MLH3, PMS1, PMS2P3
Nucleotide excision repair (NER)
XPC, RAD23B, CETN2, RAD23A, XPA, DDB1, DDB2, RPA1, RPA2, RPA3
TFIIH (Transcription factor II H)
ERCC3, ERCC2, GTF2H1, GTF2H2, GTF2H3, GTF2H4, GTF2H5, CDK7, CCNH, MNAT1, ERCC5, ERCC1, ERCC4, LIG1
NER-related
ERCC8, ERCC6, UVSSA, XAB2, MMS19
Homologous recombination
RAD51, RAD51B, RAD51D, DMC1, XRCC2, XRCC3, RAD52, RAD54L, RAD54B, BRCA1, SHFM1, RAD50, MRE11A, NBN, RBBP8, MUS81, EME1, EME2, SLX1A, SLX1B, GEN1
Fanconi anemia
FANCA, FANCB, FANCC, BRCA2, FANCD2, FANCE, FANCF, FANCG, FANCI, BRIP1, FANCL, FANCM, PALB2, RAD51C, SLX4, FAAP20, FAAP24
Non-homologous end-joining
XRCC6, XRCC5, PRKDC, LIG4, XRCC4, DCLRE1C, NHEJ1
Modulation of nucleotide pools
NUDT1, DUT, RRM2B
DNA polymerases (catalytic subunits)
POLB, POLG, POLD1, POLE, PCNA, REV3L, MAD2L2, REV1, POLH, POLI, POLQ, POLK, POLL, POLM, POLN
Editing and processing nucleases
FEN1, FAN1, TREX1, TREX2, EX01, APTX, SPO11, ENDOV
Ubiquitination and modification
UBE2A, UBE2B, RAD18, SHPRH, HLTF, RNF168, SPRTN, RNF8, RNF4, UBE2V2, UBE2N
Chromatin structure and modification
H2AFX, CHAF1A, SETMAR
Genes defective in diseases associated with sensitivity to DNA damaging agents
BLM, WRN, RECQL4, ATM, MPLKIP
Other identified genes with known or suspected DNA repair function
DCLRE1A, DCLRE1B, RPA4, PRPF19, RECQL, RECQL5, HELQ, RDM1, NABP2
Other conserved DNA damage response genes
ATR, ATRIP, MDC1, RAD1, RAD9A, HUS1, RAD17, CHEK1, CHEK2, TP53, TP53BP1, RIF1, TOPBP1, CLK2, PER1

The above embodiments can be combined arbitrarily, if appropriate. Further possible embodiments and implementations of embodiments of the present invention comprise also combinations of features not explicitly mentioned in the foregoing or in the following with regard to the Examples of the present invention. Particularly, a person skilled in the art will also add individual aspects as improvements or additions to the respective basic form of the present invention.

EXAMPLES

Embodiments of the present invention will now be described in detail with reference to several examples thereof. However, these examples are illustrative and do not limit the scope of the present invention.

Example 1

I) Cohort Information

A cohort of 84 patients with non-small cell lung cancer (NSCLC) and different response rates to chemoradiotherapy was evaluated in a cross-validated evaluation. The therapy comprised neoadjuvant radiochemotherapy (RCT).

The samples of the cohort were fresh frozen tumor tissue. NSCLC samples were classified as either lung adenocarcinoma (LUAD), lung squamous cell carcinoma (LUSC), NSCLC neuroendocrine differentiation (NE), or NSCLC not otherwise specified (NOS). Patient samples were classified as either complete response (CR), partial response (PR), stable disease (SD), or progressive disease (PD), dependent on locoregional response to chemoradiation. LUSC samples were classified as either complete response (CR), partial response (PR), stable disease (SD), or progressive disease (PD), dependent on locoregional response to chemoradiation.

The exome of extracted sample DNA was enriched using the Agilent® SureSelect® Human All Exon V6+COSMIC hybridization capture kit and sequenced on an Illumina® NextSeq® 500 instrument.

Further information regarding the patients is given in Tables 1 (cancer stage), 2 (cancer subtype) and 3 (pathological response).

TABLE 1 cancer stage of patients

| Stage | #Patients |
|---|---|
| IIA | 3 |
| IIB | 7 |
| IIIA | 69 |
| IIIB | 5 |

TABLE 2

Cancer subtype

| Subtype | #Patients |
|---|---|
| LUAD | 44 |
| LUSC | 32 |
| NSCLC NE | 2 |
| NSCLC NOS | 6 |

TABLE 3

Pathologic response

| Response | | #NSCLC | #LUAD | #LUSC |
|---|---|---|---|---|
| Yes | CR | 21 | 6 | 13 |
|  | PR | 20 | 11 | 7 |
| No | SD | 19 | 15 | 3 |
|  | PD | 24 | 12 | 9 |

II) Variant Calling

Small insertions, deletions, single nucleotide variants (SNVs), multiple nucleotide variants (MNVs), and replacements (in the following termed variants) were called using the Low Frequency Variant Detection tool from the Identify and Annotate Variants (WES)—Workflow of the QIAGEN® Biomedical Genomics Workbench 5.0.1.

The parameter setting was as follows: QIAGEN® Biomedical Genomics Workbench 5.0.1 a) Identify and Annotate Variants (WES)
Map Reads to Reference

| Parameter | Value |
|---|---|
| References | GRCh38.p7 |
| Masking mode | No masking |
| Match score | 1 |
| Mismatch cost | 2 |
| Cost of insertions and deletions | Affine gap cost |
| Insertion open cost | 6 |
| Insertion extend cost | 1 |
| Deletion open cost | 6 |
| Deletion extend cost | 1 |
| Length fraction | 0.5 |
| Similarity fraction | 0.8 |
| Global alignment | No |
| Auto-detect paired distances | Yes |
| Non-specific match handling | Map randomly |
| Output mode | Create reads track |
| Create report | No |
| Collect un-mapped reads | No | b) InDels and Structural Variants 1.85

| Parameter | Value |
|---|---|
| P-value threshold | 0.0001 |
| Maximum number of mismatches | 2 |
| Create report | No |
| Create breakpoints | No |
| Create InDel variants | Yes |
| Ignore broken pairs | Yes |
| Minimum relative consensus coverage | 0.2 |
| Minimum quality score | 30 |
| Create structural variations | No |
| Filter variants | Yes |
| Minimum number of reads | 3 |
| Restrict calling to target regions | S07604715_Padded.bed* |

*Target regions of Agilent's SureSelect Human All Exon V6 + COSMIC r2 (Design ID: S07604715)

c) Local Realignment 0.41

| Parameter | Value |
|---|---|
| Realign unaligned ends | Yes |
| Multi-pass realignment | 3 |
| Guidance-variant track | InDels from InDels and Structural Variants |
| Maximum guidance-variant length | 200 |
| Force realignment to guidance-variants | No |
| Output mode | Create reads track |
| Output track of realigned regions | No | d) Low Frequency Variant Detection 2.0

| Parameter | Value |
|---|---|
| Required significance (%) | 1.0 |
| Ignore positions with coverage above | 100,000 |
| Restrict calling to target regions | S07604715_Padded.bed* |

-continued

| Parameter | Value |
| --- | --- |
| Ignore broken pairs | Yes |
| Ignore non-specific matches | Reads |
| Minimum coverage | 5 |
| Minimum count | 3 |
| Minimum frequency (%) | 5.0 |
| Base quality filter | Yes |
| Neighborhood radius | 5 |
| Minimum central quality | 30 |
| Minimum neighborhood quality | 20 |
| Read direction filter | No |
| Relative read direction filter | No |
| Read position filter | Yes |
| Significance (%) | 1.0 |
| Remove pyro-error variants | No |
| Create track | Yes |
| Create annotated table | No |
| Create report | No |

*Target regions of Agilent's SureSelect Human All Exon V6 + COS MIC r2 (Design ID: S07604715)

e) Remove False Positives 1.2

| Parameter | Value |
| --- | --- |
| Minimum frequency (%) | 5.0 |
| Minimum forward/reverse balance | 0.1 |
| Minimum average base quality | 30.0 |
| Variant frequency | Yes |
| Forward/reverse balance | Yes |
| Average base quality | Yes |

III) Statistical Analysis and Machine Learning

In the following, the methods used to build models predicting radiotherapy response are described.

Three feature levels were included:

1. Small insertions, small deletions, single nucleotide variants (SNVs), multiple nucleotide variants (MNVs), and replacements (in the following termed variants)
2. Mutational burden in single genes (GMB)
3. Mutational burden in multiple genes (TMB)

Only informative GMB features (standard deviation across samples >0.5) and frequently occurring variants (variants occurring in at least 50% of samples in either response group) were considered.

Features with a p-value <0.05 calculated using either Fisher's exact tests (variants) or Wilcoxon rank-sum tests (GMB features) were selected. In the process, a bootstrapping procedure was applied to primarily select stable/recurrent features, i.e. features that repeatedly emerge in bootstrapping samples (features with p-value <0.05 in at least 80% of 50 bootstrap samples containing a random sample of 80% of all samples).

For the predictive models, both linear—in particular elastic-net regularized logistic regression (R package glmnet 2.0-16; alpha=0.99)—and non-linear—in particular random forest (R package randomForest 4.6-14; ntree=1000)—models were calculated predicting radiotherapy response. To evaluate the performance of predictive models, a 100-fold iterated 4-fold cross-validation procedure was applied.

IV) Results i) Variants

The variants described in the following were found.

The variants are uniquely characterized by their Human Genome Variation Society (HGVS) nomenclature, Single Nucleotide Polymorphism Database (dbSNP) identifier, ClinVar identifier and/or Universal Protein Knowledgebase (UniProtKB) identifier (as of Apr. 25, 2019)

LUSC-Specific Variants

The following variants are specifically predictive for radiotherapy response in lung squamous cell carcinoma (LUSC) patients. The number and fraction of patients carrying the respective variant are split into those that do respond (CR and PR) and those that do not respond (SD and PD) to locoregional chemoradiation.

1) BRCA2

| Database | ID/URI |
| --- | --- |
| HGVS | NC_000013.11:g.32337751A>G |
| dbSNP | https://www.ncbi.nlm.nih.gov/snp/rs1801406 |
| ClinVar | https://preview.ncbi.nlm.nih.gov/clinvar/variation/126010 |
| UniProtKB | — |

| Response | #Patients |
| --- | --- |
| Yes | 11 (of 20) |
| No | 1 (of 12) |

Potential effect of variant on tumor sensitivity to ionizing radiation: Enhanced

2) DDX11

| Database | ID/URI |
| --- | --- |
| HGVS | NC_000012.12:g.31101061C>T |
| dbSNP | https://www.ncbi.nlm.nih.gov/snp/rs1046456 |
| ClinVar | — |
| UniProtKB | — |

| Response | #Patients |
| --- | --- |
| Yes | 8 (of 20) |
| No | 11 (of 12) |

Potential effect of variant on tumor sensitivity to ionizing radiation: Reduced

3) EPHA2

| Database | ID/URI |
| --- | --- |
| HGVS | NC_000001.11:g.16125272G>A |
| dbSNP | https://www.ncbi.nlm.nih.gov/snp/rs3754334 |
| ClinVar | https://preview.ncbi.nlm.nih.gov/clinvar/variation/259392 |
| UniProtKB | — |

| Response | #Patients |
| --- | --- |
| Yes | 11 (of 20) |
| No | 1 (of 12) |

Potential effect of variant on tumor sensitivity to ionizing radiation: Enhanced

4) FLT1

| Database | ID/URI |
| --- | --- |
| HGVS | NC_000013.11:g.28308924G>A |
| dbSNP | https://www.ncbi.nlm.nih.gov/snp/rs7993418 |
| ClinVar | — |
| UniProtKB | — |

-continued

| Response | #Patients |
|---|---|
| Yes | 20 (of 20) |
| No | 8 (of 12) |

Potential effect of variant on tumor sensitivity to ionizing radiation: Enhanced

5) GEN1

| Database | ID/URI |
|---|---|
| HGVS | NC_000002.12:g.17764976A>G |
| dbSNP | https://www.ncbi.nlm.nih.gov/snp/rs16981869 |
| ClinVar | — |
| UniProtKB | https://www.uniprot.org/uniprot/Q17RS7#VAR_037845 |

| Response | #Patients |
|---|---|
| Yes | 2 (of 20) |
| No | 6 (of 12) |

Potential effect of variant on tumor sensitivity to ionizing radiation: Reduced

6) GEN1

| Database | ID/URI |
|---|---|
| HGVS | NC_000002.12:g.17768673_17768675delTAA) |
| dbSNP | https://www.ncbi.nlm.nih.gov/projects/SNP/snp_ref.cgi?do_not_redirect&rs=rs72407975 |
| ClinVar | — |
| UniProtKB | — |

| Response | #Patients |
|---|---|
| Yes | 1 (of 20) |
| No | 6 (of 12) |

Potential effect of variant on tumor sensitivity to ionizing radiation: Reduced

7) GRINA

| Database | ID/URI |
|---|---|
| HGVS | NC_000008.11:g.143991836C>G |
| dbSNP | https://www.ncbi.nlm.nih.gov/snp/rs67714660 |
| ClinVar | — |
| UniProtKB | — |

| Response | #Patients |
|---|---|
| Yes | 19 (of 20) |
| No | 6 (of 12) |

Potential effect of variant on tumor sensitivity to ionizing radiation: Enhanced

8) GRINA

| Database | ID/URI |
|---|---|
| HGVS | NC_000008.11:g.143992685C>T |
| dbSNP | https://www.ncbi.nlm.nih.gov/snp/rs56261297 |
| ClinVar | — |
| UniProtKB | — |

| Response | #Patients |
|---|---|
| Yes | 19 (of 20) |
| No | 6 (of 12) |

Potential effect of variant on tumor sensitivity to ionizing radiation: Enhanced

9) HEATR1

| Database | ID/URI |
|---|---|
| HGVS | NC_000001.11:g.236553659C>T |
| dbSNP | https://www.ncbi.nlm.nih.gov/snp/rs2275685 |
| ClinVar | — |
| UniProtKB | — |

| Response | #Patients |
|---|---|
| Yes | 20 (of 20) |
| No | 8 (of 12) |

Potential effect of variant on tumor sensitivity to ionizing radiation: Enhanced

10) HEATR1

| Database | ID/URI |
|---|---|
| HGVS | NC_000001.11:g.236554626T>C |
| dbSNP | https://www.ncbi.nlm.nih.gov/snp/rs2275687 |
| ClinVar | — |

-continued

| | |
|---|---|
| UniProtKB | https://www.uniprot.org/uniprot/Q9H583#VAR_010942 |

| Response | #Patients |
|---|---|
| Yes | 20 (of 20) |
| No | 8 (of 12) |

Potential effect of variant on tumor sensitivity to ionizing radiation: Enhanced

11) HEATR1

| Database | ID/URI |
|---|---|
| HGVS | NC_000001.11:g.236555893A>G |
| dbSNP | https://www.ncbi.nlm.nih.gov/snp/rs1885533 |
| ClinVar | — |
| UniProtKB | https://www.uniprot.org/uniprot/Q9H583#VAR_010940 |

| Response | #Patients |
|---|---|
| Yes | 20 (of 20) |
| No | 8 (of 12) |

Potential effect of variant on tumor sensitivity to ionizing radiation: Enhanced

12) HEATR1

| Database | ID/URI |
|---|---|
| HGVS | NC_000001.11:g.236555959G>A |
| dbSNP | https://www.ncbi.nlm.nih.gov/snp/rs1885534 |

13) HEATR1

| Database | ID/URI |
|---|---|
| HGVS | NC_000001.11:g.236585205T>C |
| dbSNP | https://www.ncbi.nlm.nih.gov/snp/rs1006456 |
| ClinVar | — |
| UniProtKB | — |

| Response | #Patients |
|---|---|
| Yes | 20 (of 20) |
| No | 8 (of 12) |

Potential effect of variant on tumor sensitivity to ionizing radiation: Enhanced

14) HEATR1

| Database | ID/URI |
|---|---|
| HGVS | NC_000001.11:g.236586349T>C |
| dbSNP | https://www.ncbi.nlm.nih.gov/snp/rs2794763 |
| ClinVar | — |
| UniProtKB | https://www.uniprot.org/uniprot/Q9H583#VAR_049330 |

| Response | #Patients |
|---|---|
| Yes | 20 (of 20) |
| No | 7 (of 12) |

Potential effect of variant on tumor sensitivity to ionizing radiation: Enhanced

15) MLH1

| Database | ID/URI |
|---|---|
| HGVS | NC_000003.12:g.37012077A>G |
| dbSNP | https://www.ncbi.nlm.nih.gov/snp/rs1799977 |
| ClinVar | https://preview.ncbi.nlm.nih.gov/clinvar/variation/36557 |
| UniProtKB | https://www.uniprot.org/uniprot/P40692#VAR_004450 |

| Response | #Patients |
|---|---|
| Yes | 13 (of 20) |
| No | 0 (of 12) |

Potential effect of variant on tumor sensitivity to ionizing radiation: Enhanced

16) MUTYH

| Database | ID/URI |
|---|---|
| HGVS | NC_000001.11:g.45338378C>T |
| dbSNP | https://www.ncbi.nlm.nih.gov/snp/rs3219472 |
| ClinVar | — |
| UniProtKB | — |

| Response | #Patients |
|---|---|
| Yes | 4 (of 20) |
| No | 8 (of 12) |

Potential effect of variant on tumor sensitivity to ionizing radiation: Reduced

17) NUDT1

| Database | ID/URI |
|---|---|
| HGVS | NC_000007.14:g.2251050C>T |
| dbSNP | https://www.ncbi.nlm.nih.gov/snp/rs1062492 |
| ClinVar | — |
| UniProtKB | — |

| Response | #Patients |
|---|---|
| Yes | 10 (of 20) |
| No | 0 (of 12) |

Potential effect of variant on tumor sensitivity to ionizing radiation: Enhanced

18) PARP10

| Database | ID/URI |
|---|---|
| HGVS | NC_000008.11:g.143985257T>C |
| dbSNP | https://www.ncbi.nlm.nih.gov/snp/rs11136344 |
| ClinVar | — |
| UniProtKB | https://www.uniprot.org/uniprot/Q9H583#VAR_027859 |

| Response | #Patients |
|---|---|
| Yes | 19 (of 20) |
| No | 6 (of 12) |

Potential effect of variant on tumor sensitivity to ionizing radiation: Enhanced

19) PARP10

| Database | ID/URI |
|---|---|
| HGVS | NC_000008.11:g.143985944G>A |
| dbSNP | https://www.ncbi.nlm.nih.gov/snp/rs11136345 |
| ClinVar | — |
| UniProtKB | — |

| Response | #Patients |
|---|---|
| Yes | 19 (of 20) |
| No | 6 (of 12) |

Potential effect of variant on tumor sensitivity to ionizing radiation: Enhanced

20) PRPF19

| Database | ID/URI |
|---|---|
| HGVS | NC_000011.10:g.60903374C>T |
| dbSNP | https://www.ncbi.nlm.nih.gov/snp/rs2240045 |
| ClinVar | — |
| UniProtKB | — |

| Response | #Patients |
|---|---|
| Yes | 17 (of 20) |
| No | 4 (of 12) |

Potential effect of variant on tumor sensitivity to ionizing radiation: Enhanced

21) SETD2

| Database | ID/URI |
|---|---|
| HGVS | NC_000003.12:g.47083895G>A |
| dbSNP | https://www.ncbi.nlm.nih.gov/snp/rs4082155 |
| ClinVar | https://preview.ncbi.nlm.nih.gov/clinvar/variation/135202 |
| UniProtKB | https://www.uniprot.org/uniprot/Q9BYW2#VAR_027841 |

—continued (ClinVar —, UniProtKB —)

| Response | #Patients |
|---|---|
| Yes | 20 (of 20) |
| No | 7 (of 12) |

| Response | #Patients |
| --- | --- |
| Yes | 18 (of 20) |
| No | 5 (of 12) |

Potential effect of variant on tumor sensitivity to ionizing radiation: Enhanced

22) ZNF208

| Database | ID/URI |
| --- | --- |
| HGVS | NC_000019.10:g.21973116T>C |
| dbSNP | https://www.ncbi.nlm.nih.gov/snp/rs10425763 |
| ClinVar | — |
| UniProtKB | https://www.uniprot.org/uniprot/O43345#VAR_059903 |

| Response | #Patients |
| --- | --- |
| Yes | 12 (of 20) |
| No | 1 (of 12) |

Potential effect of variant on tumor sensitivity to ionizing radiation: Enhanced NSCLC-Specific Variants The following variants are predictive of radiotherapy response in the 84 non-small cell lung cancer (NSCLC) patients. The number and fraction of patients carrying the respective variant are split into those that do respond (CR and PR) and those that do not respond (SD and PD) to locoregional chemoradiation.

1) EP300

| Database | ID/URI |
| --- | --- |
| HGVS | NC_000022.11:g.41152004A>G |
| dbSNP | https://www.ncbi.nlm.nih.gov/snp/rs20551 |
| ClinVar | https://preview.ncbi.nlm.nih.gov/clinvar/variation/93736 |
| UniProtKB | https://www.uniprot.org/uniprot/Q09472#VAR_020425) |

| Response | #Patients |
| --- | --- |
| Yes | 23 (of 41) |
| No | 10 (of 43) |

Potential effect of variant on tumor sensitivity to ionizing radiation: Enhanced

| Database | ID/URI |
| --- | --- |
| HGVS | NC_000017.11:g.21416533C>T |
| dbSNP | https://www.ncbi.nlm.nih.gov/snp/rs72846670 |
| ClinVar | — |
| UniProtKB | — |

| Response | #Patients |
| --- | --- |
| Yes | 40 (of 41) |
| No | 33 (of 43) |

Potential effect of variant on tumor sensitivity to ionizing radiation: Enhanced

3) KCNJ12

| Database | ID/URI |
| --- | --- |
| HGVS | NC_000017.11:g.21416556G>A |
| dbSNP | https://www.ncbi.nlm.nih.gov/snp/rs73979902 |
| ClinVar | — |
| UniProtKB | — |

| Response | #Patients |
| --- | --- |
| Yes | 41 (of 41) |
| No | 35 (of 43) |

Potential effect of variant on tumor sensitivity to ionizing radiation: Enhanced

| Database | ID/URI |
| --- | --- |
| HGVS | NC_000010.11:g.129467401T>G |
| dbSNP | https://www.ncbi.nlm.nih.gov/snp/rs16906255 |
| ClinVar | — |
| UniProtKB | — |

| Response | #Patients |
| --- | --- |
| Yes | 12 (of 41) |
| No | 29 (of 43) |

Potential effect of variant on tumor sensitivity to ionizing radiation: Reduced

5) PMS2P9

| Database | ID/URI |
| --- | --- |
| HGVS | NC_000007.14:g.77040016_77040017delinsCA |
| dbSNP | https://www.ncbi.nlm.nih.gov/snp/rs73144285 |
| ClinVar | — |
| UniProtKB | — |

| Response | #Patients |
| --- | --- |
| Yes | 12 (of 41) |
| No | 25 (of 43) |

Potential effect of variant on tumor sensitivity to ionizing radiation: Reduced ii) GMB The mutational burden in a gene (GMB) has been calculated as the sum over all variants in that gene using the gene coordinates from Ensembl release 91. The following GMBs were found as predictive.

LUSC-Specific Genes

The GMB of the following genes is specifically predictive for radiotherapy response in LUSC patients: APOLD1, DDX11, GEN1, GPER1, MLH1, POLB, PRPF19

The statistical significance of association with radiotherapy response is higher for the GMB of these genes.

NSCLC-Specific Genes

The GMB of the following genes is specifically predictive for radiotherapy response in NSCLC—including LUSC—patients:

ANKRD30A, AR, BTK, GTF2H4, HEATR1, IKBKE, KAT6A, MAP3K1, NUDT19, PARP1, PTPRT, SLC9A4, TAF3, TDG

The statistical significance of association with radiotherapy response is higher for the GMB of these genes.

iii) TMB

The tumor mutational burden (TMB) has been calculated as the sum over all somatic variants in one of the following genomic territories 1. All genomic positions that are covered by the SureSelect® Human All Exon V6+COSMIC r2 kit (Design ID: S07604715) of Agilent® (65,724,874 bases)
2. All genomic positions that are covered by the NEOplus™ v2 RUO panel of NEO NEW ONCOLOGY® (1,150,757 bases)
3. All genomic positions that are covered by both above kits (1,118,543 bases)

Somatic variants were defined as those that could not be found in the human reference sequence (build 38 patch release 7), the Common dbSNP database (build 150), the 1000 Genomes Project (all phase 3 individuals) or the HapMap Project (phase 3 populations ASW, CEU, CHB, CHD, GIH, HCB, JPT, LWK, MEX, MKK, TSI, YRI) using the Filter Somatic Variants (WES)—Workflow of the QIAGEN® Biomedical Genomics Workbench 5.0.1.

Hence, the TMB is a natural number (including zero). To make a TMB value better comparable to a TMB value that has been calculated on a genomic territory of a different size, the TMB value can also be specified as the average number of somatic variants per mega base (1 MB) by dividing the TMB value by the size of the genomic territory and multiplying the resulting ratio by 1,000,000. In this case, the TMB is a positive rational number.

While this procedure exemplifies the calculation of the TMB, the TMB can also be calculated differently, e.g. considering only non-synonymous variants or using genomic territories different to those stated above.

Figure 4:
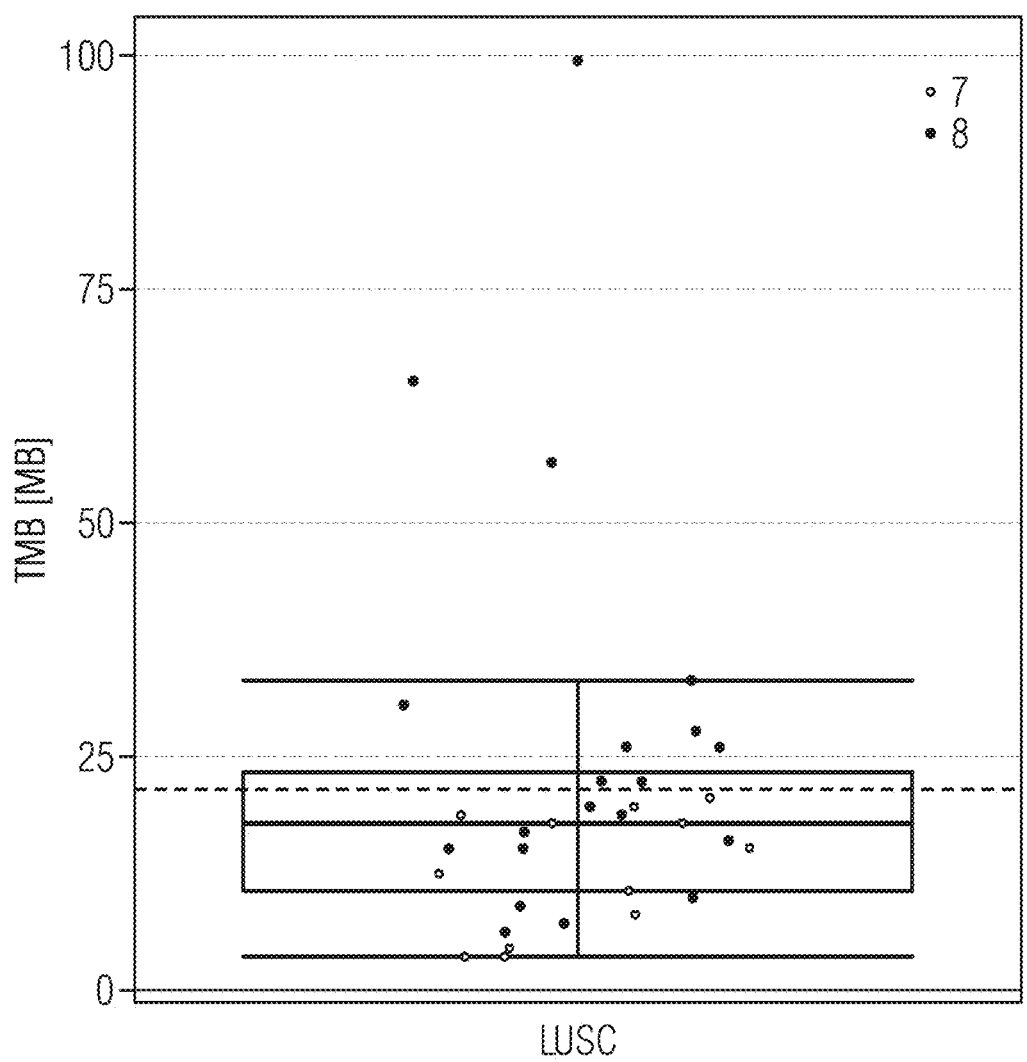
FIGS. 4 and 5 show results obtained in Example 1.

FIG. 4 shows the positive relationship between TMB and locoregional response to radiotherapy for all LUSC samples. A negative response is therein shown with reference number 7, and a positive response with reference number 8.

The TMB value of each LUSC sample is overlaid (and randomly scattered along the x-axis for better separation) and colored according to treatment response. The TMB value has been calculated within the genomic territory described in above 3. To separate responding from non-responding samples, a cutoff value can be used. In the box plot a possible TMB cutoff value of 21.45648 per MB is drawn as dashed line. This cutoff results in a prediction accuracy $$\frac{TP+TN}{(TP+TN+FP+FN)} \text{ of } 0.6875\left(\frac{10+12}{10+12+0+10}\right).$$

iv) Combination of SNV in MLH1 and TMB

As an exemplary value, also a radiotherapy success prediction has been made for a combination of the above SNV in MLH1 combined with TMB.

Figure 5:
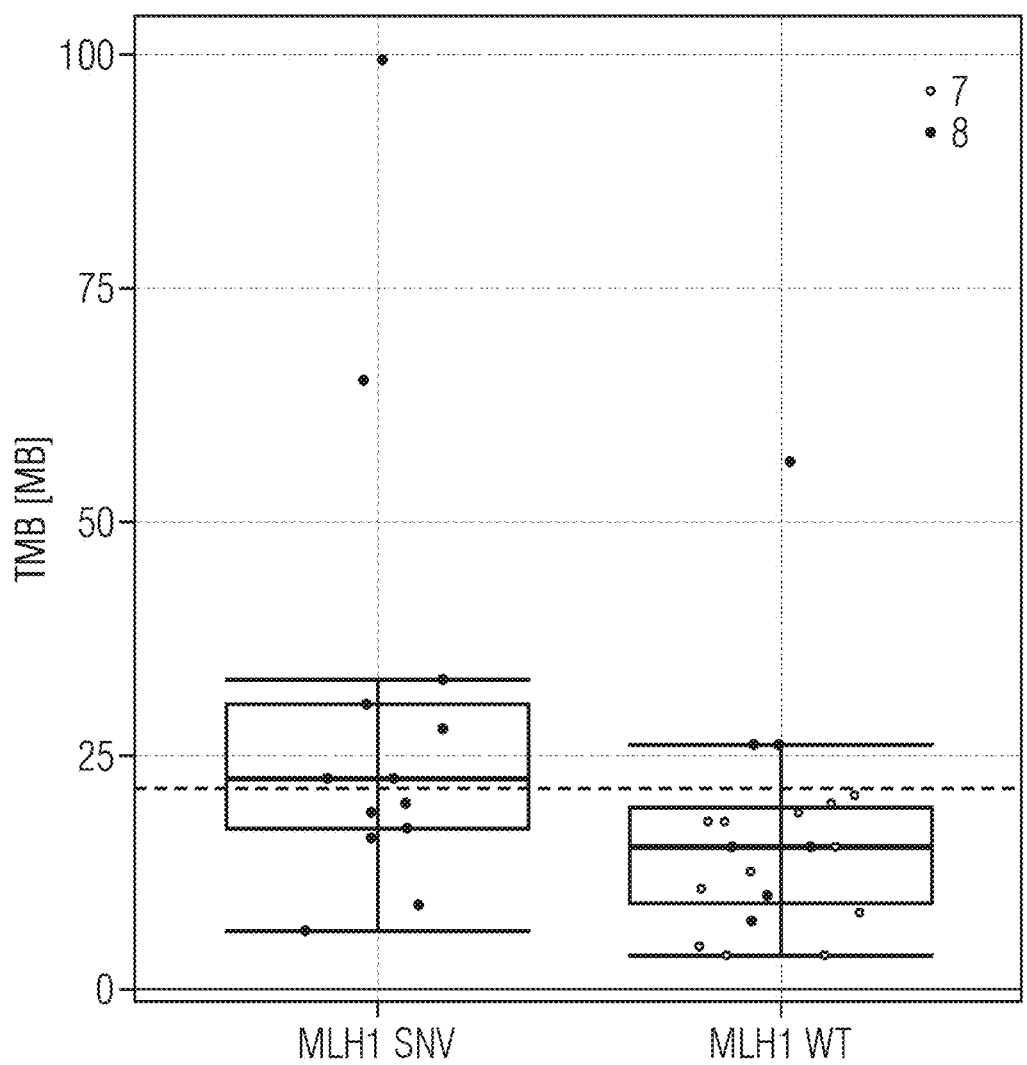

FIG. 5 shows the benefit when combining two features—TMB and single nucleotide variation (SNV) rs1799977 in MLH1—in the prediction of treatment response (WT=wild type or reference base). A negative response is therein again shown with reference number 7, and a positive response with reference number 8.

The TMB cutoff value of 21.45648 per MB is drawn as dashed line to make the two figures easier to compare. The accuracy is $$0.78125 \frac{13+12}{(13+12+0+7)}$$

when using the presence or absence of the MLH1 variant as predictor. The accuracy increases to $$0.875 \frac{16+12}{(16+12+0+4)}$$

when combining (OR logical operator) the presence or absence of the MLH1 variant with the TMB cutoff value. While this calculation exemplifies the combination of two features, the combination can also be done using a linear— e.g. logistic regression—or non-linear—e.g. Random Forest—statistical/machine learning method.

The following paragraphs contain the description of an exemplary further idea, which should not be interpreted in any way limiting the inventive concept: Generally, so-called "omics technologies" can allow measuring the following parameters on a genomic scale:
  variations in DNA (e.g. SNVs, MNVs, InDels, copy number, etc.),
  changes in epigenomic profiles (e.g. DNA methylations, DNA hydroxymethylations, histone modifications, etc.),
  changes in expression levels of RNAs and/or proteins, and the multitude of their modifications (e.g. RNA methylations, protein phosphorylations, etc.)

These variations, and features calculated from combinations of few and/or many variations, such as the tumor mutational burden (TMB), can be—positively or negatively—associated with radiotherapy success, and thus, may be leveraged in algorithms for predicting radiotherapy success. One challenge can be to prioritize those variations with respect to their impact on radiotherapy success and select those variations that are most relevant for a predictor of radiotherapy success.

Those variations could be preselected from the pool of variations in DNA and/or changes in epigenomic profiles and/or changes in RNA and/or protein expression levels (in the following termed biomolecule features) that reside in biomolecules that are known to be involved (as active component or its regulator) in the biological process of either DNA damage repair (e.g. MLH1, a tumor suppressor gene, taking a physiological role in DNA mismatch repair) and/or angiogenesis (e.g. EP300, a transcriptional coactivator, taking a physiological role in the stimulation of hypoxia-induced genes, e.g. VEGF).

Therefore, the biomolecule features can be selected in a way that
  they are, separately or (linearly or nonlinearly) combined, predictive of therapy success and/or
  they are also predictive of therapy success when using other treatment regimens of radiation and/or adjuvant therapy and/or
  they are also predictive of other subtypes of lung cancer, other cancer types (e.g. breast cancer) and different tumor stages).

The (pre)selection of the biomolecule features that are known to be involved in either DNA damage response or angiogenesis, which are biological processes that are fundamental to the tissue's response to ionizing radiation, may enable the extraction of the most relevant biomolecule features required for predicting radiotherapy success and/or locoregional recurrence.

The biomolecule features
  can be obtained from/measured in different biospecimens, such as tumor tissue, blood, urine, sputum, etc. and/or
  can be measured by any technology (e.g. PCR, sequencing, hybridization-based) and/or
  can be combined irrespective of being somatic (radiosensitivity/radioresistance of cancerous tissue) or germline (innate radiosensitivity).

While focusing on a defined set of biomolecules can reduce computation analysis time, ignoring features in biomolecules that are involved in biological processes not relevant to the tissue's response to ionizing radiation could facilitate to uncover relevant but otherwise not statistically significant features.

Since in this exemplary idea, the number of biomolecules to inspect may be reduced, clinicians may be able to interpret results faster. Furthermore, clinicians may be able to appraise the impact of relevant variations on radiotherapy success in the context of other biomolecules from the same biological process (e.g. by visualizing variations in the corresponding biological pathway).

SEQUENCE LISTING (201 sequences)

SEQ ID NO: 1 - DNA, 57497 bp, Homo Sapiens
gaagagacccagcaacccacagagttgagaaatttgactggcattcaagctgtccaatcaatagctgccgctgaagggtggggctggatggcgtaagctacagctgaaggaagaacgtgagcacgaggcactgaggtgattggctgaaggcacttccgttgagcatctagacgtttccttggctcttctggcgccaaaatgtcgttcgtggcaggggttattcggcggctggacgagacagtggtgaaccgcatcgcggcgggggaagttatccagcggccagctaatgctatcaaagagatgattgagaactggtacggagggagtcgagccgggctcacttaagggctacgacttaacgggccgcgtcactcaatggcgcggacacgcctctttgcccgggcagaggcatgtacagcgcatgcccacaacggcggaggccgccgggttccctgacgtgccagtcaggccttctccttttccgcagaccgtgtgtttctttaccgctctcccccgagaccttttaagggttgtttggagtgtaagtggaggaatatacgtagtgttgtcttaatggtaccgttaactaagtaaggaagccacttaatttaaaattatgtatgcagaacatgcgaagttaaaagatgtataaaagcttaagatggggagaaaaaccttttttcagagggtactgtgttactgttttcttgcttttcattcattccagaaatcatctgttcacatccaaaggcacaattcattttgagtttctttcaaaacaaatcgtttgtagttttaggacaggctgatgcactttgggcttgacttctgattaccctattgttaaattagtgacccctcttagtgttttcctgtcctttatttcggaggacgcacttcgaagataccagattttatgggtcatccttggattttgaagcttataactgtgacaaaaaatgtgaagggaagagatttgaaacatgtggaaggaaaagtgagtgcagactataaacttccaaaaagacaagcccaaaatacacctaaacgttatgtcagattattttgttaaaatcagttgttagtgacgtccgtacgttaatagaaaaaagaatgcttcagtttggagtggtaggtttctagagggatttattgtgaaagtataaactattcagggcaatgggactgagagaacagtgggtagaaaggaccactgaaggaaaggaagagaattggaaggtagatgaaagaaggagcaagaacctggggatgttttttccttttcacttgtaatagtagtaacagaagcaatggcagactggcttttgtttctactgtgttagaatgaattgacaggacaactgggcctattattgtactgtgccagaatactgtaaaacaaaactaaacatactagcttggtggcttgtaattaattacttaagtggagatttttattttttttttattttttttttagacggagtctcactttgtcacccaggctggagtgcagtggcgcgatctcagctgactgcaacctcctcctcacaggttcaagggagattctcctgcctcagcctcccgagtagctaggactataggcatgtgccaccacacctggctaattttgtatttttagtagagatgggatttctccatgttggtcaggctggtgtcaaaactctcgatctcaggtgaaccgcctgcctcagccttccaaagtgctgggattacaggcgtgagccaccgcgccctgcagttttttgtatttttaatagagacagggtttcaccatgttagccaggatggtctcgatttcctgacctcaggtgatctgcccgctttggcctcccaaagtgctgggattacaagcatgagccaccgcgcccggctcaagtggagatttttatatggagtccagttatactctttttaatatataagttgagatgactaatacaacttcaatacaggggctcatgagaaatgtctgtaatatttaagtaacttattgtcttctttcttttttttttaagatgaagtcttactctgttgcccaggcggaagtgcagtggcgtgatcttggctcagggcaacctctgcctcctggtttcaagcgatcttcctgcctcagcctcccgagtagctgggagtacaggcgtgcatgaccacacccggctaatttttttatttttagtagagacggggtttctccatgttggccgggctggtcttgaactcctgacctcaggtgatccgcccacctcagcctccccaagtgttgggattacaggtgtgagcccccgtgcccagcctattatcttatttctgaataaagaattgtctgtgtggggaatagataactctttctcatgcagcccctgctagaaaatttgttttctctagcagttggtctgtgcttataggctactctttgaaagcacaaaaaatttattgacttcttttttttgggtttttttttttttttgagacagagttttgcccttgttgcccaggttggagtgcaatggcgcgatctcagctcaccgcaacctccacctcctgggttcaagtgattctcctgccttagcctcctgagtagctgggattacaggcatgcgtcaccatgcctggctaattttgtatttttagtacaaatggggtttctccatgttggtcaggctggtctcaaactcctgacctcaggtgatccacccgccttggcctcccaaagtgctgggattatgggtgtgagccattgcgcctggccagaaaattcattgacttcctaaagatttattaactttctgcattacttttttttttcccctccatcgtaaatataaaagggaatagtagagaaaatcattcagaattttattttttagtgacattatttagtgacattttattagagtcacttaggaacctgaggctgaataaagttcaggtaaaagtaaaattagttgagaagagacatctgccaaaagaaatctatttttaacttcacttgctgtctttcctagaggaacagaaatagtgctgaatgtcctattagaaatgatggttgctctgcccgtctcttccctctctctcacacaatatgtaaactcatacagtgtatgagcctgtaagacaaaggaaaaacacgttaatgaggcactattgtttgtatttggagtttgttatcattgcttggctcatattaaaatatgtacattagagtagttgcagactgataaattattttctgtttgatttgccagtttagatgcaaaatccacaagtattcaagtgattgttaaagagggaggcctgaagttgattcagatccaagacaatggcaccgggatcagggtaagtaaaacctcaaagtagcaggatgtttgtgcgcttcatggaagagtcaggacctttctctgttctggaaactaggcttttgcagatgggattttttcactgaaaaattcaacaccaacaataaatatttattgagtacctattatttgctgggcactgttcaggggatgtgtcagtgaataaaatagattaaaatctattctcttctgatgcttacattatagtggtgggagacaaaatgggtataataaatattatattagatagcattaagtgctgtggagaaaactaaagcagggaggaagataggagtgtgcaagccagaaaggttgcaattaaattgagtagttcaggaaggcttcaatatggatgtgatatttgagagaccggtggaagtcaaggagcaagttgtgaggctatttaaaggtattcttggcttacagaacaatatacgcaaagactattaaatggaagcatacctgacatgttaaaggactatcaaggaggccagtttgtctagaggctgaaaaggaaagagtaataggagatgaggtctgagtgaaaacacgtaaatccttgtgggccaaggtaaaatctttagctttttttctgaatatggtgggatactgttagagggttttaagcagaggttacgtggtgtggtgagttttttttttttaatcctttgtctttctgtgtggaaaatagcaggacagggcagaagcagtctgtcctgcagactgcttggtcgcagtagagatgtaagaagcagtgagattctgggttaattatggaggcaaagttctcagaatttgctgatatagggtatgagagaaagaggaatcaggaatgatttcaaggttttggtctgctaaatggaaggagttgccatttactaagatgggaaagactatgaaagaagcagattttcagagagatcagaagttcattttggggcatgttcaatttaagatgcctgttagttggatgtttatgtgagtttggaatgcagggtagagatttagggatgaatatttggtagttgtctgcattttaatggtattaaaagccacgagaaggatgggcatggtggctcacacctgtaatcccagcactttgggaggccaaggcgggcagatcacctgaggtcgggagttcgagaccagcctgaccaacatggagaaaccccatctctactaaaaatatataattagccgggcgtggtggcacatgcctgtaatcccagctactcgggaggctgaggcaggagaatcgcttgaacctgggaggtggaggttgcgatgagccgagatcgcaccgttgcactccagcttgggcaacaagagcaaaactccatcaaaaaaaaaaaaaaaaaaaaaaaaaagccttgagactcacctgaaaagatgctcaacattattggtcattaggaaaatgaatgaaaaccacaatgagataccacttcacacctattaggatggctattatcaaaaacaaaaacaagtgtttgcaaggatgtagagattggaattcttgtgtattgctagagggaatgtaaaatagtgcagggtgctgtggaaaatgctgtggtgattcctcaaaaaattaaacataattatataatccagtaattccacttctgagttattcccaaaagaagggatgcaagcagatatttgtacactcatattcatggcagcattatttacagtagccaaaaggtgaaagcaacctaagtgtccgtcagtggatgaatggataaacaaaatggaataatttcagccttaaatagaaataaaatgttgacacatgttgcaacatatacgaaccttgaagacatcatgttaagttaaataagttggtcactaaaggacaaatattgtatgattccccttatgaggttcctagagtagtcacattcatagagacagtagagtggtggttgcccagggccggggggagcgaggagaatggaaattattgtttattgggtacagagtttctgtttggggaagatgaaaaaattctggagatggatcatgatgatagttaacacagcagtgtgaatatagttaatggcacagaactgtacatttaaaaatggttaagatggaaaattttctgttacatatattttactgcaatttttttaaattttattattatactttaagttttagggtacatgtgcacaacatgcaggtttgttacatatgtatacatgtgccatgttggtgtgctgcacccattaagtcatcatttagcattaggtatatctcctaatgctatccctcccccctcccccaccccacaacagtccccagtgtgtgatgttcccctttctgtgtccatgtgttctcattgttcaattcccacctatgagtgagcacatgcagtgtttggttttttgtccttgtgatagtttgctgagaatgatggtttccagcttcatccatgtccctgcaaaggacatgaactcatcattttttgtggctgcatagtattccatggtgtatatgtgccaccttttcttaatccagtctatcattgttggacatttgggttggttccaagtctttgctgttgcgaatagtgctgcagtaaacatacgtgtgcatgtgtctttatagcagcatgatttataatcctttgggtatatacccagtaatgggatggctgggtcaaatggtatttctagttctagatccctgaggaattgccacactgacttccacaatggttgaactagtttacagtcccaccaacagtgtaaaagtgttcctatttctccacatcctctccagcacctgttgtttcctgactttttaagatcgccattctaactggtgtgagatggtatctcattgtggttttgatttgcatttctctgatggccagtgatgatgagcatttcttcatgtgttttttggctgcataaatgtcttctttcgagaagtgtctgttcatatccttcactcactttttgatggggttgtttgtttttttcttgtaaatttgagttcattgaaaaattagaatttttttttttttcccttttttagaggcaaggtctcactctgtcgcccacactggagtgcagtagtgtaagcatagctcactgtaaccttgaactcctgggctcaagcaattctgtcatctcagccagctgaagtagtaactgtaggttcacaccaccatgcctatttttgtttttgtagaaatagggccttgctttgttgccaaggctggtcttgaactcctgacctcaagcagtcctcctgtctcagcctcccaaagtgctgggattataggtgtgagccactgcacccagccttggagatttttaataaagaagcttgtcaattaaacaaacaacaaaaagccctgagactgaatgagataatcaagagagtatgtgtagatagagaagaggtccaaggaaggagtcttgggtgactctgatgtcaagtgaggacatgaggcagaaacagcagtgactgagaaggagccacctagtaagaaaggaggaacaccaggacagtgtggtattctggattccaaacaaggaagttactgctaattttaaagctcttctcaggctgggcatggtggctcacacctgtagtcccagcacttcgggaggctgaggtaggtaaatcacttgagctcatgtgtttgagaccagcttgggcaacatggtgaaacctcatctctactaaaaatataagaaattaaggccaggtgtggtagttcatgcctgtaatcccagtgctttgggaggtcaaggcagccagatcatttgagatcaggagttcgagaccagcatggccagcatagtgaagccccatctctactaaaaatacaagaaaaaattaaccaagcatggtggcgcatacctgtaatcccagccactctggaggctgagacatgaaaattgcttgaacccgggaggcggaggttgcagtgagctgagatctcgccactgcacttcagcctgggtgacagagcaagactctgtctcaaaggaggttgcagtgagctgagatctcgccactgcacttcagcctgggtgacagagcaagactctgtctcaaaaaaaaaaaaaacaaaaaccaagaaaagaaaaaaaaactcttctaagaggatttttttttcctggattaaatcaagaaaatgggaattcaaagagatttggaaaaatgagtaacatgattatttactcatctttttggtatctaacagaaagaagatctggatattgtatgtgaaaggttcactactagtaaactgcagtcctttgaggatttagccagtatttctacctatggctttcgaggtgaggtaagctaaagattcaagaaatgtgtaaaatatcctcctgtgatgacattgtctgtcatttgttagtatgtatttctcaacatagataaataaggtttggtaccttttacttgttaaatgtatgcaaatctgagcaaacttaatgaactttaactttcaaagactgagaattgttcataaataaactattttacctgcagagacctctgatatatgtttcttgatggaagtacccagtaccacctatgaagttttcttgtcaaaaaatcaaatgtgaatctgatcattacttagatctaagtaccaatatatgaaaaatataggagacaaggaagcatggtaaatgatactgagattgggagactacatggaaaaagacttgttcccttcaacagatagacagcagggaaaaaagaatagagaaaggagtaaagaacctgtagattaaaagacatttaagggacatatgaaccaggtccagtgtatagatcttacctaaatcctgatggagcaaactataaaaaaatttttttgagacaaatgtttgaatacaggttgactatttgatggcattaaggagaaattatgaattatcttggtataagaatattgtcatgggtttttttttttgagtccttacctgttaagatacatactaaaatatttgtgggtaaaattatatgacgtataggagtatatgatttagaaaacggattaaaatataaaaggataaaataggatcttatattttgtgactcacttcctgttggatatctttctacccagtaaatatagtcctatctaggttttaatggctacatgtatgtactgtagtttgtttaaatggtttcctattgaacatttatgctctttgccattttttcctgtttaacgttctgtttttttttttgtttttttttttttttgagacagtcttgctctgttatccagactggagtgcagtgacatgatctcagctcactgcaacctctgccttctgggttcaagctattctcctgcctcagcctcctgaatagctgtgattacaggcgtgcaccactatgcccagctaatttttgtattttgggtagagacagggtttggccatgttggccaggctggtcttgaactcctgaccttgaatgatctgcccgccttggccttgcaaagtgctggggttacaggcatgagccaccacgtctggccttgtttaaggtcctgatgagtattcttataggtacactgtgtttcgtttaattatttccttaggataaatttatagaaataacattccttggtaaaagaatacatattttaaaaactgtattagtttcctgttgctgtcaaaaaatttccagaaacttagtggcattaaacaatacaaattaattattctacagttctggagatcagaagatacgggtcttactaggcctcactaggctaaaatcaaggttttggcagggctgtgttcctctatggaggttccaagggaccagagaaactactttacagtagttattttaagggaatgaaagtgaagatggggttgggcagtcaaagaggctgttacttttcatttttggcctttcagtagtttgaatttttttatcatatacatgtattactttaatttttaaaaagtaaaaagcagctgtgattcagtctctgtaatttagatcaatttacatcaaactagggtggtctcatgtgttgtcttgctcacagtgaccactagattattccaagaagggacaatttccaagacttggtttacactgagacggctcctgattttaaggataccttagatcaaactctaggaaggcagtttcattttggccttgcagttccctgggtcattttccaagcccatggcctcctggagtcttcgcctagctgtaggttatctttgtggctattatttcactgtaattatacaggaagatttattgagggatttctgtgtaccagccgtggttctcagcactttgtatactttgtattaactctgactcctgacagtaactctacagaggttctgctgttacccagttttacatagaaacatggccagcggacgcagttagaaaatggcaaagtggggattagaaactaggcagtttgactccagagtctgtgcccctgtccacttggctccactgctggggaagaggcctctgaagcagcaggaccatctgctgtgccgtgtgtagtggtactctatcttcctggtgtgatgttgtgttctactttgcattttcatgtctttccttatacaggtctcaaaatcatttacttttttttttttttttttgagacggagtctcactctgttgcccaggctagagtgtagtggcatagtctcactcactgcaacctccgcctccgaggttcaagtaattctcctgcctcagcctcccaagtagctcggattacaggcacatgccaccacagctagcaaatttttgtatttttagtagagattggtgtttcaccatgttggccaggctgttcttgaactcctgacctcaggtgatccacccacctaggcctcccaaagtgctgggattacaggcgtgagccaccccacccagccttatattttttaatgatgcacattagctcaattacataaaccagggaaatccagctaggacctggtgatttctgagcctgacccatgtgactttcaatgaactgaacttgccacagctgtatttactgtctactgagatgctgtcacacagaccccgtcatagcacagttcctgagttacatctttacatactgtagtatccttcttgtgaaaaaagatacagattccaaaggtctgagaaaccaatcttggttataaaggggaaaaatggtcatgggtttttaaaatttgttttgtcttaattgcatttcaaatttacatttctaaatgaataattgcttatataaagcagttttgattaacaatataaaacactatctatttggagtgattcctttacccatttctgaaggcaagttttaaaaattactagaagacacttcattgagaatattattaaacatgcctatagttctaccacctcaacacaattgcttattaacacattaatgttttggtgtgttttggactttttaatatgtatttttcacttgttctagtaattatgctacagattgatcatttctttttcaacatgtcatcaaagcaagtgagcaaagtgctcatcgttgccacatattaatacaaaatggaagcagcagttcagataacctttccctttggtgaggtgacagtgggtgacccagcagtgagtttttctttcagtctattttcttttcttccttaggctttggccagcataagccatgtggctcatgttactattacaacgaaaacagctgatggaaagtgtgcatacaggtatagtgctgacttcttttactcatatatattcattctgaaatgtattttttgcctaggtctcagagtaatcctgtctcaacaccagtgttatcttttttggcagagatcttgagtacgttttcttttctccttattgataaattgataatcctcaaggatgattattaggtgatactcttacttcatggattcttaaaagatatgatttaacatattacaagtgcctagcaaggtgtctgttacacgtaggtattttaagtaaatggtagctgctgatgtaatttctgcccctttgcccttcagttggggtattgctttggaccgattagagggctgtggctgggatgctaaaggttcatgtttccttagctggctcctgagccaccagctcccaccacctgtgtatacctgtgctagtttgccttcccacaagtagctgctggctatctgttatgctggtacagttttcagaaactgatgaatggcctttgaacagaacaaaaatgagattcagaataacaaaattgcacctttgtttttataagcactggccattcactagttgaagactggtaggaatacctaattcatgccaaaagaaagataatttttaaaaatcacacaggttgtttgtagattaaaagggaaaataggctaggtatagtggctttgcctgtgagtttgggaggctgaagtgggaggattgcttgaagtcaggagtttgagaccagcctgggaaacagagcaagaccccgtctctacagaaaatttttaaaaaattagctgggcatggtgatgcatatctgtagtcttagctactccggaggtgggaagattgcttgagcccagcagtttgaggctgcagtgagctgtgattacaccactgtactccaaccttaaaataaataaataaataagggaaaatatcttcaacaaaggatagttctgtctgtttctcagtcttcctcaacagataaatgtgtgaagtaatggaaggtggagatttcagattacacaacattaatgctaagggcgtttgactctgtgtgaattctaattgccctagatctagacgggctgatactattagaatcccctgtcactaactgaagacagagttgtaagttaatgccttcctagatagcctagattgtggtatgctgctgcatgctaaaatggctccccttccatagcaggatgaaatagagtcattatcttggcaaccagcccctgccaatgtgctctcagtctgcctttccagccccttctctctacctattcccagctgccatgtattctaaagcctctatgctttcatttttgtttttgccttcctggatggtctttcctgctgtctccacctgaaactattcctctctaaagaacagatgaattgccatctctctgggatgcttttacccaccctcactcccacctcaggctgaatggacccttctctagatcgcttagcatattgttctacagttaggtaaaaagtctacctatcactagatcaagagctttgtttttttttattaatttaattttcttttttttttttcttttttttttgagacagagtctcgctctgtcgcccaggctggagtgcagtgcacaatcttggctcactgcaagctccgcctcccaggttcacaccattctcctgcctcagcctcccgagtagccgggactacaggcgcccaccaccacgcccagctaattttttgtatttttagtagagacggggtttcaccatgttagttagccaggatggtctcgatctcctgacctcgtgatccacccacctcggcctcccaaagcactgggattacaggcatgagccaccgcgccgagccccaagacctttctttattaccagggcttccacagacctgacacatggtagttcctcaataaataattgcagaattactgaaaaattttactgttaacttaggcagtggtaaaaccattgtttggtagctcagaactcagcaagtaaatagcaacatttgctggaagaacagatagtttttcaaatccaattcaaggactgggtatggtggctcatgcctgtaatcccagcactttgggaggccgaggcaggcgtatccaggagttcgagactagcctgaccaacatggtgaaactccgtctctactaaaaatacaaaattagccaggtgtggtggtgggcacctgtaatctcagctacttgggaggctgaggcaggagaatcgcttgaacctggtaggcggaggttgtagtgagctgagattgtgccattgctctccagcctgggaaacaagagcaaaactccgtctcaaaaaaaaaaaaaatccaattcaaatgattatggaagtagtggagaaataaacaggaaaatgataaataattaagataatatataatatggctatattttaatctattgttgatatgattttctcttttccccttgggattagtatctatctctctactggatattaatttgttatattttctcattagagcaagttactcagatggaaaactgaaagcccctcctaaaccatgtgctggcaatcaagggacccagatcacggtaagaatggtacatgggagagtaaattgttgaagctttgtttgtataaatattggaataaaaaataaaattgcttctaagttttcagggtaataataaaatgaatttgcactagttaatggaggtcccaagatatcctctaagcaagataaatgactattggcttttgtggcatggcagcctgccacgtccttgtcttttttaagggctaggagattctttattgggatggcaaaagtcaatggcagggtagttgtcattgaaagaagattaagcttgaccccagaaggcatgggttagagcccagccttgtcactcaatggttgtatgtccagaggcaagtcacttaacatcccttaaccccagttttctcatctgtcaaatgaagcaaagaatacttgccctcttgacttaaagggtgtctgatgagacatatgactgtatcattagctgggagaaagtccatcgtgctgcctatgtatagtgcctcaagttggtctctttcccttctatgattacacaaagcactccgctgtcatgttatccatcccgcccctccattccaagtcccatctagagcacatcttcttgaagtccactgtaacctgcctaatcctggatgtgacgagccaggcaggaggcagaaaagaatgtgtgttttgcaatacatgttaagagacatcttgggctgggcacggtggctcacacctgtaatctcagcactttgggaggctgaggagggcggatcatctgaggttgggagttcgagaccagcctgaccaacatggagaaaccccatctctactaaaaatacaaaattagccaggcgtgatggcgcatgcctgtaatcccagctactcaggaaggctgaggcaggagaattgcttgaacccgggaggcagaggttgtggtgagttgagatcatgccactgcactccagcctgggcaacaagagtgaaacagggtctcaaaaacaaaaacaaacaaacaaaaaaaatcttttaccacggtgaccaccatgtgatttccaagaacttcaaatgatctaagaaattttgtgattattactagtttgaaaaatactttttttttttttgagacaaagtctcactctgttgcccaggctgaagtgcagtggtgtgatctcagctcactgcaatcactacctcttgagttcaagcagttgtcctgcctcagcctcttgagtacctgggattacaggcatgcgtcaccatgcccggctaatttttgtatttttagtagagacagggtttcaccatgttggccaggctggtctcgaactcctgacctcaggtgacccacccaccttggcctcccaaagttctgggattacagacgtgagccactgcacccagcctgaaaaatatctttgaatgccatgtgatactatacttgtcagtttacatgtgtgtcccactaaatcatgtactctcctgagcaggatcatgctttgtcttcatattttctgtacaaagcaaagactctgacacaaagctagcccccagtgcatagttgagaaatcagtgaatgaatgtgggaggcaggaaaaatgtcctttaattcttctgttaatgctgtcttatccctggccccagtcagtgcttagaactgtgctgttggtaaatataattggattcactatcttaagacctcgcttttgccaggacatcttgggttttattttcaagtacttctatgaatttacaagaaaaatcaatcttctgttcaggtggaggaccttttttacaacatagccacgaggagaaaagctttaaaaaatccaagtgaagaatatgggaaaattttggaagttgttggcaggtacagtccaaaatctgggagtgggtctctgagatttgtcatcaaagtaatgtgttctagtgctcatacattgaacagttgctgagctagatggtgaaaagtaaaactagcttacagatagtttctggtcaaggtttagccaccaattttgcagtttctctcatctccccaggaaagagcagttggtctttagatcaatgagagctcttttatggcagacaaaacaaagtgactctagccaacttgagctaaaaagaaatttagtggaaggctaggagttaccacatgaagtgtgtgcagctgccccttggagagaataagaaccagggtgcctctgggacttaacatcattactgtactccagttgttttcattcttttcctgactttgctctagagtcagtttcctaacagagtacattcgatgatcatgtgcccatatctgtggggagaagatttcttgattggcagtcttactaagggtgcatatcaagtagaatggaatagaggtagtttcctaaaggaagatgagaggctgttaccaggaggaggagaagggattcaggacagatgaaaacaacgttatatccatgatagacttacgctgctggtacagatggtacaggtggcttcagtataggctctccgaacccacatatcattgattatgatagggatatgttaactatttttcagtgtatatatgtatatgtgtgtgtgtatatatatgtatatgtatatatatatgtatgtgtatatatgtatatgtatatatttatatatgtatatgtatatatttatatatgtatatgtatatatttatatatgtatatgtatatatatttatatatgtatatgtgtgtatatatatatttatatatatgtatatgtgtgtatatatatatatttttttttgaaacggaatttcgctcttgttgcccaggctggagtgcaatggtgcgatctcagctcactgcaacctctgcctcctgggttcaagcgattctcctgtctcagcctcccgagtagctgggattacaggcacttgccaccatgcccggcaattttttttttgtttttttttagtagagagggggtttaatcattttggccaggctggtcttgaactcctgacctcaggtgatctgcctgccttggcctcctaaagtgctgggattacaggcgtgagccaccatgcctggccatttttcagtatttcttttttttttttttttttttttttttttgagacagagtttcactcttgttgcacaggctggagtacaatggtgtgatctcggctcaccgcaacctctacttcccaggttcaagcaattcgcctgcctcagccttctcaagtagctgggattacaggcatatgccaccatgcccggctaattttgtgtttttagtagagatggggtttctccatgttggtcaggctagtctcaaactcccgacctcagatgatcctcccgccttggcctcccagagtgctgggattactggcatgagccagcgctcctggcccatttttcagtatttctaaaaaaaatctaaagtgggtcaaacatttcaccttaatagaatgacaggtttgtacatcaagtttctttgctttttcttggaattttatactttttttttttttttggagacagagtcttgctgtgttacccaggctggagtgcagtggtgcgatctcagctcaccacaacctccacctccaggttgaagcaattctcctacctcagcctcctgagtagctgggattacaggcacatgccaccacacccggctaattttttttttttttttgtatttttagtagagacagggtttcaccatgttgtccaggctggtctcgaactcctgacctcaggtgatccgcccatctcggcccaccaaagtgctgggattacaggcgtgagccactgcacccggcctttttcttggaattttatcaatcagtgtcagaatattcattacctcctaaaaataaaggagttctagttggctgttttgattctaggtgtggtaaagtgaaatattgttacttaataaatgcattttgctagacacaatccttcggttcacgagctctgtagagaaaagagaaataaccgccaaccaagaaaagattgggagatactagaataagacccaggggcaggaagaagccagtgagaaggagggcatgttgagagctctgagagagaataaaagcaggggttgttggagctagcttctcaagatgtccttgaggcaaaccagacctttgggacactctgaaaataaaactgaaagtgaagagattgtgggccgaatgtggtggctcacgcctgtaatcccagcactttgggaggtcgaggcgggtggatcacctgagatcaggagttcgataccagcctggccaacatggcgaaacgccatctctactaaaaatacaaaaaaaattagctgggcctggtggcaggcgcctataatcccagctactcgggaggctgaggcgggagaatcgcttgagtccaggaggcggaggttgcagtgagctgagatcgtgccattgcactccagcctgggcaacaagagcaaaactctgtctcaaaaataaataaaaataaataaaaaagagatagtggcgtgatatccttgattctatcagcaacctataaaagtagagaggagtctgtgttttgattcagtcacctttagcatttttatttccatgaagtttctgctggtttatttttctgtgggtaaaatattaataggctgtatggagatatttttctttatatgtacctttgtttagattactcaactccactaatttatttaactaaaagggggctctgacatctagtgtgtgtttttggcaactcttttcttactcttttgtttttcttttccaggtattcagtacacaatgcaggcattagtttctcagttaaaaaagtaagttcttggtttatgggggatggttttgttttatgaaaagaaaaaaggggatttttaatagtttgctggtggagataaggttatgatgtttcagtctcagccatgagacaataaatccttgtgtcttctgctgtttgtttatcagcaaggagagacagtagctgatgttaggacactacccaatgcctcaaccgtggacaatattcgctccatctttggaaatgctgttagtcggtatgtcgataacctatataaaaaaatcttttacatttattatcttggtttatcattccatcacattattttggaacctttcaagatattatgtgtgttaagagtttgctttagtcaaatacacaggcttgttttatgcttcagatttgttaatggagttcttatttcacgtaatcaacactttctaggtgtatgtaatctcctagattctgtggcgtgaatcatgtgttctttcaaggtcttagtcttgaaaatatttatagtgtagtagaactattttatcctccaatgctccttcttttccttgtatttccattatcatcactttaggatttcacttatttatcattcaacatttattaattgcctctcatattccaggctttgtgctagaagttagggatataaagacaaataagatatttcctgcccttaaagactagattcgtgttgctaagtcttcattatcaagaaaagcataagtggggaaaagtgcttgcattatggattcctcatagttgctcccctctgcatgtaaaaatcaccatttccatcatagattcctagcggtctcaggactttataaagcccaaagtgcctatgtcataatatgaggaaaaatactgagacccttccatatatgggaggtatatggatgagacagctcctgacttcacttttcccagaaatctgaaaagcagcagcagtcattccagagcccagtttctactttgaagggcagattatttattctttgagctaacctgactgaggaacaattagtttgcttttaatttactattttctttttcttttcttttcttttttgagacagagtctcactctgttgcctaggctggagtgcagtggctcaaacttggctcactgcaagctccgcctcccgggttcacgccattctcctgcctcagcctcccgagtagctgggactacaggcgcctgtcaccacacccagctaattttttgtattttttagtagagacggggtttcatcgtgttagccaggatgatctcgatctccagacctcgtgatccacccacctcggcctcccaaagtgctgggattacaggcgtgagccaccgtgcccagccactattttctttctaattgttaatgaattaattttttaaaactgtgctcctagagcgaagggagagctctgtttacagtgtaacttttcagagcttctttaactagattttaagatcagaattagttgttgtgaaatcttagggactgtacaagattagaaatcctctatagcagcatttcccaaagcaggcttccagaacactagcctcatgaggcattttgggaaaaaagagtttgctggttcagtgtgtatgggcagtgccacaagccgtaccctccgttgaagacactcattccacacattactgcataaaaagcttccaccagccattcggcaaacttattgagtgtctgctatttcctgggtattgtgctatatggtagggttatagtagtgaacaaagaagaaatgatgcctgctctcagctgactttgcagttggaaagacacatgaaataattacgccattcattagcagattgtgctagatgcctcactggaaaaataaaggacatgatggaaaactctgtagggtcagagaaagggatcattagagaaggttctttgaagaaatattttttgaaatatgaaggataaataggaattaactaggtaccaataggttaggagtagagctttccagacagagggactagttcttgggaaggtctccagacagaaataagtgtggcttgtctgaggacctcttattcgcctattaaccttccctccccagtaaacactcctgggaacaacacacattgtagaaccacgttgtggtgctgttcagtatagcaagtaattcagcagagataagttcttggaatctcatctttgggatttagttactaagatacattcaagtttgagcaaaataaggtctcagagcttggattcattgttctgttccagcaattagagcagtacctggcacatagcacaagtgcttgaaaacactgactgagtagggtaggtgggtgagtgggtgggtgggtgggtgggtggatggatggatgggaggatgggtgggtgaatgggtgaacagacaaatggatggatgaatggacaggcacaggaggacctcaaatggaccaagtcttcggggccctcatttcacaaagttagtttatgggaaggaaccttgtgtttttaaattctgattcttttgtaatgtttgagttttgagtattttcaaaagcttcagaatctcttttctaatagagaactgatagaaattggatgtgaggataaaaccctagccttcaaaatgaatggttacatatccaatgcaaactactcagtgaagaagtgcatcttcttactcttcatcaaccgtaagttaaaaagaaccacatgggaaatccactcacaggaaacacccacagggaattttatgggaccatggaaaaatttctgatccataggtttgattaaacatggagaaacctcatggcaaagtttggttttattgggaagcatgtataatttttgtcctaagtctgtgctcagccctcccacatgtgctcattgctggttgactgttggagtctggttcttacctctaagaggaagcccaggagagggcataaagccagcacactgtcctcacctgatggtgtcagagtccttacgagtaagccctagccagaacattgctggaagagatcaagggccactgtttgaaattgcacagcaggatacggaaaaggggtaccttaggtataggcattgtcattaaagaaattgctaagatacttgagattttcctgtttaaggaatgagctttatgatacaaagagcagttctaaaaattagggagggaattaactaaattaattaggatatttctcaaattcctttacagtttttgtctctctgctgatatagtgtttacatgattgttatttactaaacaaatgctattttgtattgtgctccttataacttaattgtttattacaaggttttgatggtgacctaccaacaacaagtaatcccaaacacagtctgaattttttgttttccatccagaaataagatgaatctttccatttccgtgttttcagttttcatcatttttatcctataggttacttatctttattttaaagcatttcataataattttatagtttttgttttgtttgcttgtttgctgttggaaatggaatattccctccttccatttagactgctaaccagctgtaaatgtttcaaaatatgcatgttttacagcagttgttcaaagcaatacaggaacagtaaggacagagccagtcattttacaaccacattctgttaaactgatgtctattagcagggtttttcctattttattaggaaggacttacacctgatatataacaaagcttgttttaatcaaggctcagaaaatgtttttcattagtttttttcctaaccatgaagaataactgctttgtaacacacatgctggctataaagcagacaaaaaattcactgtaggtgctgcctgactggcctctgtccgtgtttctgttggggctgcttaccacagcctctgcattatcattagctagtgtgttcacaataccaagttcccagtagcaaagaaaggtcaagctcttacgcatgccattcatttatctacactgtgcaggcgcactcaggtggcagggacaaagaccactcctttggcgcatctcaagttcagaattctcagtagaggggctccagctgtccttttgtcaggtgcccatgcctgctccaggcctgtgtggtcaggacacgtgttacagagtacagtgacattaatgatggggccatggatatggtcagcactcagaggatgttagtctcttcattgataaagtcacaaccacttttcctgttggaaataaaaagatttgacgtatccttgtctacagcaacacaggacaacagataatcagcaggtcatctaaatctgttcagagagaaaggagagctgtttcctgaaaatacatcttcccctgattttagtcttatttttttctgcctttattgctttctaccctcttcaaaccagcctcatttcctaaattaccttgaatatgcattgacacttgtactgcctgaaattctggaaaactcagtatggctactccaccgtcagaacttcctgagcaaagttagttgctctctcggctcactgttttgttttgttttgttttcctgcctcaggtttatttgtacaaatagcacaggaggaccagccccatgcagatggtagcccaggggcgggggtagggggtcacaccagtccttctgtcctcatgttggcagagatatctactctgaagcctttgtaggggcctgggcacctttgggagcctgagctggaactgaaggtggagctgcagcctgggccttggtttgatccttggccttggcctttggccggcacagcctgagccccttggcaatacgggcacgagcacgcttcccaagcttgggatgggcaatgtaggcaagtcgatcgagcttgcggctgacaccctttgggatcttgggcttaacctccttgggctttacgagggccttgatagcctcggcacgtgcactcatggccttggcattgttggcctgcatcttctttaggcccttcttgttgtgcttcttggcaaagtgcatgttcctcaggaacttggggtccacccccttaagagattcgtatctttgtgatcggggtttcttgataccatttctgtgccattttcgggactggttgtgtgtggtgtggttcttggacttcgccatgtctacaccttaagccgcggctcccgaagcacctagaaccggaagagttggctcactatttagcacacacacacgtctataatagtgctggccacttggggttggaattagtttatttatcagcatgttgtctcccagcacttggtgtgtgtgatatgcagtatgtatttgcagaatgaaaagtctgagggctgacatcatatttcccactgtgcccagaaagagcacagttagtccacatgagctaatgggggcaaagggaagtgaggagggagaatgtactgccttatcatgttttctattacttggctgaagtaaaacagtcccaagccgatagtaagatagtgggctggaaagtggcgacaggtaaaggtgcacctttcttcctggggatgtgatgtgcatatcactacagaaatgtctttcctgaggtgatttcatgactttgtgtgaatgtacacctgtgacctcacccctcaggacagttttgaactggttgctttctttttattgtttagatcgtctggtagaatcaacttccttgagaaaagccatagaaacagtgtatgcagcctatttgcccaaaaacacacacccattcctgtacctcaggtaatgtagcaccaaactcctcaaccaagactcacaaggaacagatgttctatcaggctctcctctttgaaagagatgagcatgctaatagtacaatcagagtgaatcccatacaccactggcaaaaggatgttctgtcccttcttacaggtacaaggcacagttttccttcatttattcactaatttagcagaacctcactaagagcctcctatatgccaggctctgcgttagcaataaaaggaatgccatgcctcaccccatcaggaggtgctgatagcttgtaggcggagtggaaacagatgtgctctagaggctctaaatattacttctgctggggtcagttgggaagccacaacagctactgttcatcttccataaaagacaatcagccgggcacagtggctcacacctgtaaatcccagcactttgggaggctgaggtgggtggatcacaaggtcaggtgtttgagaccagcctggccaacgtggcgaaaccctgtctctactaaaaatacaaaaattagccaggcatggtggcgggcgcctgtagtcccagctactcgggaggctgaggcaggagaatcgcttgaacctaggaggtggaggttgcagtgagctgagactgtaccactgcactccagcctgggcgacagagcgagactccatctcaaaaaaaaaaaaaaaaagactgggttctgttctgtggaggttcttgtcttaacatatccactgttgattgcccagatgttgatgtaattaatttagcagtcgtaaatagtttagcacttgcattaaatagaccaaaccccatagtaggtatttgaaatacagaataaatgtgaggtacccctgctctaaaggagtttatagtccagagctgacttatggaggatttctttctattatttctgggtctgctactaatttgtctatttcatatcctaattatccttgttttcattttgattgaaagggggagagcatagaaattgtggtaaaaggtagttttattttttatttgagatggagtcttgctctgtcacccaggctggagtgcagtggcacaatctcatctcattgcaacctccacctcccgcgttcaagcaattctcctgcctcagcctcccgagtagctgggattacaggtgtgcaccaccacgcccagctaatttttgtatttttagtagagatggattttaccatgttggccagtctggtcttgaactcccgacctcaggtgatcctctcactttggcctcccaaagtgttaggattacaggcctcagccactgcacccagcctaaagttagttttagattaagtgttttcatgttttcccttgcaaagtaataaactggtcaagttatcaccttgttccatctccatattaatcagggtccaaacaggagatagaaaccatgcaacaatttgagtagttgaataaagaattataaacaggagattagagtaataggggattagatagtaagaggtgaagagataggaacagcagatataaagaacaaccatttcctcctatggctgagataccatcccctcaccacactcccccacctactcactgagatgcagaccttattgaagagaatgtaactggcttgctgcgaggtaaagtcaatgaggcgctccccagtaccactctgaggggatgctggggaaaactgcccatgagaagagggcacatgctgctggccacttgtgctaaagaacttgaagtctgataggagtgcaccctaacctggcatagaaaccctttcttcctgctgagtccctctagcaccttatactggcaaagctttacattgcaaacctccattatcacagagcaagcaatgaaagatggactcagagctgaggcgataaattgatagctagcatagcctctaaactgacttttatgactacattttatggatagaaagtgttcttatatatattgtttctttacataataggggacttattcatggctgcagatgagaaaacagatcctaagaagttaagtgacttgcccaaggtcacacaaagaattccactagttctaaaatgacagtaattacagttaacatacattgtatgtggcagatacatataaagcacatggcattaatttttttttttgagatggagtcttgctctgtcgccaagctggagtgcagtggcacgatctcggcttactgcaacctctgactccctggttgaagggattctcctccctcagcctcccgagtacctgggattacaggcatgcgccaccacgcccagctaatttttgtatttttagtagagacgtggtttcatcatgttggccaggatggtctcgatctcctgaccttgtgatccacccgcctcggcctccccaaatgctgggattacaggcgtgagccaccacgcccggccacttggcatgaatttaattcccgccataaacctgtgagataggtaattctgttatatccactttacaaatgaagagactgaggcaaagaaagatgatgtaacttacgcaaagctacacagctcttaagtagcagtgccaatatttgaacacactcagactcgatcctgaggttttgaccactgtgtcatctggcctcaaatcttctggccaccacatacaccatatgtgggctttttctccccctcccactatctaaggtaattgttctctcttattttcctgacagtttagaaatcagtccccagaatgtggatgttaatgtgcaccccacaaagcatgaagttcacttcctgcacgaggagagcatcctggagcgggtgcagcagcacatcgagagcaagctcctgggctccaattcctccaggatgtacttcacccaggtcagggcgcttctcatccagctacttctctggggcctttgaaatgtgcccggccagacgtgagagcccagatttttgcctgttatttaggaactttctttgcaagtattacctggatagttttaacattttcttctttgaacctagttataaaggtattgtgctgttgttcctaggcttagagtcataaggcctgagctcacttcctcactttgcctccatctggaaccttagaccaacttcctaggaaaacgagctgtctgaaaacagaatagggtgcctcttcaatgtgctcttcactggagatgttcaggaggaggctactcccacctacacagggtgcagtggagggtctgggccccagggaggcagcaggaagagtggaaagagcggaggctctactgttggacagacctgggttaccagccgtgtgactagccttccctggcctccatatccccctcagtaatgaaggaatgtgtcatccccaaatccagggacagttacaagcagtcagtgaacagaaagtgtctggtacaggttctaagtgcttattattctaagtcacttcacttacctgagttctcagttttcctatctataagataagcaggttggataaaatgttctccaatatactcctggtcctgagatgatgtgattgtgggcagccctttaatcatggtgaagatgttcatcataagcacactgaaactacaaaataggaatataaatattttctccattaaattatgctggatcctagaagcaaaaactggaactgtgaaaccctacttcacagaaaacttaaaattcccaagcagatgaatgcttctcggaaggacactgacagttacctacctggaaagaatctagatggaggtggcatgggcactaagcggtgagattaaacccagttagggcagccccaccagccttggaacccacacatctggagattgttgatgcagagagaaaggttcctactggtgagacctgaaagggatatgtggcaggtgggaggaagaagttctgtctggaaaccaacccttgttcctccgttattgattgactcctggtaccaacatgagccctaggtcttatagaggccataagtccctatgccttatagtgcccatggatgagatgaggccacacatgcccccagtgggttaacatgtctagcgtgggtaaggctcttggagcactatgatacacaggaaatgcccagtaactcttagttggtttgatatctgttcccattgctcacttaagctcagtgcccctttactgatccttttattctgcctccctctgcacatgtgcattgagactcctatctgagacacacactgtgttgggtgcccagggatgcagcatagatgttgctgccttccacagaagcgctcatggtctgctagagaatatatcccatgggagagaaaaacagactcgggagaatatagcaggggcccttgtcctggactttggcagttaggaaagggagggaagagacatggaggctgggacccaaaggctaaataggaatttgctgggccaaaggggagggggaatgaaaagagtgtttctggcagaggaaatggcaaggataaaggcctggaggcgcaagagaatatgtgtttgaggatctgaaagttgagtgcagtgggtccagtgttctctaccctggctgccattagaattacctgggaaacttttagaaaattccagtgtctgggccctccctaaaacaataaatcattcttgggtggtggggtctgggcatcaggattgtttaaaaccctccccaggtactgtcatgtgcagctggggttaagctgtgctggggtctgagtatggatctgttagggcaagtggcggtgatggagttgaggctgcagaattcaggccaaatagagaggttttcatcaggatattaaagagtttagatttcaatttggtgggaatggatgggatcttatttgcattttatgaagagctccctggttgcaatatcagaatggattggagaggagcaagatggaagcctacagtgatttgggagaagtggtgagggacttgagacacaggaagtagccccattcactaatagttgagtatgtagatttgctaggacctggaaatggtttggctggtggggagtgggaagaaaggcccaaagtgtgaaatgaagatggagagcacattgcctagcccagagtgattgccatttgctctgtcccagttgaggtccaaggggttggccagagatcatggagtctgtggctccatggggagaagaacctctcagcatgcctccttgtcttatcctgggttagtcagattcattttgttagattacattttttttccagtggaactctgcttaagtcctgaccagtatgttttcagaaggatcagagggcctgcccttgtccattggtgcatgacaccagcttggtgggttccttgctgctccctgttttcatagggttatcagaataccttctctccctgccaccagcaggtcacactggctcctgactttttggcccatggaaccaccatctttctgcttcttagattgtgccttgtactccactgatcatggccagtacatcagaagccctggtttgcagtgaatgcatttgatatggaaatcaggaaccctggggataccactcatcatatttggttgctgtgtttttcctccaatctttcaccataacaacaatcaactcaaaagatttctataaccacttgtgtgggggtttctccccacacactaaacaagcagtcagttccagagtggacagcagctggtctcctccaatttaattccaacactgtctacttggagatagcattagatcccacaggttgagggtgcagtcccctagactgcccccagtctcctgcttcagacaccagtcacaagtccaggactctagaagttctgaccagtttcaagttggggttcccacaaccccccactttatttttgattaatttgctggagtggctcatagaactcagggaaacacttagttttctggacttattacaaagatttaaaaagataccaataaatagccaaataaagagatatacagggctagatctggaagggtctggagcgcaggagcttctgtccccatctacttggctcccagcagatggatgagttcttattcattttcttgtcagcttcgacatgttcagctctctggaagcccgcaaactcttgtcttcttgggccttttatggagacgtcgttaggcaggcatgattgaaacatggacaactgtgtcgaaatatgattggacataaaggggtctaaactcagtgaggcctgtttgttcagattcttcttggcctctctgtggccattctttcctccaggatatggggcaggacccctatggaatgagggtcttatgacccacaatcaaattagagtcctgccttgggcaagtgaaaggaaagcaggagaaggtaagagaaattctgttgcctaagaccttctgaggcctaaagcaccccaacattataacagaagacgataacaggactatgggagttatgagctgggaaccttggacaaaaatatatacatattaaataaatattaagtgtatatatatacttacgtatattaagtgtatgtgtgtgtgtgtatatatatatttttttaatttactggttggttttgggaagcagaaattaccataactactcttaaaaatcttttaagtctctttgaagttagaaaagtcactgtacctttttgtttccattggccctgtacttcttattataccccagcaggaggagcataatgtgttgttatatcattctggtgataagattcataagtgggttcagctggtgacagcctgattccctcattgtaaacttatccatcaacatgtagcttaatcgtttcaccttttgtgatgaccattacctgaatcagttatttcattagattgcaagattatgcttttctgattttatcatttcttctgtattgactgtaattctttggtatagaagaactttcccttgttaatagctatttggttgtcctgaagtacagttcttactagaaagtaagaccaaatgctgaattatatccctctagctatcaattttcgaaggaatgaatggtgtcctagtaatttccagtggtgtttaattacgttttcccttctctttctccttctcttattccctccctctccatctcctccctcctcactttcagttttttgctctttcagtattttgtcatagctgttaacagagcaacatattttaatcaattgtagtcatttttctttttggtgctcaaattatcccgtcttagtcccatggaagcaagcccttggagctagggccctctaccttttgatggatttccatttgtcttgataatttccttgtttctgacaagacaagatgttgcaggcacattttatactttcccagcccaaaccctggaataggccttttctccgaggagctctagttcattttagtgggaaatggtatttagagactataatctgggatctgggagtcctcattgctactgagtagtcattacttttaggcttttccagtggtcagagctaggaaatatgtatatttaaaaatggacagttgaatggttgttgccaggagctgggaggaaggggaagtgagaaattgtttaatgggcacagagtttcagtttggggaagatgaaaaagttctagagatagctggtggtgatggttgcgcaacaatgtaaatgccactgagctctcatttaaaaatggttaaaatggtaaattttatatatattttaccacaataaaaaaaagtcttcttctgggagcacccccccaagacaaaaatatgaaaattttacactgatacttccatttcaagataattttaagattataaggattttgcttaattcttgaattttatacctgtaaaccttttatacttcaaatttcgggcagaattgcttctataacaatgataattatacctcatactagcttctttcttagtactgctccatttggggacctgtatatctatacttcttattctgagtctctccactatatatatatatatatatatatatttttttttttttttttttttaatacagactttgctaccaggacttgctggcccctctggggagatggttaaatccacaacaagtctgacctcgtcttctacttctggaagtagtgataaggtctatgcccaccagatggttcgtacagattcccgggaacagaagcttgatgcatttctgcagcctctgagcaaacccctgtccagtcagccccaggccattgtcacagaggataagacagatatttctagtggcagggctaggcagcaagatgaggagatgcttgaactcccagcccctgctgaagtggctgccaaaaatcagagcttggagggggatacaacaaaggggacttcagaaatgtcagagaagagaggacctacttccagcaaccccaggtatggccttttgggaaaagtacagcctacctcctttattctgtaataaaactgccttctaactttggcttttcatgaatcacttgcatcttctctctgcctgacttgccctctggaatggtgctggaatggtcctgtggccttgtccactgtctgcctttgaccataacttgaaagtcacccaccatagtgtcctttgaaataacttaaatgtccacagttccaagcatgagttaaaaacacttcagaatgtagagtagttgttcaattgaataaacacacacaccagaaaaaaaagcaagtttatcttttatttttagtaaagaattttgatagagcctcaacaccagaaatggctagagagagaagcctaacatatctggaggattatttttcatcctacttaaagctgctttcacttttttcaggaaaaaacacacgttctgaatctaatttataaaactccctggccgggtgctgtggctcacacctataatcccagcactttgggaggctgaggcaggtggatcacctgaaatcaagagttcaagaccagcctgaccaacatggtgaaaccccatctctactaaaaatacaaaattagccagacgtggtggcgcatgcctgtaatccccgctactcgggaggctgagacaggagaatgacttgaacccgggaggcggaggttgcagtgagccgagatcgcgccattgcactccagcctgggcaacaagagcgaaactccgtctcaaaacaaacgaacaaacaaaaaccccaaaaatccctgaagtacgtgagctagtggtgaaagaaagctggagaaaaggagcaggaataataataataataataataataataaagattgtcatttaattttgagtacttccagtgtacactttgcaggtactctaagacattacctcactgaaatctctaaggtagatattctttatttaaagtgtacttgtatgaaacctggagctcaaggtgaaggaatttgcccaaggctgcacttgcactatcgtggcactaattagccgtgtgaactgggacacgttacttcagtttgctcatttctgagtcagcctagcaagatgacttctaagaattttttccagccgggtacattggcctgtaatcccagcacttcgagaggccaaggtggaagggtcacttgagtctaggagttacacacaacacacacacacacacacacacacacactagccaggcatggtggcaaatgcctgtagtctcagctactccggaggctcaggtggaaggatcacttgagcccaggaggttggggctgcagtgagccatgatcacgccactgcactccagcctggctgacagagtgagatcctctgtctcaaaaaaagaaaaaaaaaaagatttttttccagggaataataaaggaagctaatatttatggagcatctacggtgtgccaaatactttgcatacgttatctcatttaatgctcttatccctgcagggaaagtattaacatttgtttatcacttgcagaactaagtgatatttaccacagagtagacaaatattttcaagcccaaaatcaagtggtatcacttttctgctgagaatgtttcagtggtttcctttgctcttgggataaaacttaaatccctcaccctacccttgctccaaccctccactttccttctcccatgtggtgatttggccatacagctcttgtggctgatctgaactgactgagctttttacccttttgctcttgctgttcttacagcctgggaaccccctggttacctcttggcttggtgtggtggcttacatctgtaatcccagcactctgggaggccaaggcggacggatcacctgaggttgggagtatgagaccagcaagtcacctcttgccagtggcctttgtccattgagtctgaagttctttctcctctcatttccccatcattctattatgctaccttgttttattttcttcattgtgtttattgatacttaaaatgatctcttttctgttgctgtttgactctcccactagaaagtaagcattgtagatcgggcactgtggctcacacctgtaatcccagcactttgtggggcagaggcgggtggatcacctgaggtcaggagttcgagaccagcctggccaacacggtgaaaccccatctctactaaaaatacaaaaaatagctgggtatggtggctcgtacctgtaatcccagctactcaggaggctgagacatgagactcacttgaacctgggaggcagaggctgcagtgagctgagatcacaccacagcactccagcctggaagacatagtgagactctctctcaaaaaaaaaaaaaaaaaaaaaggaagtaagcattgtgagggcaggtaccttctctgttttgttcattgctggatgtagttagtatacagcagtatctgatggatggatagatggaggaatgaatgaatgagacttcacaaattcagctcacttgctcaaggccctgcagctctacgggatgaagctatactccagagtcctgctacattggctgtgtggccagctgctgggatctgagggttgtcagataagcagtctaccagagaacagactgatcttgttggccttctgccagcacaggggttcattcacagctctgtagaaccagcacagagaagttgcttgctcctccaaaatgcaacccacaaaatttggctaagtttaaaaacaagaataataatgatctgcacttccttttcttcattgcagaaagagacatcgggaagattctgatgtggaaatggtggaagatgattcccgaaaggaaatgactgcagcttgtaccccccggagaaggatcattaacctcactagtgttttgagtctccaggaagaaattaatgagcagggacatgagggtacgtaaacgctgtggcctgcctgggatgcatagggcctcaactgccaaggttttggaaatggagaaagcagtcatgttgtcagagtggccactacagttttgctgggcaagctcctcttcctttactaacccacaatagcatcagcttaaagacaatttttgattgggagaaaagggagaaaaataatctctgtttattttaattagcattaattggtattcttgttaaaccataggagtcagagtaaatcagccatttcaccaattttcagtttgtttctgtcttagctaacagcagtgtaatggtcagcaaaattcttatcttgtgtactgaatggcatgtcctgttgctgaaagtgcacaggcttgggaggtagccatgagctcaaatcctggcactaccacctctcttgtgtgaccttagactcctgacctttctatgcctcagttctttcttacctataaaatgaaattaattttacccttaaagatcatcgtgctgattagagataaaatataaataataacacttgttacagagcaaggagttgacacttttatattctgaagacaaagtggtaaatcattatcatctatgtcagaaatagcttttgagaatacctgagtatagaactatcttgatccctgttacttcaaaactaaaataatggttttaggaattaaaaggtgaggctagtcacctccaagggatgaactgactcagggattgaggtatataacagtgaactggtccaaacaacagtcctgaccccactttatgagtgagactatgagtaatggtctaagtgtagacatcattgtccagggctccagtaggcagctctgtacttgagaatttagcagtgacccttctatttttcatctattatacctttttttttttttttttttgacacagggtctcactttgtcacccagctggagtgtggtggtgcaatcatggcccactgcagcctcaacctccctgggcttaggtgatcctcccacctcagcttcctgagtagctgtaattacaggcatgtgccatcatgcccagctaatttttcttttcttagaggtggggttttgccatgtttcccaggctggtcttgaactcctaggctctcacctctgtcttccaaagtgctgggattacaggtgtgagccaccacacctggcctattacacatttcttaattaaagtagtcaaatttgaaaactgttacaaagtgtatcttaaaatacgacgatctggtttaatttttaaaagatatgagtagccaaggagcaattctgtgcctttcccactagtccctaaccttttaaagcagctgcttcttggctgggctcagtggttcacccctgtaatcccagcactttgggaggccaaggcgggtggatcatgagtcgagatcatcctggctaacacagtgaaaccctgtctctactaaaaatagaaaaaaatagctgggcggggtggcggatgcctatagtcccagctactcgggaggctgaggcaggagaatggcatgaacacgggaggcagaggttgcagtgagtcgagattgtggcactgcactccagcctgggcgacagagcgagactccatctcaaaaggaaaaaaaaaaaaaaaacccatctgcttttgattcagtggcttctttaattttgtcggtctcagtcaccatttgtctaagcaaattcaggcaggcttcaccttgcctttctacatttgttcccttttcttagcattttgggcctttgtttacacgtgggaaaagacccacaggtcgtctctccctttgggcaggatacaggcttcctgtgactgaggttttgctagctgtagaagtggctgccaattggcttctggtttttatttccatgatttgctccagtggctcttcccttccatcattgttagctttcaagctaggaacttttaaaatgcttttaaataaaagtgagctgttacttgatgcatttagcagtcttcctcacagtggttttgatagacagactccctcagtttggaatttatgagttttctttaagggtttgtctccctcatgtatagcaggctgttgaaagttacaatgtcaataactttctgaatagtatcaaactgttttcagtgcagtgtattaacaaaactaacctgcctcaagtttggtcagctttggagtcttactgaggctaaaatgataaatctaaatgatttaaaattgtgtattcctacacagtatctcacttaattatgtaatagtcttgtgagtgaggcagagcagatgccgttttctctattttaaagatgaggaaaatggaatggaaaatggaaaggacagactaattgcaacatcctcgcaatcaaaaacaggcccaggttcatgccttgttggcagtgggttgctactggctgtggccttcatgcaggaaggctagatgcataaccaggtcaacagcccgtgcaggacaagcacgccatgtaattctgattccatcgactgaggctggtgttttcaaacgtgctggtgtagggtcttacagacagagtcatctgtgctatggggaatggaatgtgctcttgctttggagccagaactcctctgaagctcccaccacctacaccattcagaggccagacagaaatttgttcaccattttgggcatgattttcgtgcttttgtaaaatgtgcttcactgcagcccttactgggctgtggtgatgaacacttaagatactgtgtgtgtgctttataatctgtaaggcactgttcaaggggagggacctctgccatgagcccctacccactggtatctggttgacatccaaagccccagcctgggagaagctgattctctagttgaatgctgtatagggatttgactgaggctcagatttggtgaggaagaccactaaccttaacagaccaacaggctggctactccctgatgaagttccccaggccatgaaagaagtaagagatacattccttgtaacagctttcttagttgcacctgtatgattatttgatcagtgtgttgtctgtgcagggatcatgtctgtggagctcaccacctcgtcctcggtgctgagcagagtgcctggcatgtgtactcagtagatatttgctaagggagcgagtcagtgattgagaggagcagcctgggaggtaaagccctagaatctttattttaaagggatatcaaagttgaacattcagttagacagttctcttgagtccagggatttacccatccatggtggacacactttcagttaaaaagtaaggttaattttgacaggttgcagtatccaggcaagcattctatggaataaggctcatctcagggattagtaatgactgaattaacttactgctagtcccataattttgacgttaattaatggggttaagaaatgtcataagctatttggtaccatttaaagtgaaaatacccttaacgttttttgcctccagatatccacacttaatttcattttcttgctctttggtgaacagtcctgggtctgaatgtatatatccatggtttgtcactaggtgacaggtttttttggaacaagaaatcagttcagtgaacatttgtcaagtatcttctctgtaaaaagtgtaatgtgccaagctcagaagtaggaagtgaaatggataaactatgacccctgccttaaagaacaccatggtgttgtatgggaattgtttaggtagaatgaaagaaatcctctaatagagatatgaggccagttcagcagaaagccagggtgagatctcctgagagggatggaagggtgtcttgatcatctctggtagcagcaaaggcactggcatacagtggccactggaagacaaccagcaggggatgggggcgtttacccttgcaagtgagcattaggaactagaggactgattgccctttcttcagctttggtttcccttgctgcagaaaaagatgctgagactcatggcctcggttatgaactcagatatgtggtttggctttgaagcacagatggattttgtccgattttggcagggaaatgcctacagacagcactatgggcatatttaggttagggacgaaatgcaagttgattaagtcctgataagaggctgtgaagaggtccaagaagcctcacaatgcccaatgaagaaaagccctgtgcttggtgctgccgcctcccttccccgtcctgctggcagggctgcgcttcagtagctctggatgcgtcagagcagtccatgaacattctgtgtggaaaatctctgactgttttagtggattacactgctctccctttcctccagtgcctcgttattcagtattatttgatgttctccagcttttaaaataatcattttccgcctacgcagaacatcctgtagagacgttgaggttccagtgggaacagagaggaatacttattctaaaaatgaagaaaataaacctttttttatggagtgggtgatagtattgcagaacttctataatagtatgagaattcacttgtggtgccaaagcttaaaaaaaaagtatagtaaaaacataatgtataggcttattgctgtgctatgacccatgccccgttttctccaacctctcttgtcctcactcttcctttttgctggtgatatttttacttatttcatgaaaaaaaagataacatatacacacacatagatatatgcacaagtatatgtatatatgtgtgcataacacacataaacatatacattggtaaatttaaaaacatatttatgaaatatatgtagcatctacagaaaaacatgaacacttgtgagaatagcatctgcctaaaaaataggacatcaccatcacctttgaggctcttatgtgctgctcccctgtgccattcccttcccttcttccttagaggtgattactattctaaattttgggattattatttcctttttttattatagtgttttaattacagttttattacctgtatttgtattcctaaaaatttgtttacttttgcaagctttagattttataaaagtagaattacactgtaagtttaatttttctgtaatttatatatagctacacatatattcctaagattcatccatcttgttacatatagctctggtttaccttttctgtataatatagattctgcttcgtgaatttacagttcattcattcttctgttaaaggacagttggaggactcatatggcctcagtctctgtgtccccacatgccaccctgcttcccagcctcatatgagttgattggtggcctggcatactggatgagaagctctaggtcatatatttaagagagttattgctgggtcataaaatgacagattgttttccagaggggtcatattgatttaaattatcaccaacaattatattgtcagatttttaccagtttggtgattgtgaaacagtgtctgatggtagtttttatttgcattttcttggttgaaataaagttgtgtatttcagccaggtgcgttggctcatgcctataatcccagcactttaggaggccaaggtgggcagatcacttgaggccaggagttcaagaccagcccagccaacgtggcaaaaccccatctctactaaaaatacaaaaattagatgggtatggtgtcacatgcctgtaatcccagctactcaggaggctgaggcacaagacttacttgaacccgggagatagatgttgcagtgagccgagattgtaccactgcactccagcctgggcaacagagcaataactaaataaataagtaatcaattaataaataagtatatttcctcagctgttaagtacctgttcaagttttttacccaatatttgatgggctctttttttgtcttttctaattaatttttggagtttttgatatattctagatagtaatgagttacatgaaaatatccctagtttagggatcctctagtaactttttaaaatgaatacttgttttaggaacagaaattcttagatttaatgtaggcagattttatcaattgttctttacagattggctttgtagcttaagaaatccttcctaactttgcaataattaaagatatgctcttagattgtttcctaaaagactgatacttaagcctctagcccacctggaattgattttcacagatactacattttttactagttatagattggccccttcgtagagcaagtccgatagctgccatttttatggcagcatgtgctcacttagtgtctctgtcaaattttggtaattctcacaatatttccaactttttcattattactatatctgttatggtgatctgtgatcactgatctttggcattactattgtaattgtttggggcaccattaagctcactgtcttatgtgggcataaaccatgcccacataagacagtgagcttaattaataaatgtgtgtgctcagacccctccactgactgggtgttcacatgtcttccttactctcctcaggcctccttattccttgagacgcaataatatggaaactaggcaaattaataaccccacagcgtccacaagtgtttaagtgaaaggaagaggctgggcgcaatggctcacatttgagctcacaaatgagcccatgctcatttgccattccaaaaatcccagggcccttaagaattatgctaactctactctgcctctgctctataaatggaacaacaaagcctagatgacagcacatctttttagaacatgatttactgaatattttaagcccattgtggagacctactgctcagaaaaaaagattcctttcaaaagcctgtaatcccagcactttgggaggccaatgcaggtcgatcacctgaggtcaagagttcgagaccagcctggccaacatggtgaaacacgtctttattaaaaatacaaaaattagccaggcctggtggtagatgcctgtagtcctggctattcaggaggctgaggcatgagaatcacctgaacccaggaggtggaggttgcagtgagccgatatcatgccattgcactccagcctgggcaccagagtgagactacgtctcaaaaacaaaacaaaaaaaaaaaactgaaaggaagagcttaatgagaaaggcatattaaaagccagtataggttgaaagctaggcctcttgtgcaagttagccaagttatacatgaatggtaaagcaaaacagctttattgctgtaataaagaaagttttagtggtctggatagaagatcaaatcagtcacagcattcccttaagccaaagcctaatccagggtaaagccctaacttgcttcaattctttgaagactgagaggggtgaggaagctacagaagaaaacttggaagccagcagagattgatgaggtttaagggaagaagccacaagtgctgatgtagaagctgtagcaagttatccaaaagatctaattgatgaaggtggcttacactaaacaacagattttcaatgtagacaaaacaatcttctattagaaggtgtcatctatgacttacatagttaaagaggaaaagtcactgcctggcttcaaagcttcaaaagacaggttgactctaataggtactaatgcatctggtgactttaagttgaagccagtgctcatttgctattccaaaaatcccagggcccttaagaattatgctaactctactctgcctgtgctctataaatggaacaacaaagcctagatgacagcatctttttagaacatgatttactgaatattttaagcccattgttgagacctactgttcagaaaaaaagattcctttcaaaatattactgctcattaacaatgtacctggccaccctagatctgtaatggagatatataaggacatgaacactaacacagcatccattctgcaacccatggatcaaggagtgatactgactttcaagtcttatttaagaaatacatttcatagggctctagctgccatagatagtgattcttctgatggatctgagccaagtaaattgaaaacctctggaaagaattcatcattttagatgtcctgagaaacattcgagattcctgggaagaagtcaaaatatcaacattaacaggagtttggaagaaattgcatccagccctcatggataactttgaggggttcaagacttcagtggaggaagtagctgcagatgtggtggaaatcacaagaaaattagaattagaagtggagcctgaggatatgactgaattgctgcaatcccatgataaaatttgaacagatgaggagttgcttcttatggatgagcatagaaagtagtttcttgagaaagaacttaattctggtgaagatgctgttaatattgttgaaatggcaacaaaggatttagaatattatataaacttggtaaagcagcagcagggtttgagtggattgacactagttttggaagaatttctactgtgagtaaaatgctatcaaacaacatgacaagctacagagaaatctttcatgaaaggaaaaatcaattgatgcagcaaacttcactgttgtcttatttcaagaaattgcaacagcttcctcagccttcagcaatcaccaccctgatcagtcaacagccatcatcagggctagatcctccaccagcaaaaagataacaattcgccgacagctcagatgactgttaccattttttagcaaaaacctttttaattttatttatttatttattggagacagagattcactctgtcgcccaggctggagtgcagtggcacaatctcagctcactgcaaccaccacctcccaggttcaagtgactcttgtgcctcagcctcccaagtagctgggattataagcatgtgccaccacgcctggccaatttttgtatttttagtagaggcaggattttactatgttggccaggcttgtctcgaactcatgatctctggtgatctgcccacctcgggttcccaaagtgctggtattattggcatgagccactgcgcccggccagcaaaaaagtgtttttaaattaagctacctacgttgattttagacataatgctatttgcacacttaatagattacagtgtggtgtaaacataagttttatatgcactgaaaaacaaaaaatttcacatgacttgctttattgtgatattgactttattcctgtagtctggaactgaacctgcaatatctcagaggtatgcctgtatctacttgttctgtgatacttgttattgtcagtttgtttggatttaccacatattatttgatcataattctttcctgtagatgttttatggtctgcctaaacctttagtggggcctttgatggcttagtcctttcaggcttaagacaatagaagtttatttctcagagttctaaaagctgggaagtccaagatcaaggcaccgacagatttagtgtctagtgaaggcccgcttcctcatacatggcaccttctagctgtatccttacatagtggaagggaatagctagctctctggagtttctttcataagggctaatcccactaatcccaattatgagggaagacctaatcacctcccaaaggccccacctcctaatagtatcaccttgggggttaggatttaacatatgaattttgtggggacacagacattcaaacaatagccatggcaaacttttttgctttgtctaattcactcttattttgaaaagtatttgtgttgggtttaaaactccagattggtaattattttttcttagtgcattgaaggtaatagtgtatcattttctgatttctactcttgctcttgaaaattcagctatcaatcttaaaatttattacctgttgaaaatccagctaccagtcttatattttatttacttagtgggtaatctctcttctgagtacctttaagatctcctttcagaaataccatgtagtaaccctgtgtgtcacgtgtggattttgttgggcttgctagctgagacttgacagttttcatcacttctgggatattctcaggtattttgtcttcaaagtcttcagatattgtcctcttcctgccctctctccgactccttctggaacatgagttatgtatttattatctcccatgtgcataagttatctttacatattttcaatttctttatctttctgtgctacattctggataattttgttgatctaccttccagttaattagcttgttaactttgtcaaatctctttttaagtctatcttgatttttcttttcaattattgtatttttcatttttaaaaactttatgtgctcttttggaaatcttgatcccaggagatagtggatagtgtcctgctgcttactcatggttttaatagttcttgagcatgctgaacatacttattttatgttatttgctaatctttccaattcctgaaacctttacagatctcattctgtggattcttctggattctaattcatggggcattttttttgttttttgttaattcctcatactttatctgtggggaattacttgaagcctgggttgacaatgaaattctgcagagagaatttgcatttgattctactggaggaacagtcagccccgatatcagtttaaattaaaatctctgcttaaggttttcaggcaacctgcttagcatgaatcctggctggaaaagcatgtgaggaccagtttatgattacacattcacagggtgtcatgttttcttccaacaccaatgctagaggtggcagttttgcttactgcccttggagggacaggggagtgggcatgggcatagtagtatggttttccttttcactgggggtgcagcccttggagtctcagcttaatgtgttggggaagtggtctcctattagactctccatttcaaaccattccatgattttgtcctccttttgccaccttccgagcctgtaaaaactaatgtttgtgattcctgaggtttctctaatgtcttttaataaagttgacctcagagatctcgttacctctctgagttcctgctttgtcttagattttgatccttgagtgttctttaatcttttagcaattccttgttgcatgttaaaagattagttatattttattcctcatttgtgttcgttttcaccaggaggctcaattcaggcttctttgcttacttggtgtctctagttctggtgcctggtgctttggtcaatgaagtggggttggtaggattctattacttacctgttttttggttttattttttgttttgcagttctccgggagatgttgcataaccactccttcgtgggctgtgtgaatcctcagtgggccttggcacagcatcaaaccaagttataccttctcaacaccaccaagcttaggtaaatcagctgagtgtgtgaacaagcagagctactacaacaatggtccagggagcacaggcacaaaagctaaggagagcagcatgaggtagttgggagggcacaggctttggagtcagacacatgtggtttcaaatccaagttcgaccatttcccatttatttgactgtagacaagttacattcctaaactatgtctcagatttctcatctgtaagttgtggtattactagttaacatgcaggggttttgtttgtttgtttgtttgtttgtttgtgagggtaagaaataacccaagaagcctagtccttggtagttgctcagtgccctataaatgttgtgaaccaggtggtgagggtttggtgctgctagagaattctggtatctgctctgtgcaacagagtactgtaggtgatgcaagagaaagaagacctgatgccttctttcctcccagctttgagaatggagcaaaggcctaccccagccaccaagtgagccagtgggcttgatcagcacaggaaaggtgaccccggcagtttcatttgactattgcatggctggcaacatttctattgattgtttccagggaccttggcggatgagctcctgttgagtctagcatctctgttaaatctgttctcaaataggtaatgcatatgggaggatgctgccaccttgcatctactagacatcacctatctactgtgagactctccctctaagccctgctgtggcctcagagtgcttattggccctgtgagtggggcagccactatacattgcatggagttggtacatgagatagaaacctattcgccatcccttgaaactgccccagtccagaagcttcctgttagcacatgtacctccttgtatgtattcagaactcattccatttaggcttggaaacccgtttggtgcaactctgttcaagttccattgtctgctttgagaatgcttgggcttgtatagtgagctgtcactttttaatttgttaggaattctactcgccttgctttttcttttccagcatgtttaagggaatgacctccaaggccccaaatcacagttgtattcatgttctttcatttcacagatacaatccaggccagtcccagatttgcagctgttaataaatgtgaatggttttccagtaagggggtagaaaaacatagggagagaaccgggttcagagttcaatatctggattcaagtccttcctttagcactttactaactgatgtagaataagtcagctactcaataggtgcctcagtttccccaccaaaatgcagacatagaaggtgctttgtctgctttgatgagaagtctttaagcaagtctatggggttcaatgtgttttaagaactataaagtaccatataaatgtggcctttattcccattgtgttcttggaagtaattcaatatagtgtgtacttcatagctgcttttggactattgccagccagtgtatcatcctaaactacatgtcagcatagtataatcctgccttaggtctacttttgattatttaggaagactccctgcccttcctatacatttcacataatttttaataagttgtaaaaaagtgatttataggattctttgtaagtgggggaagttaagcagacaaaaagtttttaaatcttactgcagagtgtcaggaaccttttatagcaccagacaggtagggacagaacatgagtggcagcaagccagacttggtcttagtgctctaacctgtctgttagaggctggccagtcagacccctggttgaagacgttgggaatcccagctctttggaggggtaagagattttgttagactgttaaccagattccacagccaggcagaactatttctgtctcatccatgtttcagggattacttctcccattttgtcccaactggttgtatctcaagcatgaattcagcttttccttaaagtcacttcatttttattttcagtgaagaactgttctaccagatactcatttatgattttgccaattttggtgttctcaggttatcggtaagtttagatccttttcacttctgaaatttcaactgatcgtttctgaaaatagtagctctccactaatatcttatttgtagtatgttaaatttttctaaaacttctaaggatagttgctgtattgtatgatttgcatatggaggtatctataagaagttttatactttttagcaaaatagtcatttggtagccaacttaaacaaatgtttattaatatagaagttaataatatctactgatactcggccgggtgcggtggctcatgcctgtaatcccaccactttgggaggctgaggcgggcagatcatttgaggtcaggagttcaagaccagcctgaccaatatgatgaaaccctgtctctactaaattacaaatattagcagggtatggtggtgggcgcctgtaatcccagctactcaggaggctaaggcaggagaatcatttgaacccaggaggcagaggttgcaatgagctgagatcacgccactgcactccagcctgggcaacagagcaagattccctcaaaaaaataaatatctactgacacttaatacttggaaagggataaaaataaacattgtctaaagccgtggtccaaacacaacccctgccaacaattttagtccatttcttccaagacttttttttttctatgccttttgtgaaaactgtcaaaaactttttcaatgctgaattttagttctgagttaaaaatcatactacctgtttatatggtttcatatccacttttttcatgtgatatactctacaaaaagcctgctgagattttgattgggattatgttgaatctagatcaatttagggtgaaaaacttttgttagataaatcccttagtatttcacatttttaaatgctaaatggcatttttcaaaaattttcttttttcttttcttttttgagacagagtcttgctctgttgcccaggctggagtgcaatggcaaaatcttggttcactgcaacctccgcctcctgggttcaagcgattctcaaactgcctcagcctcccaagtagctgggattacaggcatgtgccaccatgcccggctaattttttaaactatttatagtagagagggggtttcaccatgttggccaggctggtcttgaactcctgacctcaggtgatctgcccaccttggcttcccaaagtgctgggattacaggtgtgagccactgcacctggcctcaaattttttttttttttttttttaagagacaggggtctcactcttgcctaggctggagtgcagtggcgtgatcataggtcactgaagctttgaactcctaggctcaagtagctaggaatacaagtgtgtaccactacacctggctaatttttttaaaaaaatttttttcgtagaaacgggagtcttgtgttaccaaggctaatctcaaactcatggcctcaagtgatactcttgcctcagcctcccagagtgctaggattgtaggcatgagttacttcacccagccaaaaaacttcaatttcctattgtttatttgctagtatatagaaatacatatagttttgtaccttgatgctgtatcttgcaaccttgttaaactcacttactagttctagtatattttttgtagattctatcagattttctatatatgtatcatgtcttctgagaataaagaaacttttacttcttgctgtgcaaactgaacaccttttctttctttctttctttttttaagacggagttttgctcttgtcacccaggctggagtgcagtggctggatctcggcttactgcaacctccacctcctgggttcaggcaattctcctgcctcagcctcctgagtagctgggattacaggcgctcgccaccacgcccggctaatttttttgtatttttagtagagatggggtttcaccatgtggccgagctggtcttgaactcctgacctcaggtaatctgcttgtctcggcctcccaaagtgctgggattacaggcgtgaattactgcgcccggctgccttttatttctttctcttgactgactgcactggctagagcctccaatacaatgttgaatagaagtggtaagaatgggccaggcatggtggctcatgcctctaatcctagcactttgggagagtatggtgggcaggttacttgaggccaggagtttgagatcagcctggcgaacatggtgaaactctgtctctattaaaaatacaaaatatagttgggtgtggcagttcacgtctgtaatcccagctacttgggtggctgaggcatgagaatcacttgaacccaggaggcggaggttgcagtgagccaagaatgcaccactgcactccagcctgggcaacacacacacacacgaaaaacgaagtggtaaggatggaaatccttctcttcttcctgatctaagggggaaaggggaaagttacaaaacattcagtatgctgttagccatataggtttttttgtagatgcccattatgaggttgaggaagttccctctgttccttatttgctacagattttatttaggattggatgttgaatttttttcaaatgctttttttgcatctactgagataatcatatgatttttcttttatagtttgttaatatagtgaattacattgattttcttatgttaaaccaatctttgcattcctgggatgaactctgcttggttataatatataatcctttttatttattatgggatttgatttgctaaaatttttattataattattttatctgtgctcatgattgttactagtttatagttttcttttagtctttggtttttgtatcagggtaatgctggcctcatagaatgagttggtaagtatcccctccttttccattttctgaaagagttttgtgtagaattgatgttaaaattattgcttaatgtttggcagaactcaacagtgaagccatctgggcttggagattttcttcatgggaaggtttttaactgcaaattctatttctttaatagtatagagctattcaggttatctgtttcttcttaggtaagctttggtattttgtttctttgaagaaatttgtcgcatttaatctaaatttttaaatttactgacataaagttatttataatatttcttattcttttattatctatggatctcttggtgacataacctctctcattcctaatattggtaatttcaggcttttctttttaacttggtcagtctggctagaggtttatcaattttattgatcttctcaaagaactaacttttggtttcatagatttttctattttctatttcattgatatctgctctgacttttaatctttcttatacctattttggtttaatttgtcttctgtttcacatttctttttttttttttttttttttttttgagacagagtcttgctctgtcgcccaggctggagtgcagtacagtggtgcgatcttggctcactgtaacctcagccttccaggttcaagcgattcctgtttctaagcctcccaagtagctgagattacaggcatgcaccaccagctaatttttgtatttttagtagagatggggtttcactgtgttggccaggctggtctcaaactcctgacctcaggtgatccacctgccttggcctcccagagtgctgggattacaggtgtgagccactgtggctggcctgtttcacatttcttaaggtagaagctgaggtcacggatttgagacctttcttcttttctaatacaggtgttaagtgctacaaatatcccttaagcactgcttcaacagcatcccacaaattttgatagtttgttttcattttcattcagttcaaaataccttctaatttcccttttgatttcgtctttgacctacaggttttttagaactgtgttatttagtttccaatctcttgaggatttttaaaacaatatgttattgatttctaatttatttccatctcagtcaaagaacatacttgcctttttttatacatttattgaaactttttttatggcccagaatatggtctgtgttggtaaatgttccatgtgtacttgaaaataatttgtattctgatctcattgagttgaatgttctaggtatatcaagttgatagtgatgcccaagtctcctgtatctttactgattttctgcctgttctgttattgagaaaggggtattgaaacttccaactataattatgatttgtctgttctctttgcagttctcttagtttttgccttcatatatatatacatatatatgtatatatatatatatttttttttttttgagatggagtcttgctctgttgcccaggctggagtgcagtggtgtgatcttggctcactgcaagctccgcctcccaggttcacgccattctcctgcctcagcctcccgaatagctgggactacaggcgcccaccaccacgcccagctaattttttgtatttttagtagagacagggtttcaccatgttagcaaggatggtctcgatctgacctcgtgatccgcccagcttagcctcccaaagtgctgggattacaggcatgagccactgcacccagcccatatattttaaagctctgttattgggtacataaacatttaggattgttatatccttttgataatggactcttctattatgaaaagataatatactgtgggtttataacatatgtaaaagtatgagtaacatattatcagaaggggagaaatggaagataacttaggcatcttatttttaagcatagttttccctttgtttctgcattagatgatttacctgaaatgtcattcaatttaacttactctccatcctcacccgcccagctttggttatgaggcagtagaaagaaatgatctgcctgtggttttctagaaatacgaaagttgagtccttaaggctacacagaaagaaagtacctccccagggcttcacccttcccatcctttcagcaggctttttgtctgtcgtatcttctctgttgaaatggccattgacaagaggaggaaaggggttttgttgtggattgttcaggcacttcctttggggtatatgggggatgagtgttacatttatggtttctcacctgccattctgatagtggattcttgggaattcaggcttcatttggatgctccgttaaagcttgctccttcatgttcttgcttcttcctaggagccagcaccgctctttgaccttgccatgcttgccttagatagtccagagagtggctggacagaggaagatggtcccaaagaaggacttgctgaatacattgttgagtttctgaagaagaaggctgagatgcttgcagactatttctctttggaaattgatgaggtgtgacagccattcttatacttctgttgtattcttcaaataaaatttccagccgggtgcggtggctcatggctgtaatcccagcactttgggaggctgaggtgggcagataacttggggtcaggagttcaaaaccagctggccaacatgatgaaaccccgtctctactaaaaaaatagaaaaattagccaggcgtggtggcgggtacctgtaatccaagctgctcaggaggctgaggcagaagaatcacttaaacccaagaggtagaagttgcagtgagccgagattgcaccactgcactctagcctaggcgacagcgagactgcgtctcaaaaaaaaaaaaaaagaacgttccaaggtcaggactaggcctcccctcagaagcagcaagtgacatatgtgacatcctctccactccctatttgcatttctaggttatataactgtactactatccatgcatgcctactcttgttcccagggtgaaggacccagacatggagagccgaatccctgcaggccattataaatgagattatgccatttgctcccatttcttcttattctttcatttttggggctctccatcttgatgtgttctttggatcgtgaacagatccaaagaaaaggttgttctgccgtgctgtttgtcaggatgaaaaactcttttttaagtgtttaggtctgcccccagtgcccagcccaatcaagtaacgtggtcacccagagtggcagataggagcacaaggcctgggaaagcactggagaaatgggatttgtttaaactatgacagcattatttcttgttcccttgtcctttttcctgcaagcaggaagggaacctgattggattaccccttctgattgacaactatgtgccccctttggagggactgcctatcttcattcttcgactagccactgaggtcagtgatcaagcagatactaagcatttcggtacatgcatgtgtgctggagggaaagggcaaatgaccaccctttgatctggaatgataaagatgataagggtgggatagctgaaggcctgctctcatccccactaatattcattcccagcaatattcagcagtcccatttacagttttaacgcctaaagtatcacatttcgttttttagctttaagtagtctgtgatctccgtttagaatgagaatgtttaaattcgtacctattttgaggtattgaatttctttggaccaggtgaattgggacgaagaaaaggaatgttttgaaagcctcagtaaagaatgcgctatgttctattccatccggaagcagtacatatctgaggagtcgaccctctcaggccagcaggtacagtggtgatgcacactggcaccccaggactaggacaggacctcatacaatctttaggagatgaaacttgcccatctctaaaatttcgggatttctttgtacccaacaaggttcaaacacaacagtcagcttttattcatgatttttacttccatctgctgatgtagaacatacctccagagtgacctcagaaattgtcaaatgtgaaaacacaagccatcacagtgagaaatgggaggttgagttagattgtctaaggctggagagtccatatactcccactgttagctctgaagtgtgtagccagtcttcagattctgggtcagttgcctcagtctctcttagcttttgccttactctttatccgaccactgccctgccaggaaaacaaggctctataactcctcttacaggtcagcttgacacaaaaagggtgcctggattcctaatgtttcattgtcacttttcccagtcagatgataatgcttttcaaatcaacatatattttgggggaggttggaagggagagttgaaatattctaagaatcaaagagtagcccactttaatcagagtatgacccctgattgctcacagtcatctcctgagcagtgtgagcgagtttcagatgaggaggctgaaggccagtcaggcatgctcgaggattccaagtctgtaggtgggagggcagagatttagtcctgttggccaaagcctctagggaatttctcactccagtggagaaggcaacacacttaccaaactgtgtggaaactatctcatttgattagaaattttacctcaagaagaggaaggacagttgagaaagaacattttcttacacatgagacagctaaggcttacaagaaggagaggaataatgaggcaaaataatcctcattaatattttcattcctcccctggggattagaactactttcagacccgattttaatggtaagttaggtacttcctacagttgccatccaaatatcagtcaggatcagacatgatgttagctcctgctacaataaaaccattttctccctgaatgaaaacaaaggttccacaggagacagtcccacagagcagtggcttcttttcctccctttaaaacctcatgttggctggacacagtggctcacacctgtaatcccagcattttaggaggctgaggtgggaagatggcttaagcccaggagtttgaggctgtagagctatgatcacaccactgcccttcagcctgggtgacagagcaagaccttgtctctaaataaacaaacaaacaaaaaatcctcttgtgttcaggcctgtgggatcccctgagaggctagcccacaagatccacttcaaaagccctagataacaccaagtctttccagacccagtgcacatcccatcagccaggacaccagtgtatgttgggatgcaaacagggaggcttatgacatctaatgtgttttccagagtgaagtgcctggctccattccaaactcctggaagtggactgtggaacacattgtctataaagccttgcgctcacacattctgcctcctaaacatttcacagaagatggaaatatcctgcagcttgctaacctgcctgatctatacaaagtctttgagaggtgttaaatatggttatttatgcactgtgggatgtgttcttctttctctgtattccgatacaaagtgttgtatcaaagtgtgatatacaaagtgtaccaacataagtgttggtagcacttaagacttatacttgccttctgatagtattcctttatacacagtggattgattataaataaatagatgtgtcttaacataa

SEQ ID NO: 2 - DNA, 87468 bp, Homo Sapiens
gccgaggaggaagaggttgatggcggcggcggagctccgagagacctcggctgggcaggggccggccgtggcgggccggggactgcgcctctagagccgcgagttctcgggaattcgccgcagcggacgcgctcggcgaatttgtgctcttgtgccctcctccgggcttgggcccaggcccggcccctcgcacttgcccttaccttttctatcgagtccgcatccctctccagccactgcgacccggcgaagagaaaaaggaacttcccccaccccctcgggtgccgtcggagccccccagcccacccctgggtgcggcgcggggaccccgggccgaagaagagatttcctgaggattctggttttcctcgcttgtatctccgaaagaattaaaaatggccgagaatgtggtggaaccggggccgccttcagccaagcggcctaaactctcatctccggccctctcggcgtccgccagcgatggcacaggttagtttcggcagccccggccttccacgttccctttaatcttttctactcggtgcgcctttattcttccattttttttttcttcctctctctctagttccctgccccttaattaattttaaaggtatttgaatgagctggtcgaagacgtccagtagcccaaccattttctttgcctcctaatacattgattgcaacactatgtcatatcggtgtgtgttctggaattagagctcgtaagtgggtgctatatagaaatggcctgtattgttgctctcatgcaatttaatttgggaaatgccaatgcatttgtgtgtaagagctcctatgcaatttaagtttcattttttttgttcttggcaaatgaatttcgaatcctttctctttactgtacttactgtgtttcctctactttccactcttcgaaattttctctcctttgcagaatattttctgttgaggaatagggtgtaaaaaaatcttgattttgtgtgtgcgaggtccaagatttcaggttagaggtgaagtttaacaattcttttatcttacctaccattcttagcttttttttcctttttcttcttatttgctttaagaatcaatatggagcgcagttcatttcacatctcccagttctttggtgtgagaccaaaatgtctgaaactctgggtttttaggttgggagaacaggggcatgttctttgcagtttgcagtcactttctcattttaggggaaataagataaacaattttgtggagttacgtacctggaaatcaaggttagaagttgaaagagttccaatcatgaactacaaacgtgaactgattgtacaaaagtttaaaatgtgcattaggtttggtgtttgtgtgtgtctttgtctttttacacttttaaacatacttggagatcaagattttcgtttaaaagctttacgaccagttcattcagttgtggactagctcctttgtcaggagaagttcagggagacttcttccatcatcccttcattcttttcttacagttagtttaatggtgttatcctgatgggtaaggaccttttctttgctgggataatgaagatgaagaatggctggccatctgacagtccacaagatgttcccctttactacggagcatctctttaactccctgagagcaggctcagcgtcatccctccatctgccagtgagagtgcataatggagttaaatgtaccctttgagtttgtagagaacttcgagagcatgtttctaaataggcttcatttcagagggtgaaaatgggaagacagagctaatgctttgaattcgttgcttttataagaaagatgtgaaatgaatttaagttaacctgcaaaaattgagaagtaggaatcttgcgagttcctctacctaaggcttgtaacattgattatgcatgaactttgatctgtacctattctatgaaggtactgtagtctccagggatttttttagctggttttttccttcagaattcatacacatacacaaacgtcgttgtattcctttgcacctactaaagtgccattcagaaacattttttagatcatctttagagacttaatcacctgtagatttttgtggtgtttctttcgtatttgtgtaatgtggtagtttttgctttttagttttggtgtaacgtggtagtcgattttacattggagttagccagtgacttggaacgtaggggaaacttttttgtgtactttgagtagtcctgatttgagcagtttcgtcttggagctgtattgtttaaatacttctgttcaggtgtgctactactttctccatgtcggtctgttttgctacttgaaatatctttgaataattacaagagttttaaatgtgttaagtgggcttttatagtttaaaaaaaaactcaacattgagattaattcattcactcataatgctaagagtttatcttagttacttttctaaattttgtaatgagggttaactttacccccctccccaaatcaagattctactccaggaattctttggtgtacggtttttaattgtaaccagtctgggtttgggggaggggagaagtgagtataaagaaaatactgtccctctgttaacttacttcaagttgggtaccattgtaatttttttttttttttttttttttttgagatggagtctcattctgtcacccaggctggagtgcagtggtgcgatctcactacaacctctgcctcctgggttaaagcagttctgtctcagcctccctagtagctaggactacaggcgcagaccaccacgcctggctgatttttgtatttttagttgagacaggatttcaccatattggtcaggctggtctcgatctcctgccctcaagtgatccacccaccttggcctcccgaagtgctggggttacaggtatgagccgcccggccagaggtaccattatatcttgaattttttttttttgacattctgcagtttgtaatatgtttgcaggtaacttttattggaggcacatcacctcttaaaacttttaagtttcaaacttgtaacttttgatttttgagttgtcacttgggtattttataaatgtgaaagaaaattatttcttgatattatggtttttgtctagaactggttgaaataagcccgaaattctagcacctaaaacttttttaaaaaaagtgatttaggcttgcaaatttcgtgatgtaaatatatccaccaagagcgttctaatgtcagctttaaaggaaagaaaactggaatccaatgggatgacatgctaaagtgttacaaatcaaattattacttaaatctcaacctctgaattgctgtttaatactcagatattctcctaaaaaatttccaggttgattcaaataacttaggttaaactcaacttttacgtgttgggatggggaagagaagacttatttgtagccttcacacctttatgttcctgtttcagtatttgcatttgatccattgaaatttttatttcatttggtatggttagggtaaaacaaatcatttgagaaatgacattttgttctccctctccctccaaaaaaaaaagattatgaaagccacttgtaaactttttttgtaaaaatgaccaaaagactggaaaagttaatgttaggcaaatcctggaaatatcttttggagctgtttctgatcatcttgagtgatggaaatgatgagggtcatctgttgtcttcattactcagtgaacacgttttgtcactgcttggtaaacgcttaatgccgtatgcacttaaaaagcacctggaaagataggattttaggatctggcatataattaagtagggtaaagatccttctggtcttggtacagttttgtggccctgggttttgtgcttttttgttttttgagtttttcccccatttcaaagacacagggcagatagtgtgtaaagtatacctgctttttgaccagtagattaatgtacacagtggagaagtggtaaggctttttaaaatgtcagctctactttttttttttttttttttttttgagacagaggtttgctctcgttgcccaggctggagtgcagtagctcgatcttggctcactgcaatctcaacctcccaggttcaagcgattctctgcttcaccctcctcagtagctgggattgcaggtgtccacaaccatgcccagctaagttttgtattttttagtggagacagtatttcaccattttggccaggctggtctcgaactcctgacctcaggtgatccacccgcctcagcctcccaaagtgctgggaatacaggcgtgagccaccatgcccggctgtcagctctattttcttaaaatgccattgtgttagtggttcgtcatcctaaccaaaacattttgatcaagaccatttattttccagctctgtaacttgtgatatgctatgttttattttattttggcttgaatgtttacataagagtttgcttctggagtcttgcagatatagctcctgatttagtgaggcatttctctcctcagtattaaattgcaaaacattttactaaagtgctttaagtttttctggcaattattctcaaggccttgtaagttcatttataggacttcaagaaggttgtctctggttgatagtgagataaagtgacttttaagttgtaaatcttgaatgcgttacaatatgggggtcttattccagcaggagttcatcttctatagcagaggttggaattgtattggcatgtccagtgaatggataatagggaggagggaggaaagggtttctgccttggtggccttttggcattattttgtgtttttctttgcttttctctctcttctttatttaataaaaacaaaaaaatggaaacagttgaaaattaatgcaaagtggtatttgtagggacattaagtggtaaataggaaagagaaaaagagtaggaagagtgttgcagatacaagtgggagtgtaaaatactttttcctggtatatttacaaaaacaatttgagagttattctgccaattcatatacccagcaattaatggaaaagtaaaagatgctagttttatgtttgtccagattttagggtttccttctttgaagatttctaaagttgaatatttttttaagtgaggcaagcagtaaaattaatgggcaaatgaaaccaattataccaagtctaaaatttttcttttttttttgaggcagagtctcgctttgtagctgggactacaggcgcctgccaccatgcccagctaattttttgtatttttagtagagacggggtttcaccatgttggccatgatggtctcgatctcctgaccttgtgaacctcccatctctgcctcccaaagtgctgggattacaggcgtgagccaccgcgcccagctaaaaattttttttttttttaatacttttaagttttaggatacatgtgcacaacgtgcaggtttgtcacatatgtatacatgtgccatgttggtgtgctgcacccattaactcgtcatttagcattaggtatatctcctaatgctatccctctcccctccctgctaaaaaattttttaacattgaacttcgcaggtgattttttttcgcttaatagacggtagtttcattttgaaattttcatgggaaattactgctcactttcccagaagcgcttaagaggataaataataattgaggtgttaagcctcttctgagcaatttggatataatttgtttttagatctagattcttttttataaatgtcccaaagcaattagaagtgattgttttttttgagacggagtctcgctctgtcgcccaggctggagtgcagtggcgcgatctcgggtcactgcaagctccgcctcccgggttcaagccattctcctgcctcagcctcccgagtagctgggactacaggcgcccgccaccacacccggctaattttttgtatttttagtagagacggggtttcaccgtgttagcaaggatggtctccatacactgacctcgtgatccgcccacctcagcctcccaaagtgctgggattacaggcgtgagccatagcacctggccctagaagtaattttgttgagagagagagagtaaaactaaaagtactgaaaagagtaagagagtagctaagagaatgagtattggagtcagactgctagagttcatagcccaggcttgtatttattaactgtgaactttgggccaaatacttaacctggctcaacctcctcacatttattcctaaccacagccctgtaaggtgggtgcgcaccttataggaatccaccttacttacccaccttacaggattgtggttaggaataaatgagaattctctttatcagatgcttaggactatgcttgcttctgtgtagtatgtgttcattgttaactgtttttaactttactgctaaatatatcagaaggaaagcagtggtagatggtttgggggttgtttttgtttttttgatttgcaacgaagtcttgctctgttgcccaagctggagtacagtggcgtgatctcggcctatgacaacctccgtctcccggcttcaagcgattctcctgctcagcctccggagtagctaggactacagctgcgcagcaccatgcccggctaatttttgtatttttagtagagacagggagtcctgacctcgtgatccacccacctcggcctcccaaaatgttgggattacaggcatgagccaccgcgcccggcctgtttttgtttttcgtggatatacagtagtccccccttatccttgcgggatacattccaagatctccagtggatacctgaaaccctgtatagtagtgaatataattgtcatcagtcagaacacgtttctgtccgtgtcttccacacacaaatttaatgccttttccatcttaactaatcacttgtcatgcactgtggctgtgatgtttgcagtttgaggtacaacagcaaaactatcacgaatttttttccttcacaatttcatgtatagatttgatctttgtaacctccgcatacaattttttttcattccttattaagtcaagaactttcaccttcaagcaatttacagcttctctttggcatatccatatagctgtcattgctacttttggacttagggactgtcattaagtaaaataagggttacttaaaactcaagcattgccctgccccatagtcagtctgacaatctgataactgagatggctactaagtgacaaatggctggtagtttatacaggtgaatacattagacggaggggagattcactacccggtcaggtgagatttcatcaggctactcagaatggcgcacagtttaaaacattgttgtggctcacgcctgtaatcctggcactttgggagattgaggcaggaggattgcttgaggccaggcattcaagaccagcctgggcaatgtagtgggaccccccatccccccaccatctctagaaaaaaaatttaaaaagtcagcaaggcatggtggcatgcatctgtagtcctagcttcttgggaggcttaaggtgtgaggatctcttgagcccaggagttttgaggttacagtgagctatgatgacaccactgtacactccagcctaggtgacatagcaagactctgtttctaaaacaacaaaaattagtgtttatttctgcagttttctttgtaatatttttgtaccacaggtgtttgaaatggcagaaaatgaaacggggtaaggatgaactcctgtatagatagactggataaagagaaagccaagtgcatgatgttcatagaggagtcttaagagtaagccttatgtcatctatccaaatgttgttttctaggagtataagaatataggaacagagcttaaaatggaaaaatactgtacagttagccttccgtatctgagggttccgtgtttgtggagtcagccacagattgaaaatatttaggggaaaaaaatccatggttgcatctgtactggacatgtacagactttattttcttgtcattattccctaaacaatacagtgcaccaactatttatgttgcatttacactgcattaggtattgtaaataatccagaaagaattcaaagtatatgggtgggtgtgtgtaggttatatgcaaatactacatgtcccctttatatcagggactggagcatcctcagattttggtatctgcagtggagggagtggattctggaaccaattcccagcagataccaagggacaaccatatatatatagtatcatgacatcttgtatcatgtcacgtatatatatatcatatatattatcatgtcacgtatacaagacatcttatatatcctatcatgtaagatgtcttgtatacgtaagtaatagaaatgaaaatcagcagatagttaaggcataatgagaaaatggaaaacattgttcttgttagaaatgtttaagaatggcttcttgataaagaactgtgttaagcatattctttcttctttttagacacagagtctcactctgtttcctagacaggagtgcagtggtgcaatcctggctcactgtagcctccatctcctgggttcaagctattctcctgcctcaacctcccaagtagctgggattacaggcacctgctaccatgcctggctaatgtttgtatttttagtagagatagggtttcaccgtgttggccaggctggtctcgaactcctgacctcagtctgcccacctcggcctcccaaagtgctggtattagaggcgagagccacagtgcctggccaattaagcataattttttctatttttcattttcttacatggatctttttttttttttttgagacggagtctagctctgtcacccaggctagagtgcagtgacacgatctcggctcactgccagctccgcctcctgggttcatgccattctcctgcctcagcctccctagtggctgggactacaggcacccgccaccatgcccggctaattttttgtatttttagtagagatggggtttcaccatgttaggcaggatggtctcgatctgctgacttcataatctacccttctcggcctcccaaagtgctgggattacaggggtaagccaccgtgcccagccacctgggtcttaaagaataaattttcttgagatggagtcttgctgtgttgcccaggctgaagttatcctcctgcttcggcctcctgagtagctgggattgcagatgtgagccactatgcctgcctctaagaaactttcttataaaggaggaagaagaaaagtagcagtgcagtgctccaaagaatttttttacaacacttaaggaagaactacctttaacttgtagcactagagactctgtttcaaagaatgcacaagaatacttacccttattacttgtaatatactctcatattttctgttgcttttttttcttttctttttttttttttttttagtactggttgcagcctactatattgatttttatgacccactgttggcttttgagccataatttgaagaatactggcgtagaagagttgacaagatggcagttattctgtattaggccaacattttctgtatgccaggaacttatcctctgtacattgttccttctttccttcctggagtttatagataagggaagaagactggcattcacggagtctggtgtgatcagcattgtatttgggaagtacgtatatagtgggaggaacaggagaacctaacccagtagttatcctggtggctgtctttgaggaattgtgtctgattttgggatctcacagatagagataggattagtaaaaatgagcccaggctagaaaggagactgtgtgaggccaggtatatcctgttctgggaacctgtgagtgctgtctgactggtagaatagccaaaaacttgactgtagaggtgagcaagggggccaatcatggagggcttataatacaggaatttagactttccattttacccatttaatggatggggcagaattgtgctttaggcagttaagtaaaaggaggaatagtttgggaagaacagggaaaaacaggaggcagggagaccagtgaaacagctgttttagggttccagccacccttaccacagaagatggaaagaagtggaaagatttgagggaagatggatgatcagcagaacttggtgactgattagaagttaggtagtaagatggacaaatcaaggataattccccagtttaaagtttgagcaacttgttgggtgatgatttatttattatttatttatttattttgagacaatctctgacccaggttggagtgcagtggtgtgatctcagctcactgcaacctccgccttccgggttcaagcgattctcatgcctcagcctcccaagtagctgggactaaaggtatccaccaccacgcctggctaatttttgtatttttagtagagatggggtttcaccatgttgatcaggctggtctcgaactctggcctcaagtgatctgctcgccttggcctcccaaaagtgctgggattacaggcatgagcagctgtgcccagctggataattatttaataaattggggagcataggaagcatagtatttgtgaagtgggtaggcaggtgtgatgggggtagtgatgttacatttggggcattttgaagttggtggttcttctgagttgagcagtcagtcactcttcatttgctgcacctttatctcattttagccaacagacattgaatacctaccaagtcttaggtatttgcaatgtaaagacaaattaaggtgccttctgctgtcagagacttcagagatacagtggggttggtatacatgtccacacagttttcccgtaagttatgctttaaaaggttttttaaatgttatatataaaggcaggggatgggttgcttttgacagagtaggtttggagcgttgatggaaaacttcatggagaaaatgtatatttgaacagggttggtggaaattaacataccttagaagtagggaaagttggaagggtttttcagatgaagctaacatgtttctgatgtggctagaatatacgctgtgtgatagggtttttcatgggagagagatgggaaaggatgttggggttctattgtggaaagagaaatatgctaaggaatttgccatttatcttagcatcaggataagaattgtatgagcaggggagtgacatggttggggaaagactaattctggtaacaccgtacagagcagcagtaggtagaacctatggcaggaagactaggagtacattatttacctcttttgaaatgagtttgtcatttgccttggaagtttttggtacattgtaattaacaaagtgaattgtttattttgttcaagatccatgcttggtttgccagttgttataaatgtagaaaatataccagataccaacttagaaaccattcactctccttgttatttacagatatgcaaggtttttttgttgttgtttttgttttgttttgtttttaaagggtatgtttctccatctaggattccctgtaggccttcccttgtaacaaatctcaaggtttgctcaaaatcaagaaatgttcagtgacagttaagttagcacacaatttaggcttactataaaacatgtccttgagttgattcttaaggtgggattttaataaataatagtgtcttcatcatgtagtttttttggtttttttttttcatacagagtcttgctctgttgcccaggctggagtgcagtggtgtaatcttggctcactgcaacctctgcctccccggttcaagtgattttcctgcctcagcctcccaagtagctgggattacaggcgcccgccaccacacccagctaatttttgtatttttagtagacacagggttttgccatgttggccaggctgacctcgaactcctgacctcaggcgatccgcccgcctcggcctcccaaagtgctggggttacaggcgtgagccaccatgtccggcctcatgtagttattttcacaagaagtgtcactatattaatacattgaaaaagagcaaggtgaattgtcaatgtgaattttctaaacatggccccaggtcacattcttgatcaattaaagcacttcacctctttaaaattcaagacttaaggctgggcgcagtggcctacacctgtaatcccagcactttgggaggctgaggcaggtggattacttgaggtcaggaattcaagaccagcctggccaacatggtgaaaccccatctctactaaaaatacaaaaattagctgggcatggccgggcacggtggcttacgcctgtaatcccagcactttgggaggccaagacgggcagatcacgaggtcaggagattgaaaccatcctgggtaacacggtgtaaccccgtctctactaaaaatacaaaaaaattaaccccgtctctactaaaaatacagaaaaattagccgggcgtagtggcgggcgcctgtagtcccagctactcaggaggctgaggcaggagaatggcgtgaacccaggaggcggagctagcagtgagccgagatcgtgccactgcactccagcctaggtgacagagcgagactccatctcagaaaaaaaaaaaaaaaaaaaaaaagccgggcgtggtggcaggcgcctgtagtcccagctactcgggaggctgaggcaagggaatctcttgaacccgggaggcggaggttgccatgagctgagattgcacctgggccacgagagtgaaactgcatctcaaaaaaaaaaaaattcaatattgaaatgttttgggtttttttgtttgtttgtttctttttttgagatggagtctcactctgtcatccaggctggagtgcagtggtgcagtctccactcactgcagcctccgcctcccgggttcaagcgattctcctgcttcagcctcctgagtagctgggactataggcacatgccaccacagccggctaatttttgtatttttagtagagatggggtttcactatgttggccaggctggtcttgaactcctgacctcatgatccacccacctcggcctcccaaagtgttgggattacaggcgtgagccaccacccctggcgtgttggggtttaaaaagaataaacttcaagttaatctcttcccaaagtataagtataccttttgatgtcatgatagcaggaccatgtgaagagtacatattttgaaatttgcttgcacttttgccctttcactctattggatttcaaaattcaacagctgtcagcatttgtagctgtgtaatcctgtataattatcatcttttatccaaatttgtataaaacttacaagttttcctaatttttttggagtattagagatcttgcctgtctttccagcatggatattttattttaattttcttaatgttccttcaaattacgtagtttgaaatgtttgtacatctttatttccttgctagatgggttgtttatatgattagataattcttcatttacagagggttaaagtaactttttttaaatgaagtactgaatagaggttaggaaagttgttggaacctgataaatttgtaaaatttacaaaatttctcattttaaaagctacagttttaaaatttcatgctttttaagcatccattgtaagagtaggagtgtccaaaagcaataagaacaagaaatctttgtaagattggtagtttcagtgtttagccaaaccattatcagaattagaatgactaatgttatgtaggtttggttttcaactccattctttttttgtttcattttttaaaaaattccaaatctctaacctggccttggcgctctgagtcttctgatctctgcccacctcatcactcactttgttctccccattttgtttatttcaattgctgaactggctgagcttttactctccccaccttaggttgttccactcttcatctgtcaagctcctactcatcctgtggactcaaccactgggttagatgaaagaaaagtttgacgtgtccactctttaaaaacattaagtgttttttgttgtttgtttgagactgtcgtccaggctgtagtgcagtggcgcaatcttggctcacggcagcctcgacctcctgggctaaatgatcctcccacctcagcctgtagctgcaccaccatgcctggctaatttttaaatttttttgtagaggcagggtcttgctatgttgctcaggcttgtctaaaactcctgggctcaagcagcctgccttggcctcccaaagtgccatgattacagttgtgagccacctaccaggtctggcctaaaagcatttttttatttttattttttgaggtgggatctcgcactgtcacccaggctggagtgcagtagcgtgatctcggcttactgcaacctccgcctccaaggttcgggtgattctcaagcctcagcctcctgagtagctgggattacaggcgtgcaccatcacccccggctcatttttgtatttttagtagcgatggggtttcaccatgttggccaggctggtctcaaactcctgatctccgccagcctcggccttccaaagtgctgagattacaggcatgagccacggtgcctgacctaaaagcattttaatgccacagagaaagccagctaaagggaggaggagcagtagatggattctgtcttctaagtgggatttgagaattgactggattttaaataattaataaaggtgttttacttaatgaacacagtttaagagaactgagttgattttacttcattttacctaaagtacaaaggtaagtgtgtttactcaaataatatgtgagccttttaagtaaaaaaaaaaaaaagtgtaactgtgagagatactaatatagtagaattagattttgagccaaaattgttttaattttaaattacattttgtgtcatagttaagtaactagaaaattgtctgatttatgttcatagtacagtgtttgggattatatttttaatggttctaattttgaaggttatgcttcatttatatataatacttcatttgttcaatttctcacgtatcattgaattattttgatcctttgatttttggaaaggctaaatgaaccgagattattttttatttatttatttggagtttggcttttgttgcccaaactggagtgcattggtgcagtctcggctcactgcaacctctgcctcctgggttcaagcgattctcctgcctcagcctcccaagtagctgggattacaggcatgtgccaccacacccagctaattttgtattttttttttgtagagacagagtttttccgtgttagtcaggctggtcttgaactcccgacctcaggtgatagcttgcctcggcctcccaaagtgctgggattacaggcgtgagccaccacgcccggccaccgagtttattttataagggattatatggttacatctgttgcaaggagcaaaccacaagcaatatagaagacaacaagggtgatctacagaatcagtatgtgataatgaaaggatgttttgactcaacactagtttccacgtgtttaatccaaactcagttgttgtttaaattgttaaatttctaatacacggtccactgggtaaaccatgtattaggctaaacttttctttttctttttcttttttttttttttttttttttgagacagggtctcattctgtcgcccagtctggagtgcagtggcgtgatcatggctcgctgcaacctcaacctcctgggctcaagcaatcctcccatctcagcctcccaagtagctgggactacagatgtgcaccaccatgcctggctaattttcgtatttttttgttgacactggtgtccttctacattccaggctggccttgaactcctgcgttcaagcaaccctccagccttggccttccaaagtggtaggattataggcgtgagccacggtgcccaacctatgctaaacttttcacatcagatttatatgtgtcctgtcccgttttacttcaccatgattggactcagtgtacactcagatgaagaaacttcaaaaaaaaaatactgctccttgtgaagcagaagaaagattttactgaaagtgatgtttgtattggagcatcattaaaggcataaaggaacttgtgaacaaactacttggtagaagcagcctggtgatgttgattggttgatactttaggaagcgggaaatgtcttactggagatagttccttcatttcaacagtcatttgtgatactgttttttaatatttgccataggatagttaaaaggtaatggaacaaacttcagatttataagtttttaattaaatataaagggggcaaaagtagataaatatcttaagagctcaccttactgtctagaaaaaatacttgctggcccagcgccgtggcacacatatgtaagtaatcccagcactttgggaggccaaggtgggaggcttgcctgagcccaggagattcagaccagtctgggtaacatggtgagacccccatctcaacaaaataaaaaattaggtgtggtgatgtgtgcctttggtggcagctactaaggaggattgcttgagccaggaggtgaagctgcagtgtgctgtgatcccgtcgctccactccaggctgggcgacagagcaagaccctgtctcaaaaaaaaaaaaaaacaaaaaaaaacggaaaacataagacagcaatcaaatacaatagatttggcttcagtaaatgaaaaccctcactgtaggccctagaataacaagacttctatattactaaagctgattactgcttgatgaactctgtacatgtgatgtgactagtatgaacttctgaggttgttgagatgaatgagaataaacgtgaggtgccaagaaaaatgcctgacacattgaaagtgctggataaatgtatgctgtcatcattgtaagctgggctatctcctaatagtgtaatgagtccattgaataacaataggtaacatgtttatagtgcttagtgtgtgccaggtactgttctaaacactttacatttattcactcatttaatcacaaataacatgaagtaggcactttgctgttatgcagagatggaaacaaggttatccctgcatcttttttttttggcagggggaggaggacgggaacggatggagttggtttttttttttggagcttctgagacccaagcttcaggccatgctcccccaagcacctccccaccaccaccccccaagatgtagtcttgctctgtttcccaggctggagtgcaatggcgtgatctcagctaaacggaacttctgcctcccgggctcaagcaattctcctgccccggcctcctgagtagctgggattacaggcgcctgccaccacgcccagctaatttttgtatttttagtagagatggggtttcaccatcttggccaggctcgaactcttgacctcaggtgatctgctcgcctcggcctcccaaagtgctgggattacaggtgtgacccactgtgcccatcctgttccctgccccccccccctttttttttaagttattgagacagagcctcacttggtcacccaggctggagtgcagtggcaggatcatagcgcactgcagcctcaacctcctgggctcaagcaggccctttgagtaactgggacctgtaggtgcatgccagcatatccagctaattttttttttttttttttttttttttttttttttttttgagacaaagtctcactctgttgcccaagctggagtgcagtggtgtcattgcaacctccacctctcgggttcaactgattctcctgcctcagcctcccgactagctgggactacaggcatgctccaccattcccggctgatttttttatttttagtagagatgggatttcactatgttggccaggctggtcttgaacacctggcctcaagtgatccacccgcctcggcctcccaaagtaaagtgctgggattgcagatgtgagctaccacatccggcctatatccagctaatttttaaaaataatatttttgtagagaggtggtctttctcccctcggccttccaacgtactaggattacaggcgtgagccacccttctggctgtcttttcctttttattttttcacacttccagtggtccttgggatctgtgtatactttagaatcatcttgtccagtttcttgacaaacttctagaagtttgattgatactgcattgaatctatagatcagtactggggaatgatgtttttaatactgaggatttctaagtgtttgagatattctgtttagtcagcctttacttttgagtttacacctgttttatatacattgtcagtttttccctatgttataaatctttttttttttttttttaaatttgagatagagtctcactcttgtcacccaggccggaatgcagtggtacaatctctgctcactgcaaactctgcctcctggatgcaagcgattctcgtgcctcagccttctgagtagctgggactacaggcatgtgccaccacgcgcagctaattttggtatttttagtggagaccgggtttcaccacgttggccaggctggtcttggctggtcttaaactcctgacctccagcagtccacctgtctcagcctcccaaagtgctaggattacaggcgtgagccactgtgcccggctctacattatttaaaaaattatttgtaaccatttgttgctggcatacagaaattcactttgatacgtttatatttatggtataaccagtcatcttgctaacctctcacaatttccagttgtatgtatttctttaaaattgacaacagttgtgtatattcatgggttatagtgtgatgatatatgtatttgctttgaactttctatgtcaacagttatattatctacagacaataagttttgtttcttcctttttcctttttctttctttccttcttttttgttttgagacggagttttgcttttgtcacccagggtagagtgcaatggcactatctgggctcaccacaacctctgcctcccaagtcaagcgattctcctgcctcagcctcctgagtagctgaggttacggcctgcaccaccacgtaccgctaattttgtatttttggtagagacggggtttctccatgttgctcaggctggtctcgaacacccgacctcaggtgaacgcctgccttggcctgctaaagtgctgggattacaggtgagaaccaccatgcccggacttttttctctttttttttcttttttagaacttgtaacctttttttttttttttttttttttttttttgagacagagtctcactctgtcgcccaggctggagtgcagtggcgcgatgtccactcactgcaagctccgcctcccgggttcacgccatcctcctgcctcagcctcccgagtagctgggactacaggcatccgccaccgcgcccagctaattttttgtattttttagtagagacggggtttcactgtgttagccaggatggtctcaatctcctgaactcgtgatccgcccgccttggcctcccaaagtgctgggattacaagcgtgagccaccatgcctggccacctatttttttatgtgtgtgtgagacagtctcgctctgtcacccagcctggagtgcagtggcactgtctctgctcactgcaacctctgctcccctgggttcaagcgattccttgcttcagcctcccaagtagctgggactacaggcgcctgccaccacacccagctaattttttgttttgttttgtttttagtagagatgtggtttcgctatattggccaggctggtctcaagctcctgacctcaagtgatctgcccaccttggcctcccaaagtgctgggattacaggcgtgagccactgtgcctggccaagatgaatcttatattttctttatcctttgttactatggcgaatgacagtttatagatgttctggtgtcccctggattcctgggattatcccaacttgatgatgatttttgagcctttggtttgctctttttaaagagtcttgtttctgtgtccatgaagaagattggcctgtgtttttcttatattggccatgtgtaatttttatattgttttttttttttagaagtatttgtgttagcttgaattgtattttccttgaaagtttggtgtagggcatgcctgtaaacaattcggatatggtgctttctttatggaaagattaaccaagggcttattttctctagtagcagtaggattacagtggtctggcttcccatgtgcctattacccagcttcaggtttactagtatattatactacccttccccccttttttgctggagtattttaaagcaaatcctagccatgtcatttcaccagaaatatttcaatgtatatctttcagtaaaaaggatttattttaaaataatgccattgttatagtcaataaagttaatgatttcttaatatcacccatttctcagtctgtacctaaatatgtcttactctcatttcaaaatgtgtgtttatagttggcttgtttgaatcaggattccaccccccccccaacttatgctatggatttgttggagaaactgggacattccatatcctatatgatttcttttttattaaggtttgagtattttctccggaatttatttattttgtatgttttcttcatttgtataaagttgatagtattgctttatcttttaattttctttttttcttaaccttcttgaagttcgtcttttgttactccaaaaaactaacttctagttttggtaatgctgttacattcctatttcctgtttcgtttatgcttttgtctttgattgtcttcttcatattaatactatttttctaatataatttggatacttaattcattattagcaacctcaggagactcactggagagttcattaatttgtaactttatttattattattatttttttgagacggagtctcgctctgtcgcccaggctggagtgaagtggcgtgatctcggctcactgcaaactctgtctcccgggttcatgccattctcctgcctcagcctcctgagtagctgggactataggcgcccgccaccacgccctgctaattttttgtatttttagtagagatggggtttcaccgtgttatccaggatggtctcgatctcctgacctcgtgatccgcccacctcggcctcccaaagtgctgggataacaggcgtgagccactgcgcccggcctttttaactttattttctaacataggcctttaggttttgaaatatattttttattactcaatttcctttgtgatttcttttgtaatttatcactgcctgtttttaaaatttctaaagtggagatttttttgccctctatgttcagtatgctaatgataaaatattttcttggatactccaggggaaaagtaaaaattgcaaataaagtatgatctcagttttgtaaatcacgtaagtataaggaaataatgaaggaactatatcagtatattaagcaggcatttttgaatagtggttttaggtcagttttgttacacatttgggtatttgttgttgttgttgttgttgttgtttgagataggatctcgctctgtcacccaggctagagtgcagtggtacattcacggctcactgcagcctcaacttcccaagctgccgctatcctccttcctcagcctccctagtagctgagaccacaggtacaggccactaggcctggctaagttttgtatttttttgtgcagtttggttttctccatgttgcccaggctggtctgctgagctcgagccgtctgccctccttggcctcacaaagtgttgggattacaggttgtgagccaaagtgctcagccttgtggcacatttttgatggaggagcccatatgatatttcaaaaggaaagagtaattctgtaaaactctggactctaaattatgccctgagatcttgggatacaatttgacttagttcatatatgaccacatgttggtttagttaatatatgaccatgtgcttactatgttgccagtaggcaaggagctggtatataagtggtaaaacatgtccttcgcgaagaatgcatggttggagtgaggggtggtcacaagggatggcaaggggaggagaggaggcaaacccagagataatttcagtgacatgataaaatgctaaaagatacagaaggagcaggattgggaagaaaaaaaaaaactacaagaagaggaagggcacatacaggaagagttatacttaggaactaagattaattggatcaagtagaccattaaggcaatattttgtcttcaagggatggtccattttttaagaggataatagctgtggaatttttgttgttgttagtagacaaggtctcacagtgcccagacttgatgtgaattcctgggctcaagctatcctcttgcctcagcctcctgagtagcttggactatagatgtgtaccactatgcccaacacccagtaatgcctttttaatgtgaaaactactttagagaattgaaaggaaagaaaactcaaataatttttatagtaggttaatactgtcaataggtcaatcaggagtaattttcttcccccaggggatgtttggtgatgtctggagacagttttgattgtcacaattgggatatgggtgctactggcataagtagaaagaccaggagtctcctaatgataatagagggcacaagacaatcaccctccacccacaacaaagaattatcacatagctcaaaatgttaatagtgccagggttgagaaaccctgcattaatctatacttagcacccagttttgtttgttcttttttgagacaggatcttgctctgtcacccaggctggagtgcagttgtgcagttaaagctcactacaacctcaaattcctggactcaagtaatcctcccaccttagcctcctgagtggctaggagtatagcctagtgccaccacacccagccgactttattgtttgtagagacagggtcttgctgtgttgacctgggctgaagaattcctcctgccttggccttctaaagtactgagattacaggtgtgagctaccagggctggtcttgcaccctgtttttggtaggggtggtttgtatggtgaaggagccagaggcatggtgttgtaccctattctggctagactttggttaaggaaagctattctgtaggctacaggtcaaaaactccgcctgttaaaggcctactttgaggcaggtactatataggaacttggtaaaaaatggtggatagccctctgcttaactggagcacacactgagtgttccacaaatgacaggtcttttgtatcagttgtgtgtctttatgtattacaatatttaaaatgttttctttccatcctgagtttagtttgtgtgtagatattttaactgttcttctaaggaacttgggaatattaatacagcttaattgcatttcttttttccatgactgtggatacaaacctttagctagcaactcatgtaataatgggtgttgcactttttttttaacaaaaaataaaattttatttcaactattatgctaattctataacattatttagaatgtttttctttttttaattatcctttaagttttgggatacatgtgcagaacgtgcaggtttgttacataggtatacatgtgccatggtggtttgccgcacccatcaatccgtcatctacattaggtatttgtcctaatgctatcctctcctagccccccatcccccagcaggccctggtgtctgatgttcccctctctgtgtccatgtgttcgtatttaactcccacttatgagtgagaacatgcggtgtttagttttcttttcctatgttttctgagaatgatggtttccaggcttcatccttgtccctgcaaaggacatgaactcatccttttttatggctgcatagtattccatggtgtatatgtgccacattttctttatccagtctgtcattgatggggggtgttgtactttcaatcccttttttccttggtcttattttaggtatagttcttaagtgtttaagtttgttgatataaccaaatatcccctcaatttaaaaaatctataaaatggttttagtatgacctaaaaaactaccatacaaatagtatatatatagggctgtgtgtggtggctcacacctgtaatcccagcactttggaaggccaatgcagacagatagcttcagctcaggagtgtaagaccagccaggtcaacatggcaagctccgcctctactaaaaatacaaaatttagctcggtgtggtggtgcgcacttgtagtcacagctacttgggaggctgagatggtagaatcacttgaacctgtggatagaggttacagtaagccaagatcgcgcaccactgcactccagcctgtgcaacagagtaagaccctgtctcaaataaatagaaaaacatggagtgaggttgggaaatgacatttaatgcttattgagaacaatatagagcagttttttattttggttttgtcatactttgacctttgtcttttccctttgcttttagattttggctctctatttgacttggagcacgacttaccagatgaattaatcaactctacagaattgggactaaccaatggtggtgatattaatcagcttcagacaagtcttggcatggtacaagatgcagcttctaaacataaacagctgtcagaattgctgcgatctggtagttcccctaacctcaatatgggagttggtggcccaggtcaagtcatggccagccaggcccaacagagcagtcctggattaggtttgataaatagcatggtcaaaagcccaatgacacaggcaggcttgacttctcccaacatggggatgggcactagtggaccaaatcagggtcctacgcagtcaacaggtatgatgaacagtccagtaaatcagcctgccatgggaatgaacacagggatgaatgcgggcatgaatcctggaatgttggctgcaggcaatggacaagggataatgcctaatcaagtcatgaacggttcaattggagcaggccgagggcgacagaatatgcagtacccaaacccaggcatgggaagtgctggcaacttactgactgagcctcttcagcagggctctccccagatgggaggacaaacaggattgagaggcccccagcctcttaaggtaagtacagttttggtttgtgtgcacaatcggcatgcatgtgagtattgtcatgatggatggagggtttgccttacattgtatagcagtttccactattacacgccaggaatttactgtgctgtcataagttttaagaagtgcctgtatttaagtaaaacgtttattttacagctggtattctataacttcatacttccaaatgattgctggctaatgctggttctctctggcacaagtattggaatgtttttatctcatttccaagtccagtttagccttgtagcctccttataaaattacagttttgagatggctggcattacactgtcttcagatggatactccatttgttcctattgctttgaatgtccctggttttcaagagatacatttattctgagaaatgtattaactgttatttttctttattggttgatggaaattaaggtgcatttgttcatgtgaaacctcaacagtgtagatgtttcagtgaaccagaacttggccaaagacttctgttagctttattaactagagaatgctaagtatattaaaaatattttaaacttttaaatgtggatcctgtatacataaataaggcataatcacacatactttagtgcttatttcttcatatttttctttacatattttatctgtttttcttaaaatgggatcacactatggttgccagtgcctggcatgtagttcgtttttgttgaatgagagatggcttcacttcgaagatgaaattggagataggtacgattttcacaaggagtcaagagcaagctttctctgtaacaggaataatttgagcagacatcaggacttctgtgttcctgagaatcttgggtgcagtggctcatgcctgtaatcccagcactttgggaggccaaggctagaggatcgcttgagcccaggagttaagagaccaaccaggtagcattgaccccatcttctatttaaggggaaaaaaaaaaaaagaaccttgatggtgacagagaatgcaagtgtgaattgaagacagatggacaaacttgtgttggggggaactgaggtgacatgtaggaattcaaaaaccttaaatttttttttgctgcgagaatattgacaagttaggattctgttttagcattcctttgtagattctccctttctgcccctcacccccgccaccttttttttttttttttgagacagggtcttactctgtcacccaggctggagtgcactggcctaatcatggcttactgcagcctcaacctaccaggcttaaacagtcttctcgcctcagcctcctgagtagctggaactgaaggcacataccaccatgcctggcttattattattttttttttttttttttttttttttaagagatggggtctcactatgttgctcaggctaatctcaaactcctcttgggctcaagtgatcctcttgtctcagcctcccaaagtgccaggattacaggtgtgagccactgcacccatcctctgacacttttagattgccgtgtcagtgtagtttacttagaatatttggagtgagaaccaaaaacaaggtaaattattaagtacctcttctaggatctaggaacatagctatgaagagagaaagtccttgccaccgatgtttatattctgttacggagaggagggatgacttacaataaaccctcactggtggacaaaatactttagggttaaagtagtgaatgaacttattttatgtaacctactttctactgtgcacataagatataaattttagagtatgccaggtaagtgctatggagaaaaataaggaaaggctcattgacatctgcttgggggtgtgggactattatggttataatcttaatttctttcagaaactgggtttatatagaagtgagcaaaacaaaaatccctgtccttgtggagcttgtattttgatgagaaggaggaattcaaattttaaacttctgttaaacgatattttatttccttatttgatttttattttgagaccgagtcttgctgttgcccatgctggagtgcagtggcgtgatcttggatcactgcaacctctgcctcccgggttcaggcagttctcctgcctcaggctccaagtagctgggaccacaggcatgcgccaccaagcctggctaatttttgtatttttagtagagaaggagtttcaccatgttgcccaggctcgttgtgaactcctgacctcaagtgatctgcccacctcggcctcccaaagtgttgccaccgcacctaggcctattttcttattttaaatgaatccacctatattgatattttgtagagtacttatatcagtgtttgacaaatgagggagctttaaatgtttaataaatttaacaaatgttttaagttatgtaggtttaggataagataaccacttaaggctggatgcagcggttcacacctagaatcattccagaccagccccagcaacatagtgagacccccatctctaccaaaaacaaaaaattatccttgtgtcgtggcacacccacgccagcagttgcccttccactgtaccaagtcctaaaattatcttgtagagcgaattatactcattacatttcttaaactcctaagacttgtgatatttaagaattaggatttaaggtgtaagaaagttttcagtaagatttgatgactgtaaccctgttggcaaatgacatcagcttttgcacaccgttcttgtcatggatgaatctgtggttcaggaggtgcaggcaggtggtgacattactactacagctgtcttccaaaagtctgacctatggtgatttataggaagaaacttggatcatactgccttttaccccaatctttagattcagcataaactaatcaaagccagaatgttttaagttacttttgtttttgagacaggatctcttcctatcacccaggctggagtacagtggcaccatcacagctcacttgcagccttgatctcccaggcttacgcgatcctcctacctcagactcctaagtagctagtactacaaggactgtcatgccctgccagttatttttatttttgttgagacagggtctcactatgttgtcttggcatcaagcaatccacctgccttggtcttccaaagtgctcagattacagacaggggccactaagcctggccacatttttttcaagaagaaaaaataggcatggctcagtagttcacatctgtattcctaccgctttgggaggctgaggcaggaggatctcttgaagccagaagttcgagatgtgcctgggcaacataatgagaccccatctctacttttcttttttcttttttcttttttttcaaaaaagaaagaatagttgtctgcaggacgcatttcttgtagctgcctagaactttgtgtggcttcctcaccctctcctttttagtttaggtagctatttgtatggtggtgggtaattggacatctggagcatattagctatggagaaagaaacaagatcaaataactatagtgtagcagaaattaagtacaaaatcttccttattacatttagtgtggggagtaaagaagcagggctcaggagatagaaggggcagtgatctggaggttggttggtattttattttctaattcctcagcagatctgtgtgggagatggaaaaacaaaagctagagaatcttttttggtcacagtgaccaaaagtgtcaggaagaaattactgccagctgatcagcaatcagtgtagtctgtgtatttaaacccatagtctgccatagaggagcttggagtttccaggtaatgcatcgtgatcaagggaacaagcagtgtcaggaattggttgaaattcagttggtctaggcaggcaaggcatgcaatcatgaaggaccagattgtttggggaaatatttggataaagacattacatttattaacaagagacaacaacacagcttagaaattccaacattttgttgattcagataataggactcttgagggcataatttattgtcttagtcttttattgtttgtcatgcgggttctgtgatagaatgactttcatactatatctatcatgaattttcatgctaataagaaacaggttaaacaactcccccatgtataggtatggatattattggagccacataggataaatactagtagtttaaaaaaaacataggtagcagcagcacttgcagtcagatttgtaactaccaaaagtagcctggacttgatttaaacctgtttctgcattctattgcccctgcaatcttttggccatatttacatagaatcaagaaggtttttttctttcttcttcttcttttttttttttttttttttttttggagacagagtttcgttcttgtcgcccaggcaggagtgcaatggcccaatcttggctcattgcaacctctgcctcccaggtttaagtgattctcctgcctcagtctcccgagtaggtgggattgcaggtgtgtgctaccacgcccagataatttttgtattattagtagagacagggttttaccatgttggccaggctggtttcaaactcctgacctcaggtgatccatccaccgccacctctcaaagtgctgggattacaggcgtgagccaccgtgcccgaccaagaaattatcttctctgaatgcttctcatttcaggccacctcattcttttatgcttccatcaaactgccacttgtaaattacttgtaaatcattcttgtaaattacttaccttagtctctgaatttcatctggaaaatgaaaatgttctttaacttttttttttcattttttggtaatagtataaagaagattaatttacatttttttgttttttttaatagaggcaaactgctgaaccaaaaaagatgtcatattcatagatttgcagagtatagatattgcatatgatttaaagaacgaattttaggccaggcatggtgggagatgcctgtaatcccagcacttaggcagaaggattgcttgaggctaggagttcagtcaactcctgggcaacatctctacaaaaataaaaacaaaaattagctgggcatggtggtgcaagcttgtagtcccatctgcttgggaggctgagatgggagaattgcttgagcccagaggttgggaattataatgagctatgataatgcaactgcactccaacctaggcaacagagtgagaccctgtctttttatataaaaagtaaaagaaaaattttattaagagctttgtacctgtccaaaacagatgcttcacagaggtagtaacatttgaaattacaaggatgagtagaatctgcaggtgtttcttagttaggttgtactatctaaggaaccaacagaaaatgcctctctgtgaacttggtgtttatttccaggttggcattaaggagtcaaataggaaagaaaatgtgctactgttcagttgtagggaaagggaaaagcttgaggcaaatgctggaggctcaaggagcgtgatactttcagactttaagaaatcagtacaggaaatatataagataccatagataggtagtcagacttcataaaggctttggtatacgtactgtggggttgatttttttcttttatagaggcaggtgaaaacagaagacaggcaaacctgttgtccacagtctgtacaagcactgtgataggtttgagttaagacagtcacagtaggtaggaatacatgggaagggttttagtgtctatgtgtgcttttagaggtagaattgaaggaccctttgattggtcttagcagacagaaatctggtatgaatcctttaattgggcagtagctatagtatcttgagttattctgagtgtttgctcaatgtttctagtagtgatgatgacttgtagttgggatcctatgtgtaatttggcagaagaggacggtggcttcaaactttgtttgggatataaagttgaccccattttgaattattttaaaataatttgaaagattaatgaaaatgcatttttataactttcattattagtaaaacgtttgactttagaataatgctgtttttcaattaattattattatagtataatggctccaggtgaacttaacataaatatagaacataaactactttttaaagtacagagggagccggcacagtggctaacgcctgtaatcccagcactttgggaggccgaggtgggcagatcacttgaggtcaggagttcaaggccagccttgccaacatggcgaaaccccgtctcgactgaaagtaaaaaaattagctgagtatggcggcgcacgcctgtagtcccagctactcaggctgaggcaggataaccgcttgaacccaggaggcagaggttgcagtgagccgaaattgcaccactgcgccccagcctgggcgacagagcgagactttgtctcaaaaacagagaagtacataagggttgcaaagtcaaatgacttgaagggccaagcaggtgacttagcaggtgacttaatagagcagctaggtttaaaacagcaaggaatagtgtggagtctggacttccgcatgctctatgtaaaggagtcagaatcagaagttttaaaaaacactgtcatcagtgtccctacacaaaaaaggacatattcccaaaccatcagttttctactttttatacaaacaaaatacaggaataattattcaaatgaggccaagcatggtggttcacgcctataatcgcagcactttgggaagctgtggtgggaggattgctagagcccgggaatttgagaccagcctgggcaacatggcaagaccctgtctctattttttaatagtcaaaaaaaagaagaagaagaaaacattcaaatgcttgaacatgacaaaggggttagatggcttattaagttgaattcgccatgtagcatcatgtgtgacgtaatggaaatgaatggcaaaccttgtttaacagaattaaatgaagatgattaaaagtatttctaaaacatctttatttcaaatatttatgaaaataactctgtacatttaccatacccaaggcccctaaatcttaattttgatcttaatcttgaaaatgtattgttgttagcatactttgtatagtgggttttttttgtttgtttgtttttgagacagggtctcactctgttgccgaggctggagtgcagtggcctgatcatggcttacttgcagcctcaacctcccaggctcaggtgatcctcctacctcagcctcctgagtagctgggaccacaggcacatgccaccacatccagcttttctttccttttttttttttttttttttttttgagatggagtctcactctgtcgcccaggctggagtgcagcggcgtgatctcggctcactgcaagctccgcctcccgggttcactccattctcctgcctcagcctcccgactagctgggactacaggcgcccgccaccacacccggctaattttttgtatttttagtagagacggggtttcaccatgttagccaggatagtctctatctcctgacctcatgatcctcccgcttcggcctcccaaagtgctgagattacaggtgtgagccactgcgcccggctgttttttggggttttttttttgtattttggtaccgatgggttttcaccatgttccccaggctgttgtcaaactcctgacctcaagaaaccctcctgccttggcctcgcaaagtggtgggattacaggtatgagtcgccaggcccggccacttggttttttgccatcatggctccctacaacctctacctcccaggcttcactgataatcccactttagccttccaattagctgggactataggcttgcgccaccatgtccagatttttgtattttttagtagagatggggttttgtcacgttgcccaagctgtagtgtcttttctaatagaagctgagaatttcctttgaaactgtctttgtgaacttggaagtgaaatcagaaaaggaataataatgtcttaaattttattgcttattttgttttcttttgtttcttactcttagatgggaatgatgaacaaccccaatccttatggttcaccatatactcagaatcctggacagcagattggagccagtggccttggtctccagattcagacaaaaactgtactatcaaataacttatctccatttgctatggacaaaaaggcagttcctggtggaggaatgcccaacatggtgagtactaatccattacagacttgttttcaaactggcattttgacaaaagaattgtgttaaactttcacccttctgttatatatgctgggatttgtacccactaggagcctaaattgatatgtacttgatgatccctgtgaggaggcttgtgcttcctttccatttctctgttttttttgttccatgtggttattgatcagtgagcatgttgatccaaacaggagtaagtgaactgctacaatgaagttttaggggcctgccattcagcaacttggtcttgtgagcgtttccatacgatacgaaagcggaacctttcacttttgggggaaggaatctctggcaaaggatccgaactctcagtgaccatatttaccaatattatttgattctactacacccaagtaaattccctctcaaaagtaatgtattgttttaaacagcaatttttgttaaataaaattttcaggaacttctagtgttatttttgtacagtcaaactactagtagtaaatgtgtctgcattcaactttggaaaaacattgtctgaaaaaatcctctttcagatgttttagttttgtcctttgtgtcattatgtttatggactgcctatatttgagatactctgccaagtactggagttatacagatgaatgaaacatgtcatctctgtcccgagaaatgttcacttttttttttttttttttttttttttttttttgagacggagtttagctcttgttgcccaggctggagtgcagtggtacgatctcggctcactgcaacttctccctcctggtttcaagcaactctcctgcctcagccttctgagtagctgggattacaggcatgtgccatcatgcccggctaactttgtatttttagtagagacagggtttctccatgttggtcaggctgatctcgaactcccgacctcaggtgatccgcctgcctcggcctcccaacgtgctagggttacaggcgtgagccaccgcgcccggcctgaaatcttcactttttaatttaaaaaactaaatttatcccagagtttagaaaaactagtttttcaccaacccgaaagacccctctgctgagtctcttgaggagttcttcattgctctttaaaacctaatttgggtgtgcttttaactacagacaccctctcacccttccctctcccgctggagtttaccatgtccttctctctgcttttgctctctgtgtattatacatacttatatcacttcgtaatgtcattttttttcttattaaattgagcttcttaaaggtaggagccatggtttatgcattccctgtgtcaaaaaatggagtctggcttatagtagactaaccataaaggttttcattgaaaatatccacatctctatttattaagaaatagcacattatgactcctaccattaaatatattgttatatctctcagggtcaacagccagccccgcaggtccagcagccaggcctggtgactccagttgcccaagggatgggttctggagcacatacagctgatccagagaagcgcaagctcatccagcagcagcttgttctccttttgcatgctcacaagtgccagcgccgggaacaggccaatggggaagtgaggcagtgcaaccttccccactgtcgcacaatgaagaatgtcctaaaccacatgacacactgccagtcaggcaagtcttgccaaggtaagtggacccacagggttactgtacttagcaatttttacagccagggagaagaaggaaaatgtgatcaagtctattttgtggtgatggatatgtttaataccttaattgtggtgatggtgtctgtatgtacaaagtcaccaaaatgtatacattagaccaggtgtggtgtctcacacttacaatcccagcactttggtaggccaaatggggaggattgcttgaggccaggagtttgagaccagcctggacaacatagcaagacctcgccgggcatgatgatgcacctgtagtcctagctgagggactaagaaggctgaggaaggaggattgcttgagcccaggaagtcaaggctgcagggggctatgattgcgccactgtactccagcctgggtgacaatgtgagaccatgtctttaaaaaaggttgggcgcagtggctcatgcctgtcatcccagcactttgggagactgaggtgggcagatcacttgaggtcaggagttcaagaccagcctgggcaatatggtgaaacctcgtctctacaaaaaaatactaaagaaaatcagccagatgtctgggtgtgttcctgtagtcccagctacttgggagattgaggtgggaggatggcttgagcccaagagggcaggggttggtgtgattcgacatcataccactgcactccagcctggacgatagaaccaaaccctgtttcaaaaaaaaaacagtgtacatatgtgtaattttttaaaattattttattttatttatttgttttttgagacagagtctcgctctgtttcccaggctggagtgtggtggcacaatctcggctcactgcaaactccaccttccaggttcatgccattctcccgcctcagcctcccaagtaactgggactacaggcaggcgcctaccaccatgcccggctaattttttgtatttttagtggagacggggttttaccgtgttggccaggatcgtctcaatctcctgaccttgtggtccacccgccttggcctcccaaagtgttaggattacaggcgtgagccaccacgcttggccaatatgtgcaatttaaaaaatatttataccccaaagcatttagaaaattccattgtctaaatgcatcatcacagttaactcactcggtaaaggtcgtcttggctgcgtccattctgtggcaattacgaataaagctgccataaacaaaatcaattttgagactcctttactgatagtgacgttattttaggaaatgataaaaacacagttttttttttgagatggagtctcgctctgtcgcccaggctggagtgcagtggtgtgatctcagctcaccgcaagctccgcctcctgggttcatgccattctcctgcctcagcctcccgagtagatgggactacaggcgcccgccaccatggcggctaattttttttgtatttttggtagagacggggtttcactgtgttagccaggatggtctctatctcctgacctcgtgatccgcccgcctcggcctcccaaagtgctggaattacaggcgtgagccaccgcgcccggccaaaacacactatcgtttttgtgagcaagtatctaaggatgtgagaagagaataaattttaaaggtcttcccatgtggtgatcctcatagactttgatttttatttgccctagcatagcatactttaaatgttattgagggtttgctaactgtcatgtaggcaagtgttcaatttaatacaatttactgcagtcatttttacccgatctaatacaatttgtatgaagtcattaaaaagtgttcttataggcatgtgtgtcataacattggtttagagtacatttgcttagaataaagtaggttgtgtatagcatggtgaaaaatgagggctcttaagccagactgcttgaggttgaatctcactttgagtactctgtgactttgtgcaaattgcttacccattctttttgcctttcttgactgtgaattctgagtattaataggagctaccttatagggctgttaggaagatgaaataagttaatgcatttatgttacttattaagtggtcaacaagttagctattattaatgtaaaaacattaacctgctcttgaaaaaatatgttttcttctctttagtggcacactgtgcatcttctcgacaaatcatttcacactggaagaattgtacaagacatgattgtcctgtgtgtctccccctcaaaaatgctggtgataagagaaatcaacagcgtaagtgatgaaatcttttgaaggtttatatgaaaagttttaaagtctcaccagtgccatttatagtactacttgattatgtgagggacctgtggtgttgtactatgttgaataaatgtttttttcccttttaatttttctgcttccctagtgcatagaattgaactgcttagggagtttgaggctgcagtgagctatggtcatgttactgcgctccagcctgagtgatggagtgagaacctgcctcaattaaaaaaaaaaaaaaaagaaagaaaaaacagtgcagtggctcatgcctgtcatcccaacagttttggaagccaaggcaagaggattcccaggagttcaagaccagcctaggcaacttagcaagaccttgtatcttccaaaaactttaaaaattagttgtgtgtggtgtgcctggctgagatgagaggattgcttgaatccaggaggtggaggctgtagtgagctatgattgtggcacagcagtccagcctgggtgacacaaggataccctgtctttaaaaaaaacaaaacaaaacaaaacaaaaaaaacaactgaacactgcttaacatccaaaataagatccaggaactctcaatacttattatttatacaaacagcaataggtaaatttatgttctgctttgaacctatgaaaatttaaagaccgttgctttggcattgggcaagttattcttttatactatacttgtgatctaaacgttccaggtacttggaaattattttaaaaagaaaaaatatgagattatttttataatattgggatatagaagagctttttttttttaagagaaaagacgagattaacactttaaaattgtaactaccacatctctatagcaacaaaaatttaagcttttagggttaaaggacaaatttgggaagtattgtacagcatttgaaaatggaattaaattttataacaagaattgggaatagaaaatagacaattcaccagagacgggaggagagaggggaactcccaatataattcactattaagaagagaaataaggtatcgtttctctcctgtagtgtaggcagaaatgatgctgccgggtgttggcagttgaatggctccaaagcattcatacagtgttggtcggaacattaataaagccctttgggaaggctattgggcattcagaatcaaaagccttttataccagtggtcccctttaccaatcagttctgcatctagaaatttcttccaggaaataatggaagacaagatccacatactcagatgtttcataatcacgtaacaataattttgtggggttttttattagacatgttagtcttttttttctcaccagcattaatttgtaatactatatcttttgtcttctctagcaattttgactggagcacccgttggacttggaaatcctagctctctaggggtgggtcaacagtctgcccccaacctaagcactgttagtcagattgatcccagctccatagaaagagcctatgcagctcttggactaccctatcaagtaaatcagatgccgacacaaccccaggtgcaagcaaagaaccagcagaatcagcagcctgggcagtctccccaaggcatgcggcccatgagcaacatgagtaagtttgtgtcatcctaataacatggtattggttgtgtcagtaaatgacatctataaacacagtgttgttagctcctttttattttttctgctacatgattttttaagtaattttttaaagattacagtgtaaaaggtcccttacagttcatctacgagaggtaactgccactggtttgtatcttccttgatccttttttgcattatatgagttcagatttgcagaaatgagatcccatatgttattccacaacaaactttgattaatactgtgtagacgggccgggcatggtggctaacacctgtaatcccagcacattgggaggccaaggtgggtggatcacaaggtcaggagtttgagaccagcctgaccaacatagtgaaaccccgtctctactaaaaatacaaaaattagtagggtgtggtggtgcgtgcctgtaatcctagctacacgagaggctgagacaggagaatggcttgaacctgggaggcagaggttgcagtgagctgagattgagccattgcactccagcctgggtgacagagcaagactccatctcaaaaaaaaaaaaaatactatgtagacatctttcatagtcagtattccatgtatcattttaaatggttgtatagtatgtcattctttcattcttttttttttttttttttttgagatggagtctcgctctgttgtcaggctggaatgcagtggcacgatctcggctcactgcaacctctgcctcccgggttcaagcgaatctcctgccttagcctcctgagtagctgggactacaggcgcgtgccaccatgcccagctaatttttgtatttttagtagaggtggggttttcaccatgttggccatgatgatctcaatctcttgacctcgtgatccacccacctgggcctcccaaaatgctgggattacaggcgtgagctactgcacccggcccaacaatctcttacagatggacattgagatctccaattattctgctgctttaaactatacaacagaaattgtgttttgacttgaggcattttgggctgaaacatatagaaatgagtgtagttggtaatgatttcctcatgtctggcaggaggaatagtgtgccttttcaaatagtttttttgtgacttgtttgcctcacttcctgttttatgactgagagggaagagggagaagtgttccagtatcctaatttggggatatatatgtttctctgattgcatatgataacattggaagaattgttctaatatcttaattttgggatatgtatgtttctctaattgcatatgataaaatcaaacagcttttttctgtgtctatccctctgctgtcaagcagttcaaatatctaagctattttgtttgagtagttagacatccagcattgtagagaccaggtcttgtccaggttggtcttgaactcctggtcttaagcaatcctcctgccttggcctcccagagtgctgggattacaggcatgagccaccgcacctggcctaagattatccccccccccacccccaccccggaaacagagtctcgctgtgtcaccgaggctggagtacagtggcacgatcttggctcactgcaacttccgcctcctgggttcaagcagttcttcctgcctcagcctcccaaatagctgggattagaggcacctgccaccacacccagctaattttttttttggaacgaagttttgccatgttggccaggctggtcttgaactcctgacctcaggtgatctgcctgcctcaacctcccaaagtgctgtgattacagacatgaaccactgtgcctgaccctctaagattattttttaatacagattgagtatcccttttcctaaatgcttgaaagcagagtactttagatttttttcggagtttggaatgtttatatttgctggttgagttgagaatcccaaatccaaaaatcaaaatgctgcattgagcatttcccttgaatatcattcacaaagttttggatttctgtatttgggatgccaaccaacccatactgctattttttactttcttcctattttccactgctgtgttctgttgctcccatttttggtttttgaattaatcttcaggacatttttttctttctgtttttctttactatataataacagtattttcaaaccagtgatctgcttttaagcacatgttgagccactgtgcagtaaagtttaatgctcctgttttcaaaactgttgaacaactgttttgtcagaaactgaaagttatgagagtgaaatgcaaacatttttagacccatcaattttgattttgacttttaataatttaagatctaaaatgctagatagtgacatggagcttcttgtattcaagtttgtaagtcagattttgcagtcactggcatgactattttagacagttgtgctaatgctcattgtaccagaccatttctattttaatattctttagattcttcattcctgccctgttgttattgtttattacttggtctgttgatttcattcttttcttttttttttttttttttctgatttcattcttgaaagtagtattttcaaggaggatgtttttcttgagttttacctaatcagggacttagataagttttcttagataaattatggataactagaaacgtacgtgtgtgtttgagtttggtctcgctgtgtgcatgtgtgtttttgagactgggtctgataactggaaacgtacgtgtgtgtgtgtgtgagattggtctcactgtgtgtgtatgtgtgtgtttgagactgggtctcgctgtgtcacccaggctggagtgcagtagtgcgatcttggcctgcatcctctgcctcctgggctcaagcggtactcccacctcagcctcccaagtagctgggaccacatacgtgcaccaccacgcctggctaatttttgtatgttttgtagagacagggtttcgccatgtggcccaggctggtcttgaactcctgagctcaagtgatcgcctgcctcgacctcccaaagcagtttgtgtttttcgttacttccatgacaaccagtactaactagttaaataattattgagtgacgagtttttaagcaggactaggaaaagggatgaggagcaatcttgccttttcaggcttccttttacctcttctgtattgaaaataacatgtacagcggtaatggaaagttggacctggacactagcatattttcccctcttgttttatatcttctgtcttggaatgagcattgcttttttctttctttctttctttttctttttgagacaacatctcactctgtcgcccaggctggagtgtagtggcgccatctcggctcactgcaacctccgcctcctgggttcaagcgatgctcctgcctcagcctccaagagtagctgggactaggcgcacaccaccacctttttgtgttttcttttagtagagacagggtttcaccacattggccaggctggtcttgaactgctgacttcgtgatccgcccacctcggcctcccaaagtgctgggattacaggacgcccagccagcattgcttttttatctcccattccatgttacgcagaatgcacttacctttttccttaagttttagtaggttgttgtcttcccctggcctggaatttcattactgtaattgggtagttcccttttgtttttcaaagttatgtttatagttcctattatagctcttttcctctcattatattatcttgcctatgtacttttatatatatgcacaattatttgaatgataattttgggggatttttgcccccatttcttcgtgtctttttatttagaattagatttaagattactcaagttccctttgtttttatttcttctggtctcctgaagtgctgagattacaggcgtgagcctctgcgcctggtcacatttgctttttttttttaagttatgtttcgttttctatgatttactgttgggtgcttcatctttttcttacctgtttgtaagggtgcttcaaatcagcctttacatatgtgttgccagttatattgtcaattatttattgtatatgctgcaaattttttttctgatttgtcatttgtttcttaactttatagtatttattgtatggtggctgttgtatttatttctgtctcctgttatttcattttgacttaggtgctagtcctatgggagtaaatggaggtgtaggagttcaaacgccgagtcttctttctgactcaatgttgcattcagccataaattctcaaaagtaagtcttaacgtgatttataccctgggtcacattacaaatactactggttaacaattcattgtttgacttttgaacttagtttcctcggtttgaggatgtctttgaatacagatagatgtttgagtccattctttcttttttcgctctgtagcccaggctagagtgcagtggcatgatctcagctcactgcaacctctgcctcctggttctggttaaagcaattctcctgcctcagcctcctgagtagctgggattacaggaacacaccaccatgcccagctaatttttgtacttttggtagagacagggtttcactgtgttggccaggctgttcttgaactcctgacctcgcgatccgtctgcctcagtctcccgaagtgctgggattgcaggcgtgagccaccacgcctagcccactctttcttctttctacagccttaatcgaaattgtattgattttctagtgtagcctacaccttccctaatacagtaggatgttgcaaggttacagctccataatagccttatcctgatgttaagaattagtccaccagcctgggcaatatgtcaagacgtcttctctacaagaaaatacaaaaaagttaacggggcatggtggcgtgcacctgtagtcccagctactgatgaggctgaggtgggaggagcacttgaggctgggaggtcgaggctctggtgagccgtgattacaccactgcaccctagtctgggtgacagcgagactgtgtctcaaaagataaaaattattattttaaaaagagaggtagtccatcatccaaagcattccctgaggtgagctgtgttaaaatgacagcttagtctgataacacaagccttagaaaactaagtatgggccgagcatggcagctcccctgtaatcccagcactttgggaggccgaggcaggcagattgcttgatcttagaagctcaagaccagcctgggcaacatggcgaaatcctgtctctgctagaaataagaaaattagccgggcatggtggcatccacctgtaatcccagctactcaggaggctgaggcaggagaatcgcttgaaccccggaggcagaggttgcagtgagctgagatcatgccactgcactccagcctgggtgacagagcgacacgccatctcaagaaggaaaaaaaaatggctgggctcagtggctcacgcctgtaatctcagcactttgggaggcccaggtgggtggatcacttgaggtcaggagtttgagaccagcctagccaacatgatgaaaccccatctctactaaaatacaaaattagccggacgtggtggcgggtgcctgtaatcccaccaactcaagaggctgaggcaggagaatcgcttgaacccagaaggcagagattgcagtgatctgggattgcaccactacagtccagcctgggcaacagagcaagactttgtctcaaaaaaaaaaaaaaaaaaaaggcattacagacaaaacccagaaaatgaagtcttatgatatcttgtgttaggacatcatcctgccctccaaagaaatacaacttaccctcacacaggtatgaacatgcacagtttaaaatcagtctagtcacacacttctccctgcctagctccttaatgcgaatagaagtgacatagcatattgattccattacaataatcagtgtcagcttgaattaaatgaggtcttctcctacctttcttcactaaaactatttggtgacccctttttgaagcccaatgatgagtgaaaatgccagtgtgccctccctgggtcctatgccaacagcagctcaaccatccactactggaattcggaaacagtggcacgaagatattactcaggatcttcgaaatcatcttgttcacaaactgtaagtaagattgtggacacgtctcattcgtaaagagatgttacgtcaacatgttttcaatctcctgggcatttaattactaaaggaatattagcaatttttctgtagcatggaggttgatgttgatacttctactcttgtggatttcttgctgctgctgcttttttccttctcaacctttcccaccatcatctatggtagtctttcagctttaatggtatgtgaactattctgtctagtgacagtaaataatatattaaacattgtttttagctattgcctttgcaaaacttatatatctaagaaaaactaggcctcagctcattaaaatattgcattgataacatccttttctgttactcctggtagagcaggggttttttgtttgtttgagatggagtctcactctgttgcccaggctggagtgcagtggcacgatcttggttcactgcagacttcgcctcccaggtgccagtgattctcctgtctcagccgcccaggtagctgggactacaggcacgtgccacctcacctggctaatttttgtatttttagtagagacggggtttcactgtgttggtcacgctgacttcaaattcctgacatcaagtgatccgcctgcctcagcttcccaaagtgctaggattacaggtgtgagccaccacgcctgtcctggtagagcttttattatgtaaaaatctggtagggtggactctctggtcttctcgtcctccagatgtgcacatggcagtttatttttgagaagttgatatatttcaggcactctccccttacgaactccatcttaatctaaagagtttttgtcagatgaaggagggggaggcatatagagcaaggtaatgaaatgtgctcagcatcataaaaaggtagagcttggaccttgccaattacagagtttacccttcaaacaccatgcagtattttttcttggagaagtcttttcatttcactttcagttaatagcagggtcgtctttactgtatccatattttttaattgactgaggaactatttatcattttgtcttaatttatttttatgttatgtcaaactaccaattatatacgtttcatttaggaatttttttttcctcccacgaacccatgcttgctaatcatttaggattctttgtttgtttgtttttgtttttgtttttgagactgagtctttctctgtcgcccaggctggagtgcagtgtcgtgatctcggctggctactgcaacctcccgtctcctgggttcaagcgtttctcctgtctcatcctcccaagtagctggggttacaggtgtttgccaccacacctggctgatatttgtatttttagtagagatggggtttcgccgtgttggccaggctggtctcgaactcctgacctcaggtgatccacctgccttggcctcccaaagggctgggattataggcgttgagccactgtgtccagccaggaattcttcagtggtagcactaagtaacggaatttgacaaggaaagaacttcacaagtttaatgaaattattcctttaataaagaataaccgatctcttattttgtgacagactattcaggaacttttatttaatggacagagatgattatttggggttgatcatttgactttacgttaaaagtttattatatatgctcgagttttctaccaacttggtattattctggacttccatttatatcttcttgatctggttccttcaagtcctatgcaactgagtacgggatgtccaaataaaattagtgcctaaagatcacatttgtcagtcataagagatactagtgcaaaacattttgttagggaattgcatgaaagtgaaaaactgaatctaacagaatcattacgcatttctggtctgtccacttcaggtttttggttttttgtttgttttttataagcctttgtcagaacagttcaagtttttgatgttttaacattttagagtggttactgaattttatttcagtaagctaaataataaatttagaagagcagatggaactctgaaggctacttgatactatgacaaggcctgttttcctcactgtctttagtatgtaacccaaagtaatattttgctttatgtctagagtaacagggaccaaagagtattttttatagagtcatttcttatattgtgaacggaaatatagacaaaaattcttttgtttatcacaaaaagataatttcatttcagtaagtaatatatatcaccttgccattattttttcttttcctctatgtgttcagtgtataaaaatcagaaaaatactaattaaatgctgacatgatattacagtggtaggattttctttttccagcgtccaagccatatttcctacgccggatcctgctgctttaaaagacagacggatggaaaacctagttgcatatgctcggaaagttgaaggggacatgtatgaatctgcaaacaatcgagtgagtgtctggtttttttctattaatagccaagattgaacctgttgtggttattttattcctctttagcatgtacaagtagtacatatgcttcagacgggggacacgctgtagctatcccgtcttattgtccccaagcatagttaggataccaaagcagtttcttaagtgtatgtcatcaagaatcttatgtttttcctcctaatacagtgcactcatgtggcactttatctggttgtcctgtcaacctaaaaagtggctgagctggccgagtgcagtggctcggtgcctgtaatcccagcagtttgaaagtctgaggtgggcggatcacttgagcctaggagttggagaccagcccgggcaacatagcaaaaccccatctctacaaaaaattagccaggcatggtggcacgtgcctgttgtcccagctgctcaaaaggctgaggtgggggaatcaccagagccttggaagtcaagctgcagtgattcgggattgcgctgctggtgacagagggagaccttgtctctctcaaaaacaggagtggggtggtgctgagctgttaccagctgtgttctcttttcactagaatataatgaagtagcgacttaactgttgttcacggtagttcagattctctacataagttgaactttcctttctaaattggcaccagttcttaatgcagcatataaaatgaaactaatatctattctcagtttattttttctgttacctggtggtagttccttttttcctcatctcccttattttacttcaacaattcaaaaggcggaatactaccaccttctagctgagaaaatctataagatccagaaagaactagaagaaaaacgaaggaccagactacagaagcagaacatgctaccaaatgctgcaggcatggttccagtttccatgaatccagggcctaacatgggacagccgcaaccaggaatgacttctagtaagtggtttttgttatatttctgtttgagagaaattgataataaaatagtttctatctaaagtcattaatttctgtaagcttgtgtaactattctagagttttttaaataaccatttgcctttgcaaagaaaataactcatctactagtaaaaacagaagcagaacaagtatatttaagatgtctgggcatggtacttaacataccttgataatctggaattgtttttagagcccaaggtgtaaacttctctaatagtgacatctagaaagcaatagcctacatacagatgttcacagatttctctgagactggcttgtgtggtaagtagccagtaaatgtttgtaggctgaccaggttcaggagccctgtaacacacataatatcatattacactgtcacactttctacttgacataaaatattctaagtctaggaactctttttttttttttctttttctttttttttgaggcagagtctcactccgtcacccaggctggagtacggtggcatgatcttggatcactgcagcctccgcctcccaggttcaagcaattctcccacctcagccttccgagtagctgggattacaggcacatgccaccacgcctgtctaatttttgtatttttcgtagagacagggttttgccatgttggcctagctgatctcaaactcctggcctcaaatgatccgcccaccttggcatcccaaagtactaggattacaggcatgagccaccactccctgcctagaagcatcatttaaaattacattttgacagcttcagtttctgattatagcatcattgttgacctgatgaattaaccagatagccaagactatgataaatagtcttactcaatcgttgacttattggtacgatcaaagtagtgaaatatggagcaggcacaccattttcaggaatggcacaggctgtaagtgctgtgagcaaggctgtgataggaaaaacctgcatttactgagttaggaaatgctaatgacctctaagaagtgccaactgagccagcgggcagtaaacctcatacgatcagtagattataggtgggctgagaagttcatctctttcattcattgaagtagtaaagtagagaaccattggttaccactggcctttagcagcctcatttgctaactgaagtgtgccaggtactgttttgtaatgtgtaaaaagttgggaggagcaacattgctgaggaaatagtatacatggaggctgcccaatagtaaggaaaaacacagattttttgagtagttagaacaaattttcaggaatgaaaaagtcaagattagagttgagactgcttcagtacatgatttggacttgagtagtaactaaagattaaaaaaagtagacaggctgggtgcggtggttcatgcctgtactcccagcactttgggaggccgaggcgggtagatcatgacgtcaggagatggagaccatcctggctaacacggtgaaaccccatctctactaaaaatacaaaacaattagccgggcatggtggcgggcacctgtagtcccagctactcaagaggctgaggcaggagaacagtgtgaacccgggaggcggagcttgcagtgagccgagattgtgcctctgcactccagcctgggcaacagagcgagactctgtctcaaaaaaaaaacaagtggacatacctgagatacttggttttggtagaatttactcaagttctgggtgaagttctgagccaagtttaaagtctgtgagatattaaattgtattctaatgtcagtataaacagtatggtactgatgtaagcaggaataagtggtagtggaactgagtatcagccttaagtatatgttgacctttagctcgtactaaatctgacattttgtagaatgagattcttaccttaacctgatacacagaaaataatagaagcataaaagtggtcgggcatggtggtggctcacgcctgtaatcccagctctttgggaggctgaggctgcagatcacttgagcttaggagttcagaaccagcctgggcaacatggtgaaactctgtctctataaaaaatacaaaaattagccaggcatggaggtgtgtgcctgtagtcccagctactcaggaggatgaggcaggaacatcacttgagcccaggaggtcaaggctgcagtgagctgtgattgtgccactgcacttaagcctggacaacagagtgagatcctgtctttaaataaataaataaggtttgtaaactttgaaaaaacaaaattgaaagaactacgtagaatgttgaagaaaacataacattctcatcttcatgtttctttaacatttgtttttttgttgttggttttgtttttgttttttttttgaaacagtctctctttgtcactcaggctgaagtgcagtggcaccatctaagctcactgcaacctctgcctcccagattcagttgattcttgtacctcagcatccccagcagctggaattacaggcatgcatcaccacacctaactaatgttttgtattttcagtagagacagggtttcacaccatgttggccaacctagtctcgaactcccggcctcaagtgatccgcgtaccttggtcttgcaaagtgctgggattacaggcttgagccatcacacctggccacgtttgatttttttgttttaatacaaagaatacagttattatagaatcagagagtggcaatggcaggactatgtgtattggcctaaaaatatgcccatagtaaacttatgtaacgtgtaccatcttgaaaaaataatcccggttgttaatggagttgaaggtaggtaactctttccttattaattttttgcaaagatacgaagtttcaggaaaagctgatgacagaagtatgcatgttatagtctgagtttttttaagtgtggcatatgccctagaaaaagttctggaagaagtaaatactaatctctgaacatgggcttctgatgggggcagtggaattccaggatacttgtgttgtgtgataaagggtttttgattatttgacttaatgcatatagtttgcattaagggcatatatattgaaatgtgaaagatggacatttttgtttgtgtatattttctttacctctaaatatttatatatatacatttttgagatggggtctgtttcgcccagcctggagtgcagtggtgtgatctcggctcactgcatcctccatgcctcccaagctcaagcaatcctcccacttcagccccccaagtagctgggaccacaggcacacgccaccatgcctggctaatttttttttattttttagtagaaacagggtttctgtatgttgcccagactagtctcgaactcctgagctcaagatatccacccacctcggcctcccaaaatgctgaaattacaggtgtgacccactgcgcccagcctttaaatatttatcttaaaaaatagtatcaagatgttcctttaaataattcatcaagtttccttaaaatgacaagagctgcctcatggagcaataatagatacattcgtatctgcatcatatggggcaaatgtgggcagtaggattgcggttttatttttaaaccattttcatttgattagtctcaaatacttaaaaatcagaagattttgcatttaaaaagtctgaatttctggctgctttaaaaaaaaaaggacatgtctggcagacttgaccccctttctcctacagtgacacctgtctatagctgcactcatggctgactctagaagagctgtgttttctctccacttcagtcctcaccattctctattgttttgggtacttaaaacagttttacttggtattagctgcttggcacttgccatttagcttggaacacctatccatattgttgacttgaaaaaaaagttactcatatcttaggtgaaaacattgttttgtagatagtgtgcgtgaatacagatatgtgtggggaggaagaggaaaggtttatctcaaggtcatttgttggatcctgattcatttttctattgatttttaatttttatgtaatgagcatggattatgcatatacttcttataaagcttgcagagttacagataaaagtttatatgaataaatgttgagcatttcctctctcagttttgctcatttactaaaggttgaaatttgtctgaagggatggacatctccttagaagagcagcaggtcttcctctcctatgcctgaggcttgaatgtacagcccttgatggagggtatggccagggtggagccaggtcactacagacatctgtcctttccgagggtgctgtaaaaatattttctctgtgcactatgttgaaagtactacactagagcatgtgcagataatccaggaaaaagaccttagaatttatgtatttatattttaggttttttttgagacggagtctcgctctgtcgcccaggctggagtgcagtggcacgatctcagcttactgcaagctccacctcccggggtcatgccccgggttcacgccattctcctgcctcagcctcccgagtagctgggactacaggcgcctgccaccacgcccggctatttttttgtatttttagtagagacgggtttcaccgtgctatctaggatggtctcgatctcctgacctcgtgatccgcccgcctcggcctcccaaagtgctgggattacaggatattttatttttttaagaattatttctgtttttgtatttaagaggtacatgatatgtagtgtggtataatatgcatattatttaaaatcaatgttcacagtttatgtgcataaaaacgttgtgctacatgatcaaattcggccaccattagacatgattcatagctattatccatggagatactctgttgcatgccaaccagactcagactttgttaaacaataacatattaaatgctatgatggcctcaatttttttttttttttttgagacagagtcttgctccatcgcccaggctggagtgcagtcgtgtgatcttggctcactgcaacctccgccttccaggttcatgcgattctcctgcctcagcctcctgagtagctgggattacaggtgcctgccaccacgcctggctaatttttttgtatttttagtagagacagggtttcgccatgttggctaggctggttttgaactcctgacctcaagtgatccacccacctcagcctcccaaagtgccaggattacaggcgtgagccactgtgcctggcctataatggcttcaatagcttatttttctatcaacattgaaagcacccgggctcataaaggaataccaacaaatccacttggaggcatttttctgtattccagaaataacattttcttcaagcttctgtctagttcagagctttattttgtgattcatactcaattttcaaaggtattattaaaaatattttgtggggtttgtgtgtgcagtgagtttttgtttggttaagggaagatggtgcaaagatacttatttctcttttttactctagatggccctctacctgacccaagtatgatccgtggcagtgtgccaaaccagatgatgcctcgaataactccacaatctggtaaatagtgaaaaaaatttttttattttaaaagaatccccggtgtactgcaagataatacttgctacctgaacacccgctttatgccaacagcaagtgtcatgattacctgcccatagaggaagagggggtgaagagcaggttggctggcagatcacagggcaggtgacattaaatgatcaagtatccattaaaaaacaactgcaggctgggcatggtggctcacgcttgtaatcccagcactttgggaggccgaggctggtgtaccacctgaggtcaaagtacgagaccagcctggccaatgtggtgaaaccctgtctctactaaaaatacaaaaaaattagccggttgtagtggcacgggcctgtaatcccatttactctggaggctgaggctggagaatcacttgaacccaggaggcggagtttgcagtgaggcgagatcgcgccactggaccccagcctgagtgacagcaagacttcgtctcaaaaaaaaaaaaaaaagcagattgtaaaatttgtaaaattcagtttggagatcctgttagttgataatgtctgtttactgctactgtgaatgagacagatttatttatacttagaaggttgaaagccagtttattagtcctgatagaatcagggccaggtgcggtggctcacgcctgtaatcccagcactttgggaggctgaggcgggcagatcacaaggtcaggagatagagaccatcctggctaacacagtgaaacccccgtctctactaaaaatacaaaaaattagctgggtgtggtggcggacgcctgtagtcccagctactcaggaggctgaggcaggagaatggtgtgaacccaggtggcagagcttgcagtgagcggagattgcgccactgcactccagcctgggcgacagagcaagactccgtctcaaaaaaaaaaaaagatacagaatcagacataagaattctatcttttattattcaatttcacaaaggcattcagatctaacattttgctcatattcacaggtttgaatcaatttggccagatgagcatggcccagccccctattgtaccccggcaaacccctcctcttcagcaccatggacagttggctcaacctggagctctcaacccggttagtttgacgtctttggtaatctctttggcctttacctggtattttgaaaatcctgtttgttcctactttataaattctcacagtcatttaaacagaccataactcctagttcttctgtaattcttctgtatttaactctactagaaagctgaccaaaaaacgaaaacagccagtcccttgtccctggagtgtcagtgtttagtggcctgcatgcgttttcacggtcacttctcttccctgatgtctgtcttccctcctccaggcagagaactgtcttgcaaggttgatggtgcgtttttgcctggttcttgaactcggagaagagagactaggcttctcctgctccttatgcgaactcttaaccagtccatctctctaccttgaccctaaccctcctgctgccctttagagttagctggtgcctctgattcttgacccttttgggggttcctgagcattactacttctcactaatctgccattttcaacagggagttctgtccttcattttaacctataagacagatggtcttagcttatgaagtttttggcctttggtactcgagatttctttctttaaggcctgaatttgtgtagggtaattttggaaatgacatgtaacagtgctagagcatttgtggaccatgaatgctaccagattctgctacaacttgtaagattttcttgtttttacatattatgggtcttagaatttgtgttattacatcactgacatgacctcatgaaattgtgattaactctcctcacttaacagagcatgcaaagaaaattacctgctatccttgtgctaggcatatttgtgtaccaagagaatgtgtgttccatcctcttactatttcttggagtaggcctaggtaaactgtgaggctatttctctttatcttggcacaagagtcagttgttctacaactttcttccttctcctcttcagccctcttcacctatactcctgtctttggcttttctctacttaataagcctgacgttaggagcatttgatgattttagttatagtagaataactataatgaagcagtttggtgatttgtgttttttttttttttcagcctatgggctatgggcctcgtatgcaacagccttccaaccagggccagttccttcctcagactcagttcccatcacagggaatgaatgtaacaaatatccctttggctccgtccagcggtcaagctccagtgtctcaagtatgtctcataagtggatttttcacttatttttgattcttgaaacttctcttgatgtaggtttttataggagagagtggcagcaaatagtgggtgaaaacagatgattttttaaaaaataacaattttggacttagggtattctgaacatgaagagattattctgtgacatagcaatggtgttaattgttacaaagtaggaaataatttaaatggatagttttaattgtttttactagtgaacactttaaaataaatcttagaattaaacacaatgtagaaggaaatctggctgaaaagagcataggcaggccctagagcactctgcactcaattctgccatttttctgcggtggctgaggccattctgctgaatggtttgaagtctctttagttaagtactatcttgatggtgctgtccaaagatacatgcccagtaatagggtattttacacattttgaaatagacacattgctactctttgtttaatcagtttgtgtcctaaatttatatatcatgcctatgtaagtatttccttaattctgttctgaattgctgtcttgttatgttttttattttaacaggcacaaatgtctagttcttcctgcccggtgaactctcctataatgcctccagggtctcaggggagccacattcactgtccccagcttcctcaaccagctcttcatcagaattcaccctcgcctgtacctagtcgtacccccacccctcaccatactcccccaagcataggggctcagcagccaccagcaacaacaattccagcccctgttcctacacctcctgccatgccacctgggccacagtcccaggctctacatccccctccaaggcagacacctacaccaccaacaacacaacttccccaacaagtgcagccttcacttcctgctgcaccttctgctgaccagccccagcagcagcctcgctcacagcagagcacagcagcgtctgttcctaccccaacagcaccgctgcttcctccgcagcctgcaactccagtaagtagagatttggatttaggcagaatcattagagctatactgtagtattatattacttctgggccatttccattctcttttgctttatctcttactgttttctccacaagtagaatgtaatctatttttcattagggacttttgtatcctgttttgccttcctgtgatagtacctatcgtagcaggagcataaagattttatttagctctgactttgaccattatgtttcatgttgtaccctgaggtctgaaggtacgtaaaggggtacgacaaggggacacaatccttctccttatttagtatattatttagtgcagcacataaattttacatatatttaaggaatctttttcaaacagtttgagccataaaacctagagattgaatttaaaaattgcagatttggacgggcgcggtggtgtacacttttcatcctagcactttgggaggctgtggcaggcagatcacttgaggtcaggagttcaagaccagcctggccaacatggtgaaaccctgtctctacaaaaaaataacaaaaattagccagacatggtagcgggtgcctgtaatcccagctactcgggagactgaggcaggagaatggcttgaacctgggaggtggaggttgcagtgatccgagattgcgccactgcactctagcctaggcgacagagtgaaactccgtctaaaaaaaaaaaaaaaaattgcagatttatgagtccttgtggcccaaaccaaagtttaaaaataagatgagagaattatagacccagaacaacctgtagcttccttgtgagaggttggttatgtatataataaaaatccaaattctcatctaatagttgaatccttattaatagaactttttttaagggtttagaagcttctactttgataccgatattaatatatatcggtatccaatagttctcagccatgttgatgaactgagaagttccatgagtcacagccgttttataaagtactgtacttgacggatggctggttcatcgtggcctctgatagacaaggaaggacagaatgagagaggaaccagtggatctgcttgattttattctttataaaatcaaggatacttccagaaaatactgacttctcattaagagatttcttatgacaagccttaggataaagatagggaatgccagtttatctcattagaatctagcgattcaaaacagccactctctgggacatcattatatttattgtctccttttctgtacctttgaaactttctctggtgagaaggtaaaaacaagccagtctttcttattttctttcactcatttctgtataaatgtgagctcctctgaagcagacatctttgaaatccccacacactgccagataatgatagttatcaatgaaatagttgctggttctttgatgtacaatcagccaaccagtatttacaagtcttaattctcctgttcttaagcataattaagggaggtgaaatgggcagagcaaatgaaagcaccatgaataaatataagccaagaaataggtggctaattctgctatcctgttgcttaccttacattctgattgtatcgttggcagactctgcgtgtgtctcacctacttcccttttttttctgcccagctttcccagccagctgtaagcattgaaggacaggtatcaaatcctccatctactagtagcacagaagtgaattctcaggccattgctgagaagcagccttcccaggaagtgaagatggaggccaaaatggaagtggatcaaccagaaccagcagatactcagccggaggatatttcagaggtgagagtagggcaattactgtttgatttggttaggacctcagtataggaacccaagttttaaaaaatattgcagaaaaatattttgataattagatctcatggcatagattttgcatgagaaagggtgttcagattactgattcccaactagatatctttggaatactaaaaattcttacgttttcttttagtctaaagtggaagactgtaaaatggaatctaccgaaacagaagagagaagcactgagttaaaaactgaaataaaagaggaggaagaccagccaagtacttcagctacccagtcatctccggctccaggacagtcaaagaaaaagagtgagtctctgaagccattcgttctggaggtagctgaagaaaccaaagacccagggcagaattgcggtcatgcctcttgggcctcagaagttgccattattgtgatttcattaacctggaagccctgggcctggtctcttcattgttactaataatttttctttcttttttttttttttaatattcacttgcagcaaccaatgagttaagtcattcccctcatttcttcagggttccctgtgttagtacaccctaaaaattgtctcatttttcaggagagagaaatgtttgtaaatagccttgactaaaatgcaggaaagaatagcaatagtaatagcatttgtcattcacctgctgtgtgctaagtatccacattgtctcatttaataatttctttctttctttttcttttcttttttgtttggaatcggattctcacttttgttgttcaggctggagtgcagtggcgggatctgagctcactgcaacctccacctcccaggttcaagcgattctcctgcctcagcctcccgagtatctgggactgcatgcgcatgccaccatgcccgtctaatttttgtatttttagtagagacaggatttcaccgtgttggccaggatggtctcgatctcttgacctggtgatccacccgcttcgagctcccaaagtgctgggattacaggcatgagctaccacacccggcctcatttaataatttcacaacagctctgaggttattggcctgaagcttagcaaagttaagtaactttccacaggttactcagctgaccctactgcctgggccaggaagcagacccaggcagtctgaggcagagtgctcaaatccagccattccaacaagtgttaattgactattttaggactagaacttttgtggctctagtgatctgcaaaaggcaccaggtaggacatacctgaggagtgagtctgctggctcttacagatgatatatattgaaaagtgttccattaatacaatgtgttgtaaaatgttgggattaaaaaattattttcattttaaaaataagacttgtatatattgaggtgttttaatatgggctgtaacaaacccagtcttactattggcaatctctctttaaaatgtgtgttccctcatgcctgtaatcccaccgctttgggaggccgagcgggcagatcacttgaggtcaggagttcaagaccagcctggccaatatggtgaaactctgtctctactaaaagtacaaaagttagccgggtgtggtggctctcacccgtagtcccatctacttgggaggctgaggcagaagaatcacttgaacccgggagatggaaggaggttgcagtgagccaagatggcgccactgcactccagcctgagtgacagagagtaattgtctcaaacaaataaataaaataaaatgtctaatttcacaagtttattcaaatagtccttatttttagcacagctaaatatgagtgacaagcatcttcgtagtctggtttccccccactccatggcaaccccccagaggtgaaaattatctgaagtaacaaatatactctaccgatgatgaaattttttttgccaattaagaaaaaataaggcccttgctgaaattgaaagctttttaaatcactggcttctcaaagaactgtttgattccatttgggacacaccaacaaatttttccggactttttgggaaatatcattgagaacacatttgaacttaatttgatcaactaagtctattattttagcaataccatttttgttctctcttcttttaaacttaaacctaacatttgtcattaaaatagtacatgtctctttttctttggctctaaaataccaagcatttgaacgaaggagtcttctcttctgtgcccctgactccttgtagtataagacaatacctgatctagtctagtttctgacttgttaaatactgatgtcatgaagaaagacttttctgttcttgcttgactgcatctccctcttaacacgagtatcttgtgcactctttttttttttttttttttttttgagatggggcctcattctgttgcctaggctggagtgcagtggcgccatctcggctcactgcaacatctgcctcccgagttcaagcagttctcttgcctcaagcctcctgagtagctgagactagcatgccaccatgtccgactaattttttatatttttagtagagacgaggtttcaccatgttggccaggctgaaacttctgacctcaaagtgatctgcccacctcagcctccaccgtgcctggtcccatggactcttatttggcaaagtctcttcataaatttttagaagcctttggattctgcttctaattgaccgagtctgtcttcactgactttgtgactgaaaagttaagctgagggtgaagagtgttttaaggtgataagacacaatgttttttaggagctgtctgaaacaaagcggggcttagaatctagaatcagtgattgagcctgtagtgatatttccatggggacagagtggttaattttgttattgattcttgagatgcttttagagcttcaggctgaatgattttttaaagttcttctgcttaattggtaactaatttcaaatgcactttttttttttaagttttcaaaccagaagaactacgacaggcactgatgccaactttggaggcactttaccgtcaggatccagaatcccttccctttcgtcaacctgtggaccctcagcttttaggaatccctgtaagtatttggtggtacttttgattttattttttaatttgataacagctttattgagagataattcacattccaaacagtatagccactcatttcaaatttgtaattcagtgattttttttttttccccctgagacagggtcttattctggttgcctaggctggagtgcagtggcacgatcgtggctcactactgtctccacctcccgggctcaggtgattctcccacctcagcatcctgagtagctgggataactacattcatgtgccacctcacctggctagttttttgtattttttagtagagacggggtttcgccatgttgcccaggctggtcttgaacgcctggactcaagcaataggcccatctcagcctcccagagtgctggaattacaggtgtgagccactgggcctggcctaattcagggagttttagtatattcacagagttgtgcatgacactttcattttcatcatctgaaaaaaatcctttaccattaacagtcactcactattttctcccatagcaccccaatcctagacatcaccagactgcattctgtctctggatttgtctgttctacatgtttcattaaattggaacatacagtatgtgattctttgtgccaggacgttccttagcataatgttttcaaggttcatccatgttgtagcatgaatcagtagcacatacctatttatagcccaataatattccattatttttctttacctgttgatgagttgatagacatttaggttgtttacacgttttgactattaagataggactgtagtgaacattgtgtggatttaagtttttatttctccttggtatttacctaggagtggaattcctgggttatatagtttgtttacttttttgttgttgttatttgttttttgtttttttgagatggagtttcactcttgttgcccaggctagagtgcaatggcgcaatctcagttcacctcaacctccccctcccgggttcaagcagttctcctacctctcagcctcccgagtagctgggattacaggcatgtgccaccatgcccggctaattttgtatttttagtagagatggggtttctgtatgttggtcaggctggtctcaaactcccaacctcagatgatccacccacctcggcctcccagaatgcccagattacaggcgtgagccaccgcacccggccactttcgttgtttcaagagcaataggtcatagcagaaaaaaggaccgtggttagctttgtttttaaagttgcctccatatactaggctgctggcagatttcatttggtggttttaaactgttacttggccgggcacggtggctaacgcctgtaatcccaacacttttggaggccaaggcaggcagatcacttgagttcaggagttggagaccagcctcaccaacatggtgaaaccccatctctactaaaaatataaaaagtaactgggcgtggtggtgcacgcctgtaatcctggctacttgggaggctgaggcaggtgaatagtttgaacgaccctgggaggcagaggttgcactgagccaagattgcaccactgcactccagcctgggcaacatgttgacagagactccatctcaaaggtcaagtgcttccaggggcaaaagccttttaggacttttcctctcttgtatcttgctgtgatttcagatggaacattttaagttctgtgggcttagtttcctcattgtacaccccttctagtactaaaattttaaatgtctttgactttactgatctcacatgtactttcataaagaacctgaagttgcttcagtagaatatcagcctgatgtctagaaagtccatagtagttctgtttctctgccctttgagtagtttaatatctctgtaaactaatatttaaagaagtgatggacatcagtcacctcttggggaatatagacaggccagaaactaaaacactgcctggaaaattaacaatgataatggatgatactccatctcccgtaaaaatagtgagacttgagtaatgtttgatgtcacttgtctttctaggattactttgatattgtgaagagccccatggatctttctaccattaagaggaagttagacactggacagtatcaggagccctggcagtatgtcgatgatatttggcttatgttcaataatgcctggttatataaccggaaaacatcacgggtatacaaatactgctccaagctctctgaggtctttgaacaagaaattgacccagtgatgcaaagccttggatactgttgtggcagaaaggtaagaaatgtgtttcagatttgactttaacttttctgggatacctagaataatatagtggtgactgggataagagaatatcctgcttctggctttgacatggcttttttttttttttttttttttcctttttgacagggtcttattctcccaggctggagtgcagtggtgaggtcatagctcactgcagcttcaacctcctgggctcaagcaattctcccacctcagcctcctgagcagctgggactacagccgtacgccaccatgcctggctgattttttaaatttgttttgtagaaacagggtctcatgatgttgctcaggctagtcttgaactcctgggctcaagcagtcctcctgcctcggcctcccaaagtgctggaattacagtcatgagccacctctcccagccaacacagtctttctcttactgtgtgccacagtagtaatatctcttaatatgaaatgggctttctttaaaggcattttttcagagtggcaattgtatggaaaagttgactaattaaataatcaacagactgttaactcatctggagtaggggcattcttatattcacctgtgggtgcagattcctcagcatgtgctggctttcctgtacataccaattcacattattggttttttgtttttaaaataagactatggtcttgctgtgttgcctaagctggtctggaactcttgggctcacgcagtcttcccacctcagcttctgagcactgcaggcatgtgccaccctgcccagctattcctgttaggttctttggtaaagtgatggaaggatatgactgctaagcctacctcagcgttttgaaataatgtggtagtaaactgagaatgattttcaggaactgaattagcccatcattattaacataaatgagaactaagacaccactgacttctgtttctgacttgccattcttactgttctagcttgtccttaaggcctctgtgctttttaacaaatggtttcttttgcagttggagttctctccacagacactgtgttgctacggcaaacagttgtgcacaatacctcgtgatgccacttattacagttaccagaacaggtaagcttggccaggtgtggaccatggtccatgtgtccacatgtccagggagtgcatgcggatgggccagcacacatacagtcatggttcatgtgtatcttgcttgaagacagctgtatagcacaagttctgttttttgccttctgcctttgtttgcagaacaataaaattttctatcagagtagccttgcatcagttacctgggttcctcccaagagcttgagaagttaagcaactttgtgagttgttggcctagatgggtctatatcccaggccccacttctctttctactgtgtgtttgttgatcaccacagcctgaggcaaaactgagaagatttttaaacttttaactgaaactcgctagacagctttttggaaatatttcctttttagatgaggcctatccctaagtagttgttattagaatatatgaaaacaggattctggagtcttttctttgcctcatattaagcaaattaaaaggaaaacctcacatagctctctgtaccttacttttcccaacccagccttgtatgtgacagaggatgatttgagtctaataaacgaggcacctctgcctaattttctcctgcccaatcaatggctgtaatcacataaatctcattcactaatctatcttaaccacaatttgtctcctgttttcagtgatcagctacaagtatagcttgcattgggtgtttatttggggctctgatacaataataacaaggctggatgatattaataccctttatttgtttgttaataccaaatccatggtgttggtttttgctgaacttgtgtgttgcagatgcatttctagctttgaaaagtcacttaaactttttcttttatttacaaaaagttaggcgtgcttctaatgctttgtagacctaatgctttgattttgcagtgagtaaaaatctagctctttactcatttgaaacctagaaaaggtgggactcaagttgttataagtaccttatgtttaaaaaagcaagtaactggacatgaaacttttctcatgtttactaaaacagtagtctaaagtgtttatctttgcaccaagccatctttaatcaggtacctgcacacatcatttccttttgaaatgtatcacttgatggctgtagtcagtatttaactgcttgtgcaggcttttcaataaacagttttttttctttctttgttgagacagggtctcactctgtcactcaggctggagtgcagtggcgcaatcttagctcactgcaacctctgcctcccgggttcaagcgattctcctgcctcagccttccaaatagttgggattacaggtgtgtgccaccatgccttgcttatttttgtatttttagtagagacagggtttcagcatgttggccaggctggtctcgatctcctgacctcagatgatccaccctctcagccttccaaagtgctaggattataggtatgagccaccacgcctggcaatggttgttttagattattgttttctgcagttgtatctatagtgggcttttggggtggggggtgggggtctgtggttttttgttttgtaagtgggaagaggtgtgattcctgtatttaggtaatgagtagcagttcttctctccctggtatatttatccttcttcctccttttgattatttacatcacatagcgttaattgctgaaatgaaaggatatgggtctgtgtaattgaaacatttgcttttatttgcagtaatcatttgctacttgtgatcccatttgagatatttaatgctaatctgtgctttgccttggctttctgctttgtgttgttctgtcttgcttttatgttttttgttgtcttgcaatccctcatttcttcgtttgttttgtgtttttttttctccctcatgcttgtcgttgtctgcacttggctttgattgcaaaaaaaaaaacaaaaaaaaacaaaaaaacaaacaaaaaaaccaaaacccaaactgtggggcccatatatctgcatcattgaatgtccttgtcgccgttgatgacctgctctctgctcccgtccccctccttggcctgctgtgattggtggcttcgttgcttggcttgggctgtgttgtgtgaacggaacagttcaccccagtatggccttcttgccgacaggtatcatttctgtgagaagtgtttcaatgagatccaaggggagagcgtttctttgggggatgacccttcccagcctcaaacgtaagtaactgcattattttgaaaagtgctaattagtttgttgtccagtgattatgcacagcttatttctaaatgaacttaagctatgctgttgaatatggtagccattagccacatgttgctatttaaatgcatattaatttaaataaaaattgtttatcacatggaatactcacatttcaactgttcagtagctatctgtgtctggtggctaccatattggtcaacacagagaacatatccatcatagtagaaagctctttgagacatcaatgaattagggaatatgtcagcaatgggcaatcatcttagttctagtaaaagtattctgtataggaagcaatcagcttctcttcgaaaaattggaggttagtacaagaaaacatcattattaactgttctgagtttgagggtgattgaactgatgaccaccttacacccttctcttgtaggttaacagaagacccaagtcactattgtagtgaataatagactttaacagcatgccggggtttaagagatttgcttgtgctttgcagtctcacaagctcttaccatttggtaaatggccaagaaaaaaatttcaaacatatagtctaatagtttaatctctggccaggcgtggtggctcatgcctgtcatctcagcactttgggaggccaaggcgggcggatcacgaggtcaggagatcgagaccatcctggctaacacggtgaagccctgtctctactaaaaatacaaaaaattagccgggcatggtggtgggcgcctgtagtcccagctactcgggaggctgaggcaggagaacggcgtgaacccgggaggtggagcttgcagtgagctgagattgggccactgcattccagcctgggcgacagagcgagagtctgtctcaaaataaataaaagaaaaaaagaaaaaagtaacttaagatgtaggcagtcattagaattcaaactgggactgtctaagaaggaaaaactgttcagtgtaattttaatattattgaaagttcatatttacttctgttcaggacgttgcacaaaaatttggaattctcttgttcctagtaaaaatggggcttctgagaaaagctggttaatttttctaaattgcgttctaaagatagcagtgtctgggtgctagctaggagagtagatactaggagcctttgatccttgaaacattttgacatttggttaagccaggaaggttagctctagggtaagtttccttgatgcaggaagagacgtaagccttgtcattgaactctcaggtggcttaccaaatagtctaaaccttaaggcagtacatctctaactttgaaaagagtaggaacaagacccttcccaattctgcaggcctgtagtggatccaagtgtctatttctaactcccagattgttctggtgctgctcatcttcagattgcacttggagtagcaagacaggccattcaggaaaatgctattaacagagatgaatgaatctctaggccataactagtataagaaacggttttcaatgtggacatgtcctcatttttgtaaggaagtataacagaagtccaagttggtccccctaatgttgattctagttggagaatgtggatcctagttggagaatggtaagactgttagcttttgtatgtagtgaggctatgagcagtgtgttatgctgggtttcaggatgggaagccatgatacctaacaccaagaatagtaacagacaagattttaaaaggaaaagaagaaacagtatttctagttcttcctgggttctccatttctgataagaggaaatttatttactatgaagtcctatagaatattcctttacataaacatgcattttgtgtgagccaagaatacacctatttaaatgtgtattcttaaaaaacctgaatctctatatagggtgaagtttgttcctttggttagaacagcagtcagattgctcatctctatcactttttctcattgtgtcccttttctctccttagtacaataaataaagaacaattttccaagagaaaaaatgacacactggatcctgaactgtaagtacgatccccttgaatagtcagtacgctttggcttttctttttccctttcattctcttgaagtttgcatgaccaatcagatgatcctatattcttgggctaaatctacataacatacatctaatggatagtaaaaccatggaaaacactgaagtactaaggaacattatttcttaatgttaattttaatgttcttaatgttgaatgtgaaacattaaagatctaaacttctagtttgcagtgaggccttttagatcatggaggactgacatgtatgtcttctagatgttcctaaaatggatgggatggtatttggatttatttggaattttcagcaccaggaatctgtcttaaaaattagccaggttttggccgggcacggtggctcacgcctgtaatcccagcactttgggaggccgaggcgggcagatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacctgggaggcggagcttgcagtgagccgagatcccgccactgcactccagcctgggcgacagagcgagactccgtctcaaaaaaaaaaaaaaaaaaaaattagccaggtttggccgggcacagtggcccacatctgtaatcccagcactttgggaggccaaggcaggatcacccaaggtcaagagttcgagaccagcctggccaacatggcaaaatcccgtctctactacaaatatataaattagctgtgcgtggtggtgcgcgcctgtaatcccagctactcgggaggctgaggcaggagaatcgctggaacccgggaggcaggggttgaagtgagctgatatgacgccactgcactccagcctgggcgacacagagagactccatctcagaaaacaaaacaaaaaacagccaggcatgatagtatgtgcctatcctagccaggtagctgagaggccaaggcaggaaaatggcttgagcccaggagtttaaggttgtagtgagctgtgatcatgccacccactccagcctgtacaacagagaccctatctctaaaaaaatagaaactttattaaaactattttcagttctttggtcatgaccttggctgtctttgtcagaagtcatgggaaatattgcaagttttcatttggttaaggtttggggttaattttggaattggctctgctcttccaggtttgttgaatgtacagagtgcggaagaaagatgcatcagatctgtgtccttcaccatgagatcatctggcctgctgggtaagtcttaacgttgttactttctctggaatttttctttatcgtgaatattaacaagttttttattctatgcaattgactgtattatatcttcaaagttactatctttaaattgttttctttgggtttggccacgataattatagttcgctttttaaaaattaagtaacctagtatccaaaaatagatttttatcttatttttatgcattcttcttagccatataaatatattttattctgctggattgtttattaaaattatattgtagttattacacatcaaaagtaaatatttatggccaggcgaggtggctcacgcctgtaatcccagcactttgggaggccgaggcgggcggatcacctgaggacaggggttccagaccagcctgaccaacatggcaaaacctcgtgtctactgaaaatacaaaaattagcctggcgtggtggtgcacgcctgtaatccagctactcaggagggaggctgagggaagagaatcacttgaacctgtgagggggaggttgcagtgagctgagatcacgccactgcactccagcctgggtgacagagtgagactctgtctcaaagaaaaaagtaaatgcttttgttccggcatctagaaactaggatcatgctgctggcatgaataggtctggccctggtaagggtcaccatttggttagggcaggaacagcaagttataaggctgcagtcatagtgtaattgcctagtaaaagggaggggccatcgctctgtacaagaggaactaatcccagccatgttccaaaggaagcgggtatatgggacatccagtgcctctcattaagatgggatctccatctcttctgctctgttcttgggctgattgttgttcctgatttggaggttacaagaaagggcaggctaattgacagatttcacttttctttttttcaccgttattttcacatagaaaataacactaaggaaaataggtgatggtttagtggatactttattttcagtgtgacttgtcttttaagtgtgcctttttagtgctttccttaacagatttcgtaagaatgattaagagacttcttgtggttcttctaatttaggatcagtcaactgaatgaaaataatctgttattactgtgttaagcttgctttttcttaaaagtaatttatgttcattataaaatttgaatagtatgacagtttatgaagtaaaaagcgacggtctcagcttctctcttcccacccagattcctcactacaggaataacactcttttgtacatacaatcatacattttctttttttctttttttgagacagagtttcgctcttgttgcccaggctggagtgcagtggcgcgatctcggctcactgcaacctctgcctcccaggttcaagtgattctcctgcctcagcctccctagtagctgggattataggtgtgtgccaccatgcccggctaatttttgtattttggtagagacagggtttcatcatattggtcaggctggtcttgaactcccgacctcaggtgatccacccacctcggcctcccgaagtgctgggattacagcatgagccactgcacctggcacattttcttgatttatgtgtatttaatttttaatttttgtattttgttataagtcatagacttttttaattgagtctcactttcatcacccaggctggagtgcaatggtgtgatctcagctcactgcaacctccacctcctgggttcaggcaattctcctgcctcagcctctcctgcctcagcctctcgagtagctgggattacaggcacataccaccatgtctgaccaattcttgtatttttactagagacagggtttcattatgttggtcagggtggtcttgaactcctgacctcaaaagatccacccacctcgacctcccaaagtactgggattacaggcgggagccaccacgcctggctggtcatagacactcatttatgtctgctgcatttttaatggatgcatagtattctgtaacatactataatccatttatttacttggttgatgaacaagtttatacaagaaactacttaggagacaaatatcatgtgcatttgcagtagctgaatctattggttctactctcaaaatgtactttccaactagtagcatataggaaatgtcacctcttaggatttttctcccctatcacattagcaaaacctatcttgatttgtaatccttgatcatcttttcctgtgtaaaccaatttatatgcccttcatgtttcttcatgtctgttgcttgattttcaattatcttttttattcttactgatttctaaaagctctttgtgtattagttttattaactcttcattagaaatttagaaatacttctgctagattgtcttttgaattttaactttttgttagtataaattcaacggtttatctaagttgtgtaagcaaagttttggtttacatttagattcgtctgtgatggctgtttaaagaaaagtgcacgaactaggaaagaaaataagttttctgctaaaagtaagttttattcttaaaggtaaattttggcaaaacttatctgaagcctagataagaaaccatccaaagtgaattactttgtttttaatcacagtaatagagtaaaaataaaataattctataatctccttatagttgatctgtaatatattttttggtgtgaaatttattagaccaaagaaaaaaatttccaaggaacggatttgtagaatgcacaagatacgtgtttttcctgttcctatatttttccctatttggggcatttcataaaggaggaataaggtgtggaaatgattggccggaattgccatctctcagtttgtttatttattattttttattttattttttgagagtctcactctgtcccccaggctgcacagtgcagtggcacgatctcagctcactgcaacctccgcctcccaggttcatgtgatttttctgtcttagcctccagtgtagctgggactacaggcatgtgcctccacacccagctaatttttgtaatttattagagatggcgttttgccatgttggccaggctgatctcaaactcctgatcacaggtgatccacccaccttggcctcccaaagtactgggattacaggcgtgaaccaccatgcccaacccctcagttcacaccatttatatgggctaccttttggccttatgtgattgttttctactgtgccaggaggatgtcaaaaattttatcatgtaagtaattaacactaataatctaaatgtagtatttgatttagttttggggtgttttactgatctacagattattttgattcttgtaaggtttctcaaaatgctcaaccttcgttactttaaaatattactgcaatctaggcaaagtacatagagatgttcattgtttatatatttgtgtgtgtgtgtgtgtgtgtgtgtatatatatatatatatatatatatatatatatatatatatatatatatataatgtttggttggttgggttttttgttttttggaaacaaggtttcactgtgttgtccaggctgatcttgaactcctggattcaagcaatcctcccacctcagcctcccaaagtacaaggattaggattatgggtgtgagccttgtctcctggccattgttctatttctgtttgtttttgtttttttttttgtttttttttttttttttttttttttgagacagagtctcgctgtcgcccatagtggcgcagtctcagctcactgcagcctctgcctcccgggttcaagcgattctcgtgcctcagcctcccaagtagctggaattacaggcgtgcaccaccatgcctggctaatttttgtatttttagtagagacggggtttcagcatgttggccaggctggtctcgaactcctgacctcaggtgatgcgcccacctcagcctcccaaagtgctgggattacaggcatgagctaccgcacccggcccctgttctgtatttttataaactcttccaaaattggaaatttttcaaaatgagaagttggggaaaatgatatttagaaattattgagtactgtgtctgctttaatagcacatgtattaaaattagaatgatatgaagattagcatgttccctgcactcatatgacatgtaaatctgcaaagtagtgactactttgctatgattttttaaaatttcaccaagttatcctgtttgtattgaaaaaagtacaaatgagatttgaggttgaaccttaagactaacaacagtaaatttgcacctcagtaacttttaacttttacattcctagggttgccatctaccagacttggcacctttctagagaatcgtgtgaatgactttctgaggcgacagaatcaccctgagtcaggagaggtcactgttagagtagttcatgcttctgacaaaaccgtggaagtaaaaccaggcatgaaagcaaggtatctagtcatttcacttttcttctcctcgtggatccaaaattgctcatacatggttactattggtgattccagtctgaatgagttatgttgtggttcccccaccatctcaattgtataggtttgtggacagtggagagatggcagaatcctttccataccgaaccaaagccctctttgcctttgaagaaattgatggtgttgacctgtgcttctttggcatgcatgttcaagagtatggctctgactgccctccacccaaccagaggtatgactagctcacagtggctagctccggatttgtgtgggagttccaacttataataggtggaaaagcataacaggcaagaaaatgtttagtgtgtttggtttggaaatgcaaaatctcaagtgtccagtaattttaaagtgaaacagattaaaaagcaaacccccaaacaaaataaccgctcaatactgctcttctgtggtcatagtaataaaggatatgaatagcaacctgaaattggaatttgaaaacaaacgtactactcttcagaaaatgagcttaaatctggattaagtagctatgtgaaaatatatcatacaaatcgggtgggaatttcttttctccaaaaatagtataaaggcaataataaaaacgtatagggatcaccaaatactgattgatgtgtatgtgccaggcactgctagttactacaaatagaaggaaaccacaggctcactgaacttccctgaagggttcacggcggagtcgcctacctgcctgtgatgagcttcacaaataacgatgtgagcaaagagcctgggagagtgagagggtgttattaggcacatggagtaaagaactcattatgtgacctgactttttttttcctcttcatttctcttcattttgtataggagagtatacatatcttacctcgatagtgttcatttcttccgtcctaaatgcttgaggactgcagtctatcatgaaatcctaattggatatttagaatatgtcaagaaattagggtaagcatattttgataatggctttttttctttaactagcatggcattctggtgagatataggttaaatatgcaaatatataactcttggcctttttttcctcattttagttcttacgtaacaattctcttaactttgttggagcccctttgaagttaatgtcagtagagagaaatggatatgttggccctagtttcacccatccaacattagttttgtttgtaagctaagccattgggtccactttgctttgaagtttgatttgtgcccctcatttgagggcagaattttaactgcatttgatccttttacaacctgggtatgaagaccaaaaacagttctggagatacttcttacctttagagtatgtatgtcattggaaacattcactccctcatcttgaagtctgtttctctgaacagtgtgccttttaatttagctcttgttaaatgggtccattttcctttgcagtgtaatcttcatttggtcttaacatgcagacttagggtttttggatccagggctaagtcacccacttcgtggctgagattcgcaacatcccaccatggcctccaaaaataagtaggcaatatgagatccattgttactactgtgagttatgcctaattttggcctcacaatgttaatctcattctgggttatatatacactgtgttatcttgggaaaaattattggtatctatatcaactccaacttgtggtttaaaatgtagccttctagaatagattatctcttttccttaatgttctttctctttgtattgttagttacacaacagggcatatttgggcatgtccaccaagtgagggagatgattatatcttccattgccatcctcctgaccagaagatacccaagcccaagcgactgcaggaatggtacaaaaaaatgcttgacaaggctgtatcagagcgtattgtccatgactacaaggtcagttgggacataggggccaggtgctgacaatagatctggaaatgcactaatgttgctgctctttgttctgtcatttaacttttttttttttttttttttttttttgagacggagtctcgctctgtcacgcaggctggagtgcagtgacacgattttggctcacttcaagctccgcctcctgggttcatgccattctcctgcctcagcctcctgagtagctgggactacaggctcctgccatcacacccggctaaatttttttgtatttttagtagagacggggtttcaccgtgttagccaggatggtctcgatctcctgaccttgtgatccgcccgccttggcctcccaaagtgctgggattacaggcatgagccaccgtgcccagccttttttttttttttttaaacaaaagtcttgcttgttctacctcttgcatgtaattcctaaaaatgctaatttgattgcttttattttgtatattcaaaatttttcaatataagaaaaaccaggttttgaagagcggtagatcaagaaatccctgttttaaacatgtaaccaaaattttattttatttatttttggggggagggtggggatagagttggggtatcgccatgctgcccaggctggacttgaactcttggcctcaagcattccaaagtgctgggattacaggcatgagccactgtgcccggccttaaaatatatctttttgttttggttttttgttggtttggtttgggttggttagggttttaggggtgtgggtgttttgttttcagaaagggtcactctctgtcacccaggctagggtgcagtggcatgatacccgctcattgcaacctgtgcctcccaggctcaagccatcctcccatctcagcttcctgagttgctgggactaggtgcacactacgagagctagctgatttttgtatattttttgtagagacaggatgtcaccatgttgcccaggctggtctcaaactcctgagctcaagtgatctgcccacctcagcctcccaaagtgctaggattataggcatgagccacatcacccagccaaaaatatattctcccttttttttttttggacggagtttcaggctggagtgcaatggtgcagtctcctgggttcaagtgatggtcctacctcagcctcccgagtagctgggattacaggcatgcaccaccaagccaggctaattttttctatttttagtagagacggggtttctccacattggtcaggctggtctcgaactcctgacctcaggtgatccacctgcctcggcctcccaaagtgctgggattacaggtgtgagtcactgcacctggccaaaaatatattcttaattaacagtattatgttattcataaatataggttgtctcatgatacagacttgtcttcctcaatttagtagttcaactaaataaagaagttttcctaagcagcccagcaaatcattctgcagcagatactatttccagtatttgtagttttggtcattttgaacaaagctgtcagtaaaagctgctgaaattccaaggatgggtgtgaggagggcatgcttcataccacatattctgtgataaggagtggtaggggccatggcatgcatgatggtgctaccaccctgacgttgatcctggcaggataattgccacttggttatataaaggcagataagctccctgtttttgtgggtagaagaaatagaaaaccggaaatattgactttaggccaggccttttcactatttatttttctaaatactccctggcttacggcttaggtataaagtctctgccagctttcaagacattttaagctttcatgtttcttgtcagccatgattattctgtataatcaatgctttaaaagaacatagaaattcctatatgtacatgcatgttttcacaggatatttttaaacaagctactgaagatagattaacaagtgcaaaggaattgccttatttcgagggtgatttctggcccaatgttctggaagaaagcattaaggaactggaacaggaggaagaagagagaaaacgagaggaaaacaccagcaatgaaagcacagatgtaagggcattgagtttcctttgaaacttctatcatgattctaatatttaatccagaagtgcacttaaactttcaattgggttttaaagctttcaggtgtaaaagagctctttaagttggacaagaaatattggcttagagaggttattagggttctgtttcagtggtattaaacttttaaagcatcagagccccttttaaaatggcatctcagactttgagtaatgtgaaatgataaaagaaactgaaggaaatcctgaaaaactgatagaagattacttatctgaaggactaggttatgaatattataggccttgtgggtcacatatctctggcatattttctgtcttttaaaaacacactctttttaaatgtaaaaaaccattcttagctatacaaaataggcctgagccagaatttaagttactaagcctggcttagtaacctcaccagttatttccccatagcatatctcgaattacctccattgaatttaacttaacaaaaggcacccttaaatagtctgttaacaaactcttacagccttgtcatttagtatttgtaggctcataacattttagaatatgagtggaaggaaataaaaccaaggtcttctggctccccactttgatacactcttcactaccccaaagtgccaccccttccttgttccctagccccaatctgggatacattcaatcaatctacagggtctgcacattctgtggcctcttctaggcaaaaagctaaagggctgccattgccttaaagatcactgggagaaaattaggtcaaataacaactttaaggagaaagaataagtgaagagaacagctagtaaaataagttacaggcataagattatgatatctagtttcaaagaagggagatattctgtgctattcccaaattacttaacaaaaaccttattttcttgtctcctttgtgctactctgcaggtgaccaagggagacagcaaaaatgctaaaaagaagaataataagaaaaccagcaaaaataagagcagcctgagtaggggcaacaagaagaaacccgggatgcccaatgtatctaacgacctctcacagaaactatatgccaccatggagaagcataaagaggtaagatgcagccacccagagttggggaaaaacggcaagatttctggccaggcatggtggctcacacctgtaatcccagcactttgggaggccaaggcgggtggatcacctgaggtcaggagttcaagaccagcctgaccaacacggtgaaaccttgctctactaaaaatacaaaattagctgggcatggtggcacatgcctgtaatcccagctactcaggaggctgaggcaggagaattgcttgaacctgagaagcggagattgcagtgagccgaggtcactccattgcactccagcctgggcaacaagagcgaaactccacctcagaaaaagaaataagaaatgaataaaaacactgactgttcgctgggcgtggtggctcatgcctgtaatcccagcactttggaggttgaggcaggcggatcacttgaggtcaggagttggagaccagcctggccaacatggcgaaccgaaaccccgtctctactaaaaatacaaaaattagcctggcgtggtggcacacacctgtaatccttgggatgctggggtgggaggatcacttgaacctgggaggcagaggttgcagtgcacttacagcctgggtgacagaacgagactctgtttcaaaaaataaaaagatttaacctttctgaaagtgaattagtaaatagaattggagaaaagttaaacttccacatatggacttacaacccccttctcaaaactttttgagttatttcatcatttacattgtttagttgttcttgcagtcatttgggaaaataactgggtaaggttttttttttctctctttaatatcatataattgataacgaaagccaggagaattgaagagtaattcctctcagggtttgtccaatggtagtaatctcgattgttcagtcagactcctcattttactatctcggttctcagacatataatcaagttcttataggaagtggtaattaagttgagagggaaatgaaggcttgatttcaggttgtaattccgtacctaaaaattggttaaacagtctctttgggagagaaatagttaacaaaatcttttttagagaggaatttgttataatgatgttatcatggtgaacacctatatacataggtgttcaaagtatcttttcccccactgctccccccatcaccaccccttttttgttagcctagaataatgggctacgatgtaataatggtaataaccattatctcagccatgctagtgaaatggaaggattcctgagttctaatacgttaggtaatgattattaacaattaatagttactagctatttcaagcagtaagtaatgccacagaatcctaggcagttgggaaaagcccttagaatatattgtaataggtttgacttaaattgtggacacattccatggctgtttaaatttaggttgtaaatccaagtattggcctggttgtagggtgacagaagcagcgaacattgctggccagagactgtgagtgtggctgccagtgtgcacagatgttgaataatctgttatcagtacagcagtttctcacaagttcctaatttcttaaggggatgttttacattttattactttaataggtgtttatagttatatactaattaatgtcaaatacatatgtaataccagctttttataccttttacactaatggttatgagaattgatggttgttacaagttttttcaaacttcaatgaacaagaattttattgctttgtcaacaaagactaagattttttatccattccattcccttccaaacctgtaggaaaagttacacaggaaagttgcataggggaccttcatgagtccaggccagttgtttttcatactgtctccatatttggatttgtctggtttgttgtaattagattgaggttaaaccatggattgcatcttaaagtagactgccttgaggcaaaatgtccactgtgcatggtgctatacctcacccagaccattgttactctgaaggagttactgaatgaaggagaaaaaaatcacaggatgtgcatttcagttctatttatagtcagtctcaagagaccaaagaggtaaagcaggaaaaggaacaggaggcgtatggtggtgaaactaactcagcattcgccagtctcattggtgctcagcctgctgtacctgctcacacctgtaatcccagcactctgggaggctgaggcaggcagatcacttgagcttaggagtttgagaccagcctgggcaacatggcgaagcctcgtctctacaaaaaatgcagaaattagccaggtgtggtggtgtgggcctgtggtctcagctattcaggaggccatggtgggataattgcttgagcccaggaggcagaggttgtagtgagccaagatcacgccactgcattccagcctggatgacagagcgaggccctgtctcaaaaaaaagagactgtctgtttttcaggtcttctttgtgatccgcctcattgctggccctgctgccaactccctgcctcccattgttgatcctgatcctctcatcccctgcgatctgatggatggtcgggatgcgtttctcacgctggcaagggacaagcacctggagttctcttcactccgaagagcccagtggtccaccatgtgcatgctggtggagctgcacacgcagagccaggaccgctttgtctacacctgcaatgaatgcaagcaccatgtggagacacgctggcactgtactgtctgtgaggtaggcaccgggttgtgggaaggaggaggtgagctccgcagggttgttctgaggggccatgcagccacgtattttatagaggcctgtgggatgctaggggcttggcctcgtgtttgaggggcagagctgaagaggctagtttttgttctacgaaaggggcttttctagcccaaacaatatctaaaatacttttgaatgacttaaatcttggagagtttacgtgcacctcctgttttttccctaggattatgacttgtgtatcacctgctataacactaaaaaccatgaccacaaaatggagaaactaggccttggcttagatgatgagagcaacaaccagcaggctgcagccacccagagcccaggcgattctcgccgcctgagtatccagcgctgcatccagtctctggtccatgcttgccagtgtcggaatgccaattgctcactgccatcctgccagaagatgaagcgggttgtgcagcataccaagggttgcaaacggaaaaccaatggcgggtgccccatctgcaagcagctcattgccctctgctgctaccatgccaagcactgccaggagaacaaatgcccggtgccgttctgcctaaacatcaagcagaagctccggcagcaacagctgcagcaccgactacagcaggcccaaatgcttcgcaggaggatggccagcatgcagcggactggtgtggttgggcagcaacagggcctcccttcccccactcctgccactccaacgacaccaactggccaacagccaaccaccccgcagacgccccagcccacttctcagcctcagcctacccctcccaatagcatgccaccctacttgcccaggactcaagctgctggccctgtgtcccagggtaaggcagcaggccaggtgacccctccaacccctcctcagactgctcagccaccccttccagggcccccacctgcagcagtggaaatggcaatgcagattcagagagcagcggagacgcagcgccagatggcccacgtgcaaatttttcaaaggccaatccaacaccagatgcccccgatgactcccatggcccccatgggtatgaacccacctcccatgaccagaggtcccagtgggcatttggagccagggatgggaccgacagggatgcagcaacagccaccctggagccaaggaggattgcctcagccccagcaactacagtctgggatgccaaggccagccatgatgtcagtggcccagcatggtcaacctttgaacatggctccacaaccaggattgggccaggtaggtatcagcccactcaaaccaggcactgtgtctcaacaagccttacaaaaccttttgcggactctcaggtctcccagctctcccctgcagcagcaacaggtgcttagtatccttcacgccaacccccagctgttggctgcattcatcaagcagcgggctgccaagtatgccaactctaatccacaacccatccctgggcagcctggcatgccccaggggcagccagggctacagccacctaccatgccaggtcagcagggggtccactccaatccagccatgcagaacatgaatccaatgcaggcgggcgttcagagggctggcctgccccagcagcaaccacagcagcaactccagccacccatgggagggatgagcccccaggctcagcagatgaacatgaaccacaacaccatgccttcacaattccgagacatcttgagacgacagcaaatgatgcaacagcagcagcaacagggagcagggccaggaataggccctggaatggccaaccataaccagttccagcaaccccaaggagttggctacccaccacagcagcagcagcggatgcagcatcacatgcaacagatgcaacaaggaaatatgggacagataggccagcttccccaggccttgggagcagaggcaggtgccagtctacaggcctatcagcagcgactccttcagcaacagatggggtcccctgttcagcccaaccccatgagcccccagcagcatatgctcccaaatcaggcccagtccccacacctacaaggccagcagatccctaattctctctccaatcaagtgcgctctccccagcctgtcccttctccacggccacagtcccagcccccccactccagtccttccccaaggatgcagcctcagccttctccacaccacgtttccccacagacaagttccccacatcctggactggtagctgcccaggccaaccccatggaacaagggcattttgccagcccggaccagaattcaatgctttctcagcttgctagcaatccaggcatggcaaacctccatggtgcaagcgccacggacctgggactcagcaccgataactcagacttgaattcaaacctctcacagagtacactagacatacactagagacaccttgtagtattttgggagcaaaaaaattattttctcttaacaagactttttgtactgaaaacaatttttttgaatctttcgtagcctaaaagacaattttccttggaacacataagaactgtgcagtagccgtttgtggtttaaagcaaacatgcaagatgaacctgagggatgatagaatacaaagaatatatttttgttatggctggttaccaccagcctttcttcccctttgtgtgtgtggttcaagtgtgcactgggaggaggctgaggcctgtgaagccaaacaatatgctcctgccttgcacctccaataggttttattattttttttaaattaatgaacatatgtaatattaatagttattatttactggtgcagatggttgacatttttccctattttcctcactttatggaagagttaaaacatttctaaaccagaggacaaaaggggttaatgttactttaaaattacattctatatatatataaatatatataaatatatattaaaataccagttttttttctctgggtgcaaagatgttcattcttttaaaaaatgtttaaaaaaaaaaaaaaactgcctttcttcccctcaagtcaacttttgtgctccagaaaattttctattctgtaagtctgagcgtaaaacttcaagtattaaaataatttgtacatgtagagagaaaaatgactttttcaaaaatatacaggggcagctgccaaattgatgtattatatattgtggtttctgtttcttgaaagaatttttttcgttatttttacatctaacaaagtaaaaaaattaaaaagagggtaagaaacgattccggtgggatgattttaacatgcaaaatgtccctgggggtttcttctttgcttgctttcttcctccttaccctaccccccactcacacacacacacacacacacacacacacacacacacacacactttctataaaacttgaaaatagcaaaaaccctcaactgttgtaaatcatgcaattaaagttgattacttataaatatgaactttggatcactgtatagactgttaaatttgatttcttattacctattgttaaataaactgtgtgagacagaca

SEQ ID NO: 3 - DNA, 84193 bp, Homo Sapiens
gtggcgcgagcttctgaaactaggcggcagaggcggagccgctgtggcactgctgcgcctctgctgcgcctcgggtgtcttttgcggcggtgggtcgccgccgggagaagcgtgaggggacagatttgtgaccggcgcggtttttgtcagcttactccggccaaaaaagaactgcacctctggagcgggttagtggtggtggtagtgggttgggacgagcgcgtcttccgcagtcccagtccagcgtggcgggggagcgcctcacgccccgggtcgctgccgcggcttcttgcccttttgtctctgccaacccccacccatgcctgagagaaaggtccttgcccgaaggcagattttcgccaagcaaattcgagccccgccccttccctgggtctccatttcccgcctccggcccggcctttgggctccgccttcagctcaagacttaacttccctcccagctgtcccagatgacgccatctgaaatttcttggaaacacgatcactttaacggaatattgctgttttggggaagtgttttacagctgctgggcacgctgtatttgccttacttaagcccctggtaattgctgtattccgaagacatgctgatgggaattaccaggcggcgttggtctctaactggagccctctgtccccactagccacgcgtcactggttagcgtgattgaaactaaatcgtatgaaaatcctcttctctagtcgcactagccacgtttcgagtgcttaatgtggctagtggcaccggtttggacagcacagctgtaaaatgttcccatcctcacagtaagctgttaccgttccaggagatgggactgaattagaattcaaacaaattttccagcgcttctgagttttacctcagtcacataataaggaatgcatccctgtgtaagtgcattttggtcttctgttttgcagacttatttaccaagcattggaggaatatcgtaggtaaaaatgcctattggatccaaagagaggccaacattttttgaaatttttaagacacgctgcaacaaagcaggtattgacaaattttatataactttataaattacaccgagaaagtgttttctaaaaaatgcttgctaaaaacccagtacgtcacagtgttgcttagaaccataaactgttccttatgtgtgtataaatccagttaacaacataatcatcgtttgcaggttaaccacatgataaatatagaacgtctagtggataaagaggaaactggccccttgactagcagtaggaacaattactaacaaatcagaagcattaatgttactttatggcagaagttgtccaactttttggtttcagtactccttatactcttaaaaatgatctaggacccccggagtgcttttgtttatgtagcttaccatattagaaatttaaaactaagaatttaaggctgggcgtggtggctcacgcctgtaatcccagcactttgggaggccgaggtgggcggatcacttgaggccagaagtttgagaccagcctggccaacatggtgaaaccctatctctactaaaaatacaaaaaatgtgctgcgtgtggtggtgcgtgcctgtaatcccagctacacgggaggtggaggcaggagaatcgcttgaaccctggaggcagaggttgcagtgagccaagatcatgccactgcactctagcctgggccacatagcatgactctgtctcaaaacaaacaaacaaacaaaaaactaagaatttaaagttaatttacttaaaaataatgaaagctaacccattgcatattatcacaacattcttaggaaaaataactttttgaaaacaagtgagtggaatagtttttacatttttgcagttctctttaatgtctggctaaatagagatagctggattcacttatctgtgtctaatctgttattttggtagaagtatgtgaaaaaaaattaacctcacgttgaaaaaaggaatattttaatagttttcagttactttttggtatttttccttgtactttgcatagatttttcaaagatctaatagatataccataggtctttcccatgtcgcaacatcatgcagtgattatttggaagatagtggtgttctgaattatacaaagtttccaaatattgataaattgcattaaactattttaaaaatctcattcattaataccaccatggatgtcagaaaagtcttttaagattgggtagaaatgagccactggaaattctaattttcatttgaaagttcacattttgtcattgacaacaaactgttttccttgcagcaacaagatcacttcattgatttgtgagaaaatgtctaccaaattatttaagttgaaataactttgtcagctgttctttcaagtaaaaatgacttttcattgaaaaaattgcttgttcagatcacagctcaacatgagtgcttttctaggcagtattgtacttcagtatgcagaagtgctttatgtatgcttcctattttgtcagagattattaaaagaagtgctaaagcattgagcttcgaaattaatttttactgcttcattaggacattcttacattaaactggcattattattactattatttttaacaaggacactcagtggtaaggaatataatggctactagtattagtttggtgccactgccataactcatgcaaatgtgccagcagttttacccagcatcatctttgcactgttgatacaaatgtcaacatcatgaaaaagggaaatgattccatagcgttattatgaaagtagttttgaactgtaatggtagaggatgaatagctcacaatacaaatttgtcatttccctttaagagagaattcccattttatgtgagagtccacatgttcctcatacccatagtttgccacatcttgagtactcttcagaattatttgaattttttgaattttatctgtggaatgtatttttttttttttcttttttgagacacagtcttgctctgttgcccaggctggaatgcagtggcgtgatctcggctcactgcaaccaccgcctcctgggttcaagtgattctcctgtggcagcctccggagtagctgggactacaggcgtgtgccaccatgcttggctaattttttgtgtttttagtaaagatggggtttcaacgtgttagcaaggttggtctcgatctgacctcgtgatctgctcgcctcagcctcccaaagtgttgggattacaggcgtgagcccccgcacctggccgaattttatcgtggaatgtattcttaatgtgaatagtttttgattccgaaccatgaataataagaaaataaataaaatttaaatgaaaataaaagctaatatatacagcttttaataatatagttaaatgccatcttgtaacttttgtgaactcttgttacacctttctatagattcgcaagagaatggattaatgatcttgtttaattaatatgccttaacaaaagtaatccatagtcaagatcttaagcatttttttccttatgatctttaactgttctgggtcacaaatttgtctgtcactggttaaaactaaggtgggattttttttttaaatagatttaggaccaataagtcttaattggtttgaagaactttcttcagaagctccaccctataattctgaacctgcagaagaatctgaacataaaaacaacaattacgaaccaaacctatttaaaactccacaaaggaaaccatcttataatcagctggcttcaactccaataatattcaaagagcaagggctgactctgccgctgtaccaatctcctgtaaaagaattagataaattcaaattagacttaggtaagtaatgcaatatggtagactggggagaactacaaactaggaatttaggcaaacctgtgttaaaatcttagctcattcattaattgtgtcatgctgggcaaatcagtctctctggcctctttttcctcactcgaaaaatggagacgatgaaaataatgtctcataggtttggattaaattaaataatgtaggtacttagtaaatgttctctttcatccctcctttgataaatttgccaactgagatttgctgaattacgtctttcttatgccaaaaaaacctaggacttgttttgatgttaattaaactaaactatatttctgcaagctatcacagaggacagagattattttaccgatatactataagtatcatgatttggaaggagtttccctggcgtaggtgccgcatgtttctaagcaattatgtaataagattatatattcagtcattcaaataattattacctacttgacataagtaatgaactttcccttttcttcagagtgttaatctctagtaaggggaataaagagtacacagataaagtatagtgtaaggttgaatgtagtatgtgctaagagaaaaatataaaaaagtataatgagagttgagaagaaagagcaaatagtattgggcaaagttaggcaattattcctttgagctaaaccttgaaggataggtgagagattaagaaatttgaagatgtggtagagtgataatgttctaggcagagggaacaacatgaggaagaatatgtagtgtgttcaggaaatagcaagtaattcaggttggctttggttgttttgtgtctgaaagggaccaatagacaaggcaaaaaggcagactaaaggcaggcattgaatgccaagctaaagaaattgaatttgtttggttggttggtgagcagagaaatcacatgcaaatttcatcatgctacttattgtgtcaaaccttagatcacctccctttgtccttatagcaaaatctaaacttgatatggctttcaagttcctttgtgatcaggcccctgatttacactcttggctcagcttgccatattcatcctctcacctatcttcatttgccattcattcctactgaatttcttttcgttaccaaaaccacaatgctctctggctctttattaaacatattgttacctctacccacaacctactttttccctactttttgtctagctaatttgcgtgctcgtctttcagatcttggcttatttctgcttctgagaaatacttcctgtctgccctcgttgagcttctagtgaaggagacatacataagcaattatagtgtgatacatgctttgaaagaaattcatggctatagggagtgcatatacaaagggaatataggtaatgggcaaatatttacatgtatgttattggataccaaatggtatacataggattcagtaaatatttgtagagtgagtattagtattatttgctttagaaagcctaatgatcaaacagcagtctttggagataacgtttttcaaaatgtcatgtctgtgccattagaatcttctagactgctcattgaaaggacagattccaggccccactctgaatctcttaatttataatttttggaaatgatgcccatgagtctacattttaaactacctgaatgatccctatagaaagagaaaactggaggtaggaagatcagttaggggatgtgtaatggtctaggtgatagagacaagtgcctgaattacagtaataacagtgaaagtaaatatggaacataaaactataggaccttgcagtagtctagatatggaggattcaaaaaaaggaacaaatgacagggcaaagcatatgcagaacacagtagtaacagtcatagaaatggataagggagtcatccattctgcaaatacttagtgcttacttgtgtctggcaacctgctcggcattaaggatacaaatatgaataagatgtcctttgacctctaagtactcagtctcgtaagcacgtcttgtaagcacatcttggttgcttccataaaaataaatacactagtgtgatatgttataagagcatgtaccaagtgcatgaaaagtgagcagccatctctggttggtcagaaaaagctccataaagcagtttttgctgaatcttgaaagatatacctaaggtcaaatggttaattctttaatcataacctgctagaattgatctataaccaaggaaggatagtaaggaattaataaggccactctcaactcactgcaaaggagttaactttttgaaggctgtaatacataaatctgctgactagtctcttgagaccttttgcttttacgtttactttagattcagtattgaaaagtaagagtaatggacttaagctgtgtttttcaacctgttttgttcagttctaacatgtaatattttttaaaaaattattcctaaagttctatgaggaattgtgctgtttctgcctctcagcagtccttccttttgcattaaatcataggcatttctgttaccattcttcagcttattaatgagatcctcaggttatttgggaaatgtttatttggtaattaactctttttcacctagttcatttttttaacttttttttttaaatagccgagtttcttttcattgctgaactaaaatggatgtgttattattagctgaactccttagtttactttagagttcaccctttgtatggttctatggattttgacaaattgtataatgtcgtatatctgccattatggcattatacagaataattttgctgccctaaaaatctcccgagttccacctgctcacccatccctcctcctgagcccctggcagccactgatctttttactgtctgtatagttttgccttttccagaatgtcatgtagttggaatcatacagaatatagcattttcagactggcttctttcacttagcaatatgccgagaccagctcgattgtagagaccctaacccagcggcactagaggaattaaaggcacacagaaatatagcggtgtggagtgggaaatcaggggtctcacagccttttgacagcaagccagtgataagcattgtttctatagattatagattaactgaaagtattccttaggggaaataaagggctgggccgaagtaaagggatgggtctggctagttatctgcagcaggagaatgtccttaaggcacaggtcgctcatgatagtttgtggtttaagaacgcctttaagcggttttctgccccgggtgggccaggtgttccttgccctcattccggtaaacccacaagcttccagcgtgggtgtcatggccatcacgaacatgtcacagtgctgcagagattttgtttatggccagttttggggccagttcccaacagcaatatgtgtttaaggttcttccatgtcttttaatgatttcatgctgaataatattccatcgtattgatgtaccacagcttgtttatccattcatctattgaaggacatcttgattgcttccaaattttggcaattatgaataaagctggtataaatattcacatacaggtttgtgtgtgaatatattttcaactcattttggttcacaccaaagagcacgattgtgggatcatatagtaagagtatgtttagttttatgagaaactacaagctttcttccaaagtagctgttgcattttgtattcccaccagcagtgaatgagagttcttgttgctcacatcctcaccagcatttggtgtgtcagtgttttgaattctagccattctaacaagtgtgtagtggtacctcattgtttgttttatttaattttttttttttttttttggagatgaaatctcgctttgtcgcccaggctggagtgcagtggcgtgatcttggctcactgcaagctccgcctcccaggttcacgccattctcctgccttagcctcctgagtagctgggactacaggcacccgccaccacacctggctgatttttttgtatttttagtagagacggggtttcactgtgttagccaggatggtcttgatctcctgacctcgtgatccgctcgcctcggcctcccaaagtgctgggattacaggcgtgagccatcatgcccggcctgttttattttttaaagtcaattttctttcaagaattagctactttttagtatctttaattaaaaatctcattagagaaggaggttggatattttgttgaagtggggtttttaagttacacatccatttgctttattagtgattatgtctagtccatgttaacttgaaaaatgagactataatgagacattttatttaggctgctacaaacagttttaaatttggtcttcactttattttagtaacattgatagagcttatttttcccaaaagctaagttagagattataggaccaaccgaagcaactattttctaagagtaataataagtgactcaggtgccaaatttgtagttaccatcaactattggaaccatatgagtacttaatgccctggagagtcaaatataatctactctaatacagaaaatagaaatattgaaaaactgtaaattggatttcatattgttaaagccacctatagctttagaaactctgaacattattttcttagaaaatggatgtgttcaataagaatagaaattatgtattactgtctgcaactcactttgtctaattatatccaatttattcatccagtcaatatttcaggagtgactaatataccagacatttttgtagttgctagggatacagtgacaaataagacaaaatctctacctcagattgctcacagcctagtagggggaaaaagaacagtgtatgatcaaactcttcagggaacacataggggggcaaacacttaatcttaccttagggatcactacagttttctggaggaggtagtttctaaatggaagcctgaaagagttgttccaggtcaagaaaagcaaagaaggggaaacagcttgtacaaagtcctagaggttaaagaaaacattctttcaggatatgcaaatggttgggtatgggtaaaaagtagactgtaaaagaatggcatcataaaaattaagtaaattgtcacataaatatatatatttcttatgtacccacaaaaattaaaaatgaagaaattaagtaaattgtgaaaggccttcatactatggagtttgacttgatcttgaaaagtaagatcttgaaaggtttttagcacaagtgatattgtcagatctggtacattggtaggttttcagtaaatgtcttcccttactccttttttctctttccttctgcttttgtttaaagcgacaagatgttgctcttttcccaggctggaatacagtggcatgatcatagctcaagctcctgggctcaagtgatcctcccgcctcagcctctcaagtagctaggactacaggcatatcaccacaccagcgttttctttgtagaggcagagtctcactctgttgctcaggcaggtgttgaactcctgcctcaagcaatcctcccacctcagcctcccagagccctcaaattataagccactgtgctcggggcatcctttttggggggtaatcagcaaactgaaaaacctcttcttacaactccctatacattctcattcccagtatagaggagactttttgtttttaaacacttccaaagaatgcaaatttataatccagagtatatacattctcactgaattattgtactgtttcaggaaggaatgttcccaatagtagacataaaagtcttcgcacagtgaaaactaaaatggatcaagcagatgatgtttcctgtccacttctaaattcttgtcttagtgaaaggtatgatgaagctattatattaaaatatttaaatgaaacattttcctacatatatttgttctataaagatgaatctgatttttatgctaatattttggctaagagcctggtagaagatcttacatttttaaataatcttttaggttgagtcctttaatagaatagtttttacattagaaacatgtaagttgttgttcttgtgatgttgaattggctggttttctgtatattctgtgattttttaagtaacaaaaataacagtggtgaaaagcagtaagtcagtccttgaattatcaatttaaaataaattgtgtacttttcatctttggagagaatatgatttactttacaaattttttttttgttttttttttttttgagatggagtctctgtcacccaggctgtagtgcagtggtgcgatctcagctcactgcaagctccgcctcccgggttcacgccattctcctgcctcagcctcccaagtagctgggactacaggcgcccgccaccatgcccggctaattttttgtatttttagtagagacggggtttcaccgtgttagctaggatggtctcgatttcctgacctcgtgatccgcccgcctcagcctcccagactgctgggattacaggcgtgaaccactgtgcccggcctactttacaaaatttttgagtttaaaatacacggtttccagcagctgaaatttgtgagtacatatgtgttggcattttaaacatcacttgatgattatttaatgcttcatgagagatttactttttaaaatgtaatataaaatatctaaaagtagtattccaacaatttatatgaatgagaatcttcttttaaaaataagataaactagtttttgccagttttttaaaataacctaagggatttgctttgttttattttagtcctgttgttctacaatgtacacatgtaacaccacaaagagataagtcaggtatgattaaaaacaatgctttttattcttagaatactagaaatgttaataaaaataaaacttaacaattttcccctttttttacccccagtggtatgtgggagtttgtttcatacaccaaagtttgtgaaggtaaatattctacctggtttatttttatgacttagtaattgagaatttgacaatagcgttatacctttgccctgagatttacaaatctgtacctagcattctgcctcatacaggcaattcagtaaacgttaagtgaaataaagagtgaatgaaaaaataatatccttaatgatcagggcatttctataaaaaataaactattttctttcctcccagggtcgtcagacaccaaaacatatttctgaaagtctaggagctgaggtggatcctgatatgtcttggtcaagttctttagctacaccacccacccttagttctactgtgctcataggtaataatagcaaatgtgtatttacaagaaagagcagatgaggttgataattgtcatctctaatacttctgttaaaaggaaatatgaaaagaaaatattagataatgtctttgataagtgtgttagtaactgacaataattttattctattaagtgtagattggaataaatacaaatacatttagtggtagtccagtggtgtcaagcattatgttttagtacgatgtgattaacgtagaatagcttacaaatattcctttactggcctatataagcgtttaagaggcagtatttggtgtgactgaattctttttacaaatgattgtggtaattggggcattaaagcagcattaaataagcttttgttttctctacttaaatgtgttctaaggtctgtattgccagtagtactgaattgaggtcttaaattccacaagtgtaattacacaactatgtgataaactgcaatatttatccattcattaaactgtaaactctttgcagtctcaccacagtttctcttactaggatctagaaatatttcctattgtaggctggttgcagtggctcacgcctgtaatcccaacactttgggaggctgagaagggtggatcacgtgaggccaggagtttgagagcagcctgtacaacgtggtgaaaccctgtctctactaaaaataaaaaaattggccaggtgtggtaacacacacctgtaatcccagctacctgggggctgaggcatgggaattgcttgaacctgggaggcagagggtgcagtgagccgagattgtgccactgcactccagcctgggtgacagggaggctgaggtgggaggatcacgaggtcaggagatcgagaccatcctggctaacgtggtgaaaccctgtctctattaaaatagaaaaaattagctgggcgtggtggcagacacctgtagtcccagctactcaggaggctgaggcaggagaatggcatgaacccgggaggcggatcttgtagtgatctgagatcatcacgccactgcactccagcctgggcaacagagcaagactctgtctcaaaaaaaaaaaaaaatcctgttataaaactacttaaaaatctctgagtagctgagatttggctaatcatgacttagtatttgaaaagttgtgactattttttttttttttaattgagacaaggttcttctctgttgcccaggctggagtgcagtggcaccgtcgcagttcactgcagcctcaacctcccaggctcaattaatctttcttcctcttagccttccaagtatctgggactacaggtaccatgccaccagtatactaccagtcctggctaattttttttgtattttttgtagagatgggtcccgccatgttgcccacacttgtctcaaattcctgagctcaagcagccaccacacccacctgtgaccattcttttttatttttatgagataataaacatacaagtttaaagaaatgtctgtacataaatgtgattatagtacaaacaagtatttggaagttcatctaaacaaatgcatcacagtttataggcaaaacatgaaagattggataataatgggaaaaaaagtaaatattcaccaacattctttctcttttttctttttcgttttttttttttttgaggcggagtcttgcccttttgcccaggctggagtacagtggcaccatctcggctcacagcaacctctgccttctgggttcaggcgattctcctgccttagactcccgagtagctgggattacaggcacccaccaccacgcctgactaatttttgtatttttagtggagaggaggtttcactgggttggccagggtggtcttgaactcctgacctcaagtgattcgtttgtctcagccacattttttttgtctaagaagatactgggccagatcattgtttctcaaattgcagattatgacctgttcatagttgtgaaacttattttgtgagtcgtatatgctctttttaaatgaaatgaaaattctgagtacatcacatgtagttagggtttagaaaataaaaaatacaatatatctagttaaatttggacttcaggtaaacagcgaataattttgagatatacttaacactaaaaaattattcattgtttatctgaaattcaaatttaatgaggtgtcctgtattttatccagaagtcctacacacagtaaagtttgttttgtaaaacttttttacttaacctttgtgtgcccatgtgtgtgtgcagtcataaagtgtgtgtgtgtgtgtgtatttaaaaaactaggttgtactcaaagcctgagcttaatttattcccaaaccagtattacattttgtttattctagcaaaatagcattctgttttgattcctctttagctgggagtaagttaaccctattctgttgcttagatgaaataatatggataaaatcattttgaaaatatgtatttaatatatagtatgcctttaggctgtagtgttgtctaaatgaatgctaaagtctccaagctttagcttttaagtcataacctcacagcatcatctgactttccaactcattgtggacagtattaccataaagtaatgatcaccaagccatatcttaccaccttgtgagtagtactaaggaagtaagtatagtttattcactgtgttgattgacctttctaattactatacttaagtacttgaatcaattcattttgtttcaaatgtgtcatgtaatcaaatagtagatgtgctttttgatgtctgacaaaaaataagtttttgcattctagtgataatatacaatacacataaatttttatcttacagtcagaaatgaagaagcatctgaaactgtatttcctcatgatactactgctgtaagtaaatatgacattgattagactgttgaaattgctaacaattttggaatgccttgttaaattatttatcttacatttttaatttcctaatctgtaatttatctaagcctttgagaaagtctctaaacctggtcctatatgtgattttaacttcctgtgaaactctgctgtctctctgttaaagttgcatatatacaatatataccgtagtcccctattcatggggtatacattccaatatcccccagtgaatgcttgaaaccttagatagtaccgaaccctatatatatatattaaaaatgtgtagtatttatatatatatacctataatctttttttctataagcacataccctgtgataaagtttaattcataaattaggcacagtaagagattaacaagaactaataataaaataggacaattataacaaaataccgtaataaaagttatgtgaatgttgtctctctgtctcaaaatatcttattgttctgtactcatgtggcagcagcttcatcagcagatgtggcctctccagtaatttttatatttttcagtccaaacctattcttgaatctgtgtaaccaaccatcccttacttgcagtaaatggcttggtgtcattcatttcaggggatcccttactgaagttttcgtttaggctctatgctttctggcgtaatatgtagctgtcaatcaaaacaacctgttcatgttttctacccacaaatgtaataccttttctacttctatggtgcactgtgtggccacaacatttgcagtttgaggtgtgacagcaaaaccagctcatatgtctttctccttcacaatctcacagatagatttgttcttaccatagatgtcgcagtacaatttttttcctttccttaagtcgagaactttcactgtttcaattaaaggaagcactttatggcttctttttggcatatttgaattgccagcatcattatacttgtgctttggggccattgttaagtaaaataagggtgacttgaacacaagcactgtggtaccacaatagccgatctgataaccaagacaactactaagtgactaataggtgggtaccatatacagcctggatacgctggacaaagggatgattcatgtcccaagtgggatggagcaagatggtgcaagtttttttttctccatttccattttcctttcctaagatttccacatcctagtggtgcaagatttcatcacactactcaggatgacacacaatttaaaacttactaattgcttacttctggaattttccattaaaaatttttggacctaggttgattgcagataactgaaatcaccaaaagtgaaaccatggataaggggggactactactatatgtgcattgagagtttttatactagtgattttaaactataatttttgcagaatgtgaaaagctatttttccaatcatgatgaaagtctgaagaaaaatgatagatttatcgcttctgtgacagacagtgaaaacacaaatcaaagagaagctgcaagtcatggtaagtcctctgtttagttgaactacaggtttttttgttgttgttgttttgattttttttttttgaggtggagtcttgctctgtcacccgtgatctcggtttaccgcaacctctgcctcccgtgctcaagcgatcctgcctcagcttgccaagtagctgagattacaagcatgcaccaccatgcccaactattgtatttttagtagagatggcatttcaccatgttggccaggctggtctcaaatggtcgtgagccaccatgcccagcctgaactactctttttaattggcaccattgaaggattgctcctcttttcttaaagagaaaatatattacctttcctttcttgactactgaagtagtattttatctcaaagtattgagagtagaaactaacttggtgtgcctgtgatcccagctactcaggaggctgaggtgggaggatcgcttaagcccaggcggtcaaggttgcagtgagctgtgtgtgtgccactgcactcccacctgggcaacagagtgagaccgtgtctcaatggaaaaaaagagaaactaatttgatttcgatgacagtatttaaatactgtgtaagacagtactatttaatatgtggttgtgacacaaaaacaaagcctattgaaaattttcagagacaataagatatataattaacaaaatctgagctttttttttttctaattagaaagtaaatgtggtttagatataccatagtttacctaatcaggtcatggaatattgcatttttcttagtatgtgtgtatgtctgtataactgtgtaggatttgatatctgtttttgtctgtgtggtatcatgtacgtatgtatatgcatatgtaaaatcagatttacccttgttatagggccacagaattgatttggaacatctgttttgataggtcttagaatatttaattgtatatatagtaagattaggtgagttttaattgtgtagaactgctaaagaaaggtttttagggattgttgtatgaataaaaggctttaggttcattggaatcaggggaatcaggctttactagaagaacaggagaaggggtgactgaccgaaaaataaaatgccaagtactcagaataaccctttaaatactgatatgtaatatttagcacattctacataaactgtttctatgagaaaggttgtgagaataatataaattatatggcttataaaatattaatgtgcttctgttttatactttaacaggatttggaaaaacatcagggaattcatttaaagtaaatagctgcaaagaccacattggaaagtcaatgccaaatgtcctagaagatgaagtatatgaaacagttgtagatacctctgaagaagatagtttttcattatgtttttctaaatgtagaacaaaaaatctacaaaaagtaagaactagcaagactaggaaaaaaattttccatgaagcaaacgctgatgaatgtgaaaaatctaaaaaccaagtgaaagaaaaatactcatttgtatctgaagtggaaccaaatgatactgatccattagattcaaatgtagcaaatcagaagccctttgagagtggaagtgacaaaatctccaaggaagttgtaccgtctttggcctgtgaatggtctcaactaaccctttcaggtctaaatggagcccagatggagaaaatacccctattgcatatttcttcatgtgaccaaaatatttcagaaaaagacctattagacacagagaacaaaagaaagaaagattttcttacttcagagaattctttgccacgtatttctagcctaccaaaatcagagaagccattaaatgaggaaacagtggtaaataagagagatgaagagcagcatcttgaatctcatacagactgcattcttgcagtaaagcaggcaatatctggaacttctccagtggcttcttcatttcagggtatcaaaaagtctatattcagaataagagaatcacctaaagagactttcaatgcaagtttttcaggtcatatgactgatccaaactttaaaaaagaaactgaagcctctgaaagtggactggaaatacatactgtttgctcacagaaggaggactccttatgtccaaatttaattgataatggaagctggccagccaccaccacacagaattctgtagctttgaagaatgcaggtttaatatccactttgaaaaagaaaacaaataagtttatttatgctatacatgatgaaacatcttataaaggaaaaaaaataccgaaagaccaaaaatcagaactaattaactgttcagcccagtttgaagcaaatgcttttgaagcaccacttacatttgcaaatgctgattcaggtacctctgtctttttttttttgtaaatagtacatatagttttatagatgacgattccttctgtgtttttttctgctttttaaaatcttcatatcttatatttaatcttaggcatcatctgtatacatgattgtttaggtctttaattaccagtgtttagaatcaggtcactcaaacatggtagataagtttgcatagtttgtgtatatccatcactcttgagacagttttattttaagttccggggtacatgtgcaggatgtgcaggtttgttacataagtaaacgtatgccatgttggtttgctgcacctgtcaacccttcacctgagtattaagcccagcatgcattagctatttttcctggtgctctccttccccccacacacccccacctcctgacagaccctagtgtgtgttgttcccctccctgtgtccgtgtgttctcattgttcagctcccacttatgagtgagaacatgtgatgtttagttttctgttcctgcattagtttgcttaggataatggcttccagctccatctgtgtccctgcaaaggacgtgatcttgttcctttttatggctacatggtattccatggtgtatagttccacattttatttatccagtctatcattgatgggcatttgggttgattccatgtctgtgctattgtgaatagtgctgcagtgaatgtacaggtggatgtatctttataatacaatgatttatcttcctttgggtatataccccgtaatgggattgctgagtcagatggtatttttggttctaggtctttgaggaattgccacactgtcttccacaacggttgaactaatttacattccagccaacaacttgagacagtttttgactcataaacattcagagcttggctagctaattcctgctttaatttaaaaagtgtttattatatgcaaattggacaactcatataaatatgtggtgctacttactatgtattttctctaaagcatgttaaaaaaataggctagatatagtggctcatgcctgtaatcttagcactttgggaggctaaggcaggaggatcacttatggtcaggagtttaagaacaccctgggcaacatagcgagaccccatctctacaaaaaatttaaaatacccaggcatggtggcatgcttctgatgttgtagctactcaggatgctcagacaggaggatcacttgagcccaagtgactgaggctgcagtgaaccaaaattgtaccagtgcactccagcctgggccacaaaatgagaccttgtccctgaaaaaaaaaaaagaaaaaaaaaatttaaatagaggaaatactagctaagtttaatgtaggccagttctaaaataatgatttattgctgctgttgttacataattttcttaaatattttaaagattgcatactgttactgctctatttctgcatctccgtggtgtaactctgtcctctttgttgttgcaacagttcacttagcaactaaactgtatgtttacaaagtgattttatctccctatgagaagactttagtgaatagctcagtgaatagtagagttggtgagaccacagtacagaactgtttgaagtttgggttaaatttttagaggaaaatgtttgatactatgcatatcatagttaaagccaatgaaaaagctaatataggccaggcgcagtggctcacgcctataatcccagcactttgggaggccaaggcaggcagatcacttaaggtcaagagttcaagaccagcctggccaacatggtaaaaccccatctctatgaaaaaaaacaaaaattatccagatgtggtggcatgtgcctgtaatcccagctactcgggacgctaaggcaggagaatcacttgaacctgggagatggaggttgcaatgagctgagatcacgccactgcactccagcctgggtgacagaacgagactccatctcaaaaaaaaaaaaaaaaaaagctaatacatgtgatcactgatgaaatgcaattaagaactggttagtagaaaattcagagggtcaagaaatttaacagagcagttgaactcatttgcctttatcgttgagattagatcatctttcaggctgttagtatatggaccctgtttttaaaaattgtggttttgtttttttcaatgtgaaagaattaagaaaattgttacttttctaattccttttctgtgccttgcttttctgttcacaccagtattaacagcaatgaaattttttcaattttattttccaataaaaattactttgagttttttttatggtagctagctacttccttgacctagatactaattttgattgagttggtaactattattaaaaaaacaacttaggtctaatttatcttgagctaaaaaatgtaataactgaaaaatagagcatatttaggattctttctgctttaaatttgacattcagttattttcatgtaatttgtgttttgagcactaccttttaattaatttatttatttttattttttagagactgtctcattctgttacctagtctggagtgcactagtgtgatctcagctcaccgtagcctcaccctcctgggctcaagcagtccttgcacctcaccctcctgagtaactggcaccacaggcatacaccaccacacccagctaatttttatttttcatagagtcatggtctcactatgttgcccaggctagtctcgaactcctgggctcaagcagtcttcctgcctcagcctcccaaaagtgctgagattacaggcatgagccactgtgcccaaacactacctttttaacttagtgaaaaatatttagtgaatgtgattgatggtactttaattttgtcactttgtgtttttatgtttaggtttattgcattcttctgtgaaaagaagctgttcacagaatgattctgaagaaccaactttgtccttaactagctcttttgggacaattctgaggaaatgttctagaaatgaaacatgttctaataatacagtaatctctcaggatcttgattataaagaagcaaaatgtaataaggaaaaactacagttatttattaccccagaagctgattctctgtcatgcctgcaggaaggacagtgtgaaaatgatccaaaaagcaaaaaagtttcagatataaaagaagaggtcttggctgcagcatgtcacccagtacaacattcaaaagtggaatacagtgatactgactttcaatcccagaaaagtcttttatatgatcatgaaaatgccagcactcttattttaactcctacttccaaggatgttctgtcaaacctagtcatgatttctagaggcaaagaatcatacaaaatgtcagacaagctcaaaggtaacaattatgaatctgatgttgaattaaccaaaaatattcccatggaaaagaatcaagatgtatgtgctttaaatgaaaattataaaaacgttgagctgttgccacctgaaaaatacatgagagtagcatcaccttcaagaaaggtacaattcaaccaaaacacaaatctaagagtaatccaaaaaaatcaagaagaaactacttcaatttcaaaaataactgtcaatccagactctgaagaacttttctcagacaatgagaataattttgtcttccaagtagctaatgaaaggaataatcttgctttaggaaatactaaggaacttcatgaaacagacttgacttgtgtaaacgaacccattttcaagaactctaccatggttttatatggagacacaggtgataaacaagcaacccaagtgtcaattaaaaaagatttggtttatgttcttgcagaggagaacaaaaatagtgtaaagcagcatataaaaatgactctaggtcaagatttaaaatcggacatctccttgaatatagataaaataccagaaaaaaataatgattacatgaacaaatgggcaggactcttaggtccaatttcaaatcacagttttggaggtagcttcagaacagcttcaaataaggaaatcaagctctctgaacataacattaagaagagcaaaatgttcttcaaagatattgaagaacaatatcctactagtttagcttgtgttgaaattgtaaataccttggcattagataatcaaaagaaactgagcaagcctcagtcaattaatactgtatctgcacatttacagagtagtgtagttgtttctgattgtaaaaatagtcatataacccctcagatgttattttccaagcaggattttaattcaaaccataatttaacacctagccaaaaggcagaaattacagaactttctactatattagaagaatcaggaagtcagtttgaatttactcagtttagaaaaccaagctacatattgcagaagagtacatttgaagtgcctgaaaaccagatgactatcttaaagaccacttctgaggaatgcagagatgctgatcttcatgtcataatgaatgccccatcgattggtcaggtagacagcagcaagcaatttgaaggtacagttgaaattaaacggaagtttgctggcctgttgaaaaatgactgtaacaaaagtgcttctggttatttaacagatgaaaatgaagtggggtttaggggcttttattctgctcatggcacaaaactgaatgtttctactgaagctctgcaaaaagctgtgaaactgtttagtgatattgagaatattagtgaggaaacttctgcagaggtacatccaataagtttatcttcaagtaaatgtcatgattctgttgtttcaatgtttaagatagaaaatcataatgataaaactgtaagtgaaaaaaataataaatgccaactgatattacaaaataatattgaaatgactactggcacttttgttgaagaaattactgaaaattacaagagaaatactgaaaatgaagataacaaatatactgctgccagtagaaattctcataacttagaatttgatggcagtgattcaagtaaaaatgatactgtttgtattcataaagatgaaacggacttgctatttactgatcagcacaacatatgtcttaaattatctggccagtttatgaaggagggaaacactcagattaaagaagatttgtcagatttaacttttttggaagttgcgaaagctcaagaagcatgtcatggtaatacttcaaataaagaacagttaactgctactaaaacggagcaaaatataaaagattttgagacttctgatacattttttcagactgcaagtgggaaaaatattagtgtcgccaaagagtcatttaataaaattgtaaatttctttgatcagaaaccagaagaattgcataacttttccttaaattctgaattacattctgacataagaaagaacaaaatggacattctaagttatgaggaaacagacatagttaaacacaaaatactgaaagaaagtgtcccagttggtactggaaatcaactagtgaccttccagggacaacccgaacgtgatgaaaagatcaaagaacctactctattgggttttcatacagctagcgggaaaaaagttaaaattgcaaaggaatctttggacaaagtgaaaaacctttttgatgaaaaagagcaaggtactagtgaaatcaccagttttagccatcaatgggcaaagaccctaaagtacagagaggcctgtaaagaccttgaattagcatgtgagaccattgagatcacagctgccccaaagtgtaaagaaatgcagaattctctcaataatgataaaaaccttgtttctattgagactgtggtgccacctaagctcttaagtgataatttatgtagacaaactgaaaatctcaaaacatcaaaaagtatctttttgaaagttaaagtacatgaaaatgtagaaaaagaaacagcaaaaagtcctgcaacttgttacacaaatcagtccccttattcagtcattgaaaattcagccttagctttttacacaagttgtagtagaaaaacttctgtgagtcagacttcattacttgaagcaaaaaaatggcttagagaaggaatatttgatggtcaaccagaaagaataaatactgcagattatgtaggaaattatttgtatgaaaataattcaaacagtactatagctgaaaatgacaaaaatcatctctccgaaaaacaagatacttatttaagtaacagtagcatgtctaacagctattcctaccattctgatgaggtatataatgattcaggatatctctcaaaaaataaacttgattctggtattgagccagtattgaagaatgttgaagatcaaaaaaacactagtttttccaaagtaatatccaatgtaaaagatgcaaatgcatacccacaaactgtaaatgaagatatttgcgttgaggaacttgtgactagctcttcaccctgcaaaaataaaaatgcagccattaaattgtccatatctaatagtaataattttgaggtagggccacctgcatttaggatagccagtggtaaaatcgtttgtgtttcacatgaaacaattaaaaaagtgaaagacatatttacagacagtttcagtaaagtaattaaggaaaacaacgagaataaatcaaaaatttgccaaacgaaaattatggcaggttgttacgaggcattggatgattcagaggatattcttcataactctctagataatgatgaatgtagcacgcattcacataaggtttttgctgacattcagagtgaagaaattttacaacataaccaaaatatgtctggattggagaaagtttctaaaatatcaccttgtgatgttagtttggaaacttcagatatatgtaaatgtagtatagggaagcttcataagtcagtctcatctgcaaatacttgtgggatttttagcacagcaagtggaaaatctgtccaggtatcagatgcttcattacaaaacgcaagacaagtgttttctgaaatagaagatagtaccaagcaagtcttttccaaagtattgtttaaaagtaacgaacattcagaccagctcacaagagaagaaaatactgctatacgtactccagaacatttaatatcccaaaaaggcttttcatataatgtggtaaattcatctgctttctctggatttagtacagcaagtggaaagcaagtttccattttagaaagttccttacacaaagttaagggagtgttagaggaatttgatttaatcagaactgagcatagtcttcactattcacctacgtctagacaaaatgtatcaaaaatacttcctcgtgttgataagagaaacccagagcactgtgtaaactcagaaatggaaaaaacctgcagtaaagaatttaaattatcaaataacttaaatgttgaaggtggttcttcagaaaataatcactctattaaagtttctccatatctctctcaatttcaacaagacaaacaacagttggtattaggaaccaaagtgtcacttgttgagaacattcatgttttgggaaaagaacaggcttcacctaaaaacgtaaaaatggaaattggtaaaactgaaactttttctgatgttcctgtgaaaacaaatatagaagtttgttctacttactccaaagattcagaaaactactttgaaacagaagcagtagaaattgctaaagcttttatggaagatgatgaactgacagattctaaactgccaagtcatgccacacattctctttttacatgtcccgaaaatgaggaaatggttttgtcaaattcaagaattggaaaaagaagaggagagccccttatcttagtgggtaagtgttcatttttacctttcgtgttgccaatcactatttttaaagtgtttattcagtagacttggtatgctaacaattaagagtgttataaactatgtcttttcagccatttttgtgtagtcagtttgggggagtatggtttgatatacagatacacagattcagtattcgtatacagatttgatatcttggtatacagattcgatatctctgaatctgtataccaagaaatcatgttttaagggtctcaatatattttcaaaaagattattagtataataattgagaaattactgttaaaaagttttgagtttctctagaaaatttgaaactcttaacaaaacctgcataatactaacttaactgttttcatatacatagcaagttcagactctgacttatatgaactttaaaagttggtttccgggaggccgaggcgggcggatcacgaggtcaggagatcgagaccatcccggctaaaacggtgaaaccccgtctctactaaaaaaatacaaaaaattagccgggcgtagtggcgggcgcctgtagtcccagctacttgggaggctgaggcaggagaatggcgtgaacctgggaggcggagcttgcagtgagccgagatcccgccactgcactccagcctgggcgacagagcgagactccgtctcaaaaaaaaaaaaaaagttggtttccgattataccatttactgggtaatatatactacttagttacactacttacatagcttcagtttccttatctataaaatgcaaataacacctcccatgagggctgggcgtggcgctcatgcctgtaatcccagcactttgggaggccgaggtgggtggatcacctgaggtcaggagtttgagaccagcctgaccaacatggtgaaaccccatctttactaaaaatacaaaaaattagccaagcgtggtggcgcgcacctataatcccaactactccagaagctgaggcaggagaatcacctgaacctgggaggtggagggtgcagtgagctgacatcacaccactgctctccagcctgggcaacagagcgagactgtctcaaaaaaaaaaaaaaaaaagtgtatttaaagcacttagcagtgaacttgacatatagtaggcagagagcattcagtaagtgttggcttgctccctttttttcatttaggaagtgatctaaaaacagtattgttagtaaatggtatcttgatcttaatgttatgtggactattttaacttcccttttaaatgtatatatatctaacaacttagttcaactacagtcatgtgtcatttgacagggatatatgttctgagaaatagattgttagatttcatcattgtgggaacatcatagagtatacttacacaaacctaggtggtatagcctactatatacctaggctgtatggtatagcttattgctcctaggctgcaaacctatacagcatgttactgtcctgaatactctaggcagttttaacacagtggcaagcatttgtgtatgtgaacatagaaaaggtacagtaaaaatacggtattaaaatcttatggggctgggctcagtggctcatgcctgtaatcccagcactttgggaggctgaggcaggcggatcacctgaggtcaggagtttgagaccagcctggccaacatggtaaaaccttgtctctactaaaaatataaaaattagctgggcatggtggtggcacacgcctgtaatcccagctactagggaagttgaagcaggagaatcacttgaaccctggaggcagagatttcagtgagccaagatcgcaccactgcactcctgcctgggcgacagagcaagactccatctgaaaaaaaaaaaaaatcttatgggaccactattaaagtcttataggatgaccattgcatatgtggtctattgttgaccaaaatgtcattatgtggcaaatgactgcattaggttaaccttatacatacctatattaggtatgtatttggttttgtttttttgtgtgtgtttttttctattagtgtatctgactggtaataatcttaaataattgaatctgtttgttagttgcaattaaagcaaatgccaaaactccaacatttcagtggataatcttaaataactagttcctttttaaaaaacctataaactcataaaaatattttagttattagaactcttcctgtctagaccccatgtattacagagagacaccgaagttagtctcctcattcaaaaagtgccttttgcccctaagtcattctggtggatacagatttacttaatcaagtgttgtccaggtcacattcaatataggatttactttatggacaaagtagtacgtttatagtacttaaactatttgctgtcctttagtgtgaaattctgaggtatatatgcttaaagatatttgtaattcttttgtggaaaataatggctttatttatagcaacccattctgttcttgtgcatactgaagtatattgactttccacctagggaaaaaaaaaacaataactcagacttgtaaatgctttcaacggtgttactacttaatttccctcatttctgtaacatataagtgtataacttagtcagcttctggttactggaacagtacaggtcactgttaaacaattaaaccacttttataataatctaacacctcctaaagccttgcatggacatttttacttattaaattatacaaatttattccctgtaataaagcatcaaaaagcaaagtacctgttatatattatctcagcatgacatggaaatgcctaccttgaattatggtttaatcttaccctcttagcctctgtagaatttttaaataagaattgtttctattactagtactttaatgtaatttgataattgtaaaaagcctcttaactctaattcaaggacctacataataaattactccttcagttaatggctgcccccgtgctgaaaaaaaaaaaaaaaaagagagaaaaagtttatttgaagaaattttgttaggccttattgccagtaaacctagagttatatttagtgtcagtttttcaaaaagtagcttatctgtggtatctggtagcatctgtttatcctatttaggatttatcctgtttagaccctgttaaatagtggtgttttaaagtggtcaaaacagaacaaaaatgtaattgacattgaagactgactttactctttcaaacattaggtcactatttgttgtaagtatttttgtttaacatttaaagagtcaatactttagctttaaaaaaatggtctatagacttttgagaaataaaactgatattatttgccttaaaaacatatatgaaatatttctttttaggagaaccctcaatcaaaagaaacttattaaatgaatttgacaggataatagaaaatcaagaaaaatccttaaaggcttcaaaaagcactccagatggtaaaattagctttttatttatatctgttctccctctataggtatggtatataatattctgacctcaggtgatccacctgcctctcaaagtgctgggattacagacatgagccactgtgcctaatcaaggacctctttatactcttaaaaattactgaggacctaaaagagcatttgtttatgtggaatatatctattgatatttaccatattagaaatgtaaattgattaatgttaaaattagtaatattatgcgttggtcatttggaagatatgagttcactgagttatgcggatcttccgaaagttgacagttttattatgcagtattaaacaatcactttcattgatgccattaccgatcagaaaagtttaagtagtagaaagctgtcaagcttacagagccagatacaagcttcccaaaaattctgattttcatctaaaagcttgaatttttccccggcaataagtattgtcacttatttttcttgtaggtgacaagcttattttcattcatttttgaaaagatgtctgccgaatacccaagtctgaataactatagtttgttggttattctttcaagtaaaaggtatttcatgaaaaaatagctagtatagctcacaactcaatcatttaagtgtgttttcttgagaaacgcactgaagtatgcaagcataatataccaacagtacaaatatcaacagtgaaaaggacatacataacattttactaataagacagttttgacagcttggattccctaaaatggttgtagatacctaacaggattccactgatcatttcttgagaatcattgtcctataatatatacataataatctaaatttacaatatcagtattaactactgacaataaaactactaaggaaaatgtaagaattgtttgcagtttttgtccttagagtatataggttgagtatccctatctgaaatgcttgggaccaggactatttcagatttcagattttttcagattttgaaatgcttgcatatacaatacataatgagatatctggggataggactcaagtctaaacacgaaatttatttaagtttcataaacaccttatacatataacttaaatgtaattttatacaatattttaaataatttttgcataagacaatttaaattgtgatccatcacatgaggtcagatgtggaattttctactggcctcatgttggcactcaaaaagtttcaggtttgtgaccattttggattttcagattagggatactcaacccatatattattaagaatgtttagtcaaaatactgtgttcaaatgtcactcaaaataattcttccggatgtggttaccaatttgataattaggttacattcctttttttccatttgttttcaattttaggatttgtcttttcttatttaattttacatttgaataaataaaacattacatagttcattcatcagaactacaaaaaggtatacttagagtttttattcacccacctcttgcttactataggtaatcttttttagtgtttttttttcaggattctgtttaataaaaataagcaaatacatgtatatactcattaccctttcttactcaaaagatacagtatatacaccattttgcaccttgtttattggttgttgtttacttaagaattatttggagatgactccttaatgagtatatagagatcgtcctcattcttttttgtggttacatagtagttgatcatctggctgtgtcagtgtttcctagtttatttaaccaatttccaactagtggacttattgaagatttaattaggttccagttacatactgagaatgaacaatatctaaagcttagcttttaaaccttcataagactaaattttaaatttggtatttgcatcagaaattagctaacacctttgagttatgatggttaacatcaactgactaaatttatgctgatttctgttgtatgcttgtactgtgagttatttggtgcatagtcattatcaatttgtgaatcaatttattttcatagttaacatttattgagcatctgttacattcactgaaaattgtaaagcctataattgtctcaaattttttgtgtatttacagtaacatggatattctcttagattttaactaatatgtaatataaaataattgtttcctaggcacaataaaagatcgaagattgtttatgcatcatgtttctttagagccgattacctgtgtaccctttcggtaagacatgtttaaatttttctaaattctaatacagtatgagaaaagtctcgtttttataaatgaacatttctaaaaataatgacactaacgttaagaagttaacacttcccgttttataaaatttataaaatactttggtagtattttatagtgctgttcatatcattattttattttttaattttatgacagctttgtaaagtagacagattttattctaattttatggatgaagtactaaggttgagaggaattaaggaaattgctccgaatcagttaacaaaaagattgcagatattaaaaatatccttttatctctcctctctaaacctttaaaaaagtactaagatagtttttttaatgtataattcccaaggacaatgatgagaagaaacaacaaaagtttggaagccaaaaacataaaggatttagtaagcatgagaaagctaaaacctgacactagagcaaacagagatgctttcccctaaaaaacctgaaaaagattcaaattggcagcaacaggtacttctgaaggtgaagtagaaaataggaagattagttgaaattctttttaagaaacatctatatttcctcccccactgcaaataggcggttatccttcttctgccaggaaatcagaaggttgttcttgaaaaagatgaattgagaggattctgaattgaaggtgggctggagggaggggacaccaggcacaattgagggaaagatactaaaatgaaagatcagatacaaatctgtatgtcaagcagtgagacctagctccttcccacacttggttcccaaatgcaggccctctaggcatgagactggaagatttttttttcctagggaatatgcctgacccaatagaaaagaccaaaaaatactgacagttgaggatactcagatgaaacagtatagccagtcaccagaccaggaagttaactgttgacatgcacagagcttccaggaagctacttagtgcttcacttttaaataagaaaagatagtcaaagataactagtcattggaagaaagctactatgaaacatagtcaccaaagtacaaaatccatagcagaaaggaacctagaggaaatcgactatgaaaacttcataaaaacctactaatattctcaggtaagaaaagaaaaaatggccgtaaaataagaacaagttgctataaaaagctcttagaaattaaaaatatgatagcacaaataaattaactcagtagaaataatggaagaatcatgaaagttcccagaatacagaataaaatgaaaaaaggtatgaaaagtcaattctgtggatctatcatctgaaaatacagagtttgagaaggaaggcacagaagagaaatgaagaaagaaattttaaaataaatacataattttaaaagttctactagtactgaaggacatgagtttccttaattaaaagggcccactgagtgagcacacaagtaaaaatgacccacagtaaggcacatccttgtgaatttttagaataatagaggcagacaggaaccttaaattcattagaggaccaagaagttaggtttcaaattgtttcaagccataatagtatgaattctcttattatcaacaatggaatctagaagactgtagatcttatataatacagagaagtgccttcaaaatactgagagaaaatgatttccaacctagaatctgaattaagtgtgagggtagacatttttcagatgtgaagtactaaaagatctcttgtgcgcttttctcaggaaactaaccaaaacaaatgcatacaccaagaaggaggaaggtataggacttaagaaataagaattcaacatagaagagaggcaaagggagctttcaggatgatattgaagggagatcccagagtagctgtgttgctaagtctagaaaggcagctagactactttggaactgaagaagataagagactttggaagagtttgccttcaagataaaaataaagcagtacctgcatgttttaatgtattaggaaacttcttagtaaagatggtgaattgaggccaggcacagtggcttacacctgtaatccagcacattgggaggctgaggtgggtagatcacttgaggccaggagttcgagactagcctggccaacatggtaaaatcccatctctactgaaaatacaaaaattagccaggcgtggtggcacacgcctgtaatcccagctactccagaggctgaggcacaagaaccgcttgaacctttgaggtggaggttgtggtaaaattgcaccactgcacttcagcctgggtgacagagtgagactctgtctcaaaaaaaaaaaaaaaaaaaaaaagatggtgaattgaacatactcatatcctttctttgccttccaaacttttaccaaaacatcattgaagaaacttacacacacacaaaaaaaaaacaaggaaaataggaaataacaaagtaactaaatttctcaaagcatgcagaaggaaactgaatgaaagctggtggtggggacagcagagaaccaacgattttacactcaggtctcaaaagactaggaattggtggcttcatttcttatctttagaattgggtggtgcagaaggagggagccaaaatggaataagttgaaattatgtttaagaagcaatactcgccgggtacggtggctcacatggaggctgaggcgggtgaatcacctgaggtcaggaattcgagaccagcctggctaacatggtgaaaccccatctctgttaaaaatgcaaaaattagctcggcatggtagcatgcccctgtaatccagctactcaggaggctgaggtgggagaactgcttgaacccaggaggtggaggctgcagtgagccaagattgcgccactgcactccagcctggacgacagagcaagaccccacatcaaaaaaaaaaaaaaaaaagcagcagcagcaatactcatgaagctgggcaactgtctcctgcccgctctatgaaaagaaccagaggcttattctccagagaggatacagtagaaggtgaacacactaggcacagttgaaggcagaagcaactacttgaaagcaagaagaagttaatatatgcatattgaatgttgggatctcccctcaccaagcccttttccaccactcagcttccagaacatagacagctaagttttcactagtggaagtttccatttaatcaagctactgtgtagcttgcagtcaacaagttctatctttgtaccaagtgcttcaaaacagccttttggtccctcactcttaactataaacagacatccaaagattatgagacatcagaaaaagcaaaaataaaataaccaaaaaacacattaatgaaaacaacttagaagaaacattattcaaggagaagaaaaaatgtttttttaaaaactataatttgtgaacagaatgaaaagaggtttatatatatagctaagagtttagatgtgaataaacagtaagtacatagaaaataagcagattttaaaaattaactcaagagaaagcaaaagttgtaaaggaagtacactatttatatactacccattaatggccgggtgtggtggttcacgcctgtaatcccagcactttgggaggccgaggcgggtggatcacaaggtcaggagatcgagaccatcctggctaacatggtgaaaccccatctctactaaaaataacaaaacaaaattagccagacgtagtggtgggcgcctgtagtcccagctacttgggaggctgaggcaggagaatggcatcaacccaggaggcggagctttcagtgagccgagattgcaccactgcactccagcctgggcgagagagcgagactccgtctcaaaaaaaaaacaacaaaataaaaaaataaaataaaatatactgcctattaatactacatatactttatactgacttagccgtaatgtaaatgttgaacattgatagtgagaggtgaagctggctgggcttctgggtcgtgtggggacttggagaacttttctgtccggctaaaggattgtaaacacaccaatcagcgctctgtgtctagctaaaggtttgtaaacgcaccggtcagcactctgtgtctagctaaaggtttgtaaatgcaccaatcagcactctgtaaaatagaccaatcagcaggacgtgggcggggccaaataagggaataaaagctggccacctgagccagccccagcagccgctcggctccacttccatgccatggaatctttgttttttcactctttgcaatgaatcttgctgctgctcactctttagtgagcactacctttatgagctgtaacactcaccacgaaggtctgcggcttcactcctgaagtcagcaagaccacgaacccaccaggaagaagaaacaaccctgtacgtgccatctttgagagctgtaacactcactgggaaggtctgcggcttcactcctgaagtcagcaagaccacaaacccaccagaaagaagaaactctggacacatctgaacatcaggaagaacaaactcgggacacactatctttaagaactgtaacaccatgagggtccacagcttcattcttgaagtcagcaagaccaagaacccaccagaaggaaccaattccggacacagtagaattaaatacgtaatttaggaagatgaaaggcaagagtgtgtgtgtagtaaggtagaagctgtgttgacagagctgaattttcattttctgtaggggtacttcaagagaaaaagtcaagaagaaacatgtcacttagacatataaatatgataaaatcatctaaaactgtttaaagtagttgcaaaatcttttctagctgataaatttttaagcctaaaaatatcattgaaattattttaatgttacattttattttattttatttatttatttatttattttgatacagagtctcactctgtcgcccaggctggagtacagtggcacgatcttggctcactgcaacctctgcctcctaggttcaagcgactctcctgcttcagcctcccaagtagccgggattacaggcgcgtgccaccatgcccggctaattttttgtatttttactagagaaggggtttcaccgtgttagccaggatggtctggatctcctgacctcgtgatccgcccaccttggcctcccaaggtgctgggattacagacgtgagccactgtaccaggcctaatgttaccttttcaaaaacacctgattgtggaattgttgaagtcactgagttgtatttctggaatgtgttttttagcaggctgcacatacacatatgtagaaagccaggtgatttttttttcatttcttttttttttatcaaaaacagttgtattaaataagaaaggaaatacgtatttacccgtgtattaccttaatttatgtgtaaaatgggagaatagtttaatgtatttaacaaacaaacatttgttaaagtacctgctcaaactacctaatatatactatagtgaaagatataaggataaataagtctaactcagattgctagcctgggaaccagacatgaaaacaagaattataatgtaatataaattctagaatagatgtaaaaagtgatctaagaacatagaaaaattatcagctaatcacatgactgctcaatgggaaaagtacttcagacagaatgtaaagaatgcttggttaaagatggcattccaaatcttggaatttggttgggggacagagggaaacaaaaagaaatggggaggttaggaccaaataggaagcttcctgtatgtcatttctgataagttgaaacctaggtaggtgataggctgtctttggaagtttctaacaagaggaacaaaataagattggtgttttagaagtataccaaagcaaaactgttgcaaggagattagtaaatacaggtcttaacctagcagaggaggtagagggtagagaatgattgagatagaaattcagtagatttggccagatagtgataagttgagactggcaaattatttccacttagatttaaatagatatcttgagcataacctacaaggcaaactccttatactaaaaatattctgaatatttaaaaagaaaggattaaaagatcaatcaatagaagtttggggacagaaggtttattcattcttgtgcattagatctcatctagatcacctgtttgaagaaatcattccagcaattatcttgtctctctcctgcatggatttttttcctaatagattgttctcatcaccctaagcagttgttgtacatctctcatcttaaaaagaacagcctttcttaagtaatctcaacagtccattttcttctcttaaagcccaactcattagaattgtccctcctcttttcacttatctctttgagtactctcctgaacccagtctagtcagtcctttcagtagaactggtccccctgcttacctccctactcctcaatacacagtgaattctcaacaaagaagccgggggatccttttaaacataagacagattatgtcatttctttactcagaactattccgtggtgtgccatctcagagtagagactaaaagcccttgtcatggtgtacagattcttcatgatctggctgctttgctatttttccagtctgaccttctaatgttccccttgctctccttgctccaggcacacttgtgtctaggccaatcgacatatttgtttgtctgtttccttccactgaaatatacatgcaaaaacaaaattttgttaccgtgttccccagcaaaacaatgtctggcacctggtaggaattcattaaatagttgatggatgggcgaacggataactaaaggaacaacttcaagttccaggtatccagggtttggtaaaaggaaatctggggttttcaacaagatatcaagtattaggaagaccacgtatgctgagaaagatgatcacttttggacatgttgagtttgaaatgagtgtgaaacatcaaggtacagatgtctgatgctatatgtagtgtaaaatgtaggaacaaccctaggagaaaaatcgggcatgaggataaaggatattttcattgttaggtgataatttaagcaatggaaatgactcacattagcaagggaaagtgtctaaggaagacatccagttttggagactttttttgaggaatcaggaagaggtaaaaccagtaaaagatgaaagaggtacagtgatggtgagaattttaaaagaaggaaaatgtaaactgtcatagctattaggaaagttgagtagaatgagtttgcgtgcatcccacatgcatctgggaggtcattaacaactttattgagaacagtttctgtagagtagtgggagaaatgagagtttattgagtagagattgaggaagtgaaaatagctacattacctattgaagaaggttgactgtggagtgtaacagtgagtattagcttgaggcagagataaaggtgagtgagaaaataagagtttcaaaggtaggcaagatttttgggctaaataaaaagggcactttaaaaaaggtataaataggtagaagagagaaaagggagcgaggtgggataattgaaagaggggatctcctgtggagactgaggtattaggcggagtagagagttcaggtgaagatgtgaaggtgagagaagaggatgggtagacatttccctggtgaaggaggtaaggagtactatgatggaattagaggggacacactgagagggtccacacttgacagactctcttctattatgtgttatgtgaggtagattgtaaagtcaaaggctagccttgaaaaatgtgatattgttttggaatggcaaccatggtgaatacaaaacagttaccagaatagtatcaccatgtagcaaatgagggtctgcaacaaaggcatattcctaaatatttatatgtgtactagtcaataaacttatatattttctccccattgcagcacaactaaggaacgtcaagagatacagaatccaaattttaccgcacctggtcaagaatttctgtctaaatctcatttgtatgaacatctgactttggaaaaatcttcaagcaatttagcagtttcaggacatccattttatcaagtttctgctacaagaaatgaaaaaatgagacacttgattactacaggcagaccaaccaaagtctttgttccaccttttaaaactaaatcacattttcacagagttgaacagtgtgttaggaatattaacttggaggaaaacagacaaaagcaaaacattgatggacatggctctgatgatagtaaaaataagattaatgacaatgagattcatcagtttaacaaaaacaactccaatcaagcagtagctgtaactttcacaaagtgtgaagaagaacctttaggtattgtatgacaatttgtgtgatgaatttttgcctttcagttagatatttccgttgttaaataatgtcctgatggttttccccctttggtggtggtaattttaaagccctttttaatgttttagattttctaaatccaaagattaggtttaaattattctaatgtttctttcaaagataacttcttgtggacttgttaaaaaaaattagacacacaatctaggactgctgttactggaatatattttctatcatgctactaattttctttttaaaatgtgataaaaatagggccgggcgtggtggctcatgcctgtaatcccagaactttgggagactaaggcgggcggatcacctgaggtcaggagttcaagaccagcctggccaacatagtgaaaccctgtctctactaaaaatacaaaataaataaataaataaataaatagctgagcgtggtggcaggcacctgtaatcccagctgcttgggaggctgaggcaggagaatcgtttgaacccgggaggcagaggttgcagtgagccgagatcgcgccattgcactccagcctgggcaacaagagtgaaaaactctgtctcaaaaagagataaaaatagtaaagatattcatatttatacagctttacaagttgaaacatcctttcatttatgaagaattaaaaggggtaccctttttagagaaaaggagagcatgtaaacttcgaggaaattgatatgtataattttataaaacagggcttgcgcttttttttttttgagacagagtttcgctcttgttgcccaggctggagtgcaatggtgcaacctcggctcaccgcaacctcctcctcccgagttcaagtgattctcctgcctcagcctgctgaatagctgggattacaggcatgtgccaccacacctggctacttttgtgttttttttacttttatatattttttttttgtttagtagagacagggtttctccattttggtcaggctggtcttgaactcccgacctcagatgatctgcccgcctcagcctcccaaagtgctgggattacaggcgtgagccactgtgcctggccaggggttgtgctttttaaatttcaattttatttttgctaagtatttattctttgatagatttaattacaagtcttcagaatgccagagatatacaggatatgcgaattaagaagaaacaaaggcaacgcgtctttccacagccaggcagtctgtatcttgcaaaaacatccactctgcctcgaatctctctgaaagcagcagtaggaggccaagttccctctgcgtgttctcataaacaggtatgtgtttgtctacaatactgatggcttttatgacagagtgtaattttatttcattaactagtatctacaaatggctttgtttaaagaatgaacacattagtgcaggaatggatgaatgaaatcatcatattttctaattagcctgcagtggcagcctctggccccttgctaggcctgcctcatcctgctaaagtgatctgtgcttccaaattactacttcttttcccccttcaaatctttcttattttgtcattgtaaatgctctcagctaggtgttaaagtagtcttactgatattcaaatgtgaataactgatagccctgaaccttctatgagctatttatattttccaaagaggattctccttaagccaatattatctaggtagaattttaggcaatggagaggtgaaaataatattgatgacattaatagctaactttgagcattttctaggtgtaagatgctcttctaagcacttcacatgcattaggtatatcttgcttaatcctcacagtcaccttgaaagaaaggcactgttactttgtttccattttgcaaatgagagaactgaagcatagagagggttaagtaactgccccaaagtcacttaactagtaagtggaagtgctatgattccaaagcaaagagtctgactccagagtcaaactctgaacaaacaaaaagacactttgggttagatatcctggggtgaaagcaagcactttgaaagtaagccaagcctgtgtacagatctgaccacctgaggtcacattccctaaaatacttaaacttctcccttttgtttcccatctaagtttttgaacttaagagattttgtaaaacatcacatttttttatcctcacagtaccttcctatggcagatttagcaggaggcgtataaacggggtggaaaaggtacagcagactgtggaatgtatggatcatttatattacattaaaatttttagtttctagtaaataacttaaatgtttttgtagtgaagattctagtagttaatgaaaatttttggtaaattcagttttggtttgttataattgtttttattgtgtgatacatgtttactttaaattgtttttcttttttgtgtgtgtttattttgtgtagctgtatacgtatggcgtttctaaacattgcataaaaattaacagcaaaaatgcagagtcttttcagtttcacactgaagattattttggtaaggaaagtttatggactggaaaaggaatacagttggctgatggtggatggctcataccctccaatgatggaaaggctggaaaagaagaattttataggtactctatgcaaaaagattgtgtgttaacttttatgtattccctcatccctctttcttctcttaactgtctctcgaactaaaaagttggctagaaatcaaatttttatgcatttaattgttttaagtgcattatggttaagcattctgtagaagtcttttgaaaagtgctgtttgtcctggggtttaatgaactggattttcttgatttgggacatttttcttaggcatttataaatatagcccaatttataaagttaaatttggccgggtacagtggctcatgcctgtaatcccagcactttgggaggccgaggcgggtagatcacctgaggtcaggagttcgagaccagcctggccaacgtggcgaaaccccatctctactaaaagtacaagaactatctgggcgtggtggcaggcacctgtaatcccggctactctggaggctgaggcaggagaatcgcttgaacctgggaggcagaggttgcagtgagccaagattgagccactgcactccaggctgggcgataagagtgagactccatctcaaaaaaaaaaaaaagaaaaaagttaaatttgagggccagacatggtggctcatgcctgtaatcccagcactttgggaggctgaggtgggcagatctcttgagcacaggagtttgagaccagcctgggcaacatggtgaaaacccatctctacaaacaaattaaaaaattagcccagccaggcgcggtggctcacgcctgtagtcccaacacttcggaaggccaagatgggccaattacctgagggtcaggagttcgagaccagcctggccaacatggtgaaaccccagctctactaaaaatacaaaaattagccaggtatggtgatgcatgcccgtaatcccagctactcgggaggctgaggcaggagaatcatttgagcccagtaggtggaggttgcagtgagccaagatcacgccactgcactccagcctgggcaacagagcaagaccctatttcaaaaaaggccaggtgcggtggctcacacctataatcccagcactttgggaggttgaggtgggcagatcacctgaggtcaggaatttgaaaccagcctggccaacatggcaaaaccccatctctactaaaaatacaaaaattagctggacgtggtggcacgcgcctgcaatcccacttacttgggaggccgaggcaggaaaatcgtttgaacccgggaggcggaggttgcagtgagccaaaattgcaccactgcactgcagcctgggcaacagtgagactccatctcaagaaaaaaaaaaaaaaaaaaaaagaaagttaaatttgaaatggccttatggtagattcctcccccgacacacacttacttcatgttttctttcattatatattttaatggatacaaaatataaataaacactaaaagttaaacagaaatatttgaatatcaataatgccaaataactagaaaatctcagagctctaaaacagcaacaatttagaaactatataacctctttttattgtagtttttacagaaacataatttaaagctttttgttatcagagatatattacattatgccagtggcaaaagatgggatttatttcctcagcatccttatctttaaatttctgtacatctttccaaaatttatagctttggaaaagtgataaaactttttttcctgaattttgttttaacttttaaaaacagaaatattgtttacatcttgcgtatcttatataacaaacatctgcttatagattccagtaagaaaagttggttaaacggttgtattattttctcgtactaaatagactgcataaggtagaagttaagaatgattgccctgtagtctaagtggaaatgtggaggctttcgttagttttttctgataattcagcaaatctctattgagcacttgctatgtgccaggtactattctgggtactagggataataaaggaaaacaaaaaagtccctgccctgatgagtcatacattctatgtggaaggcatagaaaatattgaaatataagtgaattgtgtagtatgttagaagaagatacatactataaagatagataaagttggaaaggtggcagagaaagttgggcaaggagatgcgatttttaatctaataagtagttaggaaggcttcactgagtcagctacatttgataaatgacctaaagtaaaaggagggagcataggactatcctagcaaaagacccccagcctctaagaggggagcatgcttgaagtatttgaggaacaggaagttagtgcaactggagtagagtgggcaggagaagagtagtagtagatgagatacaaaaggaagacctcatagaccttcgtaagacccttaccttttactctgcacgatttttactgaataaaccactggaaggcttaaagggtaacatgatctgacttttttttgagacagtctcactctattgctcaggctggagtgcagtggtgcaatctcggctcactgcagcctccacctcccaggttcaagcgattctcctgcctcagcctcccgtgtagctgggactacaggcgcgcaccaccgtgcccggctgatttttgtgtttttagtagagacagggtttcaccatgttggccaggttggtctcaaactcctgacctcaggatccaccctcctcggcctcccaaagtgctggaattacaggtgtgagccactgtgtccagcctgatctgacttatttttgaaaaaataattctggctgtttgttgaggagaggggcaaagatggacacacagagaccacttaagctattgcagaaatacatgtgagaggtggttggttggaccagggaagtggcagtggaattggtggaaagcagttggactctggggtattttgaaagtggcactattaggagttgctcaaggattagatataaaacgtgagagaggaggagaataagaatggctgtgaagattttggccttagcagctggaaggatagagttgtatgtaactactagaattgagaagaccaaagatggagggaaatggagagtttggttttggacatttgaagcttgagatgtaatagtagacagccaagtggagatgttaggtaggcagttggatatggaagtctatacacaggtaaagtataggccaaataaatcaattcacaagtcatcggcatatagatggacttgaaggccatgaaaaagagactgagaaagagcagccagaaagttaggaataaatgcagaatggggtgttgcattccaaatgaagatggaattttagggaatagaaaatgaccagctgtggaagctgcttctaataggtaaagtaagatgaggactgagattggccgctggatttagcactgcagaagacattactaatgttattaaaaatagctcaatagattggtggagtgatatcctgattagaatgcaattaaagagcagttgaagaggaggaattggagacacagaatacagtcgattcttttgggagttgccaaaaagaagcagagagagggacattgcttggagaggaagtaggatcaaagagtcttagttttggcttgttttaaggtagaaaaaaaccgtttcttatgctgattcacattgttcagtagagagggaaaaaattgatgatgcaggagagagaggaggcatttcctgatcgttggccttgtaggcagcaaggggtaggagctagtgcacaaatggtagaagagggcaaagtgtaaggatgcagatgcttggaagagggcaaagtgtagggatacagatgctgtgagtggatagatatgagggtgggagcttatggaagttctcttttgattacttctgttgtcttagtgctaagagtatgaatgagaaaggaggagttagagatttgagaacagaggggacaggatcaaagagagcaccaagactaagaaaggcagttctcaggcgtgatttctaaaaaaatctctttcataagaaaaataatctaaaatataattatttaaaatcaaggatctcatttttcaggaacaaatatgagttgaaatcattctgttgactgttaagtggaattttttgttttgtttttatattttgagatagggtctcactcttgtccaggctggagtgcagtggcactatcatggctcactgcagcctcaacctcctgggctcaagcaatcctcccaccacagcctcctaagtagctgggaccacagatgtgagctaccactcttggctgattttttttattattttttgtagagatgtgggggtctcactatgttgcctaggctggtctcaaacttctggcctcaagcaatcctcctgcctcagcttcccaaaatgctgggagtataggcatgagccaccatgctcagcaatgaagtttttatcagtatgatactttgatacatgtcaaataattttctgaaattatattgtagatcatatgaactcataaaaacttaatgatcttgaacaatgtagtttttgtacagagaatagttgtagttgttgaattcagtatcatcctatgtggtttttatgataatattctacttttatttgttcagggctctgtgtgacactccaggtgtggatccaaagcttatttctagaatttgggtttataatcactatagatggatcatatggaaactggcagctatggaatgtgcctttcctaaggaatttgctaatagatgcctaagcccagaaagggtgcttcttcaactaaaatacaggcaagtttaaagcattacattacgtaatcatatacggcagtatggttaaggtttctgtgtagtctgtgacttccatgtcaaaatgttgcacaagccagttgtcagtgacagttgccatcccacactgctgttctcctgtcatccctagcccccatttaagagagatcacacattcatgcattgcttgcttccctctttccccaccccctccttaacctcttgatgtatgagaagaatatgagttactaatttgatccactatttggggattgctaataaagcatttttgcattttattttttgctttttaaaaataattgatattttaacaatatgaaacaatatattcctagctacaaaatttttaattctcagtatttcttagataaattcagtttttattctcagttattcagtgacttgtttaaacagtggaattctagagtcacacttcctaaaatatgcatttttgttttcacttttagatatgatacggaaattgatagaagcagaagatcggctataaaaaagataatggaaagggatgacacagctgcaaaaacacttgttctctgtgtttctgacataatttcattgagcgcaaatatatctgaaacttctagcaataaaactagtagtgcagatacccaaaaagtggccattattgaacttacagatgggtggtatgctgttaaggcccagttagatcctcccctcttagctgtcttaaagaatggcagactgacagttggtcagaagattattcttcatggagcagaactggtgggctctcctgatgcctgtacacctcttgaagccccagaatctcttatgttaaaggtaaattaatttgcactcttggtaaaaatcagtcattgattcagttaaattctagaagttttacatttaaattttaaatgcttactaaggatgctcaatttcttagatgtactgataattttagtataaaaagcatattcttcagacagttaaagtttttgtgcagtttttgggaggtccagagatctttcttgagcttaaataatgcatttccaattaaaaagcaaaataaatttgcaccatttgattttggtatctgtagcttgctgccctcttgttctcatagctttgctttgatcagatccctattccactctggattagagaattacattttagtacttttcaaatatgtaatagatacactttttatctctatgtagattttaaactacataacaggactctttgtcatattgaatggtctgcagtattgctatctgaaattaccgataatattgtacattcagattcacttaagaggtaaccttgcagagaatttacttctgtggtattctggatcactctaaagagaatgttttataaattaaacatttttaaggtaaagatatattttgtttggcattagttccatgttggattgattgctttttactgaaagcattccatcaagctgaaacagtcttttgttttatgttgcttagaacatcaagcttgcagtggctttcattttcttgtttttgtttttttttaaatcaaatcaatgcatgtgcataatttggaaactcaagtaatataagacatataaccaaaaaaaagcagttgctagcacaaccctccccatcctcattcatggtcccaagaggcaatcgtttccagtctgtttgactattttttagcttgtactgctgtcttctttctctcttcagtttagacagcaaccgttaacttcctgctatggaaaatgaggatttcattgtcttactccaacactgctacatatttctctaccctcttccccatcttccctctactaatacagcatgatttttagtgaaatctgtattcagtgtatacattataatgactgaaaaatattttttgcaatttaatacctaatcgactgtgatcacatttcctttctttacagcttactgctttccatgaagttattaactgtccttttcatttctcttaattttctgtgtccttacacaggagctataaaaatcctgcccaatatgttaaaatttctccattggttccatttctgtttcttggagaacccctggacctcttcatatgcttactccattctgaagtgctcattttctatgtgtgccatacagctctcattctgtaaattattcttacctcttttctgtgttagaaaccccatttcctggtttccatgtcatctttctagagtttttcccccaattttaagggcccacaactctcagaggcttgttgggaaaaggagcatgcaagctttttgatatcttagggtaaggttggctggatatagaattctaggttgaaataatttcttcagaatttttaagacatttcatttatcttctttagcatagctcctgctaattgcagtgcattcttttttttttttttttttttttttttttgagacaacgtctcactgtgttacataggctggagtgtttcattttgtacagatgaggtctccctgtgttgcctaggctggtcttgaacttctgggctcaaacggtcctcacgctttagcctccgagagtgctgggattacagacatgaaccactgtacctggcctgcggtgctgtttttatcttcagtcattcattatgtgctctggttttaagaagttaagattgttttgtctttatttttatttatttatttatttttgagacaaagtctcgctcttgttgcccaggctggagtgcaatggcgtgacctctgctcactgcaacctccgcctctcgggttcaagtgattctcctgtctcagcctcccgagtagctgggattacaggtacctgccaccacacccagccaaattttgtatttttagtagagacagggtttcaccatattggccaggctggtctcatcctgacctcaggtgatccacctgcctcagcctcccaaagtgttgggattacgggcatgagccaccacgcccagcctgttttgttgttatttaaatttcacagtaatgtactttggtgtctttttttttttttttttttttaacttttttttttcctttaattcttggcccagatgcttactggcacttactctagaaacacatagtccttcattgagttctggaaaattttctttaagtggttcttttataatttccctccatttttttctctagttttttctggaactcctgatgtttggacactaggcctcctatattgttcctataattttcttgtcttttctcctactttctatttgattgtctttttttattctaacttctgggatggtttttaatttttttcttctaattctttattaatatgccatgttttatagatttgtctttaaatatttttacataattttgtaacaaaatacaaaaaaagcaattcctaaaaatttagaaagtcaaatgaaagcaaagaacttaagtgtgttttcaattagagcataatcataccaagaaagtatttcaagtaacttaaaaaatgttttatgtccctagtggtatataccccaagaacaacaatagcaacaacaactataaaatgaaacaaaatcttaagctattgttagtaatcatattgctggtggtagtgttggtattcctattctgaagttatagtggatgtgaagtatgttgtatgtgtatactcttttacgtatatttgttgtatgtgagtaattatatgattatagagaacagggatctttttatcagagaaaggtgcagatgtgagattgaagtaaaagaaaacttgtggttctgcatttgtattggaaatatcattatgaactcgagatctatattatctttaaaaaatacatgctggctgggcacagtggctcacacctataatcccagcactttgagaggccaaggtgaatggatcacttgaggtcaggagttcaagaccagcctggccaacatggtgaaaccccgtctctactaaaaatataaaacttagccaggcatgatggcatgctcctgtagtcccagctactgtggaggctgaggtgggagaatcacttgaacctgggacgtagaggttgcagtgagccaaggtcgcaccactgcactccagcctgggcgacaaagtgagaccctgtctcaaagaaaaaaaaaaatatgcttattggtttcatctatcaaaaagaacaaaaaaaaaaaaaaaaggaataatccagtagtagtgagtaaccctagctctcagactgttttctaagtactgttttctcttaaaaggatgcaaggtgtcttgaagaaatggctgattccagattcagaggaggaaatatatgaatctggaaagtcttgacataccagaaaaaaactaagcatcaaacactactagtgtcatgtcaaaaggacttaggagtgtaatagaatagattcttactgatcacagataaaataatttgagcatcagaaaggataataacaggctgggcacactggcccacacctgtaatcccaagattttgggaggccgaggcaggcagatcacttggggtcaggagtttgagaccagcctggccaacatggtgaaaccccttctctactaaaaaatacaaaaattaggtaggcctgggggcgggtgtctgtaatcccagctatttgggaggctgaggcagggagaattgcttgaacccaggaagcggaggttgcagtgagccgagattgtgccactgcattctagcctgggtgacagagcgagactccatctcaaagaaaaaaaaaaggataataacagcaaaaaattgaaattcataacaaatgataacttctattctcattgttttaaaaactaaagcccaggcacagtgtctcacgcgtgtaattgcagtactttgggaggctgaggtgggcatactcaggagtatgagaccagcctgggcaacatgacaaaaccccatctctacaaaaaatacaaaaattaaccaggtgtggtggcatgtgcctatagtcccagctacttgagaggccgtggtgggaggatgacctgagcccaggaggcagaggttgcagcgagttgagatcgtgctactgcacttcagcctgggtgacagagccagagccagacccagcctcagaaaaacaacaaaaactaggtaaaaggagaaaaaaatcaagcatttatctttcttctcttatatgatctatattttgggaccctcaagtagatgaggggaagtttctgtttataaaaatgtttcaacaaataaggaataatagaattaaaatataaccatttcgcaaccctcaaattagggttgtcttttcttctaattcttttttttttttttttttttttttttttttttttttgagatggagtctcgcactgtcgcccaggctggagtgcagtggcacgatcttggctcactgcaacctctgcctcctggattcaagcgattctcctgcctcagcctcctaagtagctgggattataggcacccaccaccacacctggctaatttttttgtatttttagtagagacagggcttcactatgttggctacgctggtgttgaactcctgacctcgtgatctgcccgccttggcctcccaaagtgctgggattacaggcttgagcctgtaaatccagaaaaggattacagcccttttcttctagttcttaaagtgaatttgtgtctaccaacataattttcaagagacctttattattccctaaatgtttttcttttttttgtgacattcagttcttgtttcatagatacagtatcttctcatctttctaaagctaatgattaatgttttattttcattttcgttttttctgctccctgcattttttttttttaatgaaaacctttgtctatttgagtctctctggttagagactttcctcaatggtgatcattcactgatccagaagttgtatgtgaggtgaggcttgtcagctcatagggtagtaatgtagtgatttagtttttaactaggagaccctcaaatatcagtgactgttctgagagctgagcagagtaaggaaattaatagggagactcattgtcagtgtaagaattttatttcagtttgttgtttgttgtttgttttttgtttttttgttttttttttggttttttttgttttttttttagatggagtcttgctctgttgcccaggctagagtgcagtggtgcgatctcggctcactgcaacctccacctcccaggttcgaggaattctcctgcctcagcctcccgagtagctgggactacaggcgcctgccaccacccctggctaattttttatttttagtagagacggggtttcaccatcttggccaggctggtctccaactcctgaccttgtgatccacccgcctcggcctcccaaagtgttgggattacaggcgtgagccacagcgcccggcccagttttgttttcaataatagcatctcacccccaccctggctgcgtctgctcagtattccagagtccacgatatgtatggttcagccctccagaaaataaagtctcctgcatttttttttttaatgctgcagcaagaatagggtcctgggttcttttttagtatgagggagagacagccacctggctacttgggataggaaagaaaatctggtgtttcaactacgtttgtacaaaatgtcaaccatttcttcctattttcagccccaccatatgctcctgccttcacaggtacctgttgcctccaatttctgagtgttttcctttaattattttgtttcatgttaactccttacaacaagtttggtggctgaataaccttgggcaagttgtgtagtttctcatatactttagttttatcgttgtctgtaaaatggagatgagtcttcagattattgtgaagataatttgtttgtttgttttttggagacggaggcacgctctgtcccccaggctggagtgcagtggcacaatctcggctcactgcaccctctgcctcccaggttcaagcagttctcctgcctcagcctcccgagtagctgggattacaggcgcccaccacctcacctggctacttttttggtttttagtagagacggggtttcaccatgttggcccgggtggtctcgaactcctgacctcaggtgatacgcctgcctcggcctcccaaagtgttgggattacaggcatgagccaccttgcctggccaaagattaattgttaatatacataaagcgcttaacaccatgccaggtaccttagtaagtgttcgatgaatatttgctttttgtattagccataatcattctcaggctgctttgtcatttacttgttccacaaattcttagcttccaaaattttggtgatacctcatttcctattctctctagttgcctttgtccatgtagattttttgaggaagcttgggtaaataagtgtattttaaactattatgtttaaatcgaagttccttttatctgttttctaatagaaacatttaaatagcattaagaacttgtagcagtataaacaatatgtttgagaagtactatattgtgaaaatattttcacttttatacagttttttacttatttactgtcttactaatcttcctaagactttttaaagtgaatatttttaaggcagttctagaagaatgaaaactcttatgatatctgtaatagaattgaatacatatttaactactaaatcaatatatttattaatttgtccagatttctgctaacagtactcggcctgctcgctggtataccaaacttggattctttcctgaccctagaccttttcctctgcccttatcatcgcttttcagtgatggaggaaatgttggttgtgttgatgtaattattcaaagagcataccctatacaggtatgatgtattcttgaaacttaccatatatttctttcttttgatacaattaatttgtttgtttgtttgagatggagtttcggtctcttgcccaggctggagtgcaatggcgtgatcttggttcactgcagcctccacctcccgggttcaagtgattctcctgcctcagcctctcaagtagctgagccaccacacctggctaattttgtatttttggtagagaaggggtttcatcatgttggtcaggctgatctcgaactcctgacctcaggtgatccactaatctcagcctcccaaagttctgggattacagatgtgagccactgtgcctggcctgatacaattaacttgaatgttatatatgtgacttttttggtgtgtgtaacacattattacagtggatggagaagacatcatctggattatacatatttcgcaatgaaagagaggaagaaaaggaagcagcaaaatatgtggaggcccaacaaaagagactagaagccttattcactaaaattcaggaggaatttgaagaacatgaaggtaaaattagttatatggtacacattgttatttctaatatgagaacaaagtcttagagactttgaatttaacatttttaatgagtaaattgtttttattttgagtagtaaattgactttattttttagtatctagggtattcttttttggtgttagacaaagaatagcaacaagggacagaaatatcaggtctaagccatttgtaatatttttcctgaattcttacctatatgatgtggcttttgcatttttgtcatggtagttattagctttcatgtgttattatgcctggaactaggacctattgtggtgtcaattttaatattaaaaatcatggtgttttgatgtttatatgacataaattttattttttcgtatctcccttttgttgttgctgaagattttatgtttttctgcatttcctcatgatttatatagatgtaacatgttctataggacatgtaatttacatgtcctatagaactataagttacatgtcctatagaacttacagttctatagttatctgcagaaatattgctccttatgctttatttgcttaaaattatcactagatcatactattttcataaataaatgaatatgaaatcattcacaggcatacctcagagatactgtggatttgattctagaccaccgcaataaagcaaatattacagtagagcaaatcacacgaatattttggtttcccagagcatacaaaagtaatgtttacactatagcataatctcttaaatgtgtagtagcattgtatctaaaaaaaacaatgcacataccttaatacactttattgctaaaaaatgccaatgatcatctgagccttcagtgagttgtaatatttttgctggtggaggatctttcctcaatgttgatgcctgctgagtgatcagagtggtagttggtgaaggttggggcagttgtggcaatttcttaaaataagacaatggcatttgcaacattgattggcttttcctttcatgaaagatttctctgtagcatgcaatgctgtttgatagcattttatccatggtagaactgctttcataattggagtcaattctatcaaactctgctttatcagaatattatgtaatattctaaatcctttgttgtcatttcaacaatattcacagcaccttcgccaggactagattccctctcaagaaactactttctttgcttatccataagaagcagctctgtattaatctgttcccacactgctataaagaatacctgagactgggtaatttctaaaggaaagaagcttaattgacttacagttccacatggctgaggaggcctcaggaaacttacaatcatggcggaaggcaaaggcaaagcaagtacccttttcataaggtggcagaagagagagtgcaggggaaactgccacttgtaagccatcagatctcataagaactccctcactagcacaagaatagcatgggggaaaccacccccatgatccaatcacctcccaccaggtctctccctcaacacatggggattacaatttgagatgagatttgggtagggacacagagccaaaccatatcattctgccctggaccctcccaaatctcgtgtccttttcacatttcaaaaccaatcatgccttcctaacagtctccgaaagtcttaactaattccagcattaactcaaaagttcaagtccaaagtcttcatctgagacaagacaaatctcttccacctatgagcctgtaaaatcaaaagcaaattctttacttccaagatacaatgggggtacaggcattgggtaaatgttcccatctcaagtgggagaaattggccaaaacaaaggggccacagtccccatgcaagtccgaaacctagccaggcaatcaatgaatcttttttttttttttgagacagggtcttgctctgttgtccaggctagagtgcagtggagagatactggctcactgcaacctccgcctcctgtttcaagcaattctcatgcctcagcctcccaagtagctgggattacaggtgtgcaccaccatgcccagctaatttttgtatttttagtagagatggggtttcaccatgttggccaggctagtcttaaaactcctagcctcgctgggtggggtgtctcattcctgtaatcccagcactttgggaggctgaagtgggcagatcacaaggtcaggagttgaagaccagcctggccaacatggtgaaaccctgtttctatgaaaaattcaaaaattagctgggcgtggtggcacgcgtctgtaatcccagctattccagaggctgaggcaggagaattgcttgaatccaggaggcagagattgcagtaagccaaaatcacaccactgcactctagcctgggcaacaaagcaagactctgtctcaaaaaaataaataaaaaaaaataataaaaataactcctagcctcaagtgagccactgcacccaggccagtcattaaagctctaaaatctcctttgactccatgtctcacatccagggcatgctgatataaggggtgggctcccacggccttgggcagctctgccctttggctcttcagtctacagcccctgcagctgctttcatgggctgccattgagtgacagctgcacagtgcaggctgtcagtgggggatgatggccctcttctcacagctccactaggcagttccccactgaggactgtgggaggtggctccaaccccgtatttccctcacagtttccctcccggtttccctcctgtactgcactaacagaggttctctatgagggctctgcccccacagcagacttgtgtgtggacatcctggcacttccatacatcctctgaaatctaggcagaggctcccacagctgaactcttgtcttctacatacccacaggcccagcatcacatggaggccaccaaggcttagggcttgcaccctctcaagcaatggcctgatctgtaccttggccctttttatcaatggctggagctggagcaagtgggacacaggttgccatgtcccatggctgcacagagcagtggggccttgggcccagcccacaaaaccatttttccctcctaggcctcaaggcctgtgatagaagggtctactgtggagatctctgacatgccttggagacactgtctccattgccttggctattaacgtttgtttccttgttacttatgcaaacttctgcagctggcttgaattctttcccgggaaatggatttttcttttctacttcatggttaggctgcagattttccaaacttgcatgctctgcttcccttttaaatataggttccaatttcaaaccatctctttgtgaacatgtatgactgtgtttctagaaaaagccacatcacaccttgaacactctgctgcttagaaatttcttccacaggataccctaaatcatctctctgaagttcaacattccacggatctctagcgcaggggcaaaatgccactagtctctttgctctaaagcatagcaagagtgacctttgctccagttcccaataagatcctcatctccatctgagaccacctcaggctggacttcactggccacatcactgtcagaattttggtcaaaaccattcaacaagtctctagggagttccagactttcccacatcttcctgtcttcttctgagccctccaaactcttccaatctctgcctgttgtctagttccaaagtcacttccacattttcaggttatcggtatagcagtcccccactcctggtaacaattatctgtattagttcatcctcatactgctataaaaaatacctgagactgggtaatttgtaaaggaaaaaggtttaattgattcacagttccacatggctggggaggcctcaggaaacttacaatcatagtggaagatgaaggagaagcaagtaccttcttcacaaggtggcaggaaagagagtacagggagaactctcacttttaagccatcagatcttgtgagaactccctcactatcatggaacagcatgggagaaactgcccccgtgatccagttacctcccaccaggtccgtccctcgacacgtgaggattaccgttcaagatgagatttgggtgaggacacagagccaaatcgtatgaagctccttatcatttaagttttattgtgacattgcagtaattcagtcacatcttcaggctttacttctaattctagttctcttgctattttcaccatatatgcagttacttcctccactgaagtcttgaaccccccaaagtcatccatgagggttggaatcaacttctggtaaacttgttaatgttgatattttgacttcccatgaaacactagtgttcttaatggtatttagaatggtgaatcctttctggaaggttttcaattcactttacccatatctatcagagaaatcactatggcagctattctttataagacatgtttcttttttttttttttgagatggagtttcgcacttgttgcccaggctggagtgcaatggcgtgatcttggctcacagcaacctctgcctcccaggttcaagcaattctcctgcctcagcctccggagtagctaggattacaggcatgtgccaccacgcccggctaattttgtatttttagtagagacggggtttcaccatgttggtcaggctggtcacgaactccggacctcaggtgatccacccgcctcggcctcccaaagtgctgggattacaggtgtaagccaccgtacccggcaagacatgtttcttaaataataagacttgaaagttgaaatgactccatgatccatgggccacaaaatggatattgtgttaggagtcatgaaaataacattaatcactctatacatctctgtcagagctctgtgacagagacatgaagtgagcacatactgttgcgaaaatggcgccagtaggcttgctcaacatagtttccacaaaccttcaatttgtgtttttaaaaaaatgcagtatctatgaaactcagtgaagtgaaatacattaaaacaaatatacctatgttaactcacatattactgtaattaaactctgtatgactttttttttttttaaacatgagtacactggtttcaaaatttcctggaaaacttatagcaggccaggtgtcatgggtcacatctgtaatcccaacagtttgggagtccaaggtggtggatcacttgaggtcaggagtttgagaccagcctggccaatatggtgaaactccgtctctaccaaaaatgcaaaaattaaccgggcatgttggatgtgcctctaatcccagctactcgggaggctgaggcaggagaaccacttgaacccaggagacagaggttgcaatgagccgagatcacaccactgcactcccagattgggtgacagagtgagaccctgtctcaaaaaaaaaaaaaagaaaaaacttttagcagttatatagtttcttatctttaaatctcccttctttgggtgttttatgcttggttctttagttttagttgcttttgaatttacagtttagtgaattaataatccttttgttttcttagaaaacacaacaaaaccatatttaccatcacgtgcactaacaagacagcaagttcgtgctttgcaagatggtgcagagctttatgaagcagtgaagaatgcagcagacccagcttaccttgaggtgagagagtaagaggacatataatgaggcttgatgattattcaaggtgagaagctgttttagactctctggccatcacaggaaggagtatgttgaaatgctgcatttctcaaaagggatgtgtacatttctgggattttcagtgatgtgccagacgagtgtggtggtatgttttcaactatataccgagtagaggatgggagggttctagaattttatatattaattaaatttggtttaaaatgcaggcaaaacttgttttatttttgtccctcctgtactctgaagcaaaaaaacttttttatttttaagataaaacaaatatcttcaaagtaatggcttagtttccatgttcttagctgtttctcaagtccttcctggagtgtacttgataatcctctaccctaagggtacttgggtagaaatgtttccgaagcactaaactgttagaagtagcataggctttagaatcgtggcactctcattttattagcaaagtaaatgacaataaaatagctggccaggcgcggtggctcacgcctataatcccagcactttgggagaccgaggcagaaggatcacctgaggtcgggagttcgtgaccagcctggccaacgtggtgaaaccccgtccctattaaaaatacaaaattagccaggcgtggtgcacatgcctgtaatcccagctgttcgggaggctcaggcaggagaatcgcttgaatccaggaggcagaggttgcagtgagccaaggtcatgccattgcactccagcctaggcaacaagagcaaaactccgtctcaaaaaaaaaaaaaaaaagctattaaatgggcgtaaaatgttgttttaggatcaaataaataatctatataaaagttccatataaatgttagttactattattagaacataattttatatattaaactacctcctaaatttttagacaggtagatagctaaaaaaaaattcaaattctaagattagtttgttagggaggaaggagcaaatattttaccaaaactacttgtttttaattgattaatttcattcacttgatgacttagtaaatcttgtgaatatagccttaaatttcttaaatagtgggactacaaaataaacaatatttcatcagtaatgtaagcagtgctatactgagtagaattccctcctgttccgaaatgttacaatttgggttctccctgtgagaagtgagtccggttttaaaacctgtgagtatacttgctgcaggtctgaaaatgaaggctttatgattctttcttgaaaaattatttgcctctatcttttataatattatttgttgaagcttgtgcattctatgaatcatcatgaagatagctttaatttcatccacaaaatttaacaatatttttttgtctggacataagggggcagaataagagttggagtagggccttgcccagccactctgtaactggacaagtgatgtatttatttcttaggacctcatttccaccttctatcaagggaaaacctaagagtaggttatctttagggttctaagtgcctatgagtctatgagatttgactttattaaagttatctttgtaattctttgaggagaacgtaggcatccatttttaaaacagtcctgttagaatttgttttcagtaacaatgttgaatgatggccttttgaaatcaggttttacaacaaaattgtttaaacactgcctgcatatttagaatctctatacctatattaagatacagagattggatagtctcccttttcagtatagataatctcccttcccggtagagattaggatattaagatgtataatatcctaaagtgtagcagcagtctggtatgttacatgtctaaattccatttcctattttatttgtttattgatttatctgtttatttttgttacactgggtaagattcccaagaggtacaagtagaaatttgctaaagtgagtaggacagaagtgtagaggcaaacataaaagtatgtttagtacatatctgttttaaattgtatctactatttcaaagttaatggaattatactcctggggctaagaatgagggttctagggccaacctctactacctatgtggcttgtgcaaattagttgtcccctttgtgcctcagttttacctacaacacagaaacaatgatattacctaccccatggactgttgtgaagattaaatgaattagtacatttactacacatagatctatttctcaaaataatgagcattcagatattagccatctgtaatgtagttggtgatgattatgattattagagtacatttataattggaggatcatttttgccgtagggaaatagaattattaatagtttgaggcacctgagaatattatgtgagaaactgattacattaaccacacccttaagatgagctctaattttgttgtatttgtcctgtttaaagccatctagttacaatagatggaacttttttgttctgattgctttttattccaatatcttaaatggtcacagggttatttcagtgaagagcagttaagagccttgaataatcacaggcaaatgttgaatgataagaaacaagctcagatccagttggaaattaggaaggccatggaatctgctgaacaaaaggaacaaggtttatcaagggatgtcacaaccgtgtggaagttgcgtattgtaagctattcaaaaaaagaaaaagattcaggtaagtatgtaaatgctttgtttttatcagttttattaacttaaaaaatgaccttactaacaaaatgattataaatccagataaagtataaagttagtttatatcagagaagcaaaatccactactaatgcccacaaagagataatataaaagaggatctgtatttattttgaaacaaacatttaaatgataatcacttcttccattgcatctttctcatctttctccaaacagttatactgagtatttggcgtccatcatcagatttatattctctgttaacagaaggaaagagatacagaatttatcatcttgcaacttcaaaatctaaaagtaaatctgaaagagctaacatacagttagcagcgacaaaaaaaactcagtatcaacaactaccggtacaaacctttcattgtaatttttcagttttgataagtgcttgttagtttatggaatctccatatgttgaatttttgttttgttttctgtaggtttcagatgaaattttatttcagatttaccagccacgggagccccttcacttcagcaaatttttagatccagactttcagccatcttgttctgaggtggacctaataggatttgtcgtttctgttgtgaaaaaaacaggtaatgcacaatatagttaattttttttattgattcttttaaaaaacattgtcttttaaaatctcttatgattagttggagctaccagttggcaaatttgctagctaactagtgatctgaaagtaagcctctttgaacctctgatttttcatgaaaagcaattctctcaattctatattatttcaagggtaacaagttacatcctagtctgtgtacttaattttatagaaattgtccttaattttattttctgcaatttatgttttcttactatttctggtgtatgtgtttatcccattgtgatgttatattggtgtcctcaatttatttccttagccatacactctacttttcattgtacagggctatttattatctcagagtcaagcttttttttttttttttttttccccgagatggagtctcactctgttgcccaggctggagtgcagtggcgctatctcagcccactgcaagttctgcctcccaggttcacaccattctcctgcctcagcctcccgagtagctgggactacatatacccgccaccgagcctggccaattttttgtatttttagtagagtcggggtttcaccgtgttaaccaggatagtctaaatctcctgacctcgtgatctaccagcctcggcctcccaaagtgctgggattacaggcgtgagccaccgtgcctggccagagtcaagcttttattttattgaatatatggtcttactaagttcaatagcatgaatctgttgtgaagaattcaagaattttcttctatttgttgagttttgttttcttaggagttttgctctttctcttttgctgtgttttctccttattttttaaatgtgtttgtgtttggtgagttatgttttagtgcttcgtaggtttttctttgactatattatattagtaagccacattgttcccatgccattttatttcatcttggtcatatttggatgactcttttcacacattttattgttattatagaaggtggataacttttgttcatttaattcatcaatatttatttaatgactgttatgtgctagacagtgttttaagtgctgggtacatagcgattaacaaaacagataagaatccctaccctcatagagcttacattatgaggttgggggagggagattacaaacaaagaaataagtaatatacatgtgtatagtttttttagtgctcagaaaaaaaattaagtgggtaagggggtaatgtcagagaagagagagggatgtaattttagattgagaggtgaggagagagacctccctggaaagctgacatttgagtgaagcttgaaggaattgagggagtgaggtgaggcatgtggccatctggggaaagctttccaggcaattacaaaggccgcagtacagcaggatcatgcctagtgtgccgtgaagcattggcagagaccagagagtgagaagtaacatccagggacagaggcagtgaagagccaggtcgtgtgggggtccttgtgtggactgtaacttcctgtgatgacaggaagtcacaggaaaattccaggtagagggacactgtctgacaggttttcacagaatcattcaggccactgtgttgagaataggctgtagggggcacaagagtacaaacaagccatttggaggctctttcaagcacttaggcaaaagatgatgaaccaaacaaaagcaatggaagtggtgagaagcagtcagattcttgttgtattttgaaggtagggggacggtgcaggatggtctgaacattgggaaaaatggaattgccacttagaaggaaagactgcaagaaaagcaagtatgtggggaagttcaggagctcagttttagacagttaagttttagatgcttattaggcatctaagtagaaatgtctacttgatggttacataggaatctgttcagaggaatggctggatatgaatttgggagtctttactacaaatttttttgtatttttagtagagacggggtttcaccgtgttagccagaatggtctcgatctcctgacctcgtgatccacccaccttggcctcccaaagtgctgggattacaggcatgagccactgcacccggccagtcatacaggggacatttaaagccgtgagactggatgaggtcactgtgggcatgggagtagatagagacgggaagagatccaagacctgattgaagccttttatacttagaagcagggaaatataaatgtaaatataggaatcagtaaaagaaacagaggaatggccagagaggttggaggaatactggagtgaggtatgctgaaagccaagagaaaaaaagaattgtcgagtagtgagagtgattaagtctgccaaatgctatttcatagaattgataatgaagtgaggaccaagaattgatcattggctttaacaccgtggaggagcactttcagtggactgaagtggggcaaaggaaatggagggaaaggaggaatgatagtgaatataggcatttcaaggatttttgctttaagagaagaagagaaatgaatcagtagccagaaggggaatcaggatcaagagaacatttgctttttcagttgaaagtgctaatagcatactgatgagatactgtatgctgatgagaaagatccaataaagaaggtaaaatgcaagatggaagcaaaacaggaacagctgtggggcactgttctcagatactgtgtggtatggtatctagaggctctgttgaaattggccttagctagcaggagagactgttcatctgtaatcacaggaaaaaagtaaagtacgtaggtatagataccaatggaagagttgatatacaagaggaaacttgtggcagacctcttttgattgctctatttcctcgctgaaacagggcacaaaatcatcagctgagagtcagaatgaagaaaagggggccaggcgcggtggctaacgcctgtaatccagcactttgggaggccaaggtgggtggatcacgaggtcaggagatggagacaatcctggataacacggtgaaaccccgtctctactaaaaatacaaaaaattagccgggtgtggtggcgggcgcctgcagtctcagctactcgggaggcagaggcaggagaatggcgtgaacctgggaggtggagcttgcagtgagctgagatcacaccactgcactccagactgggagattccgtctcaaaaaagaaaaagagaaagaaaagggtgttgaaggtttgagagaagaggaaaggcatgaaatcattatctaagaaagtggtagagtaaatggactaagtaaacacatcatgactgccagggcccactggaggtttaatgttcatgaatatattgttgttgtgtgatattttttcaaccgtgttcagctctgatggtgtgggcatgaagtagttggaaagtagaatttaaccaggtctgtagtttagctgggtaagtaatgcaaagcaagaagggcaaagaatttgggggtatatgcaaaaggaggatttaaataattgaccttggacacaatgcagagcaaagaagagacattagaagacgtggatcaatgaacaggagataagaaaagctgattgtaggtcacggtgggtttgagttagggttttagagggagtgaactgggcagatcaaaggtaggtggttgaagaaggaggtacttcaaattgagattctgggggaaatggagttattggaaataaaagtcttgggtatgtccattgcagtgagttaccagtggaaaatagaggacatgatcatttaggaagaaaacaaggaacttgggagcaacagagtattggaaggattgcctgtgaggatactgaaatttccaggaaacatgaccatcgtgatgacagaatgacagtgagttatgagttaaaatcttcaaggaatgaaaggcaatgagtgagccagggtcaatggatgcctgtagcaaggaacagtaatgaatgacagtctgataacacgaggttcaaaactgagtgtttttagagtgggaggagcagcaatgaagcatgaggaagacatctgcctcatctcagcctccagtagcacaaggtctgcaggggcaactgtacaggcagacaagaaccaggtttgttgcaacaagatggcaatgagagcacctgcaggaaagggtgacggtagtggagatcttactgagttccagaggccccattgaaaggattcgaggagatgaagaggtaggaggagatggtgcccagaaaggccacatccaaagcctggaagcggaatccagggaatttggcatgactgagagcctgtgctgccttttttaaatgttttaatttttgtgtgtttatagcaggtgtatatatttatgggggagcctgtgcttgttatggggactgacacagatcagctcttggccccaaggcaaggtgtgtgggagaagaaaaagtgaggaggcctagatgtcagaggagtccggctaaaccactgcagaactgctgcctaattcacagcaaccatgagtaaaaatgctgatgatcatcaggtcaaggatagtctggagcagttaagatgttactttacatgggaggtatcaattaaagatgatgaaatgcctgatttggaaaacagagtcttggaccagattgggtttctagactaaatacagtgtgggaatacacaatacacaacctactagcctatgtgaaacacccgaaaggccagaatgaggaagtgctggagaacttgaaagaagctgaagacttaatccagaaagaagatgccaatcagatttgagaagcctggtaacctggggcaactttgcctgggtgtattaccacatgggcagactggcagaaacccagacttacctggacaaggtagagaacatttgcaagaagttttcaagtcctttctgtcacagaatggaatgtccagagatggactgtgaggaagaacgggccttgctggaatgtggagggaagaattatgaacaggccaaggcctgctttgaaaaggatctggcagtggctgctgaaaaccctgaactcaacactgggtatgaaatcaccgcctgtcgcctggatggctttaaattagcaacgggggatcacaagtcattttctttgcctaccctaaggcaggctgtcaggctaaatgtagatgatagatatagtaaggttcttcttgccctgaagctttgggatgaaggacaggaagctgaaggagaaaagtactttgaaggagctctggccaatacgtccatgcagacctttgtctttggatatgtctttggatatgtcttctcttcttactgaagagaagactttgtggatgaagctcttgagctcttaaaaacctccttgcaggcaactcccacttctgccttcctgcatcaccatatagggctttgtgacaggacacaaaagatccaaatgaaggaagctaccaacaagcagcctagagggcagaacagagaaaaggtagacaaaatgataagatcacctgtatttcatcttcaatctgctgtggaacaaaagcccacatttgaggttgcctatatagaactggcaggaaagtatatagaagcaggcaatcacagaaaagctgaagacacttttcaaaaagtgttgtgcatgaaaccagtggtagaagaaataatgcaagacatatatttgcactatggtagatttcaggaatttcaaaagaaatctgatgtcagtgcaattatccgttatttaaaagcaataaaaatagaaaaaggcataattttcaagggataaaagtgtcaattctttggagaaactggttttaaggaaacttcagagaaatgcgttagacctggaaagcttaagcctccttaggtttctgtacaaattgaaaggaaacatgaatgaagctctagagtactgtgagtgggccctgagactggctgctgagttttagaactctgtgggacagggtccttaggcactcaaatattgaccactttcatatttcatttgattttctgttaacgtgctaatcaaggctgaggtgagtggatcacctgaggtcaggagttcaaaaccagtctggccaaagttgcgaaaccgcttctctactaaaaatacaaaaattagccaggggtggtggcacacacctgtaatcccagctactcaggaggctgaggcaggagaattgcttgaacctgggaagcggaggttgcagtgaaatgagatcgcaccactgcactccagcctgggccacagaacgagactgcatctcaaaataaagaaaaaatgataatcatcttttctgcttgctgttttcagaaacatattatgtaattcactgtaatgatgtaattattgaacagttactcaaatctgataaaatattagttgcattcaataattaatgaatcaatgtgtgtgtgcatgtaagaaaaaccatttgtatgaagcagaaaaaaaatgttaggtagatttgtaggaaacaaaatactggacttacactaaaataaagtgagaaggtcggtgccatgacccagtgtaattcttgactctctatttatccaagattaatttctcccccccttagttacagtgtgagggctggatatttgagtttctattcatgatacagtatgtatccctggaagatgtctctggttctagatcatttttcccagttcagtgagtaacgccgtgtatttatttgctataacaaagaaccatagactgggggcttaaacaacagaaatttgttttctcacagttctggaggctggaaatccaagatcaaagtgttggcagggttaattccttctgaggctgtgagaatctgttcattgcctctctctttgcttctggtgatttgctggcattttttggcattctttggcttgtagatgtctcacctccacctttgcttcattgtaaggtggtggtctcccaatgtacatgtctgtgtctaaatttccccatatattaggacaccagtcattatattagagcctgcccatatgtgtgggtggaggattacccaggtgccgaggcaagagactgaaggcacaaactatttcagtataataaagaaaatagttagattaaggatagtcataatacaaattagatatagagatgatcatggacaattagcaatcattataaaccttaatcattagcttttagtattattctttgctgcattactaatataacctaggaataactggcgggtatagggtgaggtgctgaagggacattgtgagaagtgacctagaaggcaagaggtgagccttctgtcacgcccgcataagggccacttgagggctccttggtcaagcggtaacggcagtgtctgggaagacacccgttacttagcagaccgcaaaagggagtctcatttccttggaggagtcagggaacactctgctccaccagcttcttgtggaagcctggatattacgcaggcctgcccgcagtcatccggaggcctaaatcccctccctgtggtgctgtgcttcagtggtcacactccttgtccacttttatgcttctcccgtactcttggttcctctttgaagttcgtagtagatagcggtagaaggaatagtgaaagtcttgaagtctttgatctttcttataagtgcagagaagaaaacgctgacgtatgctgccttccctctctgtttcggctacctaaaaggaaagggccccctatcctgtaatcacgtgaattgcttcaccttttcaatcacttagaagattcaccctccttaccatgcccccttgtcttgtatgcaataaatatcagcaagcccagccgttcgggccgctaccggtctcccgcgtcttgatggtagtggtcccctgggtccagctgttttctctttatctctttgtcttgtgtctttatttcttacaatctcttgtctccgcacacgagaacacccgctaagccgcatagggctggaccctacacatatgacctcatctttttttttttttttgagttagggtctcactctgttgcccaggctggagtgcagtggtgtgatctcagctcactgcagcctctgcctccccagctcaagcaattattgtgccttagcctcccgagtagctgggacgacaggcacgtgccaccacacacggctaattttttgtattttaatagagctggggtttcaccatgttgcccagggtggtcttgaactcctgagctcaggcattctgcttgcctcagcatcacaaagtgctgggattataggcttgagccactatgcccagcgtgtcttaggatttttcaactttataatggtctgaaaacaaaacatgagtaccttacaactattctttttcacttccagtacagtatgcaataaattacatgagatattcaacacttttttttttaaaaacaggccttgcgttagatgattttgctcaactgtaggctaatataagtgttctgaacacatttaagataggctaggctaacctctatgctcagtaggttaaatgtattaaatgcattttctttttttttttttgagattgaaagtcacatttattgccacgtgaaggaaagccaattaagtcaaattgattaatgtttgcagagtatatctgtttcgatccttttgtttttaatctacctttgtcgaatttaaagtgagtttcctataaggaacaaatagtcgggttataaatttttatccactctttcaatctctgtccattgattggatatttacatcacttacaatgaaggtaattattgatatgccagcattcaactttgtcattttattatttgttttctatttgtttctcctgcttttcattcctccatttctcttttcttgccttcctgaaggttacttaaatatattttaggattccatcttgatttatttttagtgttttcaggcatttttgtattatttttgtagttgtttctctaggtgttacaacatacatgtatgacttacagcagtctactagtatcaatattctaccactctaagtgaagtgtgagaattttgctttcattttgattttggagggaaagggattggatagtgaccatatacagacctttttcttccctacttttaaatactattttcttggatatcatagtattattatttttgttttagtcatcaaacataatttataaactgcatgaggaaatgatagcttatcgtatatgtccatttctcaaactctttccattgtttcttcctccatcctattgtcctcagtcctgatgctctgagagtcttcctttaatcttctcttttctgtttaaacaatttcttttaggcaatttttgagttagagaaaattcttttagttttctctcatctcagaatattttatttctcctttattccttgagaattgtttcaggatatagaatttgtagttgataattctttctttcagtacttgaaaaatattgtgccacttccctctggcctctggttttagatgagaaatctgtcatcattccaattgatgtgtccctatttaaatgcattttcaactaacaacgggtttattgtgacataaccccatcataagttgtcctcgactgtgtttccagataaggctgcattcacaggtactgggaattagtcacaatgtatcctgtaacatcctggaacctttccttatgtcagtcagtcctggtcacctgtttggtccctggcagttttttctcatttctgttcagaagaagaaaaaggtaaagattcttcagatttaggaataacagaattctcaaaaatgtcattttaccagtttagttggggaaggagattagactctgagccttcctgtgcttagttctatccataatcttctgtttcttaatcaccagattttaaattttatatcatgatattccacgtttgtagattttgggtgaatgtttcctttttaaaatttaatttgtttttaagtgttaaagttctattagaaagtttcaaggagccaccttaaaccagaagtctttaacacccagatctagtcatgatgcctcccagcttaaaatcttcagtggtcccctgtcccttagaaaatgaaacccagactcttttgtatacccccaaaaccattcaacttcctgccttaaaccaccaccatacacacgtcagctaaactctaattttaggctgggcgcagtagctaatgcttgtaatcccaggactttgggaggctgaggcggctcgcaaggctaggagtttgggacaagtctgggcaacagtgagattctgtctctataaacataaaaactaaatttaaaaaaaaaactactttaaaacataataataaaacaaactgtacaagttcatattcctgatgcatgataacatttaatgcttcctacctttaaaaatcttctttgttttgcatagatgctcttttgttctccccctcttgatgaatttgtcctattcattattcagctcaagtattacctccctagtcagatgcttacagtctgggttagatcctccttcctccagcttttgaagcattttgttggtttggctgtttcagcacttgtcacatggtccatgatcctacctgtacacttctgaataagccacctactagcctcagtaatacaatgatctcttcaaggacagggactctgtttggatttctacttccacttctgacataatgggttgaagcaggggtcagttgttgaaaactccaggtatgcagcatctcatacggtcctcatagtcacactgttcatttgctattatcatcccactttacagatggggaaactggagctcagagaggttaagtagcctgctcagggtcacaatgctataaattgatttgaacttatactttcaggccctaaagctcttaggttctttcttatacttcatgctgacaaaacaaaagcaaactcaacatttgagagttgggcttaaaacagggacatctgtatttttaatctaatgctttgttactgtattacagaaacactgtgatatataatgagttaattaaacgagaacctttcttaggttgggaaagatttgttttggggaaagcctgtttccctgggaaacagacttacagatttcatgtaggagattagaaaatgcccttaggaacagcacttgtgaggaagcaaatgcagcaggattgggcagaagaagaagaaaggttcagttagtcccacagggacttctggagctgggtggcccttcagagtcttgctagcctgaggcaagagccagtccttgcatactggctcctccagggaggggcatagccttaagcaagacaatgcctttcgacagagggcaagtccaggagggaactcagaggtgagttgtcaatagctagctctccccagaagctggaggatcacatgccttggtcctgaaggggatctgcacccgcaccatggcatccactccaggtggaatcggtgacagtggttttataaattgctaagtcctttattgtttcagtgacattttctaaaaggaattaaaagctttgaagaattctatgcaagttcagagtaggccagaccacaaagctgcaaaataagtttcttcttttccttttgtcttgtgaagatttacctagtgtaggattctaaaagtgttacactaaaaattcttccagttgttatcagttgtatgataattaaagaaataaggcttccatttcttttgatggaatttgatccagacatggaaacctccacttacgtaaaagtgcaatgaggaaactacactgtttactttttatttttctgtattctaaatgtttttcaataaacatgtattttatatttggggaaaacaagatatatttaaaaaggacatttgggagaaggacagtactatcatcaagttttgaatataattagaggcaagttccaaaattagaaaatggaacatgcttgagaaacttataatttctttaaaagcagtgtttaaaattaagatccattaaataaatttgaaatgaaaagaaagaaaagatgaaccatcatttgcaatagaataaacaaatccttatctgagaatgacatttccattccctgttatttacaacggatacataattctcagagtaacaaaaacaataaagtataaagagtagaattaaatgcttagtgcctcttccaactccagctttcctagcctcagttctatcctggtttatcccaggatagaatggatagcacctacccatctttcactttagaattttataactcttggctaggcacagtggctcatgcctgtaatcccagcactttgggaggccaaagcaggcagatcacttgaggccaggagttcaagaccagcctggccaacatggcttgaacccgggaggcgggggctgcggtgacccaagattgcaccactgcaccctagcctaggccacagagtgagactgcgtctcaaaaaaaaaaaaaaaaaattataactctttattttgaactaatttcagacctttaaacaagttgcaaaaatcgtggaatttccaaatattcctcacctagcttcccctaatgttaacatcttgcataaccgtagtacaattagaatcagaaagttaatagtggtataattattacccatactgtagatgtatttgaaaaattgtttgagtttaaggtattttaccctgtttccccttttttgttctgggatcccaaattgcatttagtcatttttcccctgtattttctaccagtctttaatacttcctgtcttctttttcatgatcattatgcttttgaatagactgataatgatcattatgtttttgaatagactgatcaattattttgtagcattcccctcaatttgagttcgtctgatgttttctcatgactaggatgaagttatgcatttctggcaagactaccactgaagtgatgatgtgtctttctcagtacatcatatcaaggggttaatgatactgatcttaatcacttgattaaggtgataatctgctgggtttctcctctgtacaataacttcctttttctttgtagttaataaatatcttgagggagattctttgagactgaatcctatttcacatcaaactagcattcatcagttgattttgtttgcaacaatgattactgtggtatttgcctaattatgatttttctccctttctttccttctacattaattggaattctataaggaaaagctgtgccctttccaccaatgtatttatttggttatttatatcagtatggactcaagaacatttattttattctgcaggttaaaatttggtaccttcattattttattgtttaactttttttttttagctttgaccattaggagctttctcatatggactcgtgtgttctttcaaccagctttcttcactttttgaacacttccttattttttgacatcacaagatgttccaagttcatcttatatgttccctgccctagtcttggaatcagccatttctcttggcttcttttttttagtagaaaatggtgtttagatccaagatctggttgctagataggctcattactttactgtggaggcatcagtactgccaggccctctcagcagacagaggtgggaaatgtttgtcttccattttggattccctcatgtctagttggatttgtttgttggttggtttattgggtatgtgaagtatcactgtggttctagggagtcagacctgtacaaaaagatatacttcatgtcacttcctccttatccttgcagtcccaatcctaatcctcctttttcccccactcacaccctgttcctttagtttctgagtttatccttcctgatttcttttgctcaaatgaacagatacatgtgtattttcttatattcccttcttccttataagaaggggaacatactctagcctttcttttatgcttttcttttttaactcaacactgtcctggagatcagttcatagaaatcgtcctcactctttttttacagctacgtggtacaccattgtttggatgtaccacagtttatccaactctatcctgtatatgagctaataaaagttgcttccaatattttataattataatgtttcagtgagtaaccttgttcataggtgttttcatgaactttatgttcatgtgtattttactattattagaggtctatcttcagagaggagtacaagaaatgggattactgggtgcaaaggtaaatggatatgtgtctttgctaggtattgccaaatttatctccagaaatcttgcacaaatctgtactcctgttagcaatgtgtgcgtatacctgcttccacatgacctcagtaaaagaatgtgttgtcatattggtattgaaattttagcactgtaagcaacaggtcattttggaaaacctgagctttcgccaaattcagctattttgatttgcttttattattagcatataccaaaataaataggcatattagagtttcctttcttgcatcttaaaattcatctaacacatctataataacattcttttcttttttttccattctaggacttgcccctttcgtctatttgtcagacgaatgttacaatttactggcaataaagttttggatagaccttaatgaggacattattaagcctcatatgttaattgctgcaagcaacctccagtggcgaccagaatccaaatcaggccttcttactttatttgctggagatttttctgtgttttctgctagtccaaaagagggccactttcaagagacattcaacaaaatgaaaaatactgttgaggtaaggttacttttcagcatcaccacacattttggtatttttctattttgacagtccagtatcaaggaaatagcttttatacaaattggatagttgaggtagtatgtgaggtaaagtttaatcatatattaattgcccatgaacctcaggagatgggggaatggggaaatgacagcaactagaaagagaagaatgacttgaagggaaatgagttaggagaaattgtgagaaggatgttcagaaatgcagactttgtaagcaaactggaaattggttacaagaataatatgagttatctgtggtttgcagcagtcagcagtgtgattagttaataatatagagactacaggtttacatttaaactccatatctagtgttttatacagattatatttctttgacttgatttaatcccagataagagacactgatattattttccctagatcatgtatgcattttctgcttaaatctatatatacattatataatattagctggtgtttattgagtgtttactatgtgtcagaccttgttctaagcttctcatttaattctcccacaaccttatgaggtagggaactgtttttctattttatcagtgagaaacaggttaaatggcttgccttaggtcaaatgccaagttagtaaaactaggattcatacttaggccatcgaatgcagaacccagactaggaactgctatgcaatgctgcttcccagtaaaatttgagatttcatgagttggtaactagtgaagaatacacaaaaaataagcctcttaattctgtagtttaatatttgaaatgtgtgttattcagaatttatataaaaatatattttaaaagcattagagtagctgtataaagaaagctgtgttgacattttacctagagactctatgcataatgaataacactctgctatatctagtttctaaattaggggtgggagttgtattcattatttagttcccatacagcatatctactgtttacaccccacattttctttttttctttctttcttttttttttttttttttttttttttttagagacagagtcttgctttgtcacccccaggctggagtacaatagcacaatctcggatcactgcagtgtctgcctcctgggctcaagcgattctcgtgccttagcctcccaagtagctgggactacaggtgcgtgccaccacgcccagctaatttttgtatttttagtagagacatggtttcaccatgttgggcagtctggtctcgaactcttggcctcaagtgatctgcccaccttggcctccccaagtactgggtttacaggcatgagccaccgagcccgcattttctctgagacgtcttcaaaggcagtttactaatcctgctgaagagacaactgtcatttacacagcattttaaagttttacaaaatactgtcatgaattaggttaaaccatatgaaattgctgatatttgaccagttgtgatttctcaagcaacagtttcatgtagtttaacctataaatcatttcaattaattcttggaacagacgtgaggtaggtgaggcaattctttcttttctctaaccaaagaagtacctttatagatgtgagatgattcccagctattaagtagtaaatagagctaggacttgagccccaatcttccagcttcaatccagatcatatgacagcttgctgattaaactagatgacagagaagatctctttccttcagatacacatactttttctctgttcccctctccctatcagctagattcccctaaatcactgatactggttttgtaattttgcatcggcatgtttgacaattggtatcacatttagggtttttcattcttttttggtccaaacttttcatttctgcttttaaaggaaatacttttggaaacataaatatgtgggtttgcaatttataaagcagcttttccacttattttcttagaatattgacatactttgcaatgaagcagaaaacaagcttatgcatatactgcatgcaaatgatcccaagtggtccaccccaactaaagactgtacttcagggccgtacactgctcaaatcattcctggtacaggaaacaagcttctggtaagttaatgtaaactcaaggaatattataagaagtatatatggaggccatcgtatattctgttgtatacctagtaaacatggtaaaatgtaattaaacttaattagaaaatgtggttgttatgtggctcctgtaagtatagttatttagaaattttatttattgaagcaagatatgaaactctgggtgcacactttccaaacaggtgctttcatttacatgtgattgaaaagtgttttttgtcatttatttcactgttccatacaattagggttgtttctaagctgtttgtaagctgtttctaagctatttaagtggttaaatcacagtagatgcaaatcaagctaaagtctttaacattggctaatggctgattcttaaatagctaatacttgctaagggtatctatattaactcatttaatcctcataacaaccctatgagataaaacctaagtcctcacttaacattgtcaataggtttttggaaactgattttaagggaagtgatgtataacaaaaccatttttttttctcatcactgttctaacaaaatgatgttgaagatttaaatgacattgctcaaagacctgctatacattgtttgacttaaagtcacagtttccgagaacctatcaattatgttaagtgaggacttgactctattatcctgattttgtagatgaggagactgtggcatagagagaggttaagcaattgcctaataaggtcacaaagctagaaaagtaggtattagaacccagatagtgtgtgttctcaagatggctttaaaatatttatctttgtttaatctgttaataataaaaaacaaaagattaaagcataagtgacgtcccctacctccttttttatcttttactgtgattattcttcatcttccttccttttcatgtcattttatatgttcttatgtaaaattactttcatctagaataggaataatgtgaactgaaatcacctaacctattaggagttaggggagggagactgtgtgtaatatttgcgtgcttaaatattttcaatgaaaagttactttgatttagttttttatgttactacataattatgataggctacgttttcatttttttatcagatgtcttctcctaattgtgagatatattatcaaagtcctttatcactttgtatggccaaaaggaagtctgtttccacacctgtctcagcccagatgacttcaaagtcttgtaaaggggagaaagagattgatgaccaaaagaactgcaaaaagagaagagccttggatttcttgagtagactgcctttacctccacctgttagtcccatttgtacatttgtttctccggctgcacagaaggcatttcagccaccaaggagttgtggcaccaaatacgaaacacccataaagaaaaaagaactgaattctcctcagatgactccatttaaaaaattcaatgaaatttctcttttggaaagtaattcaatagctgacgaagaacttgcattgataaatacccaagctcttttgtctggttcaacaggagaaaaacaatttatatctgtcagtgaatccactaggactgctcccaccagttcagaagattatctcagactgaaacgacgttgtactacatctctgatcaaagaacaggagagttcccaggccagtacggaagaatgtgagaaaaataagcaggacacaattacaactaaaaaatatatctaagcatttgcaaaggcgacaataaattattgacgcttaacctttccagtttataagactggaatataatttcaaaccacacattagtacttatgttgcacaatgagaaaagaaattagtttcaaatttacctcagcgtttgtgtatcgggcaaaaatcgttttgcccgattccgtattggtatacttttgcttcagttgcatatcttaaaactaaatgtaatttattaactaatcaagaaaaacatctttggctgagctcggtggctcatgcctgtaatcccaacactttgagaagctgaggtgggaggagtgcttgaggccaggagttcaagaccagcctgggcaacatagggagacccccatctttacaaagaaaaaaaaaaggggaaaagaaaatcttttaaatctttggatttgatcactacaagtattattttacaagtgaaataaacataccattttcttttagattgtgtcattaaatggaatgaggtctcttagtacagttattttgatgcagataattccttttagtttagctactattttaggggattttttttagaggtaactcactatgaaatagttctccttaatgcaaatatgttggttctgctatagttccatcctgttcaaaagtcaggatgaatatgaagagtggtgtttccttttgagcaattcttcatccttaagtcagcatgattataagaaaaatagaaccctcagtgtaactctaattcctttttactattccagtgtgatctctgaaattaaattacttcaactaaaaattcaaatactttaaatcagaagatttcatagttaatttattttttttttcaacaaaatggtcatccaaactcaaacttgagaaaatatcttgctttcaaattggcactgatt

SEQ ID NO: 4 - DNA, 194783 bp, Homo Sapiens
tgtgtttttggaagtttattatatgaagatggtatacaaaatacattcatcatgactagaaatataggaccaaaccatgtctgtcttatatctgtagcatatattcttggtttgtataaaagtaactttaaaattccagtttccttaaatagttatgcacaaaacacacatacacccacacacacacacacacacacacacacacacacacatacagttacaccactgtcggccaaagatgcactcctcctttaatcaatttaaatgaggctagcgagtatctgtttgatgtttgcattcttgtgggctaggaaacaaggcacgggtccctaaaattaacatctcggtgtcacttcttggactgacaagacacagacttgcacatggtttcagccccattccacccagactgttccacgtacattatctcagaaactctgaaaggaagtgctcgttctttgttagtgccaaccatttttgtcataaatggcaaatgattggaatattatcagttaattcatgtttcaattttcagtgctattttaatgaacaagcactttgtaactagctcattattacaagtctccatttttctttctacattaagactccagatggaaccattctttgactgatggatggactcatgtatgctacaaacctgagtttgaaggagctgagtaacaattctaatggttttgcttttctcttgaaaaggagtatttattatggtctcttaatgattaagaattaattattgaaatcaagacatgaatagctaaggttttatttgttatcactatttgctgggctattatctgatttggaaaaaaaaaaaaaagtagagaattgactgaggtcttcttttttctgtgtttaacctccttccagttacctgatttataaaattgccagctgtcacaggtggtttgcgtatgtaaagaagaggaagaacaaagatttgtcctctcttctggctctagcctgcttttgtttggatttagatcttggtggagaggactgtcccactcctctcttctggctagtgagtcttccacaaaagccgctgccaggagccagtaggctcactagggaatgtgctgatgacggtcccatctcttcatacagagagcctttaaacaaggatgtggcacataagaacagaggcatacattcttcggttacttagagctcaggttctacagttaaattacatggataaaaggaagcatactcttctccccaagaagcagcaatccactgttgcctctccagcttctgactggctgcagaaggtgcagacatcataaatacatagaccctaacttgcataaatagcatcaaacagagccagcttagcgatccaaggcccacttgatctttagaccctgaagagtaggcgccctttcctaccctgtctccctattcccatcatgctcagaccccaggcaagtttcaaagcagttgaaaatgggcttttcttctagtgatggctcattaactaatatcctgagtcccaactggagaaataccttgcataaattacataccacctttttactcaaggagcttaaagtgcttaatatgcgccagctaatgctcttccacatcctttcagattagtgtgagatagtggaatccccattaaatgaaaaggaaacgtgactgacttcctgtgttttgggtcccaactgtgttggtgaattggtttggttggtatagagacggggttttcccttgaccttattgacctttttcctccatcagccctcgttttgatatggagaaaactcctctcctcaggactgcattttcattcttctcagctttctttcacaactaactgtgcaaaacagaataataccaagaaattgagttaagtgtctggactatatattaatacccaaaatagaatgtgacattttcagtgtaaggccatcatggcctggagacaacctaactctggctaagttttcagtgcatcttactagaggagccaaaagtatgggctcagagttgagtgccaccctcagtgctacaaatcaaaacatgccacgaatgagaatggacatagaaccacttccataggtaaagttctaaaatttgctttagttccaaaaaagatatttgtccttttcttgcctcccagaatccagaaaatgtcccctcatcgctgtccatctgctcctggctgggccctcaaatgtagaagggtcagagctgggaagccactgaaatggcattgctgagccccgtccccctccgtgcccacatggtgcgtctcaaattctttctcatgccttctcccggtttctcttttctcccttgctttttgctttttttccttttcctcctcacatgtcttaggcctgctagaggactcccgagatgttgctcaggccagccagtgatccctggggctaacgggcttgttgccctgggttttgggctgcagggctggcccagtggggtacgtgatgcattgggtgatcagtgcagctcctcaatcaaactggtcctgcgtgccctgaggtggcgggggttggagcagggaagtcattgggtttaggaaggatttctctaacactgagtaacatgaggatttagcagtagtgttcttcacttgtcactatttctctatctggagttacattcttgttagtcaaaaaaaaaaaagcactattaaaaaaatcacaaaaagcagctggctcccatggaaagataaaggtgtaaacttatatatgcataatactggcaaaagctagtttcctgggggtataaatacacatgtgcttctagaaataaggcttcgtgtcaaactctagatgggtggggtggagtacaggaccaccgagttgtagtctgggggcggggagcagcacgcgattttcctttccagctcagcgtggtcgtaggtgaacctgcgcttgccttcgctgacgtgcccacagctggaatggcagaaactgggcctgctgacatcagacagccccgactccttacttttactggttactctcaagctaaagaaagaaaggaaagaaatcaaatattcaaaattggttttttagaaaacaaagacactaaaatctactctttctgagtgggtcatttgttcatacctgtctagagttcatggttttggaaccccccccccctcaattgctgtcagatttcctctgttctaaagctgcacacggcctccctcttaacagcttggtgtcattgggcagaaagacagtggctgggggagggtatgaaatgtatgataagataacgcaaatccataatccaggtggaaagtaactccaagacttgggtgcagccctctcctattcttgggtcaaacagcttctgtggtaggctgagaaatgcctcctaccctccaaaatattcaaatttttcatattttatatcccttctggcctccagaactgcaagagaataaatttctcttgtaagttgccaagttagtggtaacttgttacaacagtctcaaaaaacaataaagctccacacacacaagtgagtgcctctctgcctgtcgtgcctgtgttctagaagaggaaacgttttagtcacggtgctgcttatcaccagcaaggctcaagggtggagaaacttgcttctgggtcctctgtgttacatccagactaggacagacacctgaggaagaagcgctgctcttgccctttaatattcgttcaaattttttattttcaaaggatctgggatgaggcagggaacccgtgaagcttgttttagaccggtctggactaacgtgtccatgttctatattttcagtctcagagtagaggatacaatttatggtcttctttaacaaatatctagataaaattagtcaccacccattttctgaagtgttccaaagtaggaaacaaaagagcaagtatcctaccttcccctttgatccattcattcctcattggtgcctctgatctactgtaactcaattctaataccactgtgctcatgtgaaaaggaaacacacacgcagatgtttgcctggaaatgcccctgtctttcccatttacttgtggccgatgagttgtgctaactacatcacttggaggcacttgttgccatcctttgatttagatcagggttcaaaaactataacccatatctgcccacctgtctggtgtttttttttttaatgagagctttatggagatataatttacatagtgcataattcgcctatttaaaatgtgtaagccaatggttttttgtatagacacaaattgtgcaaccatcaccataatcaactttagagcgttgtcatcatcccccaaaacgcacacctgttagcagtctttcttcctcacgccctccagccccagcccaaggaaactactggtctactttctgtctctagatttaccaattctgggcatttcatgtaaaaggaatcatgcaataggaaatattttatgactggcttcttttacttagcataatattttcaaggttcatccatattgtagcatgcatgcatacttcacactttttattgacaatattatattgtgtggatataccatactttattcattgagtcatcaactgatggatatttaggttgtttctacttttggctatcatgaataatgctgctatgaacatctgtgtgcaagttttgctgtggacatcagttttcatttctcttgagtatatgcctaggagttgaattgctgagtctcgggataactgtttaaccttatgggcaacagctaaactgttttccaaagtgactgccccattttacatttccaccagcagtgtatgagggttccaatttctccatatcctcgccacactgacttcatctagctatcctcatgggcgtaaagtggtatcttatggtaatttctttcccttttttctccctctgtcacccaggctagagtgtagtggtgcaattgtggctcactgcagcctcaacctcccaagctcaagtgatcctcccaccccagcctcccaagtagctgggactacaggcacatgccagcacaccccggctaatttctgtagttttagtagagaaagggttttgccatgttgctcccgggctcaagtgatccacccacctcagcctcccaaagtgttgagactactgcatgagccaccacacccagcccctcatggtagtcttgatttgtatttccctaatgactgatgatgttgagcatcttttcgtgtactcactggccatgcccacctgtttctgtaaatacagtgtgtgggaacagagccatgcctacttgatgatgtattgtctacggttgctttttatactataatgcaagcttgcccaacttgtggcccacgggctgcatgaatcccaggatggctttgagtgcagcccaacacaaactcgtaaactttcttaaaacattctgagatttttttgcaacttttttagcttaccagcgattgtcagtgtccgtgtatttcatgtgtgacccaagataattattcttccattgtggcccagggaagtcaaaagattggacacccctgctaatggcagtagggagcatttgctgactatctagccctttaaaaaaatggctgcctaccccggatttaggtgaaagaggaaaaggttctgccttcgggtgagacagggacaggcatttgaatgaggaaaggaaggaacatccgacaggtgcagcttttcccagtccagcaccattgcaaggtagagactcgcacagagaagctgcagtggcattcggtggtgcataaggcaaggactccccagtggtggccacggcgtggagggaggagctggtggactacaagccagggctttgtggagaaattgtcaagtgagaaaagggtgccaggatgaaatgggaaagtcattcatctgtaggggctgagctctcagggtacaggtcttagccccggaaaacagtactgtgtctcctcgtgtatgaaccctgccggcatagggagtgacagcgggggcatcctctcccaccgccgggagcgtgtctctgtctgcaccacgcataggtgggcacatcaggcttctttcacctgaggcactgtgctggccacatctggactgcctgtctttgcaagattttctgcatgttttccccagagcttgctgctcatatgtcccgtttgatgttcccctttttttgccctctggggggaaatggttttctgcaactcccggataccacagttcaggagggcaagtagtcctcaaacatccctcattataccaccttcccccagcatctcccctcgtacccctccatcaactgatcacagaaaagatacccaattcttactcaatcttgagcgaggccttgggtttgctgtcagtccaggtgaagcgcttcagcatgggagaggccaacagagtgctgctgtcgccctggtagtcctagggggagaaggagaaaggttatactcttgcctggcccagcgggggtccatgctgagcctgagggatgatcctgggatacatctgttgatccaggctctgcctcaccctccacaatcccagcctattgagacaaagcatttctctaagttggccactacaaacttgacccgctgcaaatcatgtctgatccccagtgactttgaggcccttcctgaacatgaagtaaatacatttaggcaaaaggggaaatggcaagtaacaggttagcattttccatagtaaactgtgatgcaatttattgcaacaaagatactaaaactaatttggcagatcacgattgactatgagtatgctatggtagtggtggccatcatagacacaaattctaagaaatcgtaaagacatcattcgattttttttcttgaactcaatggaattctcagcccccagcccttggtcatggtctccagcaattagacttccttgttggtttcttttggcagtgagttgcctgcagactcttcactactttgttaatacggcatgttccactaagtggatcccacgctttgttcctgccaccctttaaggctcttacagggcagtgttcctgtccttaattacgagtaaacacctaagcaaataaagaagctgtcatcattcaccactgatttagggtggggagggtgaaggttgagaattctttcacgttttgctcagtatttttcccttggccttgaaaaaaatgtgccaagcagtcaaacaagatatccatatacttcacctttatattcttcagcttatttttgatgcttaaaatatttaaaataatatttccctttatctggtgtgtctgacaaggttgtggtttttcgtttttgatttttttttttttaagggtgactgtgcttgcttcaaggccacactgattgtggtgatcaccttcacactgtcattggccttccaggccctttatgggacaaggtcattgccagcactccttttttttttgagacggagtccagctctgtcgcccaggctgctagagtgcagtggcgcgatctcggctcactgcaacctccgcctcccgggttcacgccattctcctgcctcagccttcctagtagctgggactacaggagcccaccaccacgcccagctaatttttttgtgtttttagtagagactgggtttcaccatgttagccaggatggtctcaatctcctgacctcgtgatccgcctgccttggcctcccaaagtgctgggattacaggcttgagccactgcgcccggcctcaccagcacttcttaaacattaatgtgtgcaggaatcccctagggatcttgccaaggtgcagcctgactcagtgggtgtgggcaggtcccgagagctggcatttctagccagttcctaggtcgtaggaacctgcctatctggagatcacagtgagtcccagagtctgcaacatcagaactgcagtatcgctcctgcccatgctcctctcctccccttagcccctcaaccccacatcacagggctttagagagaagagctgggagacctcttgtttgccaggctatactggttagcttctcccattgtgattgggtaggaacacagctgttcaatctgtagaacctcaggggaaaggagcataaggcttaggtggacccctcccagcctcaaggctgcttgcaggaacgcgctctctgttacatcacaaagcccatcacccacacagctgggagttcctctgttactctgaaagcaaagctgcatcactgacagctaagcagcttagaaacacacaatggagtttcctcagggtctaaattcctaccacgcagggacttgggtcctggagtgagtgcatggaactctactttcaaattagttctgcacagctaggtctagttgtcagtcctccccacactgtcatttcagccactcctgaatccagaccctcactgaccaagaactactacattactggcgttggtgtttggaagggatctgaagaaggggtctatcggggtgcactaggtaccttaacttcacgacttacatcaaacatggaggtggcattcggtaaaagttcttcaaaggttttgattctttccaggctcatgaacttgaaagcatttacgtatctaatgaagaaacagaaagaattatcaagacaggaaaaggcatccagctctaatgagtcaggagaccacaggcaccatatcccagctaagatgaaccaacacaccaacaggaatcacctaactcctgaggccccgatctccccgccgtgacccctgggaatcctgacagcattgccactgcctcccgtggttgtcaattcacattctgtagggttgaggaaactcccagagggacctactctggtccgttgtgaaatcagagaatgccagacataggagagactggaggcatcatctcgtctgagtgcccaatggcacaggagagaaatgatgtgcagggaagtggtatgactttatcaggtgctctgaaaaggatgtgaggtggcaaagtgacctggcatggctacacggctaaatattatttaatggcataatcgagtgctagcgccaggcttgtattttgtgtgtgtgtgtgattacagattgggagaattgggtagtgttgtatgatgtctctataactacctactgacttttgttgatgatgtattaggaaagactattggagacatccactctgtggttactcacaaggcaagttcacctactgactgaatttctcagtcccatactctgtcactctctgccagtcccagtgtcttgggcaagctccctactggcttaaggctaagcagccttagaagggtccacatataactttgccatgccacccaccccccctccctctctctaacccagccagaccttgccaatttatttaatccgaactagttttcccagctttacaaaatgatgacacatctgcttcagcctcttgggctggttgtgaggcctgaacagtgaggctgacctgtaatccatcaccacaagtctggatttgcccactgggtttctttgaggcctgtcacaggtgggtagcagtattttcttttttccttttttttttttttttttttttggagacagagccttgctctgtcacccaggctggagtgcagtggcacgatctcggctcactgaaacctccgcctccctggttcaagtgattctcccacctcagcctcctgagtagctgggactacaggtacgtgccaccacacccagctaatttttgtatttttagtagagatgggatttcaccatgttggccaggctggtcttgaactcctgacctcaggtgatccacccatctcggcctcccagagtgctgggattacaggcgtgagccactgtgcccggccgcaagcagtattttctgactgctgcagcttcttcccatatcttccctggtggctgaactgaggttagagccagagagctgtgcctactgcaaagagagatgctagaggcccatagtacagtctggaggccctaaaaggagtcctgactgcatcgggtacagggagggagggtcagaactcctgggttagaaaattattctgccactttctagccacacagtttcggcaagccttccttctgggagccttaaggtccccatttgtgtaacgggaatgatatgttcttcccaagactgctctgggcgtaagaggagttgatacatggaaaaagcctagcaccttgccagacccagcacttgtctgtgtaaccgtcatccctgcccaggtttcgtgcacgcctaactatcagtcctgaagtgcagtccccgggccagcagtggccacagtacatatttgttcccttgccttgccccttctccaattccctctgcagtaatacgggatagatgcgtttgttaggtcaaaacaaagcaaaacaaatgaaaacacagctcgctttgtttgtttagttttatctaaggtttcaccaaaaaattcaatgtaatggggaaaagaaaagatgggggaaggttctagaataagatagacaagaaacttaagaaaatgtaatctgttattcttaattggatcctgcttttaaaaaaaacatgtaaagacacttgggtggaattatggaaatctgactattagatggcattaaggaatttatttggtgcgataattttggtgtggtttacacaggagaatgtccttctttgagtgcagtcacataatcatagcccactgcagcctccatctcctgggctcaagtgatcctccaacctcagcctcctgagtagctgggactacaggtgcccaccaccacacccggctaatttttaaatttttagtaagatgaggtctctctatgttgccgaggcagattttgaactcctaggctcaagtgatcctcccacctcagtctcccaaagtgctgcgattacaggcacgagccactgtgcccagcaacaatagccttcttccaaaatgtatactaaagtatttaggagtaaagtgctattatgccttaagcctccttttaaatggtttggcaaaaagaaaaatccgtaacaaacacaatcatagagagtataatagacaaaatagggcaaaatgttaacagttgaatttaggggatgggcatatgggtggtgatcaacataatctttctttctttctttctctctttctttctttctctctttctttctctctttcgtctttctttctctttcgtctttctttccttcttttttttgttggaaaattctgtgatataaagtttgagaaagaaatcttacctgacatcatcagagcttcctgaattaaacttcggagctgaaatactttccttgaagaagtcctcagagaaggcaggagttgagtatgtaaacccactatttcctgtcagtatggcattgattgggatgtagtctttaccatcctaaaataccaaaggtagagctctcgttgcaccaattctgacttcaacaatttctatgaaccattatgtcaactttgactatgtcatttgcacaatcttggttgtgttttgagaagataattctgtatacacacacacacaccctttttttaaacttctgatctcagctattatattaatagctcttaaaaaaaaaacaaataaaatgcccccctgacgtacattcaaaggcattttgatgtaaataaatttagttttacctgttgtacatttgcttgaagcaaatcacctagtttttccacaagttctgcaaatcttggcctttcttttgggtctctgtgccagcagtccagcatgatctgatagctggtggggaaaacagcaacagaaatagttggagagcagtgatcatcctatgcattgccttacgtactacaaagggagggctgtcatcatccgcataaagcccaagctttctgtactatgtgaccctgcttcatttttaggtttgggtttatagcaccagcacttaaaaggctgtctgggccaggtcctgtggtcagtggaaaacacgtctaccaaggcagactaaccaacccaccagagctcatggatacccaggttctttgttgtgcctgtggcctctgcagatggaaggtctgagttctgtgaatgaaacacagcaattcggaaaggaaaccccaccgctcactgcagttcaatgtgaagtggagtactcctccccacacttacagaagtaggacgatgtccttaaagttaaaaaaaaaaaaagtcatacagccataaatatcaatggctgaatagtttgtagtacttatttcattctcgagttgtaacaaaggttggtttgagctggcttcttaaaaagcatgtggcatttccaagtcctcacacctccctttatgggctcagcagtggagactggtggggaaggtcctgcgtacatgactttgtcacttccagaaggtgaagcccacagtgtggagtttccggggctgtgagcaaggttcctgtgtgtagctgatcattctcccccagcactgcaaagccgctgttacaaactggcctcccaccactcaaggcacacagcacaggttgggctcctggataatgaaaacatttgtcttaatagcacagaggtcaaatcttgtcctgggattccaatgtcaacagactcctctgtgattcttctcttacattttatttttatttttatttttatttttatttttatttttattttgatgcagagtctcactctgtcatccaggctggagtgcagtgccatgatctcagcttactgcaacctccggctcccaggttcaagcgatcctcctgccttagcctcctgagtagctgggatcacaggcacccaccaccacacctggttaatttttgtatttttagtagagatggggttttatcatgttttccaggctggtctcgaactcctggcctcaattgattcaccagcctcggcctcccaaagttctgggattacaggcgtgagccactgcgcccggcctcttctttacattttagatgtaaaggtatcaggctcctctcttggtcatgtctgcacggaatcgaggtctgtacctaccgccctctctgaaaaacacaggccagaggtccatacacacactgcattaagaattgattcttcttgaaccttgtgctcttcaagggatgtttattatatgttaactcttctctcagaagatggtctggatgagaagggactctgacttacactcaaacctgaatgggctccgaatttggctctgggtgggaattgggctgtaagcactatgtgggctgggcctcatttccacacctctcgcctaccacagggcaataaatatctgctaaaagaagtcagactggtctccgggaagagataactctgctccttctgtgaattcttcagctgtactgcagacattacttgtgctgggagatggcggttgctggggaaaaaacctgagaaaccctagttcatatcctccctctgacacttcttagaggtatgcctttagggggcgccaatggctccagatatctcttaagtatatttctattttgtttcaaagtatatgaggtggctgccaaaggcagtaagaatacagggaggtaaaaaaaaaaaaaaaaaaaaagaagaatccgggtgtggtggctcacacctgtagtcccaatgctttgggaggccatggtgggacaatcgtttgaggtcaggagttcaagatcgtcctggacaacatagtgagactttatctccacaaaaaaatacaagaattagtcaagcatggtgatgcatgcctgtagtccctgtagtacaggaggctgaggcgggaggatcacttgagcctgggaggttgaggctgggctccaaagagaggccttcaggcagaggctctgggctcgtctcctcctgcaccatcgtctccccacaggatcaagctgctgtctgggagatgcaccatcctgagcaggacactccctagtttccctgctgacactcgtaaacggaaccatctacaaccacttgctgtttgttacttttgactcttggattccgatttctagtttccactcttcttgcctaaaatccaatgcaaatcatctcagcaaacatcaaatgaaaagaaaaaaaaaataaaaaaattcattgcttattcccttattgaaagacatctgattcaacagtatctgggccaggaaccaacaactcaatgttacaagattttgtaccactaagtaaatgggtttagtaaagttatgagacattagcttgcatccaagctggggatgaggggcccccagaaagttttctttccaagctatcacccaagttcccaaatacacaccgctttaggccaagttcagatcacagaatcccagttctgagaagctgcacttggtcctcacccagcccttcctactgttagaacaaacaagaaggaaattactccatcagctttcacatgctggagaaaatggctgaaggtttgaagtctggccttctgaggaaatatttcacagagcttcttactttttaaaatttctaaaatctctccctcctcagaattaaggaaccataccactctctctaggtcacctgaggcacgggagctacctgagcgaggtttatgtaaagacttgaaggtttgagaaagtccaaagcagtttttggtccaaagctgatgtgactttgtacctctgagttatttgcgaccacagcctgggtatgaatgggaaacacactctgcagcagtgtaggatggtgctgtggactctggactcaagctgaattcgcttattaccaacgcaggcttgagcaaatcacttacatgtgcggtgcctgttttctcatctgtgaaatggggatcatggtagtcctactttataggactgttatgagcattaaataaattaatgcttaaaatagtggcacttataagcaccaaataactatttaatcagtactattcaatactgttataataaaaactaatttcaggccaggcatggaggctcacgcctgtaatcccaacactttgggaggccaaggccagtggatcacttgagctcaggagttcgagaccagcctggccaacatggagaaaccccatctctacaaaaaaatataaaaattagccaggcgtggtggcacatgcctgtagtcccagcaactcagtaggctgaggaaaaagaatgacttgaactcaggaggtggaggttgcagtgagctgagatcacgccactgcactctagcctggacaacagagcgagacactatctcaaaaaaacaaacaaaaaaacccaactaaactaatttcatactatttagaatttatatggaagtaaaaataaaacttaatttcatactgttttgcatttattttgatgtaaaaatattgttatttaataataacaactattagtgtaattgagaactttctcgagattttcagactatatgaagattggaaggacatatttaattcaaagcatgagtggccatatcagagaagcatttctactgaggaacgtggggtctgttcctaattcatcagccgtggtctagggacatcagtccagaggcttgggttctaaatgtctcctttgcttctcagctgacagacggcacattgcttcagttctcggcatctcagtttcattacttgctaaattcagattacaatagctgccctgaccacccctcaaggtctctgggaacttcaaatgagactatgtgtgggaaaacacttagaaaatcataaagttaatcatctagctctatccccagctctcagaaacaggccttgcctcagctccctgtacttttctgatgaggacaccacgcaccagtgacaagaacaggtcccctcccgcttccctacgctcaggcagagctccccagccctgctgttgggcctgagtctcctgtccacctcgtccagttccccatcctgggtctgacctacccttaccccgagatgatgaaggaaagagacagtgactttgccctttggccaagcccacacttcctgcattccctctgattccttctgaaaggccagccagggcttctgacaggaccccattgtgtgggtggaatgggagggcccctgccagttcaggaaaggtggtgccgcctcagggaggcccaagtccttgtcagcagctccacaaaagtgcaagtgtcatcacattcctgctcaggcctcaaagtgcaaaacatccacaaagccccaggaaaaaaagtgtccaagacaggcaagcaagtgcaatttgcacagtggagaaagcctcacatggacacccgaaaagccatctgaccaggcagcttcagacagctgctgggcctattcctaaaaggttcttttttttttttttttttgagacataatctcactctgtcacccaggttggagtgcagtggcgtgatcttggctcactgcaatctccgcttcataggctcaagtgattctcatgcctcagcctcccaagtagctgccaccaggcccggctaacttttgtatttttagtagagacggggtttcaccatgtcggccaggctagtctcgaactcctgacctcaagtgatccgcccgcctctgcctcccaaagtgctgggattacacatgtgagccactgcgcccggcccctattcctcccaaaggattctaaagaagttgtattgcccacaaagccttctgtgaagcataatcatgacatcaggaagttccccttttcctctccaagacctgttctgcagaccacatcaaccccctcacgggtgttctgtgcagacacaggactggtcacaagaccaaggtctagccctccatccctggggctgctaggcctgtttggctcccactccgtgagtgaggccaaggtcttgcattcagttcctgggtggtctgtttgttttgcctggattcatacctagaaactgaatttctaacttcagttcccagctagagcccttgaaaagtcatgtcagtggtcaggacaggaaataggtagggatgggtcaagggccacgtgccccactgcaagaaaacactcccagcatatctgggcctgatgggctgaggggagcatctctaaaggaaagaagaaccttggcatcttccaagactgggactctaagaatccataaaacatcccctctcaggaatgccctggtgaaaagcgagctgtcagatggggagcagagggcaccaagggctcacatttcaggagtagagtactcaggagctctcatcctcatgccttccctcaggcgactgcaaaagtcctcatccatttgtactcctgggtatggagacccacctgcgggagacaatgtggaaaacacagggcctgttatggcttaagggtacaaaagaccaagaggggacaattcagtgtttctttcctccctttaaagctacgttttagtaataaattcccagggattacaacagatctcaacataccgtacaacacacagagaagctcagcaaatccttgctaaggacacccgcttggttgggtggtcacatggtgcggggcacctggtgctcacaggctattcctatggctacttctgcctgtgtggtcagaggaaggggtgtcgtctgaagggtccttgccttctccccacaagtaactaaagaagtcccatcattagagactcatcctttgggttagtgagcttttgttttttttgaagagacgggtctccctctgtcaccaggctggagtgtggtggcatgatcttagctcactgcagcctcgaactcctgggctcaagcaatcctcccacctcagcctcccgagcagctgggactccaggtgctcaccatcaccacacttggcttgggcttctttttaaaaagccaatagacttgggataggctacataggaatcattcacacttgagtgggaatgactttaattcactttcttgcaaccttcctatagtaccagggctctaggagttgtgacaggcctgagggaaggggggctttgcgctccagggctgggctgaatggagtggaatggggtgggggctgcccgtggccaggagtctgcagacctaagggcgccagagaggcctaggctttgccttctgccagctttactgcccaggattcccctgcaacctttccttttggggggattcttgccagggctgggggtggcaaggccttctaatgcactcttgctctagccctgcagcctcatctacctcagcatttgtttgtgtgcattttctagtgattactgctggtaggaagcagctgggaggcgtgcagtgctggcaccgtgtcatcgcaggaccactgcagccgccaagctgctttcaaagactggaagcaacaggtgcctgtcatcgaaagcaggggaatgattttcacacattacaggaaaccagggatgttactgggtgacttttatttgctgtgaaaggcaaatttttggcaaagcccaaaagactcttggcgagaacttgagttttagaggcctcagatcatcactgtgtgtctgcaagcagatgtgggctctgcacgcatctgtgtgctttgaacaggacttccagccacccatagtggatgttattgcaagcagaataaatacaaccagtgttgtttattgcttatcctgtataaaccagtgtccagagccatatcatgtgttcatatcagaggcactggaaaggtctcctgtttctaacaacaccttcctcgctggggcagctgagcttgttatggcctttcctaggaagaaattctgaggtggtgggagacgcggggagggaagcggtaagggcattagaggtgtgggtgttgaggaattggaaaaggacagaattgggcaaagtacagaaaaagtactttgcttcagactttatacccttgttcatgatcgtataaagcccttttacatgaccttgttctgaccttgttcatgatcatataaagcccttttacagtagagggcagacatgcgtacgccattactcatctgagagtctacatgggcccattacactttaagagttttttgttacagtaggttctaatctaaaggctgtctaaccaaaggacattcagcagaagatgcagacatttatttctgggctgtttgatttcttccttctcccaaatttacctaaggagaagatttcccacagcaatactccgtaagaccacacgtcgctcttggtgctgtagattttgtcaaagatagattcaggagccatccatttcagaggaagtcgagtctagaagagggcaagggggccttgagcagaagggcatgaaaacaaagcacattcaacccgagtgtccatggggtcacctcccagataacatacggcctataaatcatttccgagagcagctctggtttcctaacatagagaacaccatagtatgcagtgttacgctaaaagagggagctagagtgctatactgagtcccatgaaggcagtatatgttcagtaagcccctctgatgtgttcagcatgtccttatctgcatagctctgtgagaaatcctcccccacaaagaaagcctgcactccacagggacacactcagggcttggaaaaggaaaagagtgatctgaatttgaagatatcctgaaaactggtggtggtttccaaaaatttttccaaaggaggattttgaaagcattcctatgcaaaaagacaagatttccaaagtcactgaatagggagagtgtgcaaaagcatcagaaagaagagaagaaggaaagaagtcagtgttgaaagagaatatacagttagttttcaaacatgtagacaaatcttcctctctttcagatagcaggaatcccagtgagttaggcctcaccactttagatgatggggattgatgggaggtatgggataaaggagagacaaggagaaaggaagtgggaggggcagggaggctgactcagatacagacgaacagaaaggaggggaggactaacatgaaggttggtgccatctctccagaccagggccccaaggaaagtctgttttcctttatttttatttttttatttttacaaaggatcaatgtgaagtcatatgttttccttctatacaacagattctggtgcagtggctctcgaagtatggtcctgggacatgctgtgtcagcaccttctagaacaaacatgtccaattcctggcccgcgggccacatgtggcccaggacagctttgaatgcagcccgacacaaattcgtaaactttcttaaaacatgatgagatttgtttgcatttttttttttttttagctcatcagctattgttagtgttagtgtattttatgtgtggcccaagataattcttcttcttccaatgtggcccaggaaagccaaaagattggacacccctggtctagaaactggttagaaatgcaaattctcaggctccacccaagagttactgactcagaaactctggggggtggaaggcttgttaggccagcacactgtagcgtaacaagccttctaggtgatatgtatgttcaattaagctgggaaccactactgtaactcattggcgcccagacataagcttaaccctcagggtatataggctgagggttaaggagaagggaggacatgggaggtcatccacaaaagtgaaaaataacactatgtctaaaaacaagcagggaagagaagccagtacgagccagcggggagatgctaggcatggaaggccatgggaggtaaacagtctcctccatagtcagctactgctgacggtcttccccgccctttcctgagacagatacacctgctgaatcaatcatctgggtttatttgagggaaagagtccaggctgttcttttcagtggtacaaggaattccctcaggattcaaaggaaggtaatgctaaggtctcacccaggccccaccaaacacttctcaggttagcaagtctcacgcagcgctgcccaaaggacaggtgggaggccaggcattagggaagagcagaagcaggagacagtggcctttctgagccttacacaagggctctctgggatgccgctcatctggactgtttgtcttcacagaaagccaatgatggttttcagggactacagctgaggaagtgtaaatatttaccaagtctgtggtttaaaagtgataggacacacatgagtcaaataaacatcaaactgacttacatctccttttctcacataatcggggttcttataaatatcccgggcaaggccaaaatcacaaatcttcaccacgttgttctcagataaaagaatgtttctcgctgccaggtcccgatgaatgcactataataaaacagttgcataatcaatgcatttccttaacctaaccaactaatttcctacacctgtcagtgtcattatcttaatttgggaatccatttcacatgctgtgaagggagcacctctcggtgcacacagagttaccataaacatgaagagcctctctacaaatacaggtccccaagccctcaaagtcaagaaatggtctgaatccactgggctactatttgatcagcgaagctggttatctaagatttaccagtgggcaaactttccccacagtcttttatcctgagctgccaagatgagatctttctccagctgcagttttgtgggagggccctatatggctatattaatagtagctctcctatgaagtcatgtcttctgagatttgggccagatttgaaaatatgccagaggatactgtggagagccgatgccaggtttgtctagtctgaaacctgtgagttttccccagaattaagttctatccactggtatccatgactcctcattctcaaaactcctcatatcaaggcaaattaaggcacttgcagtggtgtttgttctacatttaagaacataggtatcagcaaatactaggaaaaatgaatttatagcaaaggtgtgtgtccagccctggcagagaagaaaaacagtaaacagcaagactgacctttctggaagacaggaactccatgcctctggccacttgaaaactgtaagaaatcagatcttccatagtgatgggctccttgtagaaaccgtcagaatctggaaagcattagaaccgtaactgtttgtaatggctcttgttatcccaccaaatcccagtttattggaacaatgttagcaaaacataaaacaaaccaacaagtagatcagagttcatttttaagagtatttgagtttcaacatgaacaccagagatttttccaggcctccagcccactttatccaagcatgggggcagggggatgatccattaagatgaaaatccctgaggggagaaaacggtacagttccctgtcaaaattagtaactctgtaaattatcttaattcaaatcttatctcctcaggacattaccattcgagtctcccacggatgtttattagagtgataaataagaaaaaaatttcagagatgcatagtatgttgtaaaaatatctcagcgcgtaggacaggaaggaattaatacctaccctcctcttcctcaacatcactcagacttttatcttcctgaaagccggagctcgcaaagctttcgctgctggtgacgctatctagtcttggtttcttgccttgttccaggcctggctccattttttctttcttaggctccatgtgtagtgctgcatcctttgaagagaccgaaaaggacccaggtgaaaaggagctccagcacagcagtgggaaaccagtccctcaactggcaatcgcctgatgagaaatgagagcgtttcacttctcaaaatggatcgtgaactagcacaggggccctacggtgtccaggagcctgactacctctggagttgcagagtctattgtgctcttgcctgggcttctagacagcatcttagatcagataaaaaaaaaaaattaagagtggtgggtatttactgaatgcttactctgtgtgagctggtatattaaaagctttaggtacatttcttgtttagtgtttccaacaattttacgaagtagttcttatttatacatggagaaacaggttcagagaagtaaagtaatcaaattcacatgcagctaataaatagcaaagctggccgggcacagtggctcacgcctgtaatcccagcactttgggaggccgagccaggtgaatcacgtgaggtcgggagtttgagatcagcctgaccaatatggagaaaccccgtctctactgaaaatacaaaattagccgggcatggtggtgcatgcctgtaatcccagctactcaggaggctgaggcaggagaattgcttgaacccaggaggtggaggttgcagtgagccgagatcacgccattgcactctagcctggccaacgagagcaaaactccatctcaaaaaaaaaaaaaaaagcaaagcttgaacccaggattggtcgatgcccacatctgtgcccttaaccacttttccatgccacacgccatcttgtgaaggatgacatcactgagaggaaaggatcctcagtgtgcttggtgcttcactctgtaatccctaggaggagttataagagaaggctatagttaccaatttctcaggtttctttggggaaggagggaacatggacattgctttttttctcttccatttaaacaaagatacagtttgatcctaacaagggtagcaatggcctttcaccctggactgcacatccaagccctggttcatttggctcttccattaatcatgcgatcttgggcaagtcaccttacttttctgagtttaattatcctcttctgaaaagctctattatactattattttatgattcataggaaaggagttgtcagttctgggtgttcatgggaaaccagaaaagatttttattgccttttgtaattcatctagtaactatgacactctaaaacctagcactttcagtggctttataacaagaccatgtttgtagcctagattctgctagacagcaatactgaggcagaagcagagagggactggagttcagtggtgtcccttgatccatttgcatggtgtggcagttctaggattaacccgcgtaccccatccttcctgggcttttctagaaatgtcacaaagcaagagtgatccctccactagagggcacagtgggagcaagcagagcactgggagaaagcttcaggagggacagccctaacctagtctaaaagccaaaagggcaccaaggttcccagcccctgaaaagagaccttccggggttgcagagggaggcaggcctcagagtgaatacccactgccattgcaggtaacccacctgagggcaggtaaagactttcactatttgttattgtgtttccacaatgcagttatattggattctgttcagttggggactggaattttatttttcacaagatcctttgtgggacagaaggcatcagagaaagcgctggcaatagcatggggagaaaaatgctccacaggctcactcagggctctgcatgtgaaaactctccctggacagccttcttccccacggcacccaaaagtcacagcctaggcatgtctccaaggaccaaaactcaggctctctcactcccttcctgactcccaatcaattgtatattcagctttgcttatcagtaccacttttgttaaataaaggtaatttactgaactcttgggactctggcagaatatagtgaatttattacaaaccatatttaaggatcccagttaatttatttggaaaatgaagtattccattttcaatttagccttttggttttgcctttcctttacctttatcttccaaatatgaaagacagccatggattttccacaaaaacactaagctccaccaagttgcacagggaggcaaatcattaaatatagccagagaaggaagcaaactcttcaaaacaaaggacgcacaaacccaaacgttccatcctgcccaggtccctagggtattctgctggcttagctcttcctgaagccagtccaaaatttcagtactaaggggaatttgtactgccctcagcccaaggcaccactttccactttttcttatgcttttttcacctcatttagtgtggtgcacagaaaaggcagtggaggaggagtcaagagagctgagttctttcaccttctgacttcacctcatggtaggtgtgtgtccttaagcgaatcacttgacttctctgaacgcatctgcagcctgcgagtgtgaaccaactgatcacaaagatccctttcagtttcaagattctaattattaggccgggcacggtggctcacacctgtaatcccagcactttgtgaggccgaggcaggcggatcacctgaggtcaggagtttgaccagcctggccaacatggtgaaactccgtctctaccaaaatattcaaaaattagctgggcgttgtggcgggctcctgtaatcccagctacttgggagggtagaggcaggaggatcacttgaacccaggaaacggaggttgcagtgagctgagatcacaccactgcactccagcctgactgacagagagagaaactctgtctcaaaaaaaaaaaaaaaaaaaaaaggttcttattattagaggacctgacttaaacctggggaaaatgatgttcttgcatatattgccggtccggtagaacatctctgtctttaattagatcaaagtttgagggatgagaaaattggccagctgtccagtggttcttatttgtgtgtgaagattcttgcccacattataaagatgggcatcattcttggatttcagacattttatccaccatgtagatcagtggtacgaagttggactcacccaatttttctatcttagtaggtcaatgatgttgatgatgatgatgacagtggtggtgacagtgatgattaacatttattgaatgtttgactgagagatttttattctctcaacaatcccatcagctggattctattataagcttcatttaataaacgagggaactgaaacagacaggttgagtaatttgcattcccagatttcatgagaagtagagacaggatttgaatccaggaagtctgattccagagtctcaatgtttaaccaccacactacatgggttcatcaccagtgttgctgattactggttaataatgttgaatcactgtcccctggacttcttcagctcagagaaggacacagtattggtgccatatgtcacactggcaaagttttagtaaattatttctcctccattcaataatctctctctctctttttttttttttttttttttttgagacggagtctcactctgttgcccaggctggagtgtagtggcttgatctcggctcactgcaacctcagcctcccaggctcaagcgattctcctgcctcagcctccctagtagctgggattacaggcgcgggccaccacgcctggctaatttttgtatttttagtagagacgggttttcaccatgctggccaggctggtttcgaactcctgacctcacaagatccacctgcctcagcccccaaagttctgggattacaggcgtaagccaccgtgcctggcccaataatctcttttaaaccttgtttgcccttaggtcttgggtccacatgttccttttactacacagcttttatttaataaggctggttcagagtatatgtagggatgacatgggtagtgagggtgtcaggaagtaggggaaagggcagtggaaaagaaagataatgatttttggccctggccacatcattggtctactgctgattgtcaagtcactcagttgatttagccttagtcaaaatctaacctaataaatggagacaattatattaactattatcttccttaaagaaataagtgacttgtgtatgtatgtttgcgtgtatgtacacatgcacacatatatagggggagaaagagagaaagttattgttagatatttagataagtggctagtagatttactctccaattatggctgcatacgcacacagggatcaaatgattctctgtgctatccacactagagtgtaacagattatcaggggaaaaaacatgaaaaaaggagaagaagcagagattgagttttaagtttaatcattaacaacacaatacaggtttctcttgctttatgttgttacagactaaatgaaaactcattgctatctttaaaaacctccaacttttgaaatccttaccttgttgagaaaaaataagtcacgtttgctcttgaggtagttggagagatttccatatttgcagtattcaacaatcaccatcagaggccctgcagccaaaacagcacatgctcatgctcagccacaccaagccagtcagccatttgccagccttcagcctgcctgagaaacctcaaaccaaccagcctttgtattagtggggcgaagggatgcgatttagggatgagaggcccatgaatacggtgactttttcagtttaacctaagaaggggtttaaagaatacaattgaaatacaaaaaaaaaaaaaaaaaaaaggaggtgaggggcagtgcagaagcattagagagaaaagattggaagaaggacagaaatacgtttgaggaggggagaggcaaaagccagcctccctgcctcttaaccagacccttgcgagtagagcggcttctggttactgtcacaccagtcctggaactattaagcagctcctccctccctaccacgacagagacggctacctggccgtctctcgccagcagtgtctgcgcgatttgccttggggcttgccagaggatctacagtaggaatcggcaaactcttcttgtaaaggtccagctagtaagcattttaggctttgcagatcaaggagctactactcaattctgcctttgtagcctggaaacaaccaaacaagtatgactgtgctccaagaaaactatgaacacagagattggaatttcatacaatttcatatcatgaaatattatttttattttttattttttcccccaactttaaaaaggtcaaaccattttaagctcacaggctgaccttggtttgccaacccgaccccggtctgaaggaagcaagagggttgggaaggaagtccagctgcactctgaaggcctcctctctcctgccctgcgtttccactgcatgcctgggctgggcatgcagcccacaaagcaaggaccacttctgggtcaaaggggagtgaccccggagctgcttcaccagccgctgcccagggcatgccgggagcccagaagccactagttcttttttgtgccttgcagaagttgggctggtcctggtggagtggttttctcttagtacgaggaacacgctagaaatcctaacagcatctcatcttccccctaggttccagaacgggaagttgcttccagagttttttatgtcccctctacggcggcagatgccgcagagttcggctcccgcatggggtccagccaccgtcctcagaggggcttccatgctggcgcccagctgcacggagctgacggccgcacatgagggtaagctgtctcattatacctgatcagttttacagatgcaaagttgaggcaaacagaatgaggttgccacgacagagaacttcataaaacgttatccggggatgatggagaagcaggcggggccgtgtcgaggtccctccgactgtttctggcctccccagcctttagctcctctctaaccacctccgcccctagcagattgtcttccccagctacccttcatctctgctacctctgttgagagctggggaaaacattggcttgcacagctctttgcaccttgctggctcaaacaatgatcacacatctactctgccctaaccctgccatacggaaagaaaggtctgcgacaacatgctggagctcttaatcataaagcacagctctgtccctacccccttgggtaaggtctatctgcatggtggatctggagggaagggcccccacatcacctcctcctgggaccctaccagtagtgattcattcattcctttaggtgaagcctcaaggaatatgcaaccttctaccttttaccttggctctggccacactccttcagacccatcctgagagaaaagtgccctctgcttagcctagagcctgtggaaggagatcaaaaagggagtcctcttcagaatctttaaattaacggcacagggaagggatttatgggagcacccttctgtagatgcacaagctgtttcttctagagctattagggaggccgttttcctggaggcgaggaagcacagtgcgggggagaaggagctgtaaggcagagaactgttctcccagcctgtgcagggggagacggagccggccctccccttctccattacctccttgcttggtgcaggctcccagcaggttaaccacgttcagatggtggccaatgtgggtcaagatttttagctcagtcatcagagctttgtactcgctggccgtggccccctctgtgtgagaagcaaggaagagtcagggcgacaggacaatggggctccttccgccggaggcggcattcttgccctccttgtttgtcaatgctcagccggttgcttcactaacttccccacattctgcagaaaggccaagtctccagactgttttcattactcccaccctcctgagccaacatccttttgattacagtaaggcccagcacagtagtggggttagtcactggacatttcctcttggtggacctagttctcttcagcaatgcgctgactcagagctgggcacctcgtgaaagtgccttccaaaggcttcccttctgtcagaaccaggtgcagcaagaacccaccaggcagggagtacacctccacgtcccctcttctcaccttctccctttggggagtcacagagaaggagcacaaggggcctgccagggcagaatggctactgttgtaaacatctttgcaatgtgttattttctccctgtaaccctgtcctctctggagttcacagggttatcttgggttgtgaggatccatagcatctgacttcaacttcagtctcagagataagcattatcagtccaagaattagcagagtctaaagcctaaattgagtttgttctgtttgttcttattagttaatatgcaaggcatttaaaaattttaaattatttttagaaatataaaaatcaaataatctttctgtaaaatatttcaacaatatgagttggaataaaatgttctagataaaaagcaaaagccactccgacccacttgccttcttagaagcagccatggttaatagtttggtgttcagacctttttctatgcatttataaatattcaatcagaggtcctatatatatatatatatatcatatatatatgatatatatgactatatatagtctatttaaaaaatctatttccccccttttaataaatcagagactttttctcttctttttatttctttttattttttatttttattttttttgagacagagtctccctctgtcgcccaggctggcgtgcattggtgcgatctcggctccctgcaacctccacctcctgggttcaagcgattctcatgcctcagcctcccgagtagctgggattacaggtgtgtgccacaatgcttggctaatttttgtatttttagtagagacagggtttcaccatgctcctgacttgaggtgatccacctgccttggcctcccaaactgctgggattacaggcgtgagccaccacacccagcaggttaaccacgttaatggtggccagtgtgagcccattctttttaattgattaatggtgtccctgacatttagagtgtctatagtctttttgctattacaaataatactgtgatagtctgtgtgtaatctctgtgcacacatgcaagtgtttctgtaggacagtgtcctggaagtgggttagaggtatgtgcatttaacattgtggtagataccaacatggtatttcataagcacaaatcatttttaataataactagataaactccaaatcctgtgcatggggttagggctggctcacagtagatgctcaacaaatattttggaataaataaacacaattactcttctcatttcaggcatgggtgtaaggcccaaaaagattaatatttttgctcaaggacactttgaaagagcttttgacttatggcctttgtttcactttatgcttttgttttgagacggagtctcgctctgtcacccaggctggagtgcagtggcgtgatcttagcttactgcaacctccaactcctgggttcaagcgattctcctgcctcagcctctcaagtagctgggactacaggtgcccaccaccacgcccggctaatttttgtattttttattagagatgggattttgccatattggccaggccggtctcgaacgcctgacctcatgatctgccggcctcggcctcccaaagtgctggattacaggcatgagccatcacgccgggccatgccttttttctatctcccagaatcagatggccaattaatttaagcaagaaagctgaatgaaattttttaaaggaattttatagagtggatgatttggcagtcttttacaatcaatgctgatggctaaaaaaaaaaaataggcatttatgaagacactacacatgcaatctgtattacatagaagagattctctgagccttttaaaaaaatctcagctgggtgcagtggctcacgcctgtaatcccagcactttgggaggctgagacaggaggattgcttgagcccaggagtttgagaccagcctgggcaagatggcgatactgtctctacaaaaaaaaattttttgaattagctaggtgtgatggtgtgagcctctagtcccagctatttgagaggctgaggtggaaggactgcttgagcctgagaggcagaggctgcagtgaactatgatcatgctactgcactccagcctgggcgacagagtaaaaccctgtctcttagaagaaaaaaaaatctcaagtcagaatcttctttcaaactcattcatctccctataaccctttcctctttggaggaaaaaaaccaggtgctggttcagcttgctgtatttataggcagggccacaggtattatcttggacccacaacagactagtgtggatatcagagctgcctctcctagaggacaatgtgtggcagcaagcagagaaacgggactagctgaggaaacagttgcttccagatttagtttccacctatctctaggttggatactggattgcctccataaactaggccaggatcatcttcagggttttggagcagtgtgccaattccaggaggccaggtctctgcagcccctcttttgtggcacactggtatggaggaaagagcactgcattcaaagctggaagactttcgcacacaaacccttacttacgctgagcagctgtgtggccttgcagaggctatttaacctttcttggccatgtttcctcatctgcaaactgaggataataatgtctacctcacaaagctgttgagaggaaataagaaaaatggctgttttgtgtggttcagcctaataagtgaaagtatctagtctggtgctttcttacatagaagacatgttgatgcctcttctcttcagaatctggggttcttgcagggagggtgctagcatgcctctattttgacagaaatacctgccttcgtctgggaagtctaccccaaacaaaagttctgacttgtggataccaaactccttcccagactactttcagagcagaattggcaggttctttgcagagttttattagttttttcttgaggagtaaaccttttgaagttgaaaatatatttacatggggcttttgaaataatggagttattgctagaagattaagaactttgacgtctccctaagcaaacaaccctttctcctggagcctgtactaggtacccgtgtagttggactcacagcttgctgggcttcaaaatttcccagcagtatcctggagactttggaaagttaaaagctgctttttgagttttcagttctgttgagttgaagcatcataaaattccattacagatgaggaaatgaagtattttctacactgtaaaggacctgtgagtctttgagacatgtggtttacacagctttcactgattttcattttcaatctgtctttggtgttgggcataagtcactgtgtgatttggttctacctcccagtgcttcacagagtagtagtatctttcaacactagaaagataattcaggtttttaaactgctaaagaggaaatgttttatggctgaggtagttagtataaaatagtttagagttctgatcaactcaattgttctagctttatagttttactttatagtcaggtcaagcccaagcaaagccattgggatttagaatgtgctgctaagtttccattacaacatcacagtagatcatgccaaaatctgaacctgcagttacaatgggcttaagtcccttgttgtctacagtctgtgatgtgagatgagaaagacctttgaggtgacagagatcattttcctatggacagtgctggattgttccatttacaaggtttcttctgagctcgtgctggcctaatctaaaactcgtgagcaaagaggcctctagcagtagaagaaaattatgtgtccagagcagaaaagcttgtgtctgttcccaggctatatctaacttgtaccaacatttaggaaatgcaaaatggtgatgggtcagttgaaagccaaactacagcatacatacctttcagcattttcacagccacagtccggcacgtaggtgatttcttaatgccaaatgctgatgcttgaaccacttttccaaaagcccctcttccaagtgatttgcctgtaatgaagagaagacactggtttgtttgccgaggcaatagggtgagtttaagtctttttcaggaaggaaatgccttttcctatgtgtgcatgtgaggcatggaatctccagtgaactaaccctaaaagagacaaagtaagggacttatttctggagtctcttcctttcaactcttaactctgttcctgaggccccacatccttcaaagatagagtaagtccctagaaggcattcagtgaaggtagatgtccagtttcctttccacagcgttctcccgtaggagagatgggaccaagtcccgtgtagtttcttccattgtttaataacattatgaccaagaagacttccctgtgtggaacctaagctctttttctttttccatttacagtcatttttctctcatctgttttcagcaaaaagggagaaatagaaaatggtggttactactgtggattataataatgctcataactttaaaataatcactaagtcatttatccgacttccctaccaggcaaaatatttccagtctttctaatgtgtcttaggtgaagattacaaatcctcgtggttcagcacaggagcctggtcaaccactggtagtgatttgtttcaaccccagagaggtagttgctaaatgcaataactaagcaaggttcctttcatggtccccataatgctatgctataatgactgttaatatgtttctttccctatcctagaatgacccagggagtccttgcccccctttactctggggggcaaggaccatgtctgaatcttcccagaacctaacttggtgcctggtgctatctgttattactgaatattgctgcagaatggagagtggtgttcaggaatgtgtgggttgcccaaagcaagtctcctagtcataggtaactagaggggcccatgggatggagaccctgagattgatgccctttagggagggcactccctggagtacctaagctgccttttatatcagggaacctccttttgcacatcaggaaacagctcaatagaacccagagaaatggtgcacctccagcatgatatacccaaagaagagtaagtgaagtaagtcagtctttttttggcttttcttgggggaaggggaaatgacagaataccactggttggttaaaactattataaatcctggcagttagagtgttaatttaacacaacccctcctttcccaaccaagtgctctttcttagacccgtctgataatgtgccttcagttaatgaaccttctttcctcccttccttcctcattactccactccctttccccaaagggcatttttaaaaaattttcttgtagtttgtaatgaagctttgcttcttcctcatcatattagaacctttctacttttatgcccaactactcagtgacaaaaatgtctttaccttgctctgcttaatgtcttctactacccaccaccccaggtgtccagttaggatgtatgaaaatttcacttataccagtgtcatcattagggcctctgtgtggctgtctgcagggacatgctctgcattcagagagaacactggggagacgacacgtttctctttttgtgaaacatgctcccgtagtgattactaaatgacattcctcccagagcatgcaacacgggcagagctacagcctctgcttccttcttcgcataaaattgttgaagaaatagaccaggatggggaccctcgatttgaaataaaagagcctccagtggatcctgaaagtgctacatctgaaaatccggtgtgggaacagcgctggcagatgccttctctatactagtaaaaactggtgcattttggttggaggtttattccttgctttatttgggataaagtatcaatgtttttcttccacaatgccttccaccatctaaaaagaaaagtgtcctgagcctgagaaatatccagatcttttctccttacacacctaagacccttgcatgtttggggcaggtggcatcctttgcactttccatagtttcagcccccacatcccgtcttagccgtcacaacacactttgttttaacaagtgtttgggactttgcttcttatcattgagaataaactggctctcatttggcttccctcagccttttcatttattctcttggaagctgactgctgcctcataaaacagcatgaagctgttatgggctccttaatcatctgatgtgttggaatccttctgcagacccatggttccagtttcaggggagcccagttgcatcagacttgacctcacctgatctttcttttcccttaaaattctcctcagtgtttcctggaatgccactaactagctcggaagtgtgctaggtcattgccatacaatgcaaggatattggaatctcctccaagaatgtcctggactggccaggggccctggacacgctggggagagtgcatggcagcatgggttgggccgtctctggcattcagggctggtcttacaagaggcagcaccagcccaggcaccattcacttgccaaactcctgactccctgtattgtttgctgtattaggtaattctgacttttgattatttttcaatagaaagatgcagtgttgaacattattctaacttttttttttttttttttttttggagacggagtctcactctgttgcccaggccggagtgccgtggcgtgatcttggctcacggcaacctccacctcctgggttcaaatgattctcctggctcagcctcctgagtagctgggactacaggcacgcgccactacagctggctcatttttgtatttttagtagagacagggtttcgccatgttggccaggctggtctcgaactcctgacctcaggtgacccacccacctcagcctcccaaagcactgagattacaagcgtgagccaccacacccagcctattctaacttctataataaatatataggagctgaattatctcctaacttctgtgataaatttatagaagctgaattccctcccatgggttagtgaggaatcttttttttttttttaagattctttttgttcttggatttcaggaattttaatggtagcaacacctttgacccaacctccaactgcatccatctatcaggtactataaattccaatcccactcactagggctgctgatagtaaccaacaagtagatacagctgaaaccagatataaccttgtgtatttctctacatttacaaccccagtataactgccagttaaaacagccttttctctctatctggacataatctgggttattttcagttgctagacattacttcaaattactttgtcatttatttggcttaagaaataaacaagtcttgggcctccttgctcccacgttaatcaatcagaggagtgtacctcggggccttgcagccacactctgtattgaaagacaaagttagcagacttgacacactttctctcacccatcagagacactcaaatggacatcagccaaattctagcatgtggcaactctggaaaggaaaagagtgataagaatgatcttcaacaaggagactctcctgaaatgggattatttaaacccacagagccccaggggaattctggtagaaggattagcaatctgtgatgtggtgtggatcacaatgatactaggaaggaatgaagcgatgggacagaaagctcatgtgtcctatactggaagaagcatgtttgattatgactaataactctggaaagcaatgtgagctgagaatggctcgtgattgtgggaaaattatcccatatttcctgccaaggtcactgaggggttgggctagctgccatataatttagacttgcagaaggaactcttccagtgtgccacctgcccttaactactctaaatgtagttgattttttcctcctgtccacagccattgctggctttctcctgtctctccagcttttaactgatttccaagtttcctccccaagccaaatagaacatgctcctgaggccagtccttcctcagtgtaagcagaatcatttcaaggcccaagagaaaaacaaaagccattttcctctctctgccccctaaatccctcaccccagtatcatttgcatgtaaggagagggacgatactgttgaatttggaacaacaggctctccacaccgagagggacaagctccaagaacactggatccacaatctgttttcttagttccaactactaatgactctggcatacacaggagtgagtggaaaactttcagaagccacaatccaaacattttgggtaggagtaattgaggttccaattgttttgtagcaccagaggctggagattaatgggctttgtgacgtctgagctggaggaactggaaggtaggctgcgggaaagcacatttgcctgctgtttatagcatctgccctacctggaaaacaacagtctttgcttttcaaaagtgaaacttaaatgattcccctagggctttctactcggtctggacattcccaggaaaatcaaagtatgtaatttgtggatttgtgcagagggtttttttgatccatggccttgaagagcaccaactctttcaccgaatgtttgatttcactgttccttgccaccctcaattatgttctggatcacatatttctaatccctcaacagtttcattatgtaagcgtgcgtgtacttgtaatgcctctctctccgccgcccttcacttaccacttttgcacctatctccagactgagccctttgagggaagagatgcaagcacctttgtgtctccagggcttagaccagtgtctgctgctcagagaaggtgcctaataactgttgcaagaacaaacaggtgctgcgtgtcaccttgtactgttatctgagcattgcattggaattatttacttttgtgtccatctcccttgctagtctgtgagcagctggagggtagaatcccaggtctagtttactttcgcatctctcaaagcacagtgtttttcatgtaatatgtgctcagtataggtttatgaatctgttgaacaaatatcttacccagtttaagtctctcccgggcaaactcccacttgctggcatcataagggagccgctcacactgctcatccaaaggaacttcatctgggtccattataattgataggtagtcagtctttatttcagaagaagactgagaaataaagagatctcaaagtcatcgagaagaaaacaactttacaaatcctagatattccgttaacatccactgttttatttgggatcatttggttgaaactgtgtggccaggtgcagaaagtacttctccacattcacatacactcatcacacttaggtgtgcaatttctattaaacgactccttactattcccacactacatttctgtaatgtgagctctaccatcctatcttggataacatgcactcaaattctccagtgaccttatgtgttgtacttgatcttaaacaattatatgatggtcttgctaaaaaatgcaaagcatttttataaagtcattccaaacaatgactaaaaataacttcccatggccatcttgtataagcaggaatatatattacatatgggccaacagtggggcgcactgtggcttttctacatatataggaaaagcaagaagtggcaaagtaaacccaggatccctggggcactgaaaagcacatttcttatgaagtgtttaaactttcagaaggcctgacctcttagttgcttcagctatctggaaaggttgtagctgaatcctgagtgagactggaataaggtttaccttctgtaagaaatggaagttgaggctgtctatgtggtggcctgtaatcccagcactttaaaaggctgaggtgggtggatcacctgaggttaggagttcaagaccaggctggccaacatgatgaatccctgactctactaaaaatacaaaaattagctaggtgtggtggtacacacctgtagtcccagctacttgggaggctgaggcaggagagctgcttgaacccaggaggtggaggttgcagtgagccaagatggcaccactgcactccagcctgggcgacagagcgagactctgtcttaaaaaaaaaaaaaaaagattatttcaaaggccaaggagtaaatatggcataagacttatacacaagccacattctgacttcatttgtccattggtaggatgtcaagtgagtaaggcagacatctgccttgaagtgcttttttatcttggtaatgcaaatcaagcccagaaaatacccttcatttcagatcatagataagtggatttacatttaatgtcttagattcatatcagtgggtgtatttcctgttaatgggcaaatttctagaattgatgactgcatgtctgtgggcagactcttggataggatggaaaggaagcatgttttcccatataactcttggccagaagttatgtaaacttcatttaaatgagttttggggcccttccttttggtgcttttccctaaacgggatcagagttggaatggagaagacaacttctccatacacaccatttgacacccactcgcattcttcagcccttactcactctgttctgggctgtcacagctcacctcatccatcacttgaaatcattctccttctcacaaaaattatcactaaaatgtgtgacaaatagctcaaggcagaaaggtttgcttggcctccataaaggatgagaagcaaaaaacgatatggagcacgtttgtcacaaactgtggttgccattgggttagactatgagggcccggcctgccagacactctgtgaagagtatgaattcctataacagggtactaggtgcccattagagaaactgctgtagtagtaggttttatgactaaacttttcaatgtcctgtatacccgagccctgagaaacaatctccaatcctcacagagcataggatagctgaaacctcgcaagggacatcttgggctcatgcaggatgtgtggggaggctggcagtagtgttgacagaggcaggggaataggcggtggtaggcagtctcccacgtggcacctatggaattttatggtttgtctcaataaggcaggtgagaggagacaccaaacaaaccttaagtgagggctttgaggagactgtgatagtaaaatgttagttggcaaatatttattctttcaattgacattaacactgagcagctactaggtgcttggcatggagtctgcacagctaagtgcttcaaagcccaggcatgggggctgaatacctgggtttgaatcacaggtcaacttctgctcacccacacacataactgtggacaaactgccctctaaccttagttttcttatctgtaataatggtacttatctcatagggttgttgtgaatatcaaatgaaataatccatggaaagctattaagagcagagtctggtatgtagtaagcctccataaatgttggctataattataacaataaatgttagctatagttatgcagggtgaggataaaatataaaatgccatctttatcaatgaggaatttacattgtcgttagaggaaccacatggaaatattttgggatgtcttgttcctctttgcctcccccaatccctttcaaattttacaggcattctgtttttgagataatgatctcttgctctcattctttcttattaacatcaaaatttcacagaattttagaaatagaaggcacctcttcaatctagtcccaatgtacctttccagttttatttttgttattttttatattttttagatggagtctcactcttgtcgcctaggctggagtgcagcgatatgatctcagctcactgcaacctctgcctcccgggttcatgcgattctcctgcttcagcttcccgagtagctaggatcataggcgcctgccaccatgcccagctaatttttgtattcttagtagagacagggtttcaccatgttggccaggctggtctcaaactcctgacttcaaatgatctgcccgcctcggcctcccaaagttctgggattacaggcatgagccaccgtgcccggcccctttccagttttatttctactgtgctcctctatgctaagtaaccagactacttccccgctctggggagtaggaaggactagggcgggctgtttttctgcttctttccttccagctacagccttcaaagtctgtctcaagccttgctttctcggaagttttttctccccttctcctcctttgaactcctatagcctttgtacctcccttgcagatttggcaagttttgcttctgttagatgtatttccctatatggtgtatctcccctttcaaaactattgtgtgacctttgtttccttctcaagcagtggacttagttgtcatgtctcaaaatcagtcactccaaatggcaaaagcctgatgttaaacatttaccatagaggatggctgctggccttgtctctcataccagcactataaagtatatcttattggttgttaatatcaaatctaaggtcaaatagcctgggttcaaaactaaggtccaaccatagtgactttggatcagttaactttgtcttgctgagcctcagttgccctctctataaaatgggaataataatatatttaccttttcatatttttggaataatttattgacatactacataaagagcttcccataagacctggcatattaataagggctaatctctagaaattgagaaggccttctgatacttctcaagtcctactgattttacttcccaaatatccttgactctaatcatttagccagaggtaccataatttctttctttctttctctctctctctctctctctctttctttctttctttttctttcttttttgagacagagtctcactgtgtcacccaggctagaatgcagtggcatgatctcaactcactgcaacttctgcctcccgggttcaagtgattctcctgcttcagcctccctagtagctagctgaaactacaggcaagtgccatcacacccggcttatttttgtatttttagtagagacggggtttcaccatgttggccaggctggtcttgaactcctgacctcaggtgatccacccacctcagcctcccaaagtgttgggattacaggcgtgagccactgcgcccggctgccattataatttctttcttttcttttttttttttgagacggagtttcactcttgttgcccagacaggagtgcaatggggtgatctcggctcactgcaacctccgcccccgggtccaaaccattctcctgcctcagtctccccagtagctgagattacaggcgcctgccaccatgcccagctaattttttgtatttttagtagagacgggttttcaccatgttggctaggctggtcttgaacttctgacctcaggtgatccatccaccctgagtgccaggcgtcccaaagtgctcagattacaggtgtgggccaccacgcgcggcctgccaccaaaatttctcttcttttctttttttctttctttttttttttttctgagacagagtctcgctttgtagcccaggctggagtgcagtggtgtgatcttggcttactgcaagctccacctcccaggttcatgccattctcctgcctcagcctcccgagtagctgggactacaggcgccctccaccacgcccggctaattttttgtatttttagtagagacggggtttcatcctgttagccacgatggtctcgatctcctgatctcatgatccacctgcctcagcctcccaaagtgctgggattacaggcgtgagccaccgcgcccggcagccaccataatttcttacctggactaccaagaagtcttctaccaggtgcctctctattcactcttgccccccaccacccgggtccattcttctcacagtagccaaaataatttttccagacatatatctgtcacactaggtgccccactccccccattcctgccttagtctaacatagctttcttccccaaggcttcccattgcttttagaatacggaccaaattcctcaccatggcctacgagaccctgcctggccaggccttgccgctttcccttcccatttcttggcagcctcacctcataccttgttcctcctgttctccacgctgtagccctggccttctgtcagtctctcactgtgttccccctcccctgcccagcctcctaaatgctcttgcctctgcctacaacactccttcctctcttcttaaccttgacactcctcctacacatcttttaggcagctactctttcagctaactcagagttgcagtttgacatttgtgtggctgattaaagccaatctcccctgactgctccctccagcatctgccccactgtcaccagagggtcttgcacagggcctggcatgctgcactgagtgggtatgcagtaaatatttgaagcatgaatgaatgaatgaataaatgtaagctcttttcccactggatttcagagaagcagatcatattacagacctaagtatagaaatctgatgtcctgaatgccaacctggacctcacactctaaagaacttaattttgtggtgtgactcagaaagtatagaaaaagagtccacttatttttacttccaatatgttatgagagaagtcaaaggtggggcctttactttttttttttttttttttttttttttttttgagacagggtctcactctgtcgctcaggctgaagtgcagtggcatatgactcacttctcacttgacctcccaggctaaagtgattttcccacctcagcctcccgagtagctgggactacaggtgtgcaccaccatacctgcctaagttttaaaattttttgtagagtcagggtcttactatatcggacaggctggtcttgaactcttggcctcaagcgatcctcctgccttggtctcccaaagtgctgggattacagtcatgtaccaccgtgcccagtctcctttttatttcttagcagagagtgagcgttaggaaataaaggtttcacaggtcccacactgactttaaagactctattaacatattttgtatcaaaaataccttctgtccctgagaagtattcatcagttcattgttacggcttttcttttgaacacccccccttgtggctagagacattttgatgatttattttctttctgtgttcaccaggtcagagataggaatgagagggaagggaaagaaagagggtccaacatttgtttgcctactctagacatcagatcgggctttttagaatatatgtaaaaaggagcatagaacatcacctatgttcttacccttttcatttttcggataaagagggttaataggagccagaagagagtcgcagccacacaggtgcatgttagagtgatcagctccagattagacttgtccgaggttcctggagagaaaaaaaatcacaatagtggtgcaacaaagaaattcccaaactcagaatctttgtggttttataaaagaggctcagtttccctaaatggtttatcatagcgaacccaatctgctgccacaaaatcagtctctgggacagatctcttaccttctaagccaggcagtatacatgaactcacatagaaaaggcagtatacatgaactcacataatgaactcacatagaaaaggctttccagaaattttgctgtcaagtttgcaaactttgtaattccagaaacagctaagtaaaaatcagaggagaaattaaaaatgggaaaaaattaaggcaggaacaaaagcccattaaaatgctaaatctggaatatgttaaatctccctaatgagttttagaggaaattctaaaaaaaaaaaaaaaagacaaaataatgacataaaagggctactttgggactcacaaaattcttcaaagtagaatttaagaataaaaataaatccaggactgtcacagttgcctgtttgctccctttggaactgccagcccaaagcgcccacatcccactccctttgtctagggctctgtttctggcttcatcagccagattggggggcctgagatagaagaggcaattgctggacctgaatccttcccagtcaccttctctatcagaatcacagagatcaaaagctgagcactgttcctccaagaccaaaaggaaaagacttaaagtattcaagccatgcctccagagagggaactctggaatttgtaaagaaatgcctccatgggccagaacagtattgattcttgtgagcaatttcccaggaattctaaagtaatgcctttatcctttaacttaactacaatgagacagaagtggctgggcatggtggctcgcatctgtaatcctagcagtttgggaggctaaggagggaagattgctggagccccggagtttgagaccagcctgggcaacatagcaagatgccttctcttaaaaaaaaaaaaaatgtggtagcacacacttgtaatcccagctactctggaggctgaggcaggaggatcacttgagcccaggcgttccatgctgtagtgagctatgattgtgccactgaactcccgcttgggcaacagagcaagacctggtctcaaaagagagagggagagaaagagagagagacagacagatagatgtttatattaaggtgggcaaaggacaagtgaaattttctttttagaaataatgatgtggatgaggatctaatttgctgagcacttattatattctaagcatgcaaactatgaagtcaggggcagtaatactccagtttcatacatgagcacttcatcttgggggctctctgtttcaatgcaacaaagatgtattgagttgtactagaggcaaggttaggggccggaggagatagaaagattaatgagggacagttgccactctcaaggaccccattcaaacctaaccaagagacttaaggcaaatacaaagaaattagattttgaaagattcggctgctgagggaatctaatatatactactatctaatagtaatctaataatacttttttgaagaggtggcatttgacatgaattttaatctgcagagatgaaggcaggggagggcattataggcagaggaaacagtatgagtaaagacccagacctggccaagtgcgatggcacacgcctgtaatcctagcgctttgggaggccgagacgggcagatcacctgaggtcaggagttcaaaaccagcctggccaacatggtaaaaccctgtctctactaaaaatacaaaaaaaaaattagctgggtgtggtgggggggcacccagctcctcggtagtctgaagcaggagaatagcttgaacccaggaggcggaggttgcagtgagctgagatcgcaccactgcactccatcctgggtgacagagtgagactccatctcaaaaccaaaacaagacacaagacccagacctgggaaaagatagggcagtataatacaagatacaagacaggaccagaccatagaggattctgagcatctgtgtgatgggtttgatctaaaggctgcaggcagttggagccaaggtttcctgcccaaatcatagcaaatgcacaagctggaaacctgagataacaataactcattggcccttattgagtgctttctattctagggacttttctaaggaccaacatgtattcattcaccaaagactcacaaaaatactacaagctagattattcccattttatgaataaggaaattgagacacagagagattaagcctcttgcccaaagtcacacagcctgcaagtggtggagctgtgattttaacccagataatctgactgcacatgcttaaccacgaagcttccaagagtatgccacttcctcctctctgatccttccagcctttacaagcgcagattaatcacttcctattggccatagtccccgccacaaagttatcttttagtctggagtggaaactgatattttctctccatccaacccatcacaaagtcctgcccattctacttccttggatcattaaattatcagctctcctacccagctgtgactgcctaaaataaggccttatcagttctcaccaggactacctcattggccatggctccctccagtctgtcctccacctctgcagccagagtgatcttgccaaatcaccaatttaaaatcctattactcttctgtctaaattccgtcatctgttccctgtcaccatcaggataaaagtccaaatccttaaatcctttatgcccaaccttgcctctcttttcagcttcatctcctgctgtcctcccacttgcttcagtcacgccacagttcttatagtttcttaaatacaccaacccttcagaacatccatgctttggcttttgctatttctctgccaaaatgtgtgcttcctgatgactgagtccataacttattcaccctactcatcagcttgggcgaatgaatgtatatatatgttttgctttacctacctctaaagagtttcatgagggttttaaagagtttaggggccgggcgcggtggctcatgcctgtaatcccagcactttgggagcccgaggtaggcggatcatgaggtcaagagatcgagaccatcccggctaataccgtgaaaccccgtctctactaaaaatacaaaaaattagctgggcatggtggcaggcgcctgtagtcccagctactcaggaggctgaggcaggggaattgcttgaacgcgggaggcggaggttgcagtgagccgagatggtgccactgcgccactgcactccagcctgagctacagagcgagactccgtctcaaaaaaaaaaaaaaagagtttagggtcacgtctctgttcctgtgtattacttcataaaacatatagaccaccacctctgttgcagatatgttctaggtgctggtatacagttagaagagaaagggcatggttggagctcacagtctggtattcaactatgaactgatgagtgtgttataagttctgagtgaagcagcagaacgtagggctatggtcctcttcttcactgctacatttccagggttcagaatagtgcctggcatatagtagacatcctgaaaatagtggtcaaatgaatgaattggcttatttgctgctttgtcagctggtcttaagtttccctgaacctcatggggttgattgaaaataacttccttaaagaaatttctaagtgtgataaccttttctctcactacacatcctcacaatgggaagattgtaagctcaagttcatatgagtttggtttctttctccacagtgacagtgaggtttaatgcggccttgctgtacacacacacacacacacacacacacacacacacatgcgcacacgcacacacacacacacgcacacattcttgcttatgctgcaaataaattttgtggaatttgattgggattgggatcctctcaggacacagtggcctttggctgtcggagatgctgatagcatcttgagacattgcactgtctgcataaaacctctgcagatgcttcccgcatggaatgcactaagagaggcccccttgattgtgggaactttcctgctgcattctatgggacaggaagctgacccccaaagtctaattccacagtccttactcaagcaaaattcatttcagtggaccaaatgtgtttgtgtgcaaatacttacacatttaaggaatcagcccattaaaaaaatcttcaagatgaccatttatcgggaaggaaagatctatttaatattaataatgttcagtactgcttattgaaaaatattagaattttacagtatgtgctgtagtatcattgctctattgcatttgatggcttagtctctatctctgtttgaaaagcgactgttaggacagtcttatgctgggtgactgactgaagtgaacccttaggtgttttctcagcagtcaaacacactggcctgactaaacccagcttcaatttgctggtgacagctgatgagctaagtgcatgagataacccagcagcacacaggagtggaaagaggccagggaaatgtgggtgggatttgacagtaactaggagttagcactgggtctcagggacatggctcccgcatgatgtgcgtgaaaggccagcatcaggacacggtacaaggttatttttatttgggatactgacaagaatatagccaatttgaagagtgtatgttaactgtatctatgacagactgttgacctggttgcacagagcattccacgtcaagtactctcccaggctttataccatcccttttggaatagggaggggagatgccacaccagggatggtctgagttctgaaggggtgtgtatcttgcctgacgtctctgcagctgcgcagtgtcctgagctttcctgatagcaatagtagctctctgtacacacagcctgggctgcatggtctggcggcatcacaccagccctgatgtatggcactgtgtggcatcagactgcatgaatgggtaggcagcagagccagccaactcagctcatgcaatataaccagacagagtttcccaaggagttaaggaaacaccccaagcaaaagaccagagcaccttgtcccagggcctgccttgacttagggaccgaacacaggtttcatcgggaaagggcaggtactctgtgccccagtttcctcatccttacaaagtggagataacagccccttcctcacacgtgaattgtgttaacttagtgttagctattattttgaagcctgcttgcctgccttccttccttccctcctccctttcttccttccttctttccttccttccctccttccttccttctttcctttctctctctctccctctctccctccctctcccaccgtctctctgtttctccatctacaccccttactccaacccttttcttttttttttccttatcactttttggacctcaagtgcagagtaattttttttcattgaaacacattgcatgtattatttaatacaatttgccttttctttctgaaacaaatcagatttggacctaagtactcatcaatttctgcaaacaactggtccactacctccctgagaaatttgcctgatcctaaggttggtttaggtgttattctctggttctattgttattataatttgagtaactacttatgtgggtttattgcccattaacctgttaggacctcaagagaaggacatgtttcttgttcgctttgagtctccagcattgactcagaggaagtctcaataaagatttaggtatgaacgagaagaaaattactcagatgcactttgacctgactctcaagatccccgagcaacataagccactcaaccagtgccatctccttctatgtaaaacccagtcagcataatccaggtaaccttacttactatatggtttctctagagcctattgaaatgttaaaataggcctgcagacctttattactgtcgatgaagttttttaggaatctatgtacaccaatttggaaccactcctaaggacagtgatgtatggaaatgctgtattcccattatattttaagtacattttcaagagtactgttaagtaaggatatttaaattgctgttacgtgacgttagttctggaacacatttcttttttcacaagttaaatccttaagtcaaacaggaattctgtggcttagaacaccttttaggtgacccactggttaagtccaggaaaagtataatacagaaacttttgttgaaatggaatttggtatatcttattaacaaacggtaatgttagctaacacttacaaaatttttattatatgccagatgctgttttaaatgtgttaatccttacaacaagcctacaaagattggtataccatcattagcatgcccattttacaatgagagactggaagcaccaggaaggtaaggaacttggcaaaagttatgcagcccatgaagagtgaggcatctggcttcagaatgggtctttttaaccaccgtgctgtgctaccttagagttgaggtatagagcataaaacctatagagcaacagagcaggatggttgaacatggctacaattctcagctctgccatttccaagctgtgtaaccctggacaagtcacttaacctttttgagcctagattctcccttttaactaactgtacttccttgtacctgtaggattattgcaaaacttgagtaggattacggatgttatgtgcttaaaatagtgcactgcatgttctataagcgcaagatattaattacatggtcccaggccctcgcagagcccagcaccaagttccctaggcctaacacccacttctatgatacccaatgcagttttatgccagcctagtttctacggaaggaattaagatgaatatcttttgagtttgaattattttgcctcaagaactctctacaaacacctcaaatcagcctaactgaattccatcaccattttttaaaattcttcttgatcaaggccagctttatgtcactggttagatttgaagtataggcatgtgtatccctgtccctcagccctcctattgacattagtgcacaactggttcatctctgttttgagcactgctctctcctcgggaaacctttctaaatagccaacacccatgagaggtgtaacatcaatccccaacatattcatgcgaattagtttatcacatcctttctcagtgccaggatagtcataggagtgaatttgggggcaggattcaggaagagaggagctaacgtggagggaggtcagtcagggatcagaggagggtcaaaatggagaactgaaaactgatagctggccaagggcaatagaaagcagtgactgaagacccatggccatattgttttcagttttttctgttattgacttctgggatttaatttattagggaacatagtgtctactttctactggatgagtcctttctcaaacaagtgacaacgtgcaatcgtttgcaaatcagcctctaatgccatgaccagcatttaggctgcaggaccctcatgtagtccttttgtgcctttgggatttttgtatctgtcaatcatcttcgaaaaatgtttagaatgatagttattcttcttcaagttgtcttctcctatgtacttataaataatactgaaatatagtaaggcctaaatctgatataagagtatcagatttggctgggcgcggtggctcatgcctgtaatcccagcactttgggaggccgaggcgggtggattacctgaggtcaggagttcgagaccagcctggccaacgtggtgagaccccgtctctactaaaaatacaaaaattagccaggcgtggtggcacacgcctgtaatcccagctactcgggaggctgaggcagaagaattgcttgagctcaggaggcagagcttgtaatgagccaagatcatgccactgcactctagcctggctgacagaccaagactgtgtctcaaaaaaaaaaaaaaaaagaatgtttttatatatattgtggttatttgcattaataattataaagcatagcttaagtccttggatgaaattgtaacagccccattgagttccagggctactgagcgctatgttaatttcagaaatgattttagttactaacacttctgttgtcggttttgatatggaatttcccctttgagagcttcatgtgccctcgtgctggcactaggtccaaaccaaacaagacctgtgattatttaaagaaggtactttgactccacagttcattcatcctttacggatacaaaaataacacattgttttatctgtgagtataagaatcctttttcaaaggaaataaaaagagcagacagtttccttcctggctaattcaccaacctctttaaatctgttaaacatagccacagacacaacttgttcacttggtttcatttcctaaactcaatttgacaagataggtcagtgtgagggtccatatgcatctaacaggaaataaagtctaaatctagggaatgtttcatagctaccagggtggtaagaacaatgactctagaagaagagtcccatttcaattataaaattaatgagcaggtaccgtattcagctgttgtgaacagcatcctaggatcaaattttaatccagtgaatccaaactccttccattcaagatactgcatctgactcacacatgcaggcctttctaaggtccacatactattaacattcaaaatttcttcctgtgcaaagttatattcttatatagacttgaaacctgcctcttggaaatttcactaccatctcccttccttggttctagttatcttttctggtgtgtcaaagaatgagttaaatgcctcttctgtcagaaagctcctaaactatttcaagaaaacaatcttgttacccccatgttgtctcttttttggactaagtatcctcattttctggcactattctattcctatccaggatatagcgctacttatttgtttcttttataaatgggcacaatatttcaggtgtggctggatgattgccaatcatgtaatctatattttcagctaactactttttttaagcaaaaaaggttggatatagccatcacttttataaaagagagcaaaggagaaggccaaaaaactacaaaaagcagacacaagagttcaaaaagcatggcagttgggggcaataatgaacaaaataatggaatatataaatatatattccattatatatgccatatattatatatatgtggcaacccatatgggcaattcaagtgaaaataacctccacttttcacaagagtaaatgatatggctaacagaaaggtttagaaattatcagtaatgcagtattcttaacatctgacttttcagaaaagcataacattaatgggaaaaggaatcagcataggaagtctagaggcatgtaaacatgagagaaatggagaaaataaaaataacaggatcactgaaagagtgcttttgctcaattttatcctaagtccttgcagacaacttcctaaggcacctcaggaatgagaagagcagaggaagggcggaaatattctgaggtatacgtggactcaagtctcagcctcaccacatagtcattgtgcgactttgggcaagttgtttaacttgagtttccatcttcccatctgtagattgaagatactactattgacttctttagattcttacaaggttaataggattaagtatgtcacaagtccagcacagcgcctgcacataaaggtcctaaataaatatttcgtgctaagtgctgggcatgtgtacaggatacaaagatatgtcagacagtactgtctcaaagtttataattcggtagggaagagaagcatatcaacgccaaaataataataaaaggcagaataaaataagtactgactaatgattccagaagcggggattgagagagcagagaatgagtatctgcctcagctgttcatcccggagtacattccagggcagaaagcatttcagctggcctgagaggataagaaggatttggctggaatagggaatggagcctactccaggatgcactaacatcacaaacagaggccacgcttggcgttatgtggcaagtccggctcactaatggccaaacgactgactctaatccaatctggaaggccccacggtgctgctgatctggcctggagcagtgaaagaataacagcaggcctcctgcagagcagactgctggcgaacagaagggtggtcgttctgaaggtggggagaagaaactcacagatgtcgtaaatgcacagttttaagcacactggcttctgagaaacccacatcaacctggcagaaaaaggaaggaagtcaagactttggggagacctacaaacacgcaaaaacgtcactgcttcatacccaggctcctcccaggccataagagtccagccattgctgccccatattccctggtggaggggtggggacaggggaatgcagtcatggggtgaggggaggggagtctgagaaaagttcagttttctcctctggtctgccatgactagactgtgtgagttgggtgagtcagttcagacctctctggaggtttatcactgctctgtgtttctcatggggttgttgggaggatatgggggaaatgacgtttgctctgaggattagtgaggtctccttgctctctgtgttccctggcccggcacggccattcctgagggctatatgtctggggtgcctgttaaaagacagattagcagctatctggggaagaaggtgttaaacagagatgctaataaattgtttctgtatgagcgagcagaaaagtgaacataatattttagaacaaggattatttgggagacaaaaccattactaaaggtatttggggaatgctaccctctcactttttctgaaagtataaatttgtggtagagtagtttcagactttcagggggctctttaaaatcatctccttgtgaaagaataaagatgatgttctgttttaaaggggtttgaattctcagagttaaaatatttaagcaatgtaagtttcagggggaaaaaaactgaagtacgttgccttcttcctagttcctccccgcaaaatacttgcatattctgaagtcgactggttagcatttggaaataggctactgaacaaataccatcttttcacgtaaaacctcaatatgccatagatatttacatctaagaggtgccaatctgatattttatgatgttgtaaattttatgttttggatgattcttagcattagagaattgaaactgaggtcgaaactgttttccaaatgtaagccacatggccatagccagggtaggattaggcctctttgtattttgctgctgagcaaactgtctgagacctataaagaggaagcacttggaatatttttcttaaatgtcatctgttgattacatgttgcttctttctgataatatattacagcccacttcattttaaaagccagcttataaaagcatttggaatagcagcatatgtctaactcctgggaattagaaaaggaaaacaaatgaacaattttaagtgtgcgagttccccctcctcacctacccccctcccttttcttccattttggacatctctctcacaggtgtggactactctggccactctctgtggcagggcgtaataacacagtcagaactgggtttcctttcttctgggaacgacttctcccgcagacactgtgttcggattttgggctctcgaggatggccagccagtgtcttcaccttctgctttgccagacagaaccagacagtcccttcccggagtggcagggagaggggagaaggaggtcagggaaaggaacagactggagcaggcagcaggagactgggaggtggaaagttaaacaaacagggaaatagatgtctgaccaatttcttgttgctttcttaagcagctgtttaccttgaacagtgaggtatgctgaactttccacagagcccttctggttggtggctttgcagtgatagacaccttcatcctcttctgtgactctttcaataaacagcgtgctgcttcctggtcctaaaataattcctgaggggtgagagatgtttagattagtgggcctggatgacaaacaaaaaacagctacttctgtaacacagccttcttcctatcattatgcattcagacaaggaaatccgagctctagtgaacctggggcagggttgcttatttgttttctctgggtccaggctttctttttcttttctttcctttttttttttttttttttttctgcaggctttctaatagcaccttcaccacccagcagagctgtgatccccagcttcggagatgcaaatccacccaccctgtagaaagaaatgtgaggcagctgccatgcccaacttgaaagttgaagatatcaagaaggcagcatatctaataataacaactatcattgactcaacgccctctgtgtgctcggcactatgtgacacactttcataccttgacatttacaaccagcctgtcagctaatattgtcttccttttacaaatgaggaaactgagattctgtgagattaagtaacttcaccaagagcatgcagtttgactgaaagcacatttgtgacatatgggtcaaaggaactaatatttcatttgtcataaggcctggtgagtcaatatagcctagtgatgaagagtttgcctgggctgtgttttaatccatgccttagcgcttcaagctttgtcacttaggcaagttacttgatctttctaagtttcagtttccttaatcttaagataaaaatgaaagtaattcttactctatagtaaatggcaagcccatggtacatagtaagtgctcagtaaatgtaagcttaaggattactacagagcacagtgtagtggaaggagtcccaagaattttcagacccctgaaaggcttcaagaccttgaagcttcaataccttgtactatcaccaagggtctgttgagtatttactctgccatcagttcgtgttacaaaacaaacagcaggctaagatgtgggcaggctaagacatggtatctgttgagaaggaaaaattaattcctaccaaacacacacatttacattctctctctcccacacatgctcaacacatacactcacacacacaagccaacaaatagaaaatgtttaatgaatgagaatgagtgaatacagcacagtatacctaattaagtggaaggtctggcacagggaaggagatcagtaaggaagggtgtacttggggaaggctgcatagaagaggtgggcctcgagttgaggtctgaaggattgtcagaggtgaaatgagaaacggaagcatgagaaatggcatgatgtggaaataaacaggaattgagtacttgttccagaatagtgataaaacaggcctggccagactataggctgtatttcattagtttaaatagtttgtatttctcttatgaaagatgtactcaatatagaaaagttgagaaatatttgaaagcttaaaaaaagaaaatgtaatattataaagctatgataatcaaaacagcatggtactgttataaaaacagatccatcaaccaatggaataggcaagggcccagaaatcaacccaaacatctatggtcaactgatttttgacaaggtgccaagaacacacaatggggaaaggacagtctccttaataagtggtgttgggaaaactggatatctacatacagaaaaatgaaaatggacccttctctcatcccttatataaaaatgaactcaatatggattaaaaacttaaatgtaagaccagaaactataaaactactagaagaaaatgtgggggaaaaactccacgatattggtctgggaagagatttcttggatatgaccccaaaagcacaggcaacgaaagcaaaaataggcaaatgggattgcatcaaactaaaaaccttttgcacagcaaaggaaacaattaatagagtgaagagacaacctacagattgggaaaaagtatttgcaaatcatacatcagataaggagccaatatccaaaatatacaaggaactcaaactactcaataacaaggaaaccaataatcctatttaaaaatgggcaaagaaatcaaatagacatttttcaaaagaagacagatggccaacagttatatgaaaaaaatactcaccatctccaatcacaaaaatgtaaatcaaaaccaaatgaggccaggtgcagtggctcatgcctgtaatcccagcactttgggaggccgaggtgggcagatcatctgaggtcaagagttcaagaccagcctcgccaacatgatgaaacccagtctctactaaaaatacaaaaattagcggggtgtggtggcgaatgcctgtaatcctaactacttgggaggctgcagcaggagaatcacttgaactggggaggcagaggttgcagtgagcgagatcgtgccactgcactccggcctgggtgacagagcgagactttgtctcaaaaaacaagaaaaaaaccaaatgagatagcacctcacacctattagattagctattattaaaaagataaaagatcacaagtgttgatgaggatgtggaaagaagggaacccttatacacggttggtggcattataaattgttacggccattttggaaaaccatatggagcctctcaaacaactaaaaagaaaactgctatatgatctagcaatcccactactgggtatctacccaaagaaattgaaatcaaggatgctgaagagatgtctgcattcccatgtttattgcagcattattcacaatagccaagatatggaggcaacctatgtgtccatcaatggatgaatagatttttaaaatttggtgtatatatacaatggaatactacagccttaaaaaataacaggaaattctgtcatttatgacaatatggatgaacctagaggacattatgttgagcgaaataagccaggcactgagagacaaatgctgcatgatttcacttatatgtggaatctaaaaaagttgaactcatagatgtagagagtagagtgatggttaccacaggctggggtggggagagttggatacggacagggaagatattggtcactgggtacaaagttacagttagataagaggaatatgttctggcattctattacacagcaaagtgacaacagctaaaaataatgcacatttcaaaatagctaaaagaggattttaagtgttcccaccacaaagaaatgatatttgagctgatgggtatgctaatcaggcttatttgatccttcccattgtatacatgtattaatattaaaacatcacactgtaccccatgcatatatataattattattatttgccaattaaagaaatggaaaaggccgggcacggtggctcatgcctgtaatcccagcacttgtgggaggccgaggtgggtggatcatgaggtctaggaattcgagaccagcctatccaatatggtgacaccccgtctctactaaaaatacaaaaattagccgggcgtggtggctcatgccggtagtcccagctactcgggaggctgaggcagaagaattgcttgaagccgggaggcagagcttggagtgagccaagatggtgcccctgcactccagcctgggtgacagagcaagactccatctcaaaaaacaaaaaaaaaagaaatgtaaaaaacacacaaactccaaacacctacaatctcacctcccagatgttgtttctttagtctttctaaagtgtactttctgaaaacacagtttgttcatttatataacaaatattttttgagctcctactacgtactagacactattctagatactggtgatacactatcaagcagaagaaatccttgcctacaaattctagttttggagaattacaaagtgagtatcaacagattaaggtattagagaaaccagaggagacaacaatgaattaagtatgaacaaaagatctgagggatggagacaaattataagggtaataacttgcttatttttgtaagaaaggaaataaatagcaagagtggaggatgagcagtatcgtctaaaaaattaaaaacacaaaactttgctgatttgatagatgaaaatgattgttttaatttgtatttctttgaacattttttcatgtgtgtattagccatttttatttcaaaagacctgttttgagtaggtgactggaaaaggtgaattcagattaaggagagctttgaaatcttggttgaggagtttcaattccatgtagaaggaaagagaatcacaaagatttttgagcatagtgaaagcgacatttaaggacgttcagtctagaaggagaatacagctggactggaatgaggaaagcatagcatctgcaagtcctgctcatcagttgtaattcaggcaaggaatgatgaggtctcaaatctggatggtgggaaaggaagtagagaggaagaaatggaaacagatactttgtagaaacaacctataggaattggtgctttactggatacagcaatagaaaaagagagagatgagtccaaggtgattccaatattttaaacccagataacagggaaaaaatgacagctcttccccataaccttggctaagtcacttaatctttttggggcaagttccttacctgtaaaatgagaataatacctgctccacctatttcatgatcaattgagatagcttaaatggaagcattgaagctttgagaagtataagatatagtacaagtggcaatcacagaaaataaaagtgtggctgtacagttgctccgggtcaatgaacatttataagagcagctatcttgctacctacaatcattacaataatctccattgcagcagatctgaaactcagccaattttctatcactcaaatcccaactcaaggatagcatcatgggctgggcacagtggctcatgcctataatcccagcacttttggaggccgaggtgggcagatcgcttgagcctaggagttcgagaccagcctgggcaacataatgagactccatctccactaaaacttggaaaaaacaacaacaacaaaaaacaggctggcaccatgagtaaataaagttaaaggacttggatttcactcaaggagagtgtgtaattatgaaaggtgagagatggtagccaggatgctcatgagctaacatcatctggcacagattcctctttctagcccaaggaggagaggagatggggtgagaaggtgtccaaattcaacaggcaaagctcttctttctgatatgccctctattgtactataacaaatgacacagagacattgatgcttccccatcagataggccactcagacgctcagaactgtcatcaggcccttgctcatcctccactcttgcatttatttcccttcttacgaaaataagcatgttattacccctataatttgtctccattcttcagatcttttgttcatacttaattcattgttgtctccccaggtttctctaataccttaatctgttgatactcactttatatgacccaaatcgtaggatacaggctctgttctgctgaggaaaatacatttttaaagtggttctatttttagtttaattttaatttttttgactgtgagcactttcaaaaatgttaaagtgcagaaaaagtataactcatgtatctaccattaagatgatcagaggtcaacatcttgccatatttgctttaggcagacccatttctgtctttaatatgaaatgagatttatagatactttatcccttcctttaccctctctctccagaggtacctgaaattgtactttttctacatagtacatgtttttgtactttttccacatgcatgtttttgtactttttctacataggtatatatctgtacagaatacagaatattattttgtgtgcttaaaaattctaaataacaggtattatagattatatatccttttcaacttgattgttttcccattcagcaatgcttttatatttatcctttttttttttgagacggagtgttgctgtcgcccaggctggagtgcagtggtgcaatctcggttcactgcaacctttgcctcctgggttcaagtgattctcctctctcagcctcccaagtagctgggattataggcgcccaccactgcatctggctaatttttgtatttttgtagagacagggtttcaccatgttggctggtcttgaactcctgacctcaagcgatctgctggccttggtctcccaaagtgctgggattacaggggtgaaccactgctcccagctcatgctttttaattgatggcaaaatgattgatgtgaaatggtatcttgctgtggttttaatctacatttccctgattactagctaggtgaaatatttttattggccattcaggtttctctttgtgtgaactgcctgtttctatcctttgcccatttttctgttgtcctatttgtctttttgtcaacgattttagggttctttatatgtttgggatgctaattctttgttggcttaatacgtttcaagtcttccttcattgtatgaacagtcttttaaatttcacttatggtaaatttttattttatttatttacttatttattgagatgaggtctctttctattgcccaggctggactgcagtggcaagatcatagctcactgcagccttgaactcttgggctcaagtgatcctccagcctcagcctcctgagtagttgggattataggcgtaagccacagtccctgccatggtgaatttttaatacaaagctttaaattttttaacataatcaaatttgtcagtattttttattaactttttgtgctttttgttatttaagaactcttttcctaccctgatatcataaagaaagtatactttcttcataaaatctgtttaagagattcatttactattttgtgttttcttatttaggtttttaattgacctagattttcttttggggaggggtatgtgtatggtgtgaagtaaggacctaatttttaccatataaatagccaatgatcccagcatcatttattgaataagatcttcttttaccactaagtcgttgtgccagctctgttcagatactatctgaattttttatgttgaagctcccatgtatttgtgtatttgtggttctgtttctaggctctttatttattcacagtgacctatttatctatccctgtaccacataagttaaattatgattgcttgataacacatcttgatatctggtatggcctcaccagatagttttcaaaatggtcttgactattcttggccctttatacttcaatactttatacttcagattttgcttgtcaaattctgtaaaaagcacaattggaatgtttattggaattccactgagttcatattatattataatttgggggaaatggtcatatttatttttaggtggaaccatatggaattgccaatactttgacgtacaaaaatggcaatatggttctaccaataagtgtttttatagaagaatattgagtatctttgagttatttaggttttcttttatgtcatttaatagttttatgattttctctttaaatatcatgcttttctttagttatatttattcctagatagattttaattttgttgttatgcaaaatagtattgaggtctttgagaggtcactgtatttgaattttctctttcctttttgggtattagtctttagaactaacatgtagaactccctttttttttttgaggcggagtcttgctctgtcgcccaggctagagtgaagtggtgcaatctcggctcactgcaacctctgctcccggactcaagggattctcctgcctcagcctccctagtagctgggattacaggtgtgcaccaccaagcctggctaatttttgtatttttagtagagatggggttccaccatgttggccaggctggtctcgaactcctgacctcaagtgattcgccaaccttggcctcccaaaatgctgggattacaggcgtgagccaccgtgctcagccagaactcacttataaacatgatactctgctttgtgtttctgagatagtttaattgtaggcctgcttgcttgcttctaaaggatagcctaagtcattaccatgtgcttgtttgtgtatttccttggcttctgacactaaatacagattctttaaccactgaagccataacaattcccatggaaattcattatttatttctctttactctaagaagctgtatcagatggaccaacagggcatagagtagcatttgcaaacatagatgtcttcaggagccaggcacgtaatataaatgagttggggataaaataatggaagggggactatgtctctggagaatagaaagcctgtctcccacctaaaagcagaagcctttgcttagctccaacctattgagaatttggggatttgagtctggtgttgtcttctgagttttagaaagaaggcagaaatttgaattttttttttaatgttaaagctcatgattcttaaatgttggcaaccagatcaacttatatagatctactgtgaaggccaataaaaacatggatgcaagatatatttgatgtaacttagagtatgtacatggggataagcttttatgttgttactaagcaaggaccttcatgatctggccccttcctatcttcccagctttgctgcctgctgcatccctacatgtgtctttggtatgagccatgctaatctatttgcagtttgttctaagcctcagtgactctgcacacgtggttcccttgatgcctggttaacatttgcttgttctttaatattcagctcaggattagctactctggaaagcatttttttttttttcgagatggagttttgctcttgttatccaggctggagtgaaatggcacgatctcggctcactgcaacctccgcctcctgggttcaagagattctcttgcctcagcctcctgagtagctgggattacaggcgcctgccaccacgcccggctaattttttgtatttttagtagtggtggggtttcaacatgttggccatgcaggtcttgaactcctgacctcaggtaatccacctgcctgggcctcctaaagtgctaggattacaggcgtgagccaccacgcccagtggaaagcatcttctgatgctcttggaccccatctctgttactcctgcatcaccctgtgaatgcccctactctggcacttacctttttgtcataaaattgctgactttcttatctgcccactccactgtgggctcctggagaatggtaactctaacttattcattcttgagtccccagtgtctagtgcaggccgatagacagctgaccttcagtaactgaggaaaatgaccacataaatgaagacaatggaaaatgtcatgtagagggtggaggaggggagtgagctttgcaatatttgcggaatatgatgaagctaagctagttattagtgctaactccctgggtggtagcatagactgatgacctgcagcatgccaagctcacctcagaatttataaaattctgtcagttaattttgtcatcttaaggttcaaaaagcctcagttcctggagcttagaatgcaaactctggtggttttatgcgtttgctaaagcattagccccaaaaggacaagtaaaactttacactgggctgtttttgtagaaacgtgtggtgtcctctaaagtatctgacgatgaaactcagtgtgaggatttgaattacttattatgttggttgctaatggaggatgtggataagtttttgaccatgatggcctaatttattcatgggatgtggtctaaattttcaagatgtccaactgtcaattttaaaggtgtaattttcaagggactctgtagatagctttatttcttcccattataccttaaggtgaaggacaatcttggcattttatgtgtgagcaccatattgcccagggaagagcatggaatataattttaatccaattcaccattgagtaaataaatctgtagagcttttgaattcacctatttgattacataaatgcaggccatgtgtttgcctcctgttcccccccacacacaaaagtggcttgttgctctcctaaatgggcctactagtctgaccagcaacttctgttttgttgctcagttgactatatgtattgttgacttagagaacattatattcatccactttggccaaactaatattcgtcatcaaaactctcttttttattcatcaaagtccaattcagatgacatctcctccatgaaatctcccctgattagtcatcagaagtgctaatttttatctgatgttattttataccactcacattgcacatttatgaactgactttgtacctattatgtttgtttttcaaaggtgaggattatgtgttgcttattttcattttctctagaatataataaaggatcaggctcagagtaggcaattaatgcatgtatgttaagtttaatagaataaaaagtgaattttgtctgtttatttatttatttatttatttgttttttgagacggagtttcgctcttgttgcccaggctggagtgcagtacacgatctcggctccctgcaacctctgcctcctgggttcaagtgattctcctgtctcagcctcccgagtagctggcattacaggcatgagccaccatgcctggctaattttgtatttttaatagagacagcatttcaccatcttggtcaggctggtcttgaactcctgacctcaaatgatccacctgccttggcctcccaaagtgctgggattacaggcgtgagccaccatgcccggccatttgttattgttatgattgtcttggctctccaactaaaggataagttctttgaagttgacacataatagttttcaataaatggtagctatgatgatgatgatgatgatgatgataatgatgatagctatgatgatgatgatgatgacgatgatgatgatgatgacaatggtgatgatgacgatgacgatggtgacgttgatgtatacagttctaggtacacagtaaataatcatatctttagattggcagcttttttttttttttttttgagacagagttttgctcttgttgcccaggctggagtgcaatggtgcaatctctgcgcactgcaatctccaccttccgggttcaagcgattcttctgcctcagcctcctgagtagctgggattacaggtgcccaccaccatacccggctaatttttgtgtttttagttgagatggggtttcaccacgttggccaggctggtctccaactcctgacctcaggtgatccaccagcctcagcctcccaaagtgctgggattacaggtgtgagccactgtgcctggctagattggcagcctttaattgattagctaagagcagtgtccgaactaagaaccagaagagccaaaatatagaaatggctaaaagtgacccaggaaagctagaggcaagatgtcagattgactttccacaaaggagattttatatatccagtcaaactttggatttttggaaaactatgtctgaggaacataaattcaagttgagtaaaatggcaaaggctgacaaaattggaaaatgaaggccaggcacggtggctcacgcttatagttccaacactttgggaggccaagggggtcggatcacctgaggtcaggaattcaagaccagcctggccaacatggtgaaactctgtctctactaaaactacaaaaattagccaggcgtggtggtgggcacctgtaatcccagctactcacgaggctgaggcaggagaattgcttgaacccaggagatggaggtcgcagtgagccaagatcatgccactgtactccagcatggatgacagaacgagactccatctccaaaaaagaaaaggaaaatgaaaaacgattaatccataaatgacactaaaaagatgagtgatttcagtgcttctgaatggtgaccatgtggtttcttctttattgagaatttcaccctaagatcaagcctcatggcaaagcctttgtgaatgtaaaaaagaaaaaaagttgacgtatgggataatttgagacacagtgaaaagcagccttgcaataatatgttaagctggaagagaatatgagaatgttgcaaaacatagcgtctaaaggagacttgatggcagtgtaagccctgataagacgatttacgctttagccatgaaaaagacagagaaagaacaggaacacttagaaaagaataagactggggacagtgatgaaaaatgccatataggccgggtgcagtggctcatgcctgtaattccaacactttgggaggtagaggcaggaggacagcttgagcccaggagttcaggaccagcctgggcaacacagtgagactactgtctctataaaaaataaaaaaaattagcccggcatggtggcatgtgcctgtagttccagctacttggggaggtgggagagttgggaggaggctgcagtgagccatggtgacgccactgccttccagcctgggccacagagcaagaccctgtctcaaaaagaaaaaaaaaaaagctgtataatattcttctcactgtaacctctgaataagggaaacaccatagacaaaggtcctttcatttgggataatgtctattccttcactactttaacttacaaaatagagttatgatggggggagaggggaaggatagcattaggagatatacctaatgttaaatgacgagttaatgggtgcagcacaccaacatggcacatgtatacatatgtaacaaacctgcacggtgtgcacatgtaccctaaaacttaaagtataataaaaaaatggagttatgatagcagaatagtttctaaaagccttgaagaggctatagttaaaatgaatcctttgaaacggtgccaaaaacacacgtatttctaaatatttaaaatgaaagcatctttgtgcgctttcactgtgaactttgctcttgttctaataaagcatttcaggatgattcaggcacttaaaaatgtgtcaaatggtcctaactctatggttattatctatataaccttagctatcagctatgtttatttgtaaactgtgaacacatgcatgtaagtttgtgcgcacacccacacactcctgtcccaattaatccttgtgctatgttcagattggccatagcctatccacaaggttggatccattagtcccgaagaagatggccagtcacctacagggctttttttgtgtgtgatgaagtagcgactctaatgaccattttaagacaggaaaatcagtactattgcactccataagaacttagtcaagaaagtgtttttctctcaatagaggagtagttacataagttatgggaatacaaatcatattacagtgtatgcctgctaaaaagagtggggtagaacaatacgttttgacatagaaagacctccaagatatatcaagtaataaaagcaagtcttaaaatgacatatggtgtgaccttaactcaaattttatctcggaaatgctgggtttcccatataagcccactaccagtcactcactgtaatccattatcttattttattttcatcataacagtgatgaccatcagaacttataccatatgcttatatagtagtccccctgtatctgtggttttagtttaccaacgtgcaaaaatattaaatggaaaattccataaataaacaatttataagttttaaattgtacaccattctgagaagcatgatgaagtctctcgctgtctcactctgtccctcccaggatgtgaaccttccctttgtcccgcacgcatctccacgctgtagctgctacccatctatgaatcccttaggagctggctggcctaccagatagatggtcccagtatcacagtgcttgtgttcacagaacacttattttcctcaataatgtgctccaaagcacacgaatagtgatgaagctgtgaagtacttccttttagttaaaaggtgaaagttctcaacttaataagaaaacaaaaaaatcatatgctgaggttggctaagatctatggtaagaatgaaccttctatccatgaaattggaaagaaggaaaaagaaacctgaaaaggcatttaagtttgtgggtagaaggcatgaacagagcgtgttctgatggacagcaattggtataatctgaggtgtcaggcatcctcttggggtcttggaacaggtcccctgtggataaggggacatgacagtagttttgtttgttaaatttgttgcctgtattttcccattagaatgtaaattcaaggtccctgttttgttcccagcacctaatatgcctgtcacaaggttgactgtcagtgaatatctattgaatgaataaatcattggtgtgtgtgtgtgtgtgtgtgtgtgtgtgtatatatatatatatatatatatatatatttttttttttttttttttttttgagacagagtctcgctctctttcccaagctgaactgcagtggagccatcttggctcactgcaacctctgcctcctgggttcaagcaatcctcctagctcagtctcctgagtagctgagactacaggcacttgacaccatgcctggctaatttttgtatttttagtagagatagagtttcactatgttggccaagctggtcttgaactcctgacctcaggcaatctgcctgcctcagcctcccaaagtgctgggggattacaggcatgagccactgcatccggccatatatttttaaagcccacatttgtacatatgcacacgtataggttaaaaaatggaaaaaacattgacaagatacatatcaaacagttaatatgtattacctctccataagggaaatttgtatagcttactctatttctgtacagtggaaatgtattcatatattcctcgtttaaataaaatgtatatatatatatatatatatatatatatatatatagctgggtgcagtggctcatgcctgtaatcccagcactttgggaggccaaggtgggcagatcacgaggtcaagagattgagaccatcctggccaacatggtgaaaccccgtctctactaaaaatacaaaagttagctgggcatggtggtgcgggcctgtagtctcagctacttggaaggctgaggcaggagaatcgcttgaacccaggaggcggagcttgcagtgagcagagatcatgccactgcactccagcttggcaacagagtgagactctgtctcaaaaataaataaataaataaaataaaaatgaaacattaagacatgaaactgtagccctttttacctctttctcagtggcaaagagccattaaatgaaaagtttaaaagctatatgagttcaaatacttaaacattgcaaaactttgtaatattgactatgttagaatgagtgagtgaatgtttttgaggcaagaaaagtcgatttatattttatgacaatttacaattttagattaaggcaataaaaggacaaatcaaaacccattcagtcagaagactgtcccaccgtgtggaggtgggggagggaacgtgatatagagtatgttttctgcacttcattttgtttctcagtgatgctcagtttaattatgactgagttgtatgagatggctacttaaactaatatacagtcttgattgtttaagtctccttggtagcaggagattatataaaaatcaggtttatcatttgaatggggaggtgaactttcttgactttgatttttttcagcagcaatttagagtcgtggactgagttcactgactagttatctgagagtatatttgtttgcatattttccttaattgaattgggcatagtggtgaccccagttgcattgctgtgtatgtgccactttaggtcctgattaaactgtctgaagtttatgcttgaggggaggagagatttccatgcagattctagacatgtaaaatggaaaaagtccatctaattattttgcaaaaacatgaaagcatgaaagcatgtttaagggagtgtatgagttttccttctgtagtcatccaatctttagtgtagggaggaatttgttgattagggattgagatccctctcactctaagagcccaggcactggctcttagttttggggttagtgtctttggacagagtacagcctctgagagatctctgggatgactgctgggagagtttaccacccccactaacccctcgatgtccccaaatctctttgtatctcttctctttgtttttcttcatgccccatttctttttcccagccattgactgctcttcagacaaaatttgctgctgatcttggccatgttcaaagtacatttccgtgtgttgcaagaggtcacagagagaatcaaaagaggaggttaattcatagtcaaaaaaggagaagctttaatgggcatgggatttccgattggggttatgaaaaagttctgtaactagatagtggtgatggttttgcaacattgtaaatgtacttagtgccacttaattgtacactttaaaatggttaaaatgataaaatttatgttatgtgcattttgccacaatttaaaaaaatgaggcctgggcaacatagaaagaccaccatctctacaaaagaaaaaaaaatagctgggtatggtggcatgtgactatagtcccagctatgcaggaggctgaggtgagaggatcacctgagcccgggaggttgaggctgcagtgagccacgatcatgtcactgcactccagcctgggaaacagagcaagaccatgtctcaaaaaacaaacaaaaaacaaaacaaaatataaagaaaaaacccaaaaaaaccctttttctaaagtgatgcccacatttacaagttctctcctatttcttttcttttttttttattgagatggagtctcgctctgtcgcccaggctggagtacagtggcgcgatcttggctcactgcaacctccacctcccaggttcatgccattctcctgcctcagcctcccgagtagctgcgactacaggcgcccactaccatgcccagctaattttttctgtatttttagtagagacagggtttcaccgtgttagccaggatggtctcgatctcctgaccttgtgatccgcccacctcggcctcccaaagtgctgagattacagttgtgagccaccgtgcccggccctcctatttcttatgtcctaaatttttcatttaaaaatttaataggacctaacacacacaaacaaacacacacacaccccaccaccactaccaccaccactaaacttaaacaactagcagggggccctgctattcatacgaatagatgtttgtgttgaccaatgcatgatccctcagttggaccttactgtggccagcagctttcaggaggcttttctgggctgaatagagatgaggatgttatgctgtaaaatgcatccaggaaattttctttaggcaaagctttaggataggatatattgctatgtatgtgtgtgtatacctatgcatgtaggtgcaagacctaaatcacctgaatcttgccaataaaaagagatactttggggctgactgattcttcataaatagcttctattgctttccaattcaaaatggaactttactcatggattactttacttttctgaatataaattatagaactctaccactgtacttttcaatctcattgaactagccaaacattaacaagtaattgcagaattgcagaaagcgcataaagcaacattttcaatttttttttttttgccatgatagggctgtgttaaagtcaggttccctctgttggctgagatgagtgttgtaggtctgaactttggcaatgtcaacaggttagttttcgcatgctgttaccccactacctctcttacttcattactctcctttcttctacctcctaaaagaactttatccttggaaaagaactgagccttgattctgcaacatagtcctggcagggaagaagagctacttgcatatcagcagtgaagcttggttttccttgatctggatgtagagagcccctgaccttaatgacacatattgaagagacagggctagcgagaacagctgcttagctaatcacaccagcagatcagctctggtctcaggggtgctaagtagagcagccagctcaccctcacaggcactgctctgcgcacaccctggatatcttgttcacatttcttttctgcaataatagttcttcattcattgtgtaccgtaaggatagatttcatgagaaggaaaaggcaactacaactcaagttttgcaaaagatatttgacatttctgaatttcattaaggaatttgattaaggaatcaagcaaaactgctgattctagtagcctgagcgtgacagatggtcagtttttcatccctgggtattaacagcctcattcctctctctcttctaaggttccttaagatctttcctggatctagtcaaatcacttgataattcagaggtgattctgtcctcttaggtactaggatctgaatatggtgcctacagatgcagacatttggtgtcagtgatatagtgtgacaggaaagatgtcctctaacagttagataaacacttagtcctagtgatcaagaagatttcatttaagaaggagtattaatcattgggttagagtgattctctcctgctccaccctcagtctgtttaagacagaatttactctttctgaactctttgttgttctaatactactgctttaaccttaaaatattctaaaaatgttttgctatcataaaaatttagcttaaataatagtttgatgatggtttattggttcaggcaggctttactaagaacatctaagatcaagattgccttctgttttctcaaatatttccagagagggagggtttgttacttttttcagccttttaatgactctttcagagcacaatcacttgtgagatggtttgtgcctgtgtcagtgcaaacctaaactagataggccttctgccatatattcttggccaacttatgttacttccttacagtgccactgtgaagagggttgccagtagcccctcttgcagcacctgctcagcaatgtcataacttgaaatattttacgacctcattggagaacctgggaagagggtaaggtagaaaggagactttttgattattttggagagctgccagtcctttaggcgggtggcctgaagagggagtaaagacactcagggtcaagggttctccaaggtgacactgtaccattgttccaagtctggtttgcaaaccttaaatatttttagcccaacagaaagaaatgtttctaaaaggagctttgctgtccatgtacccctaggaatcagaccatactcaaagcaactactgtcaaacaggattcatctctgactttgaactcttgtgtggtgcttcttggtattagtcccttcacactgcattttcctctcttatctctggctctctgtattatattcacttcagcttgtctactctcttttcacctgcctcttcaaagtaaataggtcttaaattaccttcatctttcaacactttgcaccacatcagtcccttctaagagttcccagttgcttctttactcagttctaatttggagcccctactaatttccccttatctcttcctcctttctgtatatacagctaacaacaattgagaacttattgtatgcacagcatgaacataggaaaattaaagcacaaagggtgtatcttttcagctatccaatgtattaaagatattttgataccatgattgagccatagaatttttctgattgcccatttattaatttgccttattccatttttagaccaattgacacgataatagcgaataaggcaggacacacagggttgttgcttgaagaagcgtatttcaggtaaatacatgcatcacttaattactctagatttttggttcttcagatttcagttttcttgttcactgctgtatttgcagagcctagcgcagtgccagacacaaagcagtgacttataaatatttgttaaataagtaaatatatgagtattaggctgataggacatgcattctggacctttacaacttaaaagtaacacccaatctgagttcaaaataattttaaactttatacatgtctagttttttaaaaatgctttatgtgtttttaatatgctttaaaaatgtttcaaaacatgctttaaagaaaccaaagtcttcaagagacttaatctttaatttaccttatatcttaaaagtaacccccaatctgggttcagaataatgtttacctttatacatggcatgtctagtttttaaaaaaaatgctttatgtgattttaatatgcttttaaaatgtttcaaaacatgctttaaataaactgaagtcttcaagagacttaatctttttttttttttttttgagttggagtcttgctctgttgccaggctggagtgcagtggcgtgatctcggctcactgcaaccttcgcctcccgggttcaagagattctcctgcctcaggctcctgagtagctggggctatcagcatgcgccaccatgcccaactaatttttgtatttttagtagagacgaggtttcaccatgttggccaggatggtctcgatctcttgacctcatgatcagcctgcctcagcctcccaaagtgctgggattacaggcatgagccagcgtgcctgaccgagacttaatctttaagggctgagaatgagcagatattcattgttttaaatacatgtttattggtgcccactatatcatttaaaactgatgctcatttgttctcttgtgagtgaggtgagctaacatttagttatgctcaatgctaaatgcccatatgttcagtgtgcagagtgcaggcttcagagtcaaattcttctggtctgaaccttggagggctactcactaactctatgacctgggaccagttatttttcctctctatgtctcagcttcctcatccattagtctgtaaaacggtcagaatcattcagcaaacctcacagaattgtaatgaaaagcaaacaaattagcattaggtaagttctaaagcagcagcagaaacctcgcaggtgcttgttaagtaaaacagatctgtggaatgtatctaataatgtccctacctcaaaggatagttgtgaaaattaaatgagttatctccaaaacacttaacacggtgccttggtacctggtaaacgctcaataaatcttatattgctatgtttaatagagaagacatattaagatattataaaataaacacatgtaacaccagagaacaatgaagtgatgtgctcaatgacatgagttgtaaataaacctagacatcagaaaaaaggaagaatcacttccctggaaggtgagagaagatctttcacgacatcaagaattagtggggctgggcgtgttggctctcacctgtaatcccagcactttgggaggctgaggcaggcagatcacttgaggtcaggagttcaagaccagcctggccaacatggtgaaaccctgtttctactaaaaatgcaaaaattagcctggcgttgtggcatgcacctgcaatcccagctattcaggaggctgaagcaccagaacctgggaggcggagtttgcagtgagccaagattgtgccactgcactccagcttgagcgacagcgcaagactccatctcaaaaaaaacaaaacaaaacaaaaaagcattagtgggaggagaataacgtagtgagaggaaagagaatttttcaggcaagaactgaaggcagcccatggcccagaggaccgaagggagaagaggagaaaggaaaaagtgaggaagagtggtgtcagggcgcagcaggaagttagtgctaacgagctggatggggccaagcaatcgaagccctgagaagcctgacagcggtgctgggagttgggcacgcgcagcagacagcatgccaaccccgaggtactcaggcagtgtggtgtgcaaggccctgtctcttcttgtttgggttgccctggccaagattgtctcttgcaatccgttcacatgcgttccagggcctgcatgcttaagatcccttttattcctgcttgatgccctttggctcaagaatttactactcagcttttataacactttcttaaaactgcctttcttctggtgaatggctgtgccccactgacagttttttcctgaaaggaaatgataagggaggaaaaagctccaactaccccaagtaggcattttataggcgcttgtacaaagcttgagcccttgtgtgtgcctcacttcctctctaatattttctttggaatgggagcaagtcatcatttaaaaaataacaatgataatggactggatcctatcaatgatccaaggtcactaaaattctcttgctatatcaatcctttttgagctgccaggcttcatctaaaaggtgcacctcaagtatctaaaggacacacagtttattttcagggttttaaaactcagtcaagctggctaaaggctgagtatataacaaactacttttcagtctttgcaggccatgatcttaatactcttccatttcagttttgcaacaattggcgaatcagggattatcactttggttacctttattcataggtttacaaaaagaaatagtcataaaagagttggcagttttgaagatactcatatatacaaacataagggtcatcgtcatggagcatattgcattggctattgcatttgctcctgaaatgggaatattacgtatggaactttacagaaactatatacatggggaagattatctccagaaaattaagaaagccctttcctaaaggctatagtggttttacagagtgaataaaaggaagcgagagaaagaaaattgctgacttggtatagctgaacttaataagtgctaaattgctaaatagtagcatcctagaatgatatttatagaatattttgtgtaagactttatatgacctgtttttagatattattcttttggtttggccctcagaagatcagagaaagctgggtggtggaggggtggtggggggagaatctgtattattttgttttagggttgtttgacatttgagcttattaattaactctgatgccttccagtgaattctgccaactcactggacaatttctgtataaatgaggtgggtcagaaggcagcattgaacaagccaagactatgggccagcttacgttaactcatttaaaccttaccatatccctgtgtggtcagaattatcccaattttataaataggggaaaaagggctccgagagtaaggaataatgagttgcccaaattcttatatgactcatgagggccatgctaggactcaagccctgatctccccagcacactggactctttttttgcatgtggtagctgctgagacacattctcttgccttgtctctcctctagtctcataatggttctaagcttcccaaatcattttaactctgattctttaacccacttccaaattataaaaactgaacttatttcacatttacttctttcaaagaatcactcaacatcctacactaatctttcataaaatggattttgtgatcaagtaagtttgaggaatacagaacttagcacagttggccctgtgcggtgggtcacacctgtaatcccagcaatttgggaggtcaaggtgggtggatcacttgaggtcaggagtttgagaccagcttggccaacatggtgaaacccccatctctactaaaaatacaaaaaattaaccaggcatggtggcagatgtctgtaatcccagctactcagaaggctgagtcaggagaatcacttgaacacaggagatggaggttgcagtgagccaagatcatgccactgcactccagcctgggcgacagagcaagactccatctcaaaaacaaacaaacaaacaaaacaaaaacaaaaaaacttagtacagtttaccaatttctttcacaagctatttattcatgtatttattcatccttttattctgggagaacctctcaagggactagctttccacaaaactacccatcttggtagtgtgtcatcttaggcaaatcactttacctctttgagcctaagttttccattctacatgttagactaaagatactctaaaggtcccttgagctttaaaacttccatgatatgggccccacccccatgccaaatcgaggcttttgtgctaccactatgagtttgctaaggatagcctaagattttctgaaaaccatttattcattcattcatggaacatttatttattaattgtcaagtactgtgttaggttctgaagatgaaaagacaagacataaataagacaaataagataaactatctatctgccctctggaggggagacatatatgaactggtgatttaaaaaaatacataagagaggagtagaaatatgcataggtaatactgacacacatgaactgatgatttttaaaagtctcagcaagagagaagtagaaacagttataagtaataaagactcacggaggatctgcctcctatttgtgggagttgtgtaaggcctagttggagagagaacacccaatctgggtcttaagggatgcgacaaaggaagggaaggtactccaggcggagagtaaacaggaaccaaagaaagcatagggagtttaaacagcataatgtctgcagtgatctaccagagtttggcactgctggaatataaagttataaaattcaagtcaggcgactctgagcataacgtcgtaggagtaggcaggggctagatattgagggcattctctgtcagattcttgaacttcatcgaagtgtgttagggttgaagagttggagccggtggaagacttgaagcagggaagtgacatgttcacagctgcattttatactgttgtgttgaaagtagatgcaaagagagatagggagacaagtttggagaccactgaaggtgttcagaggctaggtaatgagtgtctggaccgagagaataatggggaagcagagaaaggaatggatttgagaaatatttagtatttagtaggtgtaatctgctcagtctggtgattgattagatgaagagggcaaaggagagaccatcaccttctagtttggatgattaaatatttgatgtcagtataagaggaggtgctactttatggagaaaaatgaagtgatgtgattggttttgaacctgctgagtgtaaggtctctctaagacatttgcagatatcttaaaatttggagttgttataccacaaccccattctgtgcatcaaactcaaatggaggtttcattttgtgtagaggacttacatttaaggactactccatattgctgtttatttgatttagattgttggaatattggaaataaatggcaattttatttttaataaaatatgaatatcaattaaaatcataaataatttcattgtactcttatttaaccacagatttatgaagcaggcaatagacagtgtttatacttattggtttaagtctcgttgtttttaagagtacagtcagcccacagcgagactccatctcaaaaaaaaaaagtacagtcagccttctgtatatgtggatctgcatctgtgaattcaacaaaaaaattccacaagttccaaaaaccaaagaacttttcacgcaccaagtactacattgagttcacatgaaatgatgtgtaggtattgtatcaggtattaaaagtaacctagagccgggtgtggtggctcatgcctgtaatcccagcactttgggaggctgaggcaggcggatcacaaggtcaggagatcaagaccatcctggccaacatgatgaaaccccatctctactaaaaatacaaaaaattagccaggcgtggtggcgggcacctgtagtcccagctactcgggaggctgagtcaggagaatggcgtgacctgggtggtagagcttgcagtgagctgagagcgcaccactgcactccagcctgggcgacagagcgagactctgtctcaatttaaaaaaaaaaaaattagctgggtgtggcggcgggcacctgtaatcccagccacttgagaggccgaggcatgacaatcgcttgaacccaggaggtggaggctgcagtgagctgagtgagatcgtgccactgcactccagcctggtgacagagtgagactgtctcaaaaaacaaacaaacaaacaaaaaaagtaacctagagatgattaaagtatgcaggaaggtatgtgtaggttatatgcaaataccatgtcataccattttatataaggaacttgagcatcagtgcattttggaatctgcagaaggtgctggaaccaatttcccacggatcccatggcactatatgtattgttgaaagaaaataaacctatacccactggtgtagatttatgttttttactagtatgatcaaacacaatttaaaaagttttctttttaccaaatccttaacatctgcgtagatgaatttaaaagattataaactggccagacgcagtggcatgcgcctataatcccagcactttgggaggccaaggcaggtggattacctgaggtcaggagtttgagaccagcctggccaacatggtgaaaccttgtctctattaaaaatacaaaaattagcctggcatggtgacagcacatgcctgtagtcccaactacttgcccagctacttggatggttgaggtaggagaatagcttgaacccaggaggaggaggttgcagtgagccaagatggtgtcactgtactccagcctggttgacagagtgagactccatctcaaaaaaaaaaaaaaaaaaaagaaagaaagaaaacgagattataaatctacttttctgaacttcacatatgccaggtgttccaagttctacaatacctcaaagccaagaaactaactgctcactttcccagccgtcatggtgaactgaatcattttctacatggctcttctcatttctttctgaatgcactatttaaagacttccagctgaatagattctgcaggatctttctatgggttaggaatatggtctgcataggaactggcccaaatattcctcactggacattgctatcagcatgaaccagatcccagtgtttggggctctatcagcaagtaggtctatacatactggaagcaggtgacgggactgttaagggaaaggggggctgatgaaagatgagaaataataaatggaagaaaaaaaagtctcttaccaggctcttgttgtattttgtggttgtttttaaaccaagtgatctgaggctcggggacaccattagcatgacagtctaaagtggtggaactgctgatggccactgtgtgatcactgaggtttcgcaggaggtatggtgcttcctgatctagtgaagaaagaaagggagctgtgattactcgtcaactttattcttgtattgtctatgcatatcaacatttaaaatatacagagaaacagcaaaactcaactattaggtttcattttcatttgttcactttctcttcaatcattaacctgctgcttctactttaataagatgctacgataaattgaaatttattacaacacagtgaaatcaaggactagattttgtatttttagatttcaatacaaaggcttttgcctagctagctagtttccttcctttttttgagaggagcttttctaaaactcaaggattttgcataatagtttagaagctataaatcaaaaacatgattttgtgtatagtcttgtaatgatttttatataaatatatagtgctgtagtgataggctaatataattttgtgtgagttttgattgatgtatttgtgggggcgtgtttgtgttactcaactgtcagtaacctaagttgtaaggcagcagaccaaacaggagaatttcttgaactttgaaagctttattggttctttcctttctccattcccttcccaaatgcaagcaaccaaagaattaattcaagaggcagaggcacagatttgtagtttttgcactatataatagtacaaatattgtattttatattattttctcttaaaacatacaaatatgatacaatacaatttattttaataaaatgccaaccaatatagtacaacaaaatgaattcaatacattaagatgcaatacattacaacattaaaatcccacataagaacagcagtacccccaaggcccccaatgagtacagtatatctctaatgaagtagtcagtcagtcctgctgatgtgtatacattctagttaggagggtactggattggtagctaaagcttccaaggtaaaaaataaaaacaactcctaatgtctttcccaccctcccaagtcattcctttcccctcttgttggaaatcctggaacagaaatcaaaagagttttggcataactgacacgttctctgtcactgtcttcaattatacagtatgagctttctctgcccattttcgatttcctcatcttagtgtactaaaactgtgaaggcagcttaggagtgatgacaatgctacaaagatgatacattgcaatggccttaattccatgtccctgcagggttctgccacgtcccaaaacctttcccttttgagtcctgcagggcaactctcaggattagcatttgttaaagcaatttagaaatcccaggttaaaatgtatattatcacataaattttataacattgttgaagtagtatatcatggcagggttactatctgttaggagaaacagatttctcaataaattttgatttctacagtttatcattagtcttctcattttataaaaaatgaaatctgaaggcaaaaaagtgtgctgaaggaagtgctctgatgtacaaaaacttcttcaaactagtgtagaatgaatgatagcaatgattcttttgcctctttgagcatgtctttcctatcttatcttgcccactaagcagaacgttacgatatttctgtttttgcattggatgctatctgccaaacagcttttcctaattgaaaatgcagtcctgtttaaaacctttgatttacgactacttgtacatgcttgctcattacaattttgacattttttacatagtgaagaccccaaacatatcagtgaaacatgacaagatcataaagaacagtatcatattattatttagtcgcttttacagtggcaagccaattttgaaatatctcatttaaaactcagacccaattcactgagttatacttttaatagcttcctcagcacactatttcccatgcattaaatatgataaaataatctatcactgcccatcggtcttgtaaaaaggaagtctgaatacagagcccacaacactaaaattgtttttctagctacaaagtatagcatcatcaacacagacacgatttggactccctgacaggtggattggaaaacggtgtttaaagagaagagaacattttaacataaatgtcattaagaatcccaaaggccttatttgtactacacaaacttcagatgatagaagcagcaaaaaggctgcagaacgtacatgggactctcaattaaatacaaggttcacataaacactctgaaatatacagtaatatgcatttttctttgtacccatttctgaaaaatgttctacattaaaagtctcacttttggctagtttctaaatgaccaatcaacccaagaatcatattttgtcaattcttactttatacattataataatctattttgacattttgaataagggaggtgcgttgaacccatatttcgaaacctaagttacttgatggaagtaggtagtggctttccaaaatttaacagtgtagctgatcccttcaaattgagaaaatcagaattaacagacatttctgctggttatcagtagccaaagatagctgcccaccaggttctttcacttttcagtgttatggccccagagatctgccaggtcacataaatacacagcttctatcctccgtttggaatggggactgaggaaccagcctcacaccccctgttccatttcaattattccccattttaggctccttttttctccttttttttttctcccccctccgttatcttcacctcccttcataccccagggtaacatacccctagggtaactaataaaaaacaaaacccacccaaaagtttctttaaaaaaaaaaaaaaagactctccggaaggattaattacacagtgaacaactaatactctatggaattcttaaactcatctcttggaagttcttaaaatcatcttttgtaaatactaacatcctcccctccccacaaaaattgcaaacaggggaaggaaatggtaggttctgcatgtccaattcaccattttgttttcataaggatccctcaatcattctgtttgcttttttaatgttagcaactattaaggcccccatgttctatggtattaaggcattgtttcctgaaggaacacactaacttataatgaacaaagaagccaggccaaagagccataggtaaaatttcaagatacaattgatttttctttcctttgggctgacaacttccaggttactaattgttttcagagcatttggggctccataaaactggcattctggggaaatgctattgtttactctttcacgtttgacaaaagcaattcccacgtgaaagacaagtttagccgtgggacagaatctgttacctaaaggaggaaacagtctggtgagttcccaagcttgagaagttgtcatattgtcacctcctattgaactgcccagccactgtgtttctcagccatggctattttggtcattatagtttttttttttaaatagtttatgcaagtcacatataatgatcaatcataaataaaaacaacagaacaatgcatattaaattggtgaaaaagtcattttccctcaaacgcaagcttaaaacaagagattacaacttctcttgatttaaaactggtgtgtattttttaaattactttgaattctgcttctgtagttttgccgcttcttaatccccataaaaatcctattaacatttgcatatggggaaagtggacttttttaaagggcaaattttaaatttacatttagaagaatgcattaaatctctggttacaatagcctttatttccttgataaattgattgtggtacacctttgaatgctgtcattttaacatgatgaagttccttaaaataataaccagaggacaggaatatttaaaattaaggcatgatccactttctttcagctgccatcaatagctgtgtggtgcagtcagagacagcaaggagcaaaccctttgctaggctagtctactgtggcactaactgcataattacctggatcgcatgagaggagggaggggacgttgatttggatggactcttataattcacactgcgataaacctttactatctctgaattacaccaacatcttgcacccctggggcccattttagaagctccagttcaagataaatgtgcttaacgtaaaaaaaaaaaaagcattttcaaataaataagcattataacttgctatccaggtgctatttacaaatcaagagcagatgaaatagtcccaaataaaaccaggcagaagtccgacagagtctcaaattcaactgtactcattctgagctggaaaattaacttattcgtgtccatctttggcagaaaccagcatttgtttaaattattcagtttgtgcagcttcaacacttaaaaataaaaagaggttggcatcaaaatggaaggaaaggatcatcccaagttgttgtttatcaggcaggagaaaacagcaagagcaacaaacacagagaaggcagtgcagggatcctccaaatccaaacgtgcaccaagtcggccccccggagcagccccctcggcctgaatggggggcccagagctggggcccgggggtctcattattactgctatcatctccgaactcattttgggaggagcatctcctccgagcctgaaagttagcaacagtgacaataaatcaagatgatatgagacaactgttactttttaatgagtcctttaatgttttacattactttgtgtggtacaatcattccttgtgcttttaaatttggagatccgagagaaaacagcctttttgttgcagtgctcacctctgattgtaatttctttcttctggaggatttcttcccctgtgtatacattcctggctctgcaggcataggtgcctgaatcttgcagggaaacattcatgatggtaagattaagagtgatggagtgctccttagtgatggccattttttgcttgctaatactgtagtgcattgttctgttattaactgtccgcagtaaaatccaagtaacgtctctgtataagaacttgttaactgtgcaagacagtttcaggtcctctccttccgtcggcattttttccaagttaacatgaaacccatttggcacatctataaaataagaataaagaacttcagttcacagaaaaatcagtgtcttttaatgagatattcaaagatcttaagaattgttcgtgcacaaattatctcagtatccacattaaaaaggatgagtatttggggtaaatgagcaaacacagcaggtgggaatcaactaagttcattccatcagaagtgaggtaggaaatgcaaaacagaatagttattaggatggcattttctcctgattcacgtgaagttgctcttcaaagtggcatattttctccaacttggttgttaactttatttccctttttttttgaatcagggtcttgctatgttgcccaggctggagtgctgtggcatgatctcagctcactgcaacctccacctccagggttcaagcgattctcctgcctcagcttctagagtagctggaattacaggcgtgcatcaccacgctgggctaatttttgtactttttggtgggggtgatatttcaccatgttggccaggctgatctcgaattactggcctcaggtgatccatgctcctcggcctcccaaagtgctgggattacaggcatgagccactgcacctggcctcatttcctatttttaaaatcatgtacagtattcctactggcaagtgacactggcaagtgggcaaaatagtgaagtaacataagagcaattcatcctaaaaaccaaaggcacacttacggtcaaacttatccaaaatagtttgcgaacaagtgagaataggaagtcctaggtaaagtgccaatcaattccactttagtcctagacttttgcagtgagaagcaactgttattcactatcctcctcctgctcctgtcccagattacttgccctggtccagcaaagaccacagtgggccagtggcacagtgggccagagaggagcccgctgacttactcaggacttcttttatggggatggttctattcagacctgagagagcaaagatttcttctgaaaatgcggacaactaatctggaagagttgccagattctaaaatgggggtgatagaggggtaaagagaataattttaaaaatcaaatttactctctaacatattttaaacatgttctgaaggtggctatgtcattaaaagccattttctccaatgtcgattcccagctaatctttgttataagaaaataagtcttgggaccccaaaatcactaagctaaagggaaaagtcaagttgagaactgcttacgacaaacctgcctcccattctcttcaaagtcatccctctgctctctgagacaaatgcataccttattgcctcctttggaaaggctaatcagaaactcaaaagaatgcaaccgtttttctctcacctatctatgacctggaagccccctccccacttcgagttgtcctgcctttccaggcggaaccagtgtacatcttacatatattgattgatgtctcatgtctccttgaaatgtataaaaccaagctgtacctcaatcgccaccttgggcacatgttgtcaggacctcctgaggctgtgtcacagacatgtgtccttaactttggcaaaataaacttcctaaattgactgagacctgtctcagatattttgggcaccttcatctccatctcccaggtgtctctgtcaacaccccatgagctcttcccctccgcatgcctaacctgggccatcagttcactttggggctgagaatttcttagtatcattttggcccagtctcacgggaggattttaaaaagtctgccggccctgaactgacccgctctcaaaaccttcccattgcttattactagtggtgtatctgcatttgagcaaagaatttgggccaacatcttacaaagtgctttgaagatgaaaagcattatgttatgctattattattattatactttgcacacaaagctataaagaaacctttaaacgttaaggggacaatagtccaaaattagatatcatatcaactctttcctaaatctcactttgcttgtttttctgatttttctgagctttggctttattataaagtgtcacgtctgaagaaatgccaaagtattcatttggaacctgggagcagggcgtaacagtggcttacgaagccgtcagtggctgaggagagaggataccagtggaggttttcctgcttttaaaatgaaaatctaagaatgtgccagaagatgcaggaggggcagctgacagtcacttttaagataacaataaggtgtcagaaatagttgctctaattcagcatctttttatatttgggccattttccaagcatgaggagtaaaacatcagccatcaacttttacacagatagtagagcagaggtattgtgcactggttgcaatcaactcttacaagaccacagactttccatttatgagctctcatcctggtagttagaacccaagtgagcccaagtaacaccattgagatcgtgtagagagtttctatttactttagtgatttgaaacttcctgtggaaatagctcacaggtttcctgatggaagattttgtttatctttgccaagcaccaccaggaatctcaaaataaaatgcatttagtgacattgggaaaccagggagataaggcagtgctgttcctgtttcaccctcagtaattgctaacacacccatagtcatgctgagtgccagcaaaacagcaaaaacacacacataggaaaagcaaagaaccaaattcgttttgaggcctgtttcttatataggggacatggtcactgaagctaatttgttatgttatcagacagccttttagaaatgactatttctcagtctcacccctttggtattctcttttgatccatggaagatgataaataaaaatcccagagggatttttctccttaattcatgttgacttttttttttagtctgagtacaaaaacagacccaagaaagaattgccttctaaccctcaaagtgaaaacaagaaatcttcccacacttaagtatctgtggcgaattcagcacagtcatcatcattaccaaataatactcatccatctaacatattatcacatccatggcatcttatgaggtgtcatggagaagaatcaacccttgctcagaagaggcattcaacccagggttagacgaaagtgtcatctatttataaaggtgcatacttgggggtagatatttcaactcaattggatcaggcatgtgcattaagttcatgaaagggacaagcataggaatttaaaaggacgccagggatgtcatttgttgggtaaaaataaagaaggctctactgccaccgaagagtggaaatattacttaaaaagagagtgaatggttaccaggaagttctgcttgtttcaagtggatgctatgtacaagtgtgtgccaaagtttggagtcgaagcggtcaaggattctaatggccacagtttaccattttcatcaatttggaaggcaactcaaaaaaatttttgtgtttgtttttgttgttgttgttgttttgaggcaggctctcgctctgacactcaggctggagcatggtggtgccatcatggctcactgcagcctcgacctcctgggctcaagtgatcttcccacctcagcctcccaagtaggtgggaatacaggcacgtgccagcaggcctagctagtttttgtattttttgtagagacaggattttgccatgtttcccaggctggtctcaaactcttgtgctcaagcaatcttcccatctcagcctcccaaagtgctgggatgacaggcgtgagccattgtgcttggccccaagtaactgtattttaaagaaggggcaacaggattgaaatgaggaccagtaaagatccaaatctagataagaagagcgttaaaattttagacaggcacttttaaagcattaccctcactgagtcaagtataaacactgaacaaatatatgttcatttttttcaaaaaataaacatatgaggtacaacattcatgagtctttactctcatctctagtgacaaagatttgagtgagagaaagataataattatttaaaaactaataatgaacgtaagcaagttaacctaatatcacaatcaaaaccagaacttttcaggactggtagaaaaggattaagggaaagtatattccaggcaatgagggcttggttgactggacttgtgtcagttttaaagttaaagctcttggatttctagaggaaaagaactgtgagcttcaagtaggtatgtctgaatcgaattctcattttgtatggataagccttgggatctagaagaggtttccaccccgccatggttatacattgtacaatatggtgagaggtaggagggaatttctgcctgaattcagcaggagatcacctttatcaacttgggccctttcagcaacaacaccatgggtagaaatatgatgcagcgatgagactctgggctagccagaggttggtgctgtgactaatgctaggcatcagttagctttcattgggaacagtgattaataaggaagtgagcatgatgttccccttttctcttagcacatcctcttccagtactgccctcagacccaggcaagaaggatccctgtcgcagctctgttctggtcgcagctcttcccacaatgtgaagagtttatggggccaagtgagcatgcctaccgacagcctgtgtcactccattcctatatcatgatccaggtccctgggatctcagaattccctataaggctgatttaaatctgcttctaggttggctcttccctaggtctggcctcctgagatcagactgcttgtcagtattcacacctttgggtctgtccaggcagtggccaaaggagactatctgtgaggggcatggggagagcttagatgtgtgggctgggagacaccacacatggtgcatggccccttgcagtgtggacagggtaaggggcggagaggggaggtgggtgatttagtttttctgcacggccaggtgctgccacaatctgctctggaatctgagtagtctcagagctctaaattgatcctgacctctcaggtcatcatgaaagtatatttgtccatagggggctaaaaggtatttaatggcttgtttgcttgatgtagaacttgtcagtagttagacgtatggtttgtgggcctccactggtactcttgtcttggctctgaaaatgtcagggcaagtctgttttcttctctccacctattcaaatcccaccttctctcttcctgttcaggtcctgcttccttctcagaggcttacagctgcactgtccaatatggtaactgtgagccacatgtggcttttgagcacttgaaatgtggctactgtgtcagaggaactgaagcatattcagtttatttgattttatttaaattgatttaagtgtaaaaactgaagcagtgtaatatttttaaaaaatactgattacatattgaaatcacaatagtttggatatattgggttaaataaaattaattttacttttaaaaaaacgtggttactagaaagttttaaatggtatttgtggcttatattatatctctattggacagtggtggctttagaaagcaagctcacctgtcacattacctctgcacataaattttgatactaggatatatgtaatttgacatttcttgtttgtttccttggtgttagaaacctgttcctagaaagacaggacttcattgatgttcctccaagtgctcagtagagttgaactgtaccatttaacagtgctgattaaactgttacaaagttattgaatgttcagaacaaaacaggaatttttcagtcttttgtattctaaatcagacatactacgactatgggttgagacagtaacttgtttccaaccaaatataaaggacagtgcaaacctttgtatttaattagtccaaatcccatttgctcatctggaaaatacaagagctatgatgcagaatagcctctagaatccctgacagccctgacgttctatgagaatctactcagggatatctcccatggcacagcttctctggggcttggctaacttgccagaggcccctgtgatctgacaacacatatgtgtcatggaattggacatgtctatttctttctggagaacttttggcaatttctgcagcctgccccgggcagtgagaagtttccagaaagttggcttactgcccatgtttcctcagaaattgggggagtgtggagccaggcaattgtttttatactttgagctacttacttccttcctgtacccattgagggacatagggagtgccatttgtgtaccttggaggtttttaagatttgcagagaccatcatatttaaggctaaaaattcttaaatgctatcaaaaaatagcacattaactattgttaataaagctctgtttcagattgctacagagcctcattccccaaaaagtctaaattacctaagttgtaaaaaaattaaccttttggttaaaacaaaaacaaaaccaaaaacgatgtcatcatattatatgcattataattggtttccttgattggtattgaactgctatgtaccagaccctgtgctaggtactgaagggaatgaaaaaatgagcatacaagattcccaattcataatccagtctgggagggagacaaacacaaataactctaaaagagaatacagggaaataactccttacgagatccgatgaggtagaattctattcctgagagcaaggatgaaggcactcaaagtttgacaattctatggaattaaaaaaaaatcactcaagctataaatgcactaaaagcaaacaagactgaagagagaatgaagtcaccaggctgtctctggttataggatgtgtggcttacctgtgatataaaagcttatgtttcttcccacagtcccaactttattggaagctatgcaaatgtagattccagaaattctagagtcagccacaaccaaggtgctagccatctgcaaaagaaaaggaaactttagctagcaacaggacaaataactaattgaacaccccaagctacttctgaggttgaaatgattcagctactccattcattctgcaaagagagtattgcataggtggtggttaccagaaggctctccccttgccgagccccaacaagaatggaaaaataacaggaaagcaggtcctcaggagaccggggcctatgacatccgactcatatgagggtttcaggcttatttatctcgtgctgctggcgtaacaattacagacctgaagctgagatgtgggactgcacgtcctaccctatgaggtggtcagttccacatcaatgagaggaacaggtgaggctgaggccttcccttttgtttgggtgacctgagagcatagatgccagttataacaggagccttctctgctgtttggttctataacaggcatgttaagtgagcaaggacagaagataatgtttggctgaaacttttttttttttaagaaatggggtcttgctatgttgcccaggctggccttgaacttctgggctcaagcagttttcccgcttttgtctcccaagtagctgggacaacaggcacatgccactgtacctggcttgaaactttttttctatgctcaaataatgtggcatgcagcactggatggtcctgaaggagaccgtgtgtgtgtgtgtgtgtgtgtgtgtgtgtgtgtgtgtgtgtgtaaattacctaatttctcttaataaattaagtatctattcctaatctagaagatgaaaatttaaattatgaattaatgcaattatattgttccactagactttagtgctattatttgacaacttagtccctaaagaaacattagcagtcaaaattgcatgaacttgaaagcactttccaaattctgatgtctaaaaagtaatgaaacaaaattttagacaacttaaagacttgcattcttccaaagaaaaaaaattggcaatatgaaacaaattgttaaacattcttaaatttaacccaagcttgcattaaaaagtagtgtataatctatatgaaaaaaatgagaaagctagtttctcatacttaaaattatggaaaagaaaagttagtccagttacttataaatctttgcagcctatgtcctaggacaaaaataactggttatgggctttgaaattgcagaggctgtgcaaatgattccagactaatagagtgtccttgctgaagtataatgacaagtgacttacaggctaaagtaatgtaaggctgaaatgtgacagctgactttccaaggtggtggacatactctacaagtggtttggctgtaggagagagtcctaacattttcttgagtttctaagtaatgtgctaggcactttagttgtgttctcttatcccatctaataaattaaggtatttctgtctttaatctacagatcaggaagacttaaacacatgttcctcatgtttttagccagcaaattcattggtccaaattctctacaattttcactgtggtatagtgagtagtacacagtgctttctcttctgtttgttggaaggatctgcttaattacacctacccatatactccctgtgtattattgaaattattggtaatgaaagtgtctgcaatatgtggcagacaatttagcagacatttattgagtgattatcaaggcattgcccagatgttgtaagagagacagagatgaatatgacacaatccctcccttaacattatcattctttaaggtgatagagaagaatttccctccttgaagatcatacaaaaattattctctcttttgcaaggaaagcgcatatgaaggcaaataatccatgggaaagtgtacgaaagagagctcaggtgtcccttttcttattttgatgatgaatctttttaagaggtgggacataaaaaattctgaatagccatttccttgtaattgttgtacccacccgtttagagtcacggaaggaaatggaagtagttggaagagaagcttgtaggtggcaacatgaaagaactgttagctggtggaagctggaagacaggagagatcgtcaaatacgactctgactcccttacattgtctcaggaagcttagacccttcaaagcagtatgcaaaaaattcagaaacaaggagctcagatgaagcctttttaagctggggtgtcagctccagcactgttttttttatgaagttagttctcaagtgtttatcctaatgggcctcaggagaaacttacttagattctcagattaattgttgctcagtaagtaagtgaaaaacccatttctgttggcttgggagtgtttgaaattatggacagcatttatctgcatctatgagtcatgtttgggtttttatttaaaagattttgatttcattgaacttagagcaaccgagaacaagaactgggtttcgtggcaagggaaaatcaagtcagatgtatacatttgccacatttaagacctgtgtaggtaacctgggaatggccgtggccattttacaagtccccaacaaatagtcaaataggtccaaatttatgtataatcagagaataaaactgaggtgccccgaagtgaaatgaatccgggtcacaagatggagacagaaatgtattgaatttttcttcttttgtgtgaatgacaccttccaaacaagacacattactcgtagtcaagcctgccccagaaatcatgtctccaaagcttctattaaaatagaagcagaaaacaacgttgatgggagtttacattatttctttgtttctgcgaacctttatgtatgccttacaatgcaccaggcagcatgcaaggcactttacaggaattgtctcatttaatcctccccaaaaccctgtgagatgggtatattaccctattctacaggtaggacaactgaggttccgagagattagatgattcacccaaagatgcaaaggaccacagacaggcctgggcagaatttatgctcaggtgtgtctgcctccgcgcctatgctcctaatctctacaccagattgcttctcgccttgagactctttaagttgaataacacagatctattggcaaaattctgtctacacctttaattgaatttttccttgagaatacttcctttaatccgcagagatgggtaacataaattaaatactactactatttacagaaatactagttggcttctctgatgacattttacataagctgcaagctgctcttcaactgttgttatgtggtttgaaaatatatttgataaatacaatggttatcactaaagaagaaaagttaaaaataaggtgaaacatatcctatgatcagttttattaaaatttatctcatttctagagtacttctctttcaggggatatatttttaaattataaattcaaacattttctcattaaaaataaaattatttgacaattaaaatttaaactttatagggccagagaaaggagctcaggtgcaaattgtagatcagtgtagtctggctggactagaaggcagctttgcatgagacagtgagtttcaatgtctgagtcttctgaataaaggaaaaaatctgttcctcagtccttatatccaaatactatggtgttaagggaaaaaaacgaaaatagcatcacagttagggcatgcaatatcaactaaatactttcaaagagaaagtaaccaagaatttgagttgtgcgtttgaaattataatcatttattctataaggtatgcaaaaataaattcttaaggatatctacttgtattagtgctataattagttttcattttccacaattgaaaataaatgaaagaggactgaggaagagaaaaaagcagaagtgctgaaataaaattagactattaggcctgatgcggcggctcaggcctgtaatcccagcactttggaaggcagaggtgagtggatcacctgaggtcaggagttcaagatcagcctggctaacaagacgaaaccctgtctctactataaatacaaaaattagctgggcatggtggcaggcgcctgtagtcccagctacttgggaggttgaggcaggagaatcgcttgaacatgagaagcagaggttgcagtgagccgagatcatgccaaaatacataaataaataaataaataaataaaattagactatcaaattttatattagtcttaaaggactcatgctttctactcttcatttttactgcttttgctttttgtggtgcttccagttgcctggcctggccctcaaggatttacatgttagagacagatccttcaagcccattctctaggctctttggtatgacccaggaatgctcataaaactatcagcaagtactgtaagtttggagtttttcatgttccttccttccttccccttcactaagcattagtaattcgttactacaatgttgtttgaacctcactgaatagaatggatgggctgatgtgtcattcagcctaattccagcactcgttttttaaacatctatatatggaacactgattttaatctcgggatgtttctaatatagcttcctttcaagtgtttcactgagaaataaaagtagatgtgtaaaggtcatggaagaatctaaaattaacacagggtggcacatttgagccaactgatgggaaaacagaacgtgagatttagaaaaaattggggtgtgtgtgggaactgaaacacaagctgtaattctgtggttaggattcttgctcctgtcatggatttgtctcatacaggacacatttctcaaggtacactcagaaggatttcaatggaaatattgctaacacattaaaatggtaatgattctccaaccttacagaattaatgctgtgataacgtatttcctgtgtgttttttctaacacggggttccttctacttcctactccatatctacaaacctaacagtttggcaacaccacttagacaatacgaaagtgcacatttgctactagcaactccagttgatgactcacttttcacaaatctgggccaaaactcgccaataaggaaactaaattttattgtcctctatacccttccttaagttaaacaaaaaaatacaacaaaacaaagaaaaaaaatccaaggtgctccagcgtgagtgtgatcgctgccccactgatctgtggagtagcattgctgggcaggctaccatgtgacggtggataaagggatcaccgcagtctaagctgggactttaatttgctttctaaaaatgtatagaaaataaaaacagttttaattgtgaaggaaaaagcactgcatataattcagaaacagcaaaacttccattttgtcaccatcatatgacagatacattttttcacacccacaaaaagatatattagtagatgctaaaagtaaaattactaaattctcctaaattcaagatatgaactcaatcattttatttaaagtctaatatattacaattacaactgctaatgggatatgtaccatatatatagatataaaatatatctatatatatagagagagagactttgtttagtgtgagtattaaaagttttttcagtgcaaacaattgtttaacaaagtcttcattgtatatgatcacaatcagtttagggaattgcataagggtacatatgacattcactttactaaagtagtacttgtatagggctttctcattatgttatgttatgttactttacgttacgttacgttatgttatttatttatttactttttgagacagagtctcactctgtcacccaggctggagtgcagtggcacagtgttggctcactgcaacctccacctcctgagttcaagcgattcttgtgcctcagccttccgagtagctgggattaccactacgcccggctaatttttgtattgctagtagagacggggttttgccatattggccaggctggtattgaactcctgacctcaggtgatccgcccgccactttggtaggtgatcggcttaccaaagtgttgggattacaggcatgaggcactgcgtctggccttcattatgttatttcatttcatccttgtaacaggaagtactagctaaggcaagtatcattagttctgttttttttggaggaaagaactcaagctgagagaggtgagctggtttgtatgtggttatacagagaggaagtgtcgtagtttgactccagggctcctgatggcaggttgggtagcacaagtgcagaggtctatatttaaaatcttctgcgtaactgtaaaattaccagacaataaatttgttttaaaccttcatggagaaaatcttgggacgttcttttatcatgggcatgttttgatactccacctccactgatttttataggtttttacattatatatggagtcaagttgccacttcatggtttgggttagccagaaacttcacctagctttctcatttttcatttcatttcctattgtatatttttgtggataggataccaaaatagcactagaagttaccactgaaattaagcttataaattcttgtgttaatatccggcagttaacagtacatcctcctgacatggtcaggaaaaagcaaaatgaattgacacaaccaatgaatggcatcttgacatttttctagtactttgtgacaactaatttgctgttcactgctaataaactgaggtagtttccttattaaaaatatctgaaggccgggtgtggtggctcatgcctgtaatcccagaactttgggaagccaaggcaggcggatcacagggtcaggagttctagatcagcctggccaacatggtgaaactccgtctctactagaaatacaaaacttagccaggagtgatggcgtgtgcctgtaatcccagctacttgggaggctgaggcacaggaatcacttgaacccgggaggcagacgttgccgtgagctgagattgggccactgcactccagcctgagcaacagagtgagactctttgtctcaaaaaaaaaaaaaagaaagaaagaaagaaagaacaaattaaactttcaagtttatataacttcctctaagtatttcattaaactgctctcttatcaatagctatacatcacggactgttttaaagtactgcttatttctgtcagagaaaaagagttgtaaaccacctacagctactgctatagttataaaaacttcctaagtgtttaataagagactattggtgttatcatataagctattgccactctgactaatttctacagtggcttacttggctataagggcattaggttttgcaaaggaaagactttggtttgagtctctcatttatacttttaagctgtctttgggttaatcatcttatcttccctgttttatctttaaaatagagataaccactctcatctgccaaagaatgatggtgacattagcatatgtcaaaaagtttcacataatgaaaattatagatgttatttgttgttactgttaaatcatacatgaggaacgatgccatctactttgtcatcttcaagtgcaaagtgtacggctgaatagatgacataagcatacccacactcaagcaggcagtggaatctgtattaacagtctctactccaaatcaagaaatatatatgtaaacagacatgtcagcaaggggatacttgatatgttttttctttttaaaagaatcatggctgggtgcagtgactcacgcctgtaatctcagcactttgggaggccgaggcaggtggatcacctgaggtcaggagtttgagaccaacctggccaatatggtgaaaccctgtctctactaaaaatacaaaaattagccaggtgtgatggcaggtgcctgtaatcccagctacttgggaggctgagacaggagaatcacttgaatccaggaggcagaggttgcagtgagccgagatcacgccatcgcactccagcctgggtgacagagtgagactccatctcaaaaaaaaaaaaaaaaagaaaagaaaagaatcactatccctgtgccagacaatagcagatttttaagtgtattctttactaattcaacaggaaaaagccactaggtctgagatccactgagacttgcctagctgacaggcttgttagctattgccaagcttcagtgggggttaggggagtataaaatgaatagtgcgctgatgaggtcaaggaatcttgatagattgtgtgtgtttgcatatccccctcaactcaggctttgctcttgcagacagagggaaatacatgatatttcacaaaatagaaacattcagttttagctctaagtcttgcactagcttttgcttactgggatcccactttatgtacatcagtgattctcaatccccgttaggtactggaatcacctgggaagattttacgagccctaggctgcactccggagatttggatataataataattggtagagtattctaataggcagccaggactgtgaaccaccaatgtggaccagtttgatgttcaagtggacagtgccatctctaccattaggaatgagtactcattatgttggaactggtagcttgagtagtctctgtgtgtatctccatgaagacatagctcagatattgtctttcttctctctgaatttttgtttgaacatttaaattacttctggtgccaataaacctagaattgggagctgagagtgtatttgtggaataaatatcccagtgcgcatttttacaaacaataccttattctttccttctattattgccatgcgctgagtgatgctctcaattctgtttcccatgttgctgtcagcatccaggataaaggactcttcattattggaacaaaagtcacacctattaaaaaaaaaagttgtcacaatgtggctttacagcatggttcagtcaatggggacaggtgaaatgaaaacttggtgtaagtcctcagataacaaagtcacaaattttatgtgtgatcttcttttccttagattttttcctatattcatcctcaaaacttaaaaatagcaaatatatttggctgatacttgaaaaaagccccacactagtgtgtcaccatacatccttttcgttgtaaatgttaatattaaataaaaatgcataaattagaaaatttagtatctagattttagtttttagtggaagtaacattcaaacacggaaaaaatgaagttatgttaatgaataaaaaactcaaggaaatcataccattttatatctataaaaggctggcttttaatcagaatatgcagttggatggctaagtttttccagggctaattaagtgcatatggaaatcaacatcatgaaacagttattaaattcagtctctctctgctcaagttttggggaactgttcaagctctcaggcctcaagtgtttaattataaaataaaggtgttgatgttatttatctttgaggtccatgaattctctctctgttttaaacatttcaccattttgcattctgactttctggactagaatttttttgagcagaaagcttgctggtctctaatttgcacatgtcttgggcagattctacagattttttaaaccaagaggaattttattattattattattattattattattaatattagagacagggtctcactctgtcacctaggctaatgtgcagtggtgcaatcataggtcactgcagcctcgaacctctgggttcaagcaatcctgccgcttcagcctgtagctgggattataggctaagtgaaattttcaagcttcatttccagaaaaaaatgagtggttcatctttagcagccaagagcaggaatgacttatgtgagaggaaaatgagaggctaaagtcagtgagaaaaaggggaagacagaagggaatgtggtcagaaaaacgttccgttactattcctccctggtccttgagctgagaaggaactccagagtgttaaactatcgcatctgcaggggtactggccctgtaacgtcctcctgcagagtactcaccaccttttaagtgctgacttaatggttctgagtccccgctgggccaacagctacaggaggacaggggacaaatcgacgtattcactctgtccccatagctaagcagggcccgagcatgccgtcggcgccccataaacatttgcacacatgcagacaggcacaaggtacccgaagttgtttttgctaagagtttctactttctttaattgtttattattatcaaacacaccgataagtagagagaatagtgtgatacacccccatatacccgccacccagatttcacagttatcaagattttgtcacattggtttcatctaccccttttttttcttctgtattttatttatttatttattttaaaatttttctagcctggccaaatgaaggatttctgtgttttaaaacaaatctcaggcatcttgtcattttagccctatgtacttcagtgcatctctctaaaaaatgagcaaatttttccaatataaccacaacactacttttatacctaagagaattagcaataattccgtggtggtgtttgcacctaaaccgtatatcagatttccccaaatgtttttaaagatgtctgtcttacagttagattacaagatttaaaatttaaaaagaatgaataaaaggtgaccattcctcaaggaatttctgcagtttttaccaggtataaccttataataatcatgaggtaaaataaatgaacattttaatgcttattgataagtagagtaaactgagccaaagagaaattatgtactttctcctttattagaaacatcttaatgacaaagtttaaaagtcattatatgagagtcactttgccttattttttcattatcatattctccattttctagactataacatccccatgttaatcttgcgttagacttgctatctttcacacactcgtattacaggtatgagtgtatataatgtgcacatatacacatgtgtatacctagattagacatttgcatatgtacttgggattgtgacatcaaacagctaaagttctcttgtatctggaagacaagcttttagattgtattccttttcccccaaagcaaggaaaaagatcggggataccttagtcaaagatcttaatttcatactcttgggctttaggaaatgcaaagaaatatgttagagtaaggcaagcctgggtgtttctcaagggaaatacagtctgctatctgagttcacttggggctgttgacctctgacaccccacacctcccccatcccacacccatgactctgagggcagttactaagggcacaagccctagtatggaaactataggccagacttattgccagctcttccacataaaaaggacagattctgtggctattttctaatttaggggctgttatttttccctctttgtaattggggctataaaaatagaatgtcatttagaagccttactatataacagcacttgaaaagagatttagggggaggggaatgtgcctaagccttaagaatacatcaagctcttaaggaagtagattgtgccatgtttgaagatgcaaagataatcactgtgctgggaactgtcttgaggggggaggaagccgaacaacaagaggaaagcagcgttcgctcctgatttcgcacaggaagtccacagcacctcctgccaaagcgagataagaaagctcccatgcactattctggacaaggccactgttatcagcctcagctcggcgctgtcctctctttgctccaagcctccgtccctttcctaatgagctatatgactcctacctccatttgcatacagcatgccaagtacaatggcagggaggtatttataacccctgaaaggaaaaaaaaaattatgggctaagagtgtactccatgtcatctctgctgattgctctggacctgaaacaacttaatttcggactagagattgatataaataaattaaaagaaagcagccaattatgtttccaacacatggagctaggacctcatgtgtgatatgtcagccttctacattccaagtgggagccatctgtggaactccccatctggtctaagttactagtcttcttctcttgacacattatgggaaactgccaccctctatatatgcagatgacactactgacctacatgctttgggttgattttcttgtaacagtgatgaatttgccctcttcccaccacactcaaaagtatttggcttctctgtgaccaaagacagatgaaggcagtctggggccacagaaaaaggcaaagccaacagaggtcaaacctacgatctttctttctttctttttttttttttttctgtcacccaggctggagtgcagtggagcaatcttggcttattacagccttgacctcctgggctcaactgaccctccaacttcagccttccgagtagctgggactacatgtgtgtgccatcatgcgaggataatttttgtatttttagtggagatggggtttaaccatgttgcccaggctggtctcgaactcctgggctcaagcaatctgcctgcctcagcctcccaaggtactgagattacaggtgtgagccaatgctcctggccaaacctaccatcttgacagtattgactgctggcagaatttgtactcagttctggatcatttcagaacctgtgcacttgaccccaacaccataagtaacatgatatccatgtactaccatcatgtgacaagaaattattatgcttcagtacttcttggacatagtaagaaaagacatctcaaatattcagtacacaaataccattactatgttgaggattccatggctttttttttttttagctacttttgcataacatggtcagtctctttccaaaatttgctaaacatctctcatctcacacaaccaaaatatgttgaatgaccagtgcatgcacagtctgcaattacagtttatattacagtttctatgagagctcactttgtcaccctgcagttcctgaattcaagacaggttccattcacctttacaaatccaacactcaatgaagtataatgcacaatgcacacccaaaggtacccctttgtgttcacctgtgctttttcttaattgctggtttttaacaattcttatttttagattttcttcactcctcctgccttcctctcccctccccctacttaaagctcagagctggtactttctttcctttagaggatagattgtcacatctggtggaatcagaagggaaagcccagctgggtgagcgttagctactgatagtaagtattgtgttttctttgaagtggttctcttgtgaggaaatgatcgattctcttggagaattgggtgggatggttcaacacttcatttagcctttctagaaattgcccatctgtttagtgcctgttatggtacccaagactcctatagcaatccagtataaaattctcatttcataaatgatttcctgccagtctaataaccacattgattctagaaggtctgctctacagccttagtcttaagacacacagatttttttaaaaggatcctctttcaataaatgatattaagctggcatttcaaatctctgttgtgccaatatctgattcttggctgcttgaagggaaacaagttttgtgagctgctactatgtgctactaaagcttgggctagaagcaatacacattttgcctcaattagttctcacagtcaccctatgaagcaagcattatgatccttatttcataaatccttttatcaataaggaaactgagactcagaaaaatcaaatgctttgctcaagttcacagggaaaggagcagaattaggatcagaacccagactctcctaactcttcactatcccagagctctgtgcatcacgtagggtgacttctgatcccaagaaacctccccagacctttcccaccatgggagaagtctggctcagagtcacctgttacagaggaaaactctggggggcctctaaattcaaactagcacaaagtcagacaccaggaaaattaaatttatgtttttaagagggagaaagaagatgtgcctgtctatcggtggacaaggacaggggcaaggggcagaagactactttatagttacatttttggcataaattctagttcgttttggtcataaacatgctttgatggtgaaattataggaactctttaccttctactggctgatacattttatcattaaaaaaaaaatctggccaggcgctgtgactcacacctgtaaatcccagcactttgggaggccgaggcaggtggatcacctgaggttgggagttcgagaccagcctgaccaatatggagaaaccctgtctctactaaaaatacaaaaattagctaggtgtggtggcctgcagtccagctactggggaggctgaggcaggagaatcgcttgaacctgggaggtggagtttgcagtgagccaagatcatgccattgcgctccagcctggtcaagaagagcgaaactccatctcaaaaaaaaaaaaaaaaaaaaaacttacaacaaaataaaaccatccaatatttatcacaatttttttctctccttggtaacatatttttgtctgcatgctcagtgagcatgttctgggatgaagctggcctgttttattacaaactccaacactagaatgagtggcccggggacaggagtgtgggtgagtggtgatttgagtacccaacacccgatggctgcctatttgagccagagccattgtctgggaatgaatgtttatataaatgtataatgaaagcacatttaatttggcaacaaagagggtccagaaagttctacaaagtctcaagacagataataatctccttctctttttttcttttttggatgatgaaatctgaggacttgtgtgaactctgcttatctgtttaatgagattgtactgcacgtgctaactgtgattagaatctgtttgtaaagaatattgaatcatttcaagctaggaaacaaaaggatagaggagtaatgaaaagcaaattgaagctgtaaaatgtcttttaaaaaaataggaaggaaaaaaaagcccatctggaaccctgccagagggcacaaccggggctggcccccattatggcggccatcctgtagcagggcctgatgtaaacattcctctgctactgtgggtgtcgtgtcaaaacattagcgattgtgtgtctgagccatcagattaacagaatctgcaaacactatctttcccccttctctttctttttctctttctctttctttctttctttctttcttttctttctttctttctttctctttctttctttctttctttctttctttctttctttctttctttctttctttctttcttctctttctctctctctttctttcttttttgagacggggtctcactgtgttcctcaggctggagtgcagtggcaccatcctggctcactgcaacctccgcctcccaggttcaagcgattctcctgcctcagcctccagagtggctgggattacaggcttgtgccaccacgtctggctaatttttgtatttttagtagagacgggttttgccatgttggccaggctggtctcgaactcctgacctcaagtgatccacccgccttggcctcccaaagtgctggggttacaggagtgaggcaacatcccaggcccctcacgttcttttttttttttttttttttttttgagacggagtctctctctgtcgcccaggctggagtgcagtggcgcgatctcggctcactgcaacctctgcctcccaggattacaggccagagccaccacggccggccacgttctcttaaaacagatgaaacaatataggagagtggatgctggcagaaaaaggcgtagcattggaaggagtgtttagacagaatggttcctgctcctcttgctccaggaaaagggcctgggccttcagggtggtcacagggtcaggctgaggagatcctggaggagtgactttcttgtgcagtgagagaccttgtgacgccttggagctcatactgaaaattacttcttgcctcaatggagaagggggagtggagaagagtttcgggggttgtgggctttgggtcggctccctggacaatggtggaggggatccagcgtcctgggccacctctgtttagataagagcttttccgtgagcgtcttggctcatgctgcttcctgctctcgagggccctgtggtccattcacactcagaacatggcccttcttcccagcctctgcttttccttcctcctggctccttctgctggcttctagagtgagtgccagcaatctccccgccctccaccccccaagccagacactctctccctcccagctccccactctccttcacacagtcttttccagggccaggggatcctcgtggccccgcactggggtaactgaaaggctaaaagagtgggtgtttacttggctacacccagataggagcctcacaggatacctattttgttcattcacttttcttcttagtgaaggactagttggtgaggaagggtgatttgagaaataagaaatctttaaaaaaatattaggagtgcctacaaaaaatatcctttaacacattcaagaaggaggcttaaaatagtagctgcattcactcagtggagaatattttaagctatcattatattttgttctcacaaaaaggaagagaacagcttacttcttatttagtggtcaatactgaaacatccagaaagcttttgggagtggaggtagggaatcacaggttagcataagaaacatagatgttagagctagtcagacctgaggtgaaatcatggttttataacatcctagttatgtaactgtggatgtcaaaaacctgactttgagaatcgtagtcacagaagattgctcagagggcttaccagtcttgttgatttcttgtatcattctaaaattttgtccttagatcacaccagcccacaaaatcacttttaataaattctgctttggtgctatgtcattggccaacattgagggatgttagttaccagagctgacactcactgtggaagaagtgtggtcagggagtttgcctactattagtgtcccgcagcgtatgagagaagaaatcatttctcttggatctcagttctctgaaaggtatcttatgagccccttaattttgcaaatgtttgtttcacttcttctcgctcttgacaactggaaagtaaagcctgtgggccgtaactccatactagtcttacacattttttgacttcaccaaggctgcttagttatgtattgtcctttttgtgaactacctcaaattctttgggaatggatgtgttcttagcatagccaactcaaaaaagcaaccccatgctaccatgtcttactagttttattacaggcactaaaaatgcacacataagggaaataatttaaataaagaattgaaagaagattggtttgacatcagcaaatattagggtgatacttaatgtgtaacacacttagcacagtgcctggcacacaggaaacaaatcattaatgttagttgtcagtttattatctgatttcatcgagagctacttacgtatggacagggactatattttgttcatcattatagctttggtgcctggcccaatcacttgggaaacagtgggtgagcaacacttgtcttttgctcagttaactccctgatgaaagagtggatcctgccaaagaatggccagatgagatgtggacccaatcacacatcagatgtcaaccctacctcacatcagatgtcaaccctgccatctacacttcaatcaagtgtgctgaaaaaggggctctagtgactgtcaaatgacctcacatacacccctgacctaagcactatgtcaccaccatcagcacctctccatttgcaatgatgaatattaatggatacatgggatctgccagggccctggctaacctcagcacagcagtgtcagcacctgacaaacccatagtcatggacagtttcaactcaggcaaggatgctgacatgcaaagcagtgtcatccagtctaatggcaaataggaaactgactggcaatggcctcctcttcttgcctatcttcaaagataggcacaaatattggcttgtcaataatagcaccactttgcccgggtgcggtggctcatgcctgtaatcccagcactttgggaggccaaggcagacggaccacctgaggttgggagttcgagaccagcctgaccaacatggagaaaccctgtctctactaaaaatacaaaaaattagccaggcgtggtggcgcatgcctgtaatcccagctacctgggaggctgaggtaggataattgcttgaacccgggaggcagaggttgcagtgagccaagatcgcgccactgcactccagcctgggcaacaacagcaaaactccatcttaataataataataataataatagcaccattttattcaactaaaacagagtttgctcactcctatctcatgtaagatgtaaaatcacaccccttgcaagaattagatgatttaattccttctgttatttagaaacatatatgtttattgaagagacaagtcaaattcatggaaacatatcagaatacaattgagcacaggcaagtaaaatgacaaaagcccatatactactataggctgaacaagacttgggtgattgaccatttgaatagctgaggtagaattcaccaatgagagtagatccttggatactgtaactcctttgatttcctaaataatctgaaacagccaccatttctggtcccattctgatttctttggaataaacagtcagaggacctgtcccaagatgcaaatatatttcctgggagaacattaacctaatagcatggatcatcttgtcaggacattagtgtgtatatgatgccacttcagagggaagtggctttgcagtgggcagccccagagctgcctaaaagtactagaagtaccaggtacctttcagcaaacaaacttagcactcgcaatgtaccagccactgtgctgagtacttcacacctattatgacatttaacttcctcaaacaaccttatgatgtcagtgctgttaactccatttgtagatgaggaaacccagactcagagaggtggtttattttgcccagaatcatacagccaatggatgccagtaggtggcagagccaggactcaggcaacagagcccacgtccttaaactctaaactatgttgcatctcttgatgtcaccacactggttttcaggattgtgagcttttgatgtcaccctactggttttcaggatcgtgagcttttgactaaaaatgactcattttaatgtctaagtagttgtgacacaaccaatcctggtagtgacaaatgatatgctttcaattgcctggttgatgttgtgctggaaagctgctcactttcaggctctttgacatgttaaccaggactagtgtcctaataagatactcaaactctctacctgatctggaaaatggtaataattctagcatttctcttagagaagttctgtgataattaaatgagatgatgcatataaagcacatatccagcacttaacaccacataggtaaatgcttaataacttagctataaagaaaataaaaataggaaccccaggctatacagcctctatcagccaccatcttctattatatttggctctagatggtctttaagtaccaatttttgttttcctcatcctacgtgttcaagtacttttttcatactcacaagggctgatttgtcaataaggtagcaatcagtgatcatcttatataattttcaatgatgatgacaaggcaaatggaacattaaagacctaagaaattggaataacatgcacccatgtaatgttttttaaaagggtgagtgaaaacccaagactttgattttcaggcatggagggtagagtttctgagatacagtgcgcatactgcaggctgaaggagtgccacaggtagaagaccaccaataataagtctgtgaaagtccatcagcctggaaggagggacaaagtgggcttctggccaatagatagcagaacatccaggcactagccaggtagtgactgcctgcctcaaccattcagcctctactgaaaaaatttcacatcaggtccaaaattacctttccaattttggtttttattttttctcaaccaaatctgatgaaccaaccacattcatctctggcaagttcttttcaactttccaacccgtttgtatgcctgtgttactgcatcacatctttgtccctctccccttccatttaactttccaagatctacccatcctcttcagggcccggatcccacctcctccttggtgcggcctctaaactgcaacattcaccatctaccacccatggtcggctcgtttggccagattataagcacctcccatggagactcaatacagtgttatggtggaaataatagtaaacaggaaatcagagacatgcatctagtcccgagcttgccattaagtagctgtgagatgagataactatttatctttgagccacaatttctcacctataaaacaatctctttttaaaaattaaatctttaacattccttaattccgtttttttttttttgagatgggggtcctgctatgttgcccagggctcctgggttcaaacaatcctcccacatagctaggattacaagagcacgccactgtgcctggctcaacattcttcaatgctgagtgaattaatcgtttgaagtgactaggtcaaggcatgccgaggctgaaattagcagcctctatgtccccatttcattccctcatcaactacaaaccctcatgtttcctccttcattttcttttgacccctccttttcatctcctttaattgctctcctgactaaatagccatgagttttgtgaggcccactgagggctgagtgcttgctgaatcctaatccaggacattaattctgaacaataaatgagagaatggggcttccctgccctgcaagagatcaaatacccctggatggtgggaaaatcacagaaaaggacaatacgaataggggaaagtgccacaataagcaggcccattaactgttagttagacttgccaccctcctgaggctggtcttatttagacctgctcatcccactggagtttatactccagtttctactcccaactgcagatctggggcccaagacagctgtaggtcatcactggttctcaaagatatcatgaaatttgagcccaattcacctatttgctgctcgtctttttctcctttcctctcccatcctctgctcaactctaactcaacagatgggtcagctctaactcacgacagacaagagcaaacctaccaggttaggcaggcgccctcccaaacctattccctgcagacttcagctctttcctctgggaatccacagggatgtcctctgaggagtcctatgggacaccagggaaaaataaccttctggaagaccaatctatctagccccttgtattttatttatttatttatttaagacagggtctcactctgtctcccaggctggagttcagtgacgactgcagcctcaacctcccgggctcaagccttcctcccgtctcagcctcctgagtagctggaaccataggcgcatgtcaccatgcccagctaattttttttatttttatctttttgtagagatggggcctctctatgttgcccagaccggtctctgcaactcctgggctcaactgatcctctcacctcagcctcccaagtgctgggattatagtcatgagccactgtacccagccctccccctttataccataatctgaaaacacctgagaaataactccctgagcttcagttttacttatgggaaaatagggcaagtaatcaccattccgtaaaactgttgttcagattagagataatgtgtgtaaagggatgaacatggcttttggcaccaaaaatgacttattgattaagtctatcacagctattataatgaagtagaccattgcattcaaggtggcaaaacgtcctaggaggcttctagagaaagtatgaagaaacaagggctagtgattagaagctcattaaaaggcactgtcagggccagagtctaaatccatcatgccctttccatcttatcaatccaacaggttctgctttgtcacctaaaagggcactgattttacattaaagtcacatagataccatattttaagaaacaatctaccaagtcagtgaagatatactaaaatgtagatccccaggcagaagtgcatgttttataagtgatttgttctacttatctatcacctaaagatcttgtgtcaggacattagtttctagattcaataataaaaatgctcattcaatttttaaaaatctgtaaatttggccaaagacaatctgagaggttctgccaatcttcttaaggaatcttcacaaattttgtgtcactatcttctggtaacctgagaagctacactgaatcttgctgaaaagatcactataaaaaccatccagcggccgggtgcggtggctcatgcctgtaatcccagcactttgggaggccgaggcggatggatcacgaggtcaggggatcgagaccattctcgctaacatggcgaaaccgcgtctctactaaaattacaaaaaattagccaggtgttgtggcacgcgcctgtagtcccagctacttgggaggctgaggcaggagaatcacttgaacccaggaggcggaggttgcagtgagccgagatcgtgccactgcactccagcttgggcgacagagcaagactccgtctcaaaacaaaaaacaaaaaacatcccgcatagatttcctgtgactcagccttttagtttaatttaaaacacataatgaaatgtttgatagcaattacaggagacagttaactcattagaaacaattattcatcatattcactgtattactaagaagagtgggaaaaggaggaaaatctcacaaagcagagaaaagtggcaaaggggcctttggcaaaagaactcatgctctgttctcaggactttgtatgaaatattaataagggctgttgtccgaacagtcacattaagcagcatgcacttcctcgtccagtaattatataacagaatgcaagaagtttctcattagtaagtgaacattcacttttggcttgtgatgaaagcctcctgtataagatggccagttttatttggctgtttgttcaagctcaaagtcctgctaaagtggtctttggtcaagtggtcttctttaaagtcctcattttgattcaaggttttgtttgtggtaaattaaaattctctgtagcatggctgaattgaggctgcatacccagacacacactgcatagaatatatgttgagacacatggatggatacaaattgtatgtgtacttaggaagaatgtgatcaatattaaaacatgaggtatgtgaccgtatttccaaaagaagaggtcttaaattatagcttccctcagacatctgacctacattttgcccccaggaaatgttgactttttcaatttttatagtgttaaaactttcattgtgtaggtggaaaataaaatatgggacataaaactgttacagcataaaaataatagacattcatgttggcagtcaattaaatttgggtctttgagtacatttctaattaactaccattaacaattgtcttgtttctgtcctgttaattttacataccccactgatgcgccaaactatgtttcccccaaatgatctatccctaacacatccctaatgactcaggccctcctttctttgccaatttgctgacgtaaacaatagagaaatgcaattaggcaagcccctctcggaagcccttctcagagttcctagatgcctctgcttttctgtgatattgtaggccaccccaccccccatccccggatggaaggcagtaaaccacccttactcttagagtggtcagctttctcttgacaccatccaccccagccccccatagtactctactgctggtgcacacgaagagtgtttcagacatgagatgtcacattgtcattgagaatggcgggaaacattattttctagttaacttctaaagcatgtaactattttagactccagtcctgacctacttttagagttttgcaagcggttccttgagagtccatgcatgtctactagatttttcttagaaaaccccccattttatctaagaaagccaaaagaataatgttctccctcaaccttccatgagttgagaacccaacatttttcacaccctgaagggactcatctgcagaagagcaaataaagcaggcaaagctttagagctaactgggcagagaatgagcatgccttcatttgtttgggctggatcgaggctggcaaggtggtccaggttggcactgcggaaaatacggcttggccccaatggtggaggagctgctgcacttttttttttccttactgggcccttattaacattataatcacagagtcagttttgtatcacagagtttgtacctccatttaagacttttctgacagccattctactttcataagttgaaattttctgttaatttgttaccgatcctcagagttaatggtcaaattgccttacagtttacaagaaacagaagggaaacatcagtgtgcaaacactgggaaatactttcaagcccttttgaaggaagaaaatataatttacagtgattttctaagttaactcattcatagctgtgtatgataggaaaggggaagcacgaccattgccatttacagaaggggaaatagaaacacagattaaagaactggccaaggtcacacagaagtcagggacggtgccaagaatagaacttgcttccttgattcccaattctctatccttgggaggatgtagtagatattttacagatacatatatagatccaataagtaatcaccaaatatgtttaatcttgtataatgcaaacataaatgctaaagacaagtggtattacctttatgttttacacgtggttggtgcctaataaatatttgtgtgatgagcagatggttgacagtatatttagattgaatatcagtgacgtgccaagttgctttgtaagatgtcagcaatattaatgcaatgtagacagaaatgtttctctacatattttgactagttatcacagatagcttataaagaaaacgagttttttcacaaagaacccgatgttacctaagtttttttcccatgagtggggaataacttagtacgtggtacaactctgtctattataatcaatcagtgttacttcttcctttgaaactatgatttgtgataattatatagggagagagaattaaactggactgtgatctaaagaatgtgtgctctcaaaacaaaactgcagtaatcaaaggctgcaggcattgaacctccctagaataaagacccaaacacattcaacattttagaaacagatctttgttttagaaagaagaaaagacaatccagaaacaaccaggtggactctagacacccatggaggaggtgatcagagctcatgagagtaccaggaaggagatcagcagaagccccccaccatcccgtttgtggggaacagatgagcgcaaagacccattcaggccacacaattgtccagtcagctacccgagggtctccttggtattcaagcacacgtaaagaaaagtagactttcaacatcttagattcttcctgagaaaacagtgatctgcagcacaaactgattatgccaagactgtccttgccctatcctctcctgggttcctgaaatccaccctttccattccacagagaaggtccccttccctccagtcctgtattattattgttcctttagaaaccaaccaacctccttgccatggacaatcttatctaaatagtatctcctgtgaggctgcatcagtactctggcagagttcatggaggactgtaagatcaagcggagctcagtccttggggggtttactcgtactacttagttgttcaaaatgcaggcggaacgtgaagttctagaaattgaaagtggactggctgagcaggcatcagctcccccacatgcccagtcagcccaccccagcctcagccaacccacagggcagaaccacttcctctcatgacaggaaaccaatgaatggggcaggccacacgaactgggagaattacttcattccctcatgacacccttccatttactcttccttttacttttgtctaactcttctgtagttccttaatttttcttcttctgaaaagtcatattttcctgaattccacagccaccctccaccccagacctactaaattactattcttaaagcacaacaaaactgcattttacattccataatttgcattcatttcttagaaatgtttggcaaaactgctcactgttgtcaaactagctctatagtaggcagaaatatcctttaagttcattaaaggttctcaggtcttatttaaagaaatgtaccccaatgctagcaatgattacaaccttgcaaatctgtggtgctctgtaactttctaaatacattacctcattcgatcctcatagtctctctatgaagtgtatatcattatctttactttatatgagcagaggctgcaagctatagacatgtggaaggcactatatgcttaacatccttatgatgctctctggctttttgctcagactcatgggagcaggtttaggaatatctatttagaagtctacctgttggctgaggatgagaaaaataaaatattccaccttattcagtgttgataacttattttggtgttattaatattcaaaagagatatcacagttttattatcacttttcttttctttctttttcttttttttctgaagcggagtttcgctcttgttgcccaggctggagtgcagtggtgcgatctcagctcattgcaacctccacctcccaggttcaagcaattgtccctgagcagctggaattataggtgcctgccaccgctcctggctaatttttgtattttaagtagtggcggggtttcattatgttgcccaggctggtctcaaactcccgacctcaggtgatcctcctgccttggcctcccaaggtgttgggattacaggtatgagccactgcacctggccccactttcctttttttaattaaaaaaaaaactaaaaagggaaagattctgctttatttcttcttggttcattacctgtatgagtttaaaagtaatcatcctttccctcctctcttttattcctaatgttttataagaacaaattctaggcaaaacgaaagccacaatattactcagtcaaaacttagctcgccttcatagcatattttactactttttttttaaagggtgacattttcagttgaactatcggtagttataataacttaacatatttacatatttattagactctaagacactaaataatttgagttaggtctgaacctctttctatagtagatacattaactgtctggccatattaaaccaattaatagttttgagctccttaaacaagtacattctgtcctcaaactaagcgaatgctttggccgtggatatacatagatacgccctttcactagagcctaaaatttaaatgccaggaattattctacgtatttgagagtaatgtgcatatattagtcacccaatctcttttgatgatcatgtatagacaccagtatgcaaatatgttaccatataactcaaaataagtgcaatggagcatttcttactcatgtgttactaaaattcctgtctacaactgaatctaagttagtctaagtgtatataaatatgtttatataaagacatatttgagaacttttggtaattaaagagggtttcatttatctataaattttagcttcatctctctgagagggtgaaagagtggttctgtttattttctggtgtacaaagtttctacatatatttctgaaacacctctaagttaactgtactgatttaaccaccaagcaccaaatctgggcctcacacaggtaggctactcaattagtacctgctgactaatgtacatcgagctgtcattcttgtacatcaaagatgtgtacgtttttggcagataatttcaagcagcaacgtattaaagaaataaagcatatgcaaccttaaacttccatttgtgatcagtcttgtaagtagtgaaaaaaaatgccttgaacagagaataattcaaatggccaacaaacatttaaggtaatgctctgagtcttgagaccattctgaaaggaataagacatgttttcaggccttggcgaacttattccatcacacagaagagagatcccttacaccacaaagaaattggaaagaaagctaatgtttacaaagttccattcgaggtggcctcattccccaaaccatattttattagcatcacttaaacccaaatttataaatattatgttctatcaccataattgttattttctaacatagttactagttctaatcctagatagaatagaaattttagatttaatattgccaaaacaaaatttaaatatatttagaaaaggctctgttattccagaaaaattcaactctacacttttatccgaatctaatagcttcaattatttagttttttttttatttatttgcatgttaggttggcacatatgtcaagaccctaaacggatgggtcgataaatattgatgcataccccaaatttgcaaaatagtatagaatttcagtagatctcactgtcttatgtgttaaacattcacagtggtaaagaagatatttaagatttgtaagtcttctctatttctattcttagaaaatgacagtcaaatgagaaatcagatgtgtggaaaacagctacttcccaggaattccatagctcaccagtaactttccactctgagagtaatacaccctaagcaaaacgagttggaattgtgggaagaatctagaaaatcaaatagccacttctatctgtttatgttaggattatgctttgtttacttttcctgtcaatctttttttttttttttttttgaataacaatcctcctgaacactctgcaagtggagttaaaagtaataaggaaaatagtttggcataatgataatccttgggcagtttcaataatatcttattgttgcacctatcaagtctattcctgttcttcaaattagctcccataaactatccttagtatcatccctctagactaaacaaaaagaggaaaaagcaaacaaggctcagtcatcaacaggatgcaaggaaatgctgcacaattagcagagggtagggatgtattcatttagcaaatatacactaagtatctactgtgtgccagccttggcccagcctaaagacacaagggtgctctcaatcagctcttagcttagagagagacaaacctttgcgcatcgagtgatgtaacaagggcgtgaacaaagtgctgttcatactgagggggaagaagtgattctgaatgaggcagtgaggagagttcacagagaaggtgacgtaagagctgagccatggggtttgataaataaagccctcttaggaggcaggcaatgggtggaggtgcatttcagacagatggaagagcaaagcccaaaagtaggaaacatagtgatcactggtgttgggaagaacttggatcataaccaaagaatacaaaatgaaaaatgggaatgctaatgcaactgacatagtggtattgccaaagtctagggatcttcagttgagaaacaggagaccagagttccaacctgagctcatgtcacagctcatgggaggaccttagttttgtgcttgtgcttctaaaactgtaaactagagagaaaaattatgaaattgttagccagtgatagggtatattcagtaagaaagaagagtagctgttgcccacctttttccaaggcagggagagcctttgcctcaaatatacagtacatcccacatgcagattcccatctgcgtccattaaaaaatcttaattccaggtgtcaaaaagtatttgaaagttagtaaaaaaactgactgtccctaccttgcttcggaatgattatggttacaggggtgccagaaccacttgattgtaggttgagggataccatatgcggtacaagtcaggatttgtctgctgcccagtgggtagagagccgggtctggaaacgatgacacggccttttcgtaaatctggggtttcactggaaaggagatgaagaacgggacagaagtcaagagcagttctaatgactttctcctgggccacacatgaaggaccacattctcactggctttgatgtcagggaaacaaacaagaaacaaaaaaacaaataaaccctcctatttgtcaagaaaatgcagatttttaaaagtagtagcagggttttgagattattaataatttgattccatggtatgtacattgtgattacagtgataaaagatcatgccgcctatggaatacaacaaacaaacacgagattgttaagatgggaacttaacgttaagtgttttttcaaatgattatttgaaattttgctatctttgatgttgttacgctgatttttgaattcataaatgttcactaatttgttgcctaccagaaccagaagaaagtatgaacagcaaacttaccattgacaattagagtggcagtgaggtttttaaacacatttgactgttttatgctcagcaagattgtataattccctgcatcctcttcagttacgtccttgataattaacgagtagccacgagtcaaatagcgagcagatttctcagtcgcaggtaacccatcttttaacctgtggttaaaaacatgatcagtaagtcatttcacacggcctctcaatatcactttgataacacggtcattgaagtttttgagctcaagttgaccaatttcaaacctttgatcatcagtgttgatttttaaaatgtaggcattaacttttgagtaaaggcagatatgatttttagactgggtaacacttcatatttattggcaaggaagaagaaataaagcgagcgaagatagaaaagcagtagcttagtgtgcccacaggcatactggtggccactgtgacttaagtattaacccagaagcaggggctctgattccatccgagatgtttttcagagttttccacgaggctccatcagcagtataagggccattgtaagtcagatcaagtagatcacttctccagataaaaataaaaatagacttttctattgtggtctcatgtggagttcttattagttttataaatggtcacaccagttgtccctttcataaactagagtgaaatcaagactatcaagatttttcctctgaggaagaacagttaaggcacagaaaaaaaaaaaacagaaagcataaacttaaagaaattttaaaaacgtattaaatactgaatcgatgcattgatatcactctgttgcacacagaactgagagtcagaggcttgggtgcttgacctggctctgctactcactgcaggctgctgcaaatgtgactaaccagtttgggctccaattttctcaaattttctagaggttctcaaagtttccttataactctaaaattctatgatttcattaaaatgcatggttctttaaataggcagttttaatccattaggagtttcttgtgttctgtataaaggtttaatattgggaacttagttcattatcatgcatgattataaagtcctacaaacaaattcccattactagtgtgtctcagatccaaagtaattaaaatgaggatgctacactttgtgattacaaatattgtcttggtattactttaaattatttcctacaacaagtcagcatttttgacggtggattgaatttttttttaatgcccttgctacttagttactgaagaaatcaacactaacagatgagcgtgccctcagacactggaagagtgaatgtacctcctggagtcatcagattactattcaatttactattaaacctaaaaatttactactaaacgtttttgatattctgaagcaaaaaagatcatttttctactgcaatggcatgaagacatagcacaaagttaaaattttctctttaattccctattaagtatttgagggaactgcaaacaaacactgccctcatatgacattgaaagccaaatcagctctggttagggagattctaaaatggcgccacatccctattgtatggattgttttgctaatcagttttgtactataccctttgtttaaaatgtaatgacttgagccaaagatattggcatttaacagtaattttgtaaaatgattgcagatcataaacagattacattgttttacatcaggtgttgtaccagtgttttaaaaaacaactgctgaaggaggttttgaatatgtatctttctagccaaaaaaaacttaattagttcaaataggccccatcgtccccctcttcaaatgagtaagtcttgtctctattaatgtttgtttaattttaaaacaggactggaactttcaacccagctgtatataaaagaattattttcagcattctcattacaagagcccacttcttcagggttaatagagcatgttacatattcaaaatgcttcctagtcattgctcaacacatcccattcaaagaatgttgacatcataggaaggtttagagatgcagaaagttagccacagtaagagactagactgaagcgagcactcaaacaaacctcatctctcgcttaccttgctacattatttccttttccccagcccttctcacctccaccacccaagaatctacagagttctgagctctctggggctgtctgaggaacgtctcttggtattttgtcaggaattcgagtcattaggctcttgcagcttcccacttacaaagtatgtcttaaactgttatggaaataaggatggtcctaccatacaacttccggcgagggaaatgccttcactttcatagagagccggtaagaccgcttgccagctacggtttcaagcacctgctgttttcgatgtttcacagtgatgaatgctttatctttgaaaggagaagtgatacatacattagaaaagaataatttccataaacaaaaccttagggcctcattcagggagggtgtaatcaatgagtaaataaacagagctgaattatgatagagcctatcaatgagcccaaatgttgatcatgaataggatactttaaaagcactgtaattggtgaacgcctttcaaatcaaatggtatcacgtcctagccacataaaacagtggcagagcaacagaaagtgaaacaccttaaatatctctatcacaataacaaagaagtgggaagatatttctaaaaatctacctggccactataagcaaggtgagaaaaagttgctctgtacaccctaaaacaaccaatttgatatcaaaaatcaactggagaaagacaaaaggaaataaaggctactgatagaattgttccatagtttctgccctccacactgtttccttttcagcaatggaaataaggtctttaagcattttctttatagaatttgcatactgaaattaagcaacagcattaggattccttgagagtaaaagcaggaataaaatagcattaattctaaatgatttagcataccatatttttatttctctaattcatggtagtacctgagaaatttttcttagataataaagataaaactcatcatctttttctgttttgtttatacagaacactaagaatttcataaatatattaggttctaaccgaattattagccataataagcatctaaagaaaggactctctgttcaattcaaaagtattaaatgtaaagagtacttaatgtggtttgctttttgacagggggaggagggaaccatggccaagctgtattcattcatgataatgtaactcttggccaacagaaaactgacttatttagagaacacagacatctacaatgattagaaagcatagcatgagttggcaacgctgaactatgcttaccatatatatgcactgaggtgttaacagatttgaatgatggtccactccttacacgacaagtataaagtcctttgtctttgttctgcattttgtcaatagtaagaacactgtagaatatgttggcatgggaattgctttggtcaattcgtcgccttacggaagctctcttatttttctagaaagaaaatgtataacaaatgtagaaggagtgagtgttcatgcttaaagttatataggattttaacatttcttagatcattagttcgacaacagcttctgttttatactaagaatcatgtcaaatccacctagagcgtaatgtttggaaactacatctgtgtctagaggtgcttcaaatatgtagcatagcaggatttatttagcacttaattttcttcaaatacactttcacatatactatctcaattgtttgtcccaacaacctaatgagattggcaggctgactgcccttttagtgatgaaaaaactgaaggaagtgataccctggcccaagttggctaggaactgaagttgtttgagcataaatctagtgtccttcctctggcacacacacctctctacacagtaacctgttccctaggcatagatatcgcacacaaacgtggacaatcataagccttagttagtgtctggcttaatgacagtgcttctctcaccaaatcaccatgtgagtttccttttttgtccctacgagatatgaaggaaaatataatgagtcttggctgtacttactaaggtggaataatgctatagtttcattatttcactatttgaacagtgcttgcccatgtcagctaaatcacagtaaatggatctttaaccaagacttggaaggtgctgtcccaggtttgtctcagagaagatcaagaattagccttaggctctgcaatctgacctggccacaatgacagtcctgctcactgttttgagaagacaagatcacattgccgtctccttttttttttaagcactatattttataactaataagttatttccacctctcaatccttccccatagtcatagggggcggaggggaggagcatggaaaaatgtctttgggagctgtccagaactgatttttggatcttgagcttagttctcctctgtgccacgtttaatacacttctacccacctgtccttttacttccccattggaacagacagacacatgttgaggccattttcttcattctcagcaataaccagagagaaaagtcaattgccactatcaaaagtcagagaactagtcccctaacgtaacagactgagggagctttctgcagctctatttatacaggtactacttcctttgccaagctgagtaacactggtattgcttctgacttgggaaagaactcatcctgtgttttagaattgcttcgcccagtactgcagccaccagccacgtgtggctattaaaattaaatgaaatcaaaaattcatttcctcagtcacactagtcacatttcaagtgctcatctgccatatgtggctagtggcacagtactggagcacaaatacgggatatttccatcacagaaagttctgctggacagtgctgttttagaagattattagcatttaatagatgtgttgtagatactcttacttacagcagcaatgctagcaggataaaagtttcttccctcttggcacttacggagaatatttgatttctattaaaacccagaaaatattgctacaagccatagcatttttatttaaatgaaacaatacctctcctagagaatagtttatgactgataagtccttaatgtgtccctacagggcactcgttacacgtttttgttgctaagttattccatttccatggcgagaaatgtcgatgaaaaacaacactagcttgaggctgatgcattaatctttcatacataatttaatcataaattgactttgtaattgggcaatctgaacgacataacaaatgattgtacttgagatatgccgcataaatcatgctgacacacaagaaatgggggctagaactactgtcaaaatttccgtaacagtttatcatagtttccccatctatacatttttaaaacaattattgtttgcaaggatgttcgatttgaataagggaacccaacgcaggcttcattcttctcatttttctgaaggacagaattgctcccctgacacttaacaaatggaatattggatggctgggttgtaatatcttttccaaacatgctccaatcaggtgcctgactgtctgccagtatcttaaatgaatgcgctgacagagacagcctcctggaaagttgttgttgttgttacaaaaggcagtccctgcctggcatttggtgataaatttctctctcatctctaaatcctacagagtagtttccaagaatgaaacaatcccttttcttccacctagaatcatgcaatagaaataccagtctacactcttcaaaacaaaacccccagacatcaaaagacagtatctatgcatatcacactcatgaaatgccaggcaaagaaagcactcaaaccaaacccaaagcttctttattgactaacactgccacaggagtcaggattttctgatttttcccatctcaaaacccctgcgggatttcacttgcttaaaatactgtcctgcagaagaaatagaaaaatgggtcactcacttcatcagggtaactccaggtcatttgaactctcgtgttcaagggagtggtagcagtacaattgaggacaagagtatggcctctaagtaatttgactgggcgtggtgtgcttatttggacatctatgattgtattggctgcaagcataagagagaaattttttaaaattaagatttcattacacagataaaaatacagagcacttcggcttatgttcatgcctttgaagcatcacttactttgtcgatgtgtgagatagtttgtcttatacaaatgcccattgactgttgcttcacaggtcagaagccctatttctttgtacgttgcatttgatatgatgaagccctttctactgtcccagattatgcgttttccatcagggatcaaagtgtcaagtggaaactgaaaaggaagaggcatgcattaacaaggtcctattagcactggttggcaatactgtttcaccagcagtttgtgaaaacatgatttttcatctaaaatgaaaatagtaaaactttgtagtttgcttataacaaactaggttaaaaactctagtttgttataattggttcttgagtttttttgcatatagcaaaagatatttgcattatgataaattatagtaattatgataatttactatcagccttggcaacaagtggcatctacccaggatagacctacttgtcatgtcagactttcagttggagcccataactctttggcctccgggaatcttcataataagctggtcagacactcaatagacaaaccaattaagaggccgggcgtggtggctcacgcctgtaattccagtactttgggaggccgaggtgggcggatcacctgaggttagcagttagagaccagcctggccaacatggtgaaaccccgtctctactagaaatacaaaaattagctgggcattgtggcaggcgcctgtaatcccagcctctcgggaggctgaggcaggagaatcgcttgaacccgggaggcagaggttgcagtgagctgagatcacaccactgcactccagcctgggtgatagaacgagactctgtctcaaaaacagagagagaaaccaattagcattttttttctaccggggctgccagattattctcatttgttttcatcatccagcgcttttaacaagccatagtttttcctcccattttgcatagtttactgaagaagtggctgtcttcaaaagagtgtaaataattccaggtcctccaagattcataacattaactcagcactcactggggctgtcattctgacgatcctgctgtgtcacaaggaaggcatcagctctgcctctggaaaggaaactcccagaagctgaagctgctgatggtgaaggcagcctcggaggccagagactctgcaatgaatgaagtgctctctaatgctcagaagtattcccaagcacggtgagtccaaacagaagaaaataatccatgatctgactttctccttatgccttcttctgacatcaagaatgtaacatttaaagactacaagataaacactctgccttgggattaaactttatttataaagggtcattgctccataaagtggcccagccaaattcccctgatgccaggttgccagcccaatttcagtggtggtagactcccaactaccactattccttattcccagttgaaaaagggggaaaaaaatcaaattaccttcccccaacagattataaaggaaataccaaacagccacaaagaagctcgaaaccttttctatcgccttttaaaaagtacacctggcatccctcgctctatccagttatcatttatttctattgcttgctgaaggcgctgatctggatttgtgatcctatggcagagatttctagtccagaagccactagtgcctctcttccagggactatgcctacatcggaatgtattaccggtgttccttgggtttgaaattaattacatcctgtttatgaagaactgaaagcaattaaaggattcgctttcatgtttcagtaaatcaaggtgctacctgtaaactcaggaatgcagtcggtgggaaaaaaagaaccttctcttctaatttagtgcaagcaaaggaaaaacccagaaaaatttaagtcagggactgaaatctatggtactttacaaataagtgaaaacaagcatgtgctgaatctaaaagaaaggattgctgacagacgtcctcagtacaacttaaaaatacactaaaatttcctccgaagtgtttctcttactctcatctatccattacggctgttagtagcattccattgacaaagtaactttacatttagctgacaagatctaaagcagtcaaagactgtagcccatcagctgtggccaccaccgcatgtgtaagaatgaaggcagatgggcaggtggatctcagcctcgaaaggaagccctgggcagcaaggcctgtctgcagctgaccatggctccgacaaagcaggcatgtgaaaaggagagggaggggacagaaaattagaagaaaagggacaataagagaaatgaaagggaaagatattaacttcatgtcagcagaaatacgtcataggttagaatatttccagtatatatgtgccaaaccaaaatccctgtgaaaattttacacttctctttctctctttttaaattgtgcactccagatcgtaggcagaaaaaacagtaaatagactcccaccagccccagatttttatatgggaattttggaatgctcctgatgaccaaacaacccatctgcattagcgctcccatgaaagagaacgtttccctctccacgtggtgttttccatattaatcatacagcaataattatctcagactaatgggagtaatgccatgctattgaaaacatgacttggtaatataccaagtacagtattgggtgttaaactgttaaataatgctaaagctaacccttgaatagggctgatcttgtacttagatactgttctaagtgctttccatatatcacctgacttaagttttctaacagcaatgtgaggtggtactattgtcattacccccttcctcagatggggagagtgaggtggagagaggtttgataactcattagtttgcccagtgacaagtgcagtatgttcagagtgcaggcaatgtggcaccagcctctgctcttaaccacacttgtcttcctcctatatgaactagaccattcaagaaggatggcaggaacactgaatgagaaggcaaggtattggctcaaatgcccagtatgacctgcgaagttcctgacactctggaaaccagggtgtttttatcttgaccaactgaggagttcaactcctctggcgtttccagctctgctgtataatgactttctatttcctggcgatggcacacaaatgtagtggaggccaaaacctgtctctgatggactatgttgaaggcctacgtgagtaacaacccaggagagtgaatgcaaggaaagaggataaggagaatcctccaccacatttcaggactcagggttgatgggtgagactgaacatcattctctgaacttttccagcctaactgccacagctaccagcaccaaacacttcctgagtgcctgctctgtgatgcactgtgcgaggtgctgctctggggcggacttgactttctctcttaaagttctaagctctcagaacttagcacagttttccgtttggggagcttttatccagttctgagtcctggtatactcctaactcttactgctgattaattagctagaatgtcataggtttagtttttgtctttattagattctaccctaaatcttttacctttccatatgtacaatttacaatatagtatgaagaaaagtttcacgtatggccttctttcctccctttttccctaagagatgaagtttgggtgctcagcaggagacaggccttttatcacaaggaacttgccaattcaaaccaaacgtgctggctccttatgcatgaagccagaacatatcgatgcctggagaactgggcaccctgctgacattctgtcttctctgcagtaatctggataatccactctctgcaaagttattaatttgtgtaagcagcagaattgatttttctcacatttgcacacagttgggtttgtggcaatacataacatttttcacgatttcagttctttcattattcacatcgatttatgcttaagacaccatcattttattctatttaaccacatgcatggacataacttctagcactattccttatagtaaaaggatgttacaggaaagtccactgagaagcccaggtgtttgtaaggaaattattccagaaagatagaacgagtaaaacttcattatgcttatttgcagtgaaagtatgctgagaatagcggtgttcaaatttaccttttttaaagtaacagtgatgttaggtgacgtaacccggcagggaatgacgagctcccttccttcagtcatgtgtataatttcggggatttcactgtacatctctacgaaaggtctacctgtatctgaatgagaagaaaatgaaaaaaatatatacataaatgattgacatgcaagcatctagacactgtagctagtgtggtatggtaggcattgccacagtcacgtcattctcccttaatgtaatccatacattcacatctttgtctctgaatttggccctctgtgtttctacccagaaaaagaaagcttccctaataaaacctaatttcatatctgttgttggcctctgatcagattgccccaataccttaatatgcaatgtggtatggggggaccactgtgggaaaaagcctaaaagtgcagtaggagagaaaggagaaaattctgcatagacttctcaccacagctatgctaagtgcctcaggaagcgccctccagagcctttgtaagtgctcaaagggcatagatgcagtggcgaaggtcaactctctttggagaattcaaggtgatgcagaagtctagcaagttgaggagaggattatcatttgaatgacagaagcatgacttaaaggttttctagacttttcctcggaggctaataataatgaatgagaaggtctgagctgcttagggggaggcggacaggccggagaagctgtgttgaatgctgcatttatttcatatgtatattaggcttatttctttagtatgcgctacttacctgctaatagcaaagtctgtgcaagtgcctgcagagaagtctggaaaagactttaagcaccaatacttccttaaaaagcgtggcatttggccagtctcagaggcaaggaggattcaaacacctgttcagcttccctgtaactcctcagggaaccagaatgagtccaagatccttttagaaacattctcagtctaccctgcccttgccctcgggaatctattgacatcctcaggcaacgatctcttcgggagtcattgtgttctgatcgtcccgcatttgttccagccttatatactaaatggaaagaagtcctgtgtgaactctctccatttggacctgaaagaaccaaccaggcccccacctgcttgctggtcctgcctcaggtttgtggattacgaagctaattcaggatgctgaatggagaaggaattggagagaaacaaaagcagtaagcaggcaatggttgcccagactagatggtggctacagtgatcattatggtagaactgtgtccccaccaaaacgatatgctgaagtcctaacccccctgtacttctgaatgtaacctcatttgaaaacaggattgttgcaaatgtaattgcttaagctaagtaagggagggctcctcatccaatgtgattagcatccttgtaagaaggcagtcatgtgaagacagacagggtgtgcagactcgcactatgtgcagatggaggcagagacaggtgtgatgcagcggcaagccaaagaatgccaaggattgcgggcaaccaccagcatgtaggaagaggcgagggagggttcttctgcaggtttcagaaggggcatggcccagatgatttgatttcagacttagagtttccagaactgtgagataatacatttctgtagttttaagccaaaaaagaaaaaaaagtgggccattgctgtagcctgctgaagatgggatagttttctgcacagcagtgtggaatggaggcacagatgtgagctctagagagaccctttcaccacagcccatcttgtgtggtccctggcacctatatgttaattattcccactcatcctccgggaagccttgctagcccccttccttcctgcacccttctccaccctagcccacattagggactttcccagtgttcccattgattctgttacaacacggtccacagaaccagcagtttttttctctgggtactccttggatgctacattcctagaggagaggaaatggattgtattcatgtctgtctcatgtgtactgaatgaatgagtgaacgggtatccaaccccgtccttttacagatgagaaaagaggcacaaacaggtgaaatgagttgtctagatgggcacagccaggcctgtaggccagttacttctgcctccaatctagagccccttccctggcggcaccctgaaggctgaacctctggctacgttctcttgaaggcccccatagaaagggctgccagcaggtgacaatggtttttcagagatgaaggctgatttccacacattcagtgggaaagtaagtgcctcatggtactgcatagtgttggagaaattctgaaaaagggctgaacaccaaggcatggtgtgtgagagcaggctttggggcaggctttgagtcggagggaggtggttcagagtacgcctcaaagcctgggtttaatcctggctgtggtcctgtgtaactgtgagaccttggggaaatcattataccctctgtgcctcatttgtaaaatctaagtgaaagggctatgatgaggattacatgaattaatatatgtaaagcacttagaatgatgcctggcaaatagttagctgttaattttcttattattattatgactcatttgaacttatgaacaaagtgttagagttggcagttaggcagacatgagtgggacaggagagtgcccctcctcccaagaatgtcaggtgaccatcaggtgatggtcaggtggttattaaactgtctttctaaaataataattagtcacagctggcaccagagaccgtctcccaacagataggaaacacctgaagctggtgatcagcagcttcctgataagatctcagaagttgggggagcaggctcaagcatgcacactcaaaggcaaaatggcacagtttaaccggtatatgactttcctctgtgaatgctcaactggtaagggaaaaacacctcaagtgagcacaaacacaacttcagtaaacacagtgcgcatgtggctcctcccaggtgctggcaggccactgtgcatgtggacagcccatcccaaaggaaaaatcaggggaaaataaacacaaacccttgaatctctccagttgcctgcttggccctctgccaagtgtagtttgcttcctctcattcctgctctaaaactgtttaataaactctcgctcctgctctaaaatttgcctcagtctctccctctgccttacacctactaatgcccttggctgaattccttcctccaaggaggcaaggatcaagttgctgtagacccatacagattcgctgctggtaccagtaggtagatatgaaaatcacaaattatactcatcatcttaactatcaaaaatataaatatatattgatatagtggcataggaaaaaggattggaaacaaacatactaaaattttaagagccaggtgcagtggctcacacctgtagtctcagcactttgggaggctgaggcaggaggatcacttgaggccaagagtttgagaccagcctgggcaacatagcaagatcccttctctgcccaaaaaaagttaaaaatgattatctttgggtgttggctttatggattattgttgttcttatttaccttcttctatatttgtcagtctttctagaatgatcatgcattattttatagtaatatttttaattattaaagttaaaactcaaatgataaagctccatccatttttgcttaaggaaaactataaattttgcatttgatttacctgagtttcatcctctataatagaatgagacattaactgtcacagttaataaacttatgtgtttattaggaaatctcagtgggtgtagtaacatatgcagagagaaaaagttaatcagatagacacaagggtttcttatcagaattaaattcttcctttaaataaagttgctgagctagacattcagccatggactattgggatttgatcattcctttccttcctcttgtgagtctatatttttgtctcttttgtgcatcccaaggtaaacacaaacactaagaaatggtttaattcatttaactaaattgtaaatccttcatatttaatttactgtctccttaagcaactgttttcaacaaaggacactggcacaaaaagttcctacaggagataataaaatcagtgtagtcatttctagactaatgaataccaatcccaaatgaaaatagaaaaggttaattcaacatatctttgaatttcttctttccctttggtactgtggatccccaaaaaacttaaattttactacagctattggcctctaaaagccaataccaatttcagcactgggtccactgaaattctatccgaagatatcagaacttcagtgatttgtgtccctccaaacactatgcaaaacacattatttgtgtgacagtcaaaagtggcattataaatccactgtgtttgcaaatgagcatatgactgtagatacacacacacacacacacacacacacacacacgaacacacgaacaatactctctgggcttattaatagtatatttcctctgcaatttacttcaaggaagggctaagaatgaatttgcctgacatataataatacaaacatattttgttttgtaggaccatagatatagaagaggtcacggttccattaatatcaccagtaaaaccacttactactcccgtaggacacatctgtctttgtcacaaaattaaaaatgacttccaatcccagccagcactgcagagtgatttcctgagaccaaattggctggttgttgaaagagtgaggaagagctgctccaaagactgccggtgtactggcagctcagacacactgtcaccagggactcatgccaacactcagctaggtggaggtcacactgccctcacctctctgaactcttagagctcaaagcagtgacaggaaactggcatagaatatgaggttttctcacccactgggagtatctgggctgtcacctatccttcaggacaacaagtgggctcagacacagagaaagatcaaacagggacccttgctcagaatggaacgatgtctattttttaaatgtgttttttccttttgaaatctgtaatcatgctggcacattgaagcatacagacatagtggcccctgcatgttatcctcaatggattccatttccaactggcatcacctgggagctctgctgtgttcagagcaagtaaacaatgttcaaaatttaggacttgtgacttgaagaggagttcaagagtaaacacattgttttctagcacatgtacatatttatggtttttacaaagtttttcctggttgcctttcttttaattgcatttttatcctggtcatgaggacatctagtcattttaaaggagggtatgattttcatttactgaagatgaaggggagaggataaaaaatgaattaaccaatcccatgaaaagggttctatctagacataagagttttcacatcacacagatcttcatattgtggaccgtaagtaatactcaaggagaatgtactgattggtaaaatattttatttgaaatatgagcaagaaaagaaaacaggcaggttcttccatgacttacactgcctatcaaagccactgacaactcaaaacagagctttggagcaaccacaagaaagttggagtagttatactaacatcagacaaaatagacttttaaataagaaattattagtgaggaaatggttagtgaagatagagaggggtgtttgataatattaagagggtcaatccttgaggaagatataacaattaaaaacatatatgtacctaataacagagcactaacacacaggaagcaaaacctgacagaatcaaagggagaaatagacagttcaacaataacaggtgaagatttcaataccccactttcaatagtagatagtgggctaggcatagtggctcatgtctgtaatcccagcactttgggaggccaaggcaggtggatcacttgaggtcaggaattcaagaccagcctggtcaacatggcgaaaccccatctccactaaaaatacacaagttagccagtgtggtgatgcacgcctgaagtctcaactactcgggaggctgaggcaggagactggcttgaacccaggaggcagatgttgcagtgagctgagatcacaccactgcactccagcctgggcgacacagcaagactccacttaaaaaaaaaagtggatagaagaactggacagaagattttaaaaagctagtagaacaccagaacaacactactaaccaactatacccaacgacatctatagaacacttcacccatcacagcagggtatatattttcctcaagtgcacatgaaacattctccaagatagaccatatgctagaccataaaacaaacctcaataaatttaaaaggatagaaataatacaaagtatgttgtctgaatacagtggaatgcaattaaaaatcaataacagaaataaatttgaaaaattcacaaatatgtggaaattgacacatccctaaataatcaatgggtcaaagaagaaatttaaaaagaaattagaaaatactttggtatgaatgtaaatgaagacacagcatactaaaatttaaaatttacgggatgaagctaaaacagtgtttagaggggaatttatagctataaatgcttatattgataaagaagaaacatctcaaatcaataacctaaacttccaccttagaacattgagtaaagaacagaaaactaaacctagagaaagcataagggagaaaataataaagattatagtagaaattaaagagaatgcaaaacaacagaataaattagtttcattaattttctaaaccaaaagctggttctttgaaaagacaaacacaactaataaaccttaagccagacaagccaagaaaaaaagagacaagactcaaattactagattcagaaatgaaacagggccaggtgcagtggctcatgcccgtaatcccagcactttgggaggctgagacgggtggattatctgaggcaagggttcaagaccagcctggccaacatggtgaaaacccatctctactaaaaatacaaaaattagccaggcatgatggtggactcctgtaatcccagctactcaggaggctaaggcaggagaatcgcttgaacccaggtggcagaggttgcaggagccgagattgtgccactgcactccagcctgggtgacagagctagactaaaaagaaatgaaacagtggacattactattaaaattataaattaaaaagcattatgaaggaatattataattatatgccattacattagatcacagatgaaatggataaatgccgggaaagacacaaactactgaaacaagctcaacaagaattagacaacccaagcagacttttaacaagagattgaattgtaacaacaacaacaacaacaacaacaagctgctcacgagggaaagtcagggcccagatggcaagtcaattctaccaaacataaagaactaataccaatttttcacaaacttttccaaaaaatagaagagaagagaaaactttccaactcattctaggaggctagttttactctgatatcaaaatcaaagacatcacaagaaaatgacaaaccaatatctattacgaatatagctgcaaaaaactcaataaagtactagcaaactgaattcagaaacatataaaaagaattatatacaatgcccaagtgggatttttttcaggaatgcaagattggtttaacatccaaaaaccaatgtaattactatatcatgtcaatagaataaacatcaaaacccacatgactatcttaaaatggcagaagaaggatttgacaaaaatccaagctcctttcgtgatgaaaacactcaggaaaatgggaattgcactgaatttcctcaacctaataaatggcatctagaaaaaaccctacgtctaacatcatatttaatggtgaagcactggaagtttccccctaagatcaggaataagacatcgttgtccaccctcaccgcttctattcaatagtgtactagaggttccagacagagcaattgggcaagaaaaataaatccagattgggaagatcaaaatggtacaggtattttggaaaacagtctctgttttcagatgacatgatcttacaaaatgctaaggaatccactaaaaaactactagaattaataaatgagttcagcaagattgcaggatacaatgtacaaaatgaattatattcctatacatttgcgatgaacaatctgaatgtgaaattaagaaaacaattccatttataacagcatcaaaaagaataatgtgtttaggaatatatttaacaaaagaaatgtacaacttatactttgaaaactataagacattgtggaaagaaattaaagaagatctactaagtgggaaacatctcatgttcatggattagaagacttaatattgttaagatgttaatgtcccccaaattgatctacagattaaatgcaataactgtaagaatcccagatgacttcacagaaattgacaaggtgattctaaaattcatatgaaattgcaagagacccagaatagacaaaacaatcttgaaaagcaaaaacaatcttggaagaccgcactccacatttcttgatttcagatgaaaactacaatgatcaagacagtgtggtgctggcacaatggattagtggaatagaattgagactccagagatgaacccatgtgtctatggccacttgattttcaaggagaccattcagtggggaaagaataatcttttcaacaaatggtgctggaacagctccacatgcaaaagaatggagttgtactcttatatcacaccatatacaaatattaaccaaaaactgctaactataaaaaatatatattttatagttatataatataatatataatatattatatattttatatatatttgcaaaagggtctcacttttctaggctgaagtgcagtggcaggaccatggctcactgcagcttcaacatcccaggcgcaagtgatgcccccacctcagcctcctgagtagctcagactataggaatgtgccaccacacccagctaatttttttttaaaaatttttttgtagagataagggtttcactatgttgccagggctggtctcaaactcctgggctcaagcagtcctcctgccccggtctcccaaagtgctgggattgcaggcatgagccaccacacctggcctaatacaatattctcagaagaaaccagaggtaaatcttcatgatctcaaatatggcattggattcttatatatgataccaaaagcacaagcaacacaagaaaaaataaactgaactttattaaaatttgaaacttgcatgcttcaaagaacactgtgtagaaagtgaaaaggtaacccaaagaatgggagaaaacatttgcaaattatatatctcataagggacttaaatctggaatgtataaaatatatttttatatgcctcaaatatatttttaaaatctacatatataatatataaacatatgtttagaatacataaaaatctagatatattatgtatctatatattatatctctagaacatataaaatatattataatatacaattgtatgaaataataaaaagttgaagaactcttacaactcagtaataaagacaagctaattaaaaatgggaaaaggatctgaactgacatttacccaaagaagataaacaagcagggaataaacaaatgaaaagatacttaacatcataagccatcatggaaataccaatcaaaaccacaatgagattcactgcatacccactaaaatggctataataaaaaagacataattacaagtgttggcaaggatgtggagcaactggaactctcatccactgctggtgggaatgtgaagtagtgcacccactttggaaagcagtctggcagttcctcaaattgttaaacatagagttaccagatgacccagcaattccacccctaggtatctacccaagtgaatgaaaacttgtgtccacacaaaagcttgtacacaaatgtttactgtagcactattcataataggcaaaaggtggaagcaactcaaatgtccatcagttgattgatggatagctaaaatgtgatatgtccatacaatggaatattactcagaaatagaaagaaatcaagtgctgatacatgcatgatacatgaaagaacctcaaaaatattatgctgagtgaaagaaattagtcacaaaagactacaaattatgtattctatttatataaaatatccatgagacaaatctatgggaacagaaagtagataagtggttgtttagggctggggggataaggggtgatagctaaaggctatggagtttattttgagacaatgacatattctaaaattgaccgtgatgatgatggttgcatatatctgtcaatatgctacaaaccactgaatcatcattttaaatgggtgtggtatgtaaattatatctcaataaaacttattttgaattaaaacagaggtttagtctctttcttagaaatgatgatccactgtttcctgagctggctgagctggaatggttcccagagatctcccagggtaaactcctcaccttatgagtctttgcagcatttctctcccattcccctcctgcatccagtttaggccactcacaaaaaataaaattttcccctgtgatagaaccatcatgatttaaatatgtctttcaaggttgggtgcgatggctcacacttgtaattccagcactttgggagcccaagacagaagcattgtttgaggctaggagtttgagatcagccagggcaacacagtgagaccccatgtctacaaaaaaattttaaaaattagctgggcatggtggtacacacctatagtcccagctactctggaggctaagataggaggatcaatcgaagcccaggaattcaaggctgcagtgtcactgcactctggcctgggcgacagagcaagaccctgtctctaagaaaaaaaaatgtccttcagttccttgttggcagtccctggtgggcaggtggcataatgaaacatctctgccttcacatagatgggaatacttgcctggtgtgtgtgggtattatagtccacatggaatgcgcaatttaatatctcctagtaagctatcctgattatccaaatgaatatcttaagaacctcaactataatttatcagctaaaaatataacaactgtcgccactattggtggattcatatacaaattcaaaggtgataaaaaatctcactgagactggcttaggaatatcagaaaatcagttgctagtttctgccatccagacagacacttacatgttacacaaatatttctatttgagcagggtaaacttagagaaaagtcattgtgtttcagactcaagatgccattctgaaatgaaacatttaaaaatgtattatttgtgtggtaaaaaataagaagtgcctctttctaaaaaagagctctttgcctactacctgcctttcctcagaagaaagacattgctttttgttttgttttgttttgtttgttttgcattgcttcacttataacagcagatcgaacagcaagagcagagcaaaggagaagaattagaaaggaggaacaggagtggtggttccttttctccttcctctggcttcgcctaagccccctgggatgctctttggaatgtgggtgtctagcggcaggggatcaggaaaaccgattcccctcaatccaatgtccagcagaggcggacacatggcacactgtcaacagatgtttatggagaagatataagattgaagcaagcaagaaaggtgaaatcaggacgtattatgtacccagcactgtgcacacggacagtccctggactccagtcctcagagtctagctgagcagacacacacacacctcacacacaagaatgctcatgttgattagaggaaacagtactgatacctgccttgaagggaagtagggacctcattttaaaaatttacagctaagatctgagtaagtgagttgaagatctcagtgagagtggaatgctggctagatttaagcttgatggactgtaagattaagaatgtctcagctttctgtgctctctgggttttcacactaagctggctggcggtttctaggttctgttaaccagatgactgacctcagtcagagatcttcatcttgatcagttgagacatctcagaagaaaaagagaaagggagaagggaaggagggaggaaaggagggagagagggagaaaagaaggaaggagagaggaagggagggagggaaatgaaaaagaaaaagcaaggaactctaatggattactataaatctttcttctactgctaagatttttggccatgtcccaagtcctattatttattcccagctctgcctctgaatcataacattataaaactgtcaaaggacttttaagatgccctaattctgcctatcatgttacagatgagaaaactgaggcccagagaggagagactgtcccacaagcacaggaatacaattaatggctgagcaaaaactgaatttacgcttcctgatctgaggctagtctccctccaccacaccaaaatctggccctgacactcctcaatgactcaagcgtgacaattacatcttcaaatatccacactcagtgggagaaatgagggcccagaaacaggggtagcatggggccttctgacggggactagaaatgggaagcaacggactgatgaagactcaccgcggaaaccaagcttcagtcattggaccctctgcttagctctctgctgtaaggtgctgaggactttttaggagatggtgaggacaacctcagaaccaacagttggccaggcacggtggctgacgcctgtcatcctagcactttgggaggccgaggtgggaggactgcctgagctcaggagttcgagaccagcctggacaacacggtgaaaccccgcctctactaaaatacaaaaaattagctagacgtggcggcaggcacctgtagtcccagctactcgggaggctgaggtggaagaatcgcttcaacctgggagacagaggttgcagtgagctgagatcgtgccactgccctccagcccgggtgacagaacgagacttcgtctcaaaacaaaaacaaaacaaaacaaaaaccaacagtcacaccagagcaagccctgttttctggagcctggggaggaaattccctctcaggggcagaggatgcctggtcagactcctctccagcagggacactggggacagtgggttttccgagaggacagccccgatgcattccatcagcatagctgtgtgcggggcggcgggggaggggagcgggtcggggtggaggagggcagttgaggggaggcaggagtcaggggaggagtcgggctgtgtcgaagtgctgcgctgatgacctgcgccaccacgggactctctagggctcagcttcctcatctggaatgtgggacaggcactttcctgttcctaaactcgcgatttgttatgcattcatttgaaatgttcacactgggcgtagcacactgacatccctccgggggccagacacacgagtggaggaactggaggtgggacaggaggtgttgtggcagctgggaacgtgagcccatgcctgaaggggccgtccctgcttgctgcagtccattgttgccaagtggaaatatgcgccagtgtggctagtgtttccagtttttaaagataagtaggaaatgaaatttttacgtgaactcttctagctattaagcattggcagctaaaagtgctgtgtctgccaatcaaaacatgtgtgccagctgaatccagcctgcatacttccagtttgcaaccctgcatgcactcctgtcccttctctcccattttataatgcacacaaagttctgagggagttggggtgggagcccaggcaaggacacgttagaaagaccgggggctttggagtcaaccagacttgagcccaaagctttgacaggataatttacgaagtatgcagccttaaacatggtattgaatttctttaacttttctgtaaaggaatttctcttattgggttgtttcgaggatgaaatgagatgatgtatgtattaataacaagcctgagccggacattaataaacgatagtgacctacaccaggtgcttaatgaatcccagcagaggaaaggtcctgaggcctcatctgatctggtcccatcaagtgagtgtctgcttcctagatgcgtggggactaatcactcccaagacattccttccttccactttgggacagctttgcatgtcagaaagtgtttccttaagtcaagctgaaattcttagatagttgttctgccatctaggattataaagacgaagcttaatctctttttcacataagagaactttgaatgagactgtcactcatgtctcctattttcccacccagttctttatatttttagattaaatatttaagtcctttcaattgcttcttgccaatgaaaataataaaatcatcaaattacttcatgctcacaaccctatgaggcaggcacccattttaaagatgatgacaatgaagtgtaaagggattaataatttgcttgaaattcctatttttaatgtccctcttgaggtgtaaactaaacagcaagtctggcaccacctaagtctggcactacctttattcctggtgctatatatttcttcctttcctcccctccccctccccctcccctttcctttcctttcctttcctttcctttcctttcctttcctttcctttcctttcctttcctttcctttcctttcctttcctttcctttcctttcctttcctttcctttcctttctgacagagtttcactcttgttgcccaggctggagtgcaatgctgccatctcagctcactgcaagctttacctcctgggttcaagtgattctcctgcctcagcctcccaagaagctgggattacaggcatgtgccaccacaccgggctaattttgtatttttagtagagatggggtttcaccatgttggtcaggctggtctcaaactcctgacctcaagtgatctacctgcctcggcctccccaagtgttgggactacaggcgtaagccaccacgcctggcagggtgctacatatttcttaatgtatcccaaggttggatacattctcttggtaaatatggagtcaactgaaagtctgaagtcttttgcatgtgtgctgtctcagcaatggcttcccccatccagtactagggtagttagtgggttttgcaagccaaatacaggcctttacatgtattcctgttaaatctcattttgctaatccctgttcactgctctagtttgttggaaaattttgggatcgtgatttagtcacatgacatgattttgacccccacatttgtctcattttctcaatgtgccctcaatttcctttttaaagtcaaggaagtcaggtaagactaatatacttaaaaatcccatgtttctttcatttaacaaagatttactgagcaccttctgtgtactataccctgtgctgggtcctggggctatcatggtaagcaggacgaactcagtcctgtccgtagagcttgtgagaggtgagtcctgtgtgaaaggtcagtaggagcaccatcccgagtttgggggtgcctagggtgcttcccagaggggggatatttaacttgagacctgaaaagtgaggaagagtgagctgttacagaagagctgggtggggggagtggggaagggtggaatgtcccaggcagagcacccccagtccacacccctcttactgctctttccccagtatggttaattgtaactcattttctttgacctaccaaactgcaggccccttaaaagttgttggtatcatctttgtacttcctactgtgtccagcacggtgtttttcacacacagggattactaccaatcactactgcctcctaagtgttaggcagtctgtattgtctcatgtagtctcctaatagcccctgaagtaatactcttctcattttacagttgagaaaaccaagctcaaaaaatggtaataatgagtggtagtattaataataataaactcgtatatagtgcatactatacaccaaacaccgtcctaaatgttttgcacatatgcactcttgattatgggaggtggttataggcaagaactttgttgccatctctgccatacactagttatataaccttgaaaaagctacttaacctttctgagaaataaatggagatgactgtgataatactttcagactaagatcaggatcaaggcaaggatcttccctctcactactactttccaacatcacactggaagtcttaactcatgcaataagacaagaaagggaaatagaaggtatacagattggaaaagaaaaaataaaattgcctttgttcacagatgatgtgatcatctgtatagaaaatcaaaaagaatcaacaaaaatacccctggaactagtaaaagattatagcaagcttgcaggacacaaagttaaattcaaaagtcagttgctttcctatatacaagcaatgaaaactagtagagttgaaatgaaaaacacaataccatttgcattagcacccccaaaagtgaaacacctagacataagtctatcaaaatatatataagaatctatatgtatgaggaaaactacaaaactatgatgaacaaaactgaagaaaaactaaatgaatggagagatatttcatcttggataaaaaggttcaatattgttaaaatgtcagttcttcccaacttgatctgcagattcaatgcaatcccaatcaaaatcccagaagttactttgtggatatggacaaactgatcctaaagtttatatggagaggcaaaagacccagaatagccaatataatattgaagaagagcaaagttggaagactgacactacctaacttcaagacttactacaaagctatagtaatcaagacagtgtgatattggcaaaaggatagacaaataggtcagtggaacagaatatagagcccagaaataggctcacataaatacagtcaactgatctttgacaaaggagcaaaaatcatcttgtcaataaatggtgctgaaaaactgggcatctgcatacaaacaaacaaacaaaaaatgaggctagacacagaccttacactctttagaaaaatcaacacaaaatggatcatagagacctaaatgtaaaatgcgaaactataaaactcctagaatataacaggagaaaacctagatgaacttcggtatgacaatgactttttagatgcaacactaaaggcatgatctacaaaacaattgataagctggatttcattaaaattcaaaactcctgctctgcaaaagacaacatcaagagaatgagaagacagggcacagactgggagaaaatatttgcaaaagatacagctgaaaaaagaattgttttccaaaacatacaaagaattcttaaaactcatcagtaagaaaacaaacaactctgtttaaaatgggtcatttcaccaaagaagacctacagatggcaaataagcatatgaaaaggtgctccacgtcatgtcattgggaaaatgcaaactaaaataacaatgagagaccattacatacttattagagcagccaaaatccagaacactgccaacagcaaatgttggcaaggaggcagagtgataggaattgtcatttgctgctggtgggaatgcaacacgagacagccactttggaagacggtttggcagtttcttacaaaactagcctttctattgccctaaaattgagcaatcatgttccttggtatttgcccaaaggacctgaagaattacatccacccaaaacctgcacatggatgtttatagcagctttattcattattgctaaaacttggaagcagccaagatgtcctttggtaggtgaatgggtaaataaactatgaatataattatataatgaatttatataatgaatataaaaatatataaactatgaatataaaaatatttatatgatggaatattattcagcaataaaaagaaattagatattaagccatggaaagacatggaggaactttaaatgcatattacaaaatgaaggaagccaatctgaaaaggctacatactgtatgattccaactacatgaattctggaaaaggcaaaactatggaaacagtaagaaagataagtgtttgccggccgggcacagtggctcatgcctgtaatcccagcactttaggaggcggaggtgggtggatcacgaggtcaggagctcgagaccagcctggccaacatggtgaaaccctgtctctactaaaaatacaaaaattagctgggtgtggtggtgggcacctgtaatcccagctacttgggaggctgaggcaggagaatcgtttgaaccctggaggcagaggttgcagtgagctgagattgcaccactgccctccagcctgggcaacaggatgagactccctctcaaaaaaaaaaaaagaaagaaaaataaggataggtgtttgccaggggttgggattaaggaaaggatgactaagtagagcacagtagattttagggcagtgaaaatactctgtatggtactataatagtggatacatgtcattgtatgtttctccaatccatagaatgtccaacaccaagggtgaaccctcatgtacactttgcacttgggtgattatgatgtctcactgtaggttcattaattgaaacaaatgtaccattctggtggggaatgttgataatgaagactatgcatgtggggacaaggggtatataggaaatctctgtaccttcctctcaattttgctgtgagcctgaaactgctctaggaaaaaaaaaaatcatacacacacacacacacatagacatgcacacacatctaatttttaaaatgagagcactacttcacagggttgttgtaaggataaaatctgttaatgaatgcaaagtgcttaggatggcacccagcatggattaagacccacctaaatgttaaccattctccttattaagcaatttgtccaaagtcaaagacctagtgagtatccgaacagggatttgaaagcagtctgaagcctggatcatgttgtttcaactgtagcttattaattgacatttgatgaaggaaggaaggaagggaggggtgtttactgctttagtaagctacctattttgaacaacacaatcagctagccaacataattcagcaaaaatacatcaaatgacacacaacaaatattttaaatagttaaaggaaaaactgtagaatattagaactggaaggaccataaagataaaaacagatcacctcctcatctccaagcaaggcaagcatttcattatcattgttgaagttatgaaatgccagaaacttaaagccttttcagcttaaggggatttcttctgaaaaagtcccttgcttatttttcttaaaagatcacttgagggagagtttttaaaatccttaaaaccataaagttttgatcaattgtttttcacacttcttgattgtaggggaaaaatgagagaatatggtcaattttattacctttggacttcattgccatctttagatttcttttccttttttctttccttttctttttttttttttttttttgtgatggagtcttgctctatcgcccaggctggagtgcagtggcgcaatcttggctcactgcaacctccacctcctgggttcaagcgattctcctgcctcagcctcccgagtagctgggactatacacatgcgccatcacacctggctaatttttttgtacttttagtagagacggggtttcaccatgtccgtcaggctggtgaccccaagtcatctgcccacttcagcctcccaaatactgggattacaggcatgggccaccacacccggcccatctttagatttcataattccaccacagtcatcaacttttcaaagccttaaattgtgtccaagtggcttattcaggactatgttcattctgattatttttgagtacttatatagttctactaaatgcctgatgatgtataactgcgtcgttgctagtaagtcttagcaatgtggctctagagggatggcatgccaaattttttctggtatggattttagagagccccagaaattgttttctctctgagggaatggcctgaacattttacatgtccacacaccaagtgctaaggatgaaattattaggacatcctaggagaatacagggtctggggcaggggccaaagagagaagatgcatttgttcctgactgccagcaagtctaccaatgtgagtggcttctgtcccaatcatatatcagggtcttctatagtcaagctcccttagtgtttaatgacagaaatgtttttagaagggaaatgtgacatgtcagggcttaaagatatcaagaatgtcttccatccaatttccacgtagctggaaaggaaaatggttaagagttaagttactgttctctaaactctcaccatgtggtcctaatcagctgtctgccagtgatggatagaatgaataatctccttcatacttcagccctagaaggagtgcacagccaggatgtagaggggtctatttcccaagaaaaaaactgcgattgcaaacaacatcatcagtgtgtattttaaaccctagaaatatctgtttcccctctttcacatctttatcaaaatgaaaaaataaatccagcaaaacctgaccttgcactaggtttttgatgaagatgtgtgcagatgggccagaaaattcctaggagttctttagagaatttgaaggataattctgcagatgcacgtcagtctcaggttgctgccattttaggaatctcacctgggtttccagacatgtcatccagagactgagagtcctacctttgttcaccccaacatgttcacctgtctcctgagcaaatgcatccagtagggatgtgagaggaaaaacaggatccatcacccaacctgtctgcacttgtggcctcctggtaatgcagggactcaagcgactctatggtgggaaccctagacaattcctgatcaaaactttggaaaccagttcctactggaagattagtgttagaagaaacacacatttcagaaaatacatggaaggagccacatgttagggatagaggtgagatgagtaagggagggaagctctttggatgggcaggtggaggagagaatgaggccatgtggaaaatggaaatttaaaaccagagaagactctagacattaaccaagcaatattagataacgtcatggatttcctaagaaatctatgcctaaaaaattcaaccaactagtgtggctatgagtttgggttttattttgggcgctttcttgttttcttcctgcaaaatgtaaactgtttttgcctattttcccttggaggagaattttgatgaatagaaacaatattttctctttaaagtttctctcatgaaattatagtgattccattgacatatttttgaagctttggcaatctgttcagccatgtgctgctctctgcccaacacagtgctgacctgcatgaaagcgtgaacaccttctttcggtctggggatgaagggcccacattcctggtgcatttccatcttacaagggtccttctgatccccacagggggaaagtggaggcggcaaggctcggcgatgaagcctgcagattgctactctgttgatgtccctgctggttccatggagatgtttattggacttgccataccagtctggcagattgggcaacaaacaccatctgcccaaccatcacccagctgggcagtgttgactgagccttctgtgtgtgccaaattgtgtcagatctgggaagggatctaaaggcaggcagtgctggagcaacagccacgcctcacagaacatgaatagggctccccattaggggctattaacagagccctcttcactccttagagacccacttctgaacaatagttattctctaaaaaataaaactcatgctttaaaaaatacttacaaatctgtgagctatggtcctagagagtaactgggggacttcacaattgcaggattctgtgactttgctttttatgtctctcacagatcaaacaacagggccttgtgtggagtaggtatgtaatcaacatctgcagacagattcctgttggtggaaactcctgggccaagcctccgagtgggaaaactcagttcaggagtgaaatgagtggattgcacagaaccaccaaaagcagtggacccaaatcagctaaaggagagggcttctttccactgccacattttctccagacctctgtttcagtactggtgtgcccctccccccaccccacccccccaaaaaatcacagtgcttacaattggcactgcttacctaaataatagatatggtctatcctggtaacttttaaacttattatgctaactttcacaaaaagaaatacattttacgtcagacccattacacacacacacacacacacacacacacacacgcacgtatgtactttacatttatgagggtaaaatggatatatgaatgtataaaattgaaacaaaaatagttttactaaacaacacttacccttactctttgcaatttacttggatattttcttttctattctgggttggtttttcttttttgagacagggtttcactacgttgcccaggctggagtacagtggctattcacaggtgcaatcacagctcactgcagcctcaaatcctgagctcaagtgatcctcttgtcccagcctcctaaatagctgagactacaggtggatgccccagctcctagcttttttttttttaatgcaggttgaaacccattcatttgattccatagcccattaatgaatttggaggcacatttttaaaagccctgctcaacttagtaaatttttcctttaaagaaaaagaataaatttgagattacaaaattttaataactgtataatctatgttcttaacaattaaaacaacaactagctcgtagtttgatgtcaagagctgcaactccagtacaggggaaatagacctaacctagctggatcctcatcctggtttctcaatgtatgagctctgtccagctcatgcaagtcactgaggttgttttctcatatataacatggaagaaataccaactccctttctctcagagataattaagtaaaagctcttaaggaaatctgaagttcagtacaaatgagttcattgaatcctcctcagaatcgccactgcactccagcctgggcgacaaagcaagactatctcaaaaaataaaagtaaaaataagaataaaaaaagaatcctcagaatatctgcactggtaggatttctacttgctcaaggtttcatagccaggtagagcctttttttcccccgctaaacacatttatataaaagcataattattattctctcccagaatatctaagttgttagaaattctactgctttcagttatatacccaatgtgtccgataatgtttctacctcagattatgccgctgtgcaaatctcatgagttttatgcatatgggaaaatcaactgcggaaaaatttcttataaaaatgctccaacccattgactttaatagagccaaagaggaaaataatcaagtaaagagaaacagaagagaagagatgagtttcttttacagggatgaactagaagggatccacccagccccatcattttgcttttcgattgtaatttttcaagaggagatattatatttaaataggccctagaagcttacggctggtgagagagagatataagctaacttcacagtgtggggagctcaacaccctaagtttaaggtcttgctaactaaattaaagatactgacaagtgttaactacttcagagatgccattaaaaaactcgtctggtcagttttcttactttacagtcataactcatatattacaataatattttcaatgaaatcctctaactgtgagaaaaggctgacctggagcccatttcctgtgtacaccagagtgtcagaaaagaagtgcaaaagtgctcctttctctctccaaggggatgaagttcacttaaatggccccaacattactgttcttctagaaattaatagaagaattgtactctattgtaattaggaggtgctttgtaatttgtttttgtttatgacctggtgtttcgtagctataattagattcaattcatttttaacaaagcaatttttacaaatgcatatcatattttccactattatgattcaaaagccataccaagggtatatccagagagaatgatgataatgatggtgcctttgcatcaaggtaatttagtgtggcaaacctccacctggctgtgggaccaagtggccccttccaggattctgagtgtcacattgattcccctctttccctcagccactcaacctctgatcaccaaggccaacgaatcccccaattctgtcaactctccttccccaccacgaccaaagtgaactcaggacaccaccttccacctgctttgatgcacagagcaggcccctatctggccttcctgcctcagtcttgccccttccgacctcctcctgccactgagaatgtgaagggaaaacctgaccaccttattccagtgcgagcactttcccatgactccccacagagccctaatgtgaagtgaattcttggtcctttgcttgtaaaatgaagagaacgatgcttcattggatggttgtgaggattaaatggcatcaagtaaatgaaaccatttgtttaagtgaaaagaaacaaatgtaagaaattattatattagcggaaatttaaatttactagataattcggtaattaagtaaagtagttaaatataattacttgggtacttaaattgatttaatacattatgctagaggtttggtggatttatacaagctggaatgataaagtgctgatattgatttttctgtacattacatatcagatgttacatcctaatcagtgctcaggtgggaacagcgcctgttacacagcaggcaatcaataatgcctaagtaagagtttgttcataatttacatgctgggttttgtgacatgtagacagagctatactcctgattctttttcttaaaaccctattagactacaaatctaccttttcaaaagatgtgtttacatagggttactcatccttagagaaaaataaaatgaaatcccaataatctgcagatgcttattggggctgaaatcccccaaacatattctaaagtaaatattcaacaataataaatacatgataaccaagttaatatctagcgagtaatcacagctgtatattaggaaatggttggagttttattaatgccagagacaatgctctgagtcatcagagataagttttgtgctcctgaactaaaataaacctgtcatggaagtgttcggtaacaatggaagcagaagatcaaattttctcagaaagagagttaataaaataatgagagagagacataaaatattagactcctcggaaaagttatgattgtttaatggattatatcacagctaccttggactttaataaggtgtgattatgagaccaatatcaccctaacaggaaacaaataacaaaatagatgttactgttcatagtagtacagttacaggctcatagtaactgtttcctaaatatttgctgattaaattaattagcaaacaagattcagaaggctcttctatggttaccattattgattccaatatcttttagtatcagtgctatttaaaaatagtggtctcataatattatcataacaatttttccaccaagctcatataatattcgtagtatatgtatgtatgtatatgtgtgtattccataataatctatgaaatacaacgcatttcacaatccttccttatccaaaaacaatctaagtgatagataatttcctaatgtccaacaaattatgcaagtgttttatgatattggaacttgtaattttctgcgaatggttgtggactattacaggaaggcagacatgataaatacatgacctaacggccactgctccccgacaatcccacaagagacatcaataatcaatcatggcactttttcccactaagcctggaatttatcctcaatgtcaattttaacatagtattccacaaagcacctgttaatccattcatttattcatttagcaattattatggatttcctaatatgtgcaaggcactgtaccagggaggcacattgcagataaaagtaaccaggacagacatggaccgtgccatcacagggcttagattaacaatggatttgacactcaaagtcatgattgtttgccagatctgctctgttgtatagttgaaatggaactaattctaaatagcagtgtctctcctttgtgatagtaggggactgagtggagaggcttgcactccctggcttcataaagccatgatgtctattgaatagtttaggagttaaaggtgaaaatagctgaacactatttattagaaaaaaagagatggttttctttttattcatttaagtgttcaatttgcaagtcagactgataaacctataggagaaagttttatgaaaatattagaatgaataaatttttctcccactcccctatagagacaggggcagtctgtgactcactgcagtgttttcctttctccacagatgtcggaaagaacacaatatgctacgtggaattagagaaagagaacagatggctgagtacatggctttttccaccactatcaagcgtgttgtctttccccctcagctgcaaaattacctctctgaaagtctctgctcttaatgctgcaccttctctacccttcctcattcctgcctaccatcctttcatccctgctttagaagtgggctgacttccccaagcaaaattccccggcctacctcccactcatatgtggaagtgagctgattgcatcccttgacggcaaactgcttggatggttagtcccttacagttatctaccccctggacaagcacaaaatgtcaaaacagaatttggaggatcggggacatgaaagtggctcagtcaaaatcaggctgatagcagctacaaagaggttactgtcaataacaggcaactgttctgctgtctcctaagactaatcctgaatttggatatgtacatgttatgctcagggaaaaacactgtctagttgccttatttcacaaattaaaaaaaatctcatggccaggcacggtagctcatgcctgtaatcccaacactttgggaggccgaggcaggtggatcacctgaggtcaggagttcgagaccagcctgaccaacatggtgaaacccagtctctactaaaaatacaaaaattagccaggagtggtggcagacgcctgtaatcctagctacgcaggaggctgaggcaggagtaatcgcttgcccctgggaggcagaagttgcagtgagctgccattgcactccagcatgggtgagagatcaagactccatctcaaaaaaacaaacaaacaacaacgaaaaagaactgcctcactaaaatgttagttctattgtactacctccaatgcaaagacccagttcctgacctcaccagaaggtagacccacaatgtatatttagctattgatgctgatggttggttgttttcttttgttttttttaaacctgattctgtgcctgaagtgcctactaatattgctttgtgttctctacagccttgtttgtgtgtgtgcgtttttttctttaatcccctcaagatttgaaaattggaactaaacaaggaagaagaaagtgacaggccatttttattattctttctcagggttccaattttactgtgagtttctacttcttaaaagattttgcatttctcccctttgaatgttacttcatttgttcattctctaaggaaggaagaacagtatcataaaaattatgaatgaatgaaaatgatttttttacgagtaccataaaaaatgaatcaaacatgattcatttttgccctttgccctttgcactgtatcttggtcagtgccagttctcatgtcattatagtagttcctcagtgaacatgaaataatacaacattgtccattggaaccagttatataacactcgagataacagcaacattgcgtttattaatttagtagaaacaacagtattttacagttccaacatataagagaatgcagctgtgttaaatgacaaaaatcatgtattctattttgggcttctcaataactaagaaatagaactaaaatccttttattcacttattcatccaactatgggccacatactgtgctaggagctgtgggtacagaggtgacctatacagaccagtctctctctttgtggagcacatagtgactaactgggccttgacaattctggttaaaattgacatccacgaaagtgtctacaactaggatggaatctctttcctaacccgtttctttcatactcactaggaaagcaacctttccaatggatcagggtagatttatgactcatttgcaaagcaaaagcaaacagaatgtagaaaatggaagtcttaccactaataaatatatagattgcagattctgtttccttcttctttgaagtaggtacagctagatatttgcagctgtagaagccagtgtggtttgcttgagctgtgttcaaggttaaagtactgcagaattgtttgccatttcttccacaggcagatttagttatgctcagcctttcgctttccttactcaccatttcaggcaaagaccatttatgggctgcttcccccctgcaatcacagataagaaaacaaaacatatttatggctgggccctaggctcagcaccagttcctcagcattcattttattaggaagcggaggtcctctcttaagtgtagtcatcttcctctttacgggaaagcaacacattcagaaaagctgtagaacaatactcagaataaagatgcagaactatttgggcatcccttcccccatttccctgagtgagtaatgctctcccttccccatgaatcccctttcatgggaagctggatgcctatggtttgcactttgcagatcacaggagatcactgaggtccctacctttttactctgccagggaatgattttgccttaggcatggcaactagattattcccaaaccaacacagccacttacctgcattggagatgcagtgtctggcctgcttgcatgatgtgctgggtgccttttaaactcagttcaggatcttttaattttgaacctgaactagatcctgaaaaacaaatttttaaaatgtattatttgtaaattgtcttcttacctttttttaagttatctttccatgaaggtgagtttttcatttttaatttatttacatctttaatttacttgtatctttaatttataagcaaaagatacactaatacaaatttctcttaattcacaaattttttctagctctacccttgctcataaatattatatatccttttataccaaatgacctaaataacatccaaaagcctatttatgtagaatggtaatggattcatataggttcaatgaaattatattaaaatatataactagttataatattcaaatatgcaataacttagtaaaaactctcaagaataaatgtcagtgtcatccaaaatatattttcaatactgaactttttccagtgtgggtcatctagtcctataggcctgtctcatctttttttctgaataaaaagtacagaaattttcctgggctctgaatttcatgcaatcattagttgagcaatgatatttttggccaatcatttccctttctgaaccagtttcctcatttggaaaactaattatagaatcaaaatcagttttagaagacatttggtttgtcttacgtaatctatgagttccctctacaatggtacagtcaaaagggaactgttcacacgcttacgtgacattcgacaaacatctcggaggattgttgtgaggcaataaagtgaggtggtgaaagtgctttaaaatctacacatctccatatgatgcaataatgacatccattttagtgactagctgtatcaccctagacaagtcatctctctttccagatctcagttatcttatctgtaaaaaagagattggactagacgaccttgaaatctctgaccttccatttctcacagtcccagcctgatatagcttggatgctgaccctccaattctgatggtgaattgtaatcctcaatgttggaggtggggcctgatgggaggtgtttgggtcgtgggggtggatccctcatgcatggcatggtgctgttgtttagatctgattatctgaaagtgtgtggcacctccccccttctcttgttcctgctgccaccatgtgatacacctgctcctgttttgcctttgacatgagtaagggctccctgaggcctcactggaaggcaagcagatgctagcaccatgcttgtacagcctggagaactgtgagtcaattatacctcttaataaattaccaagcctcagatatttctttacagcaatgtaagaacagcctaacagacagcctcatgattttttgaaccataggtgctacagaggctgagcctcccttgaagctattactgaccaatcagaatactatcactaaggatctctctcgcctccttcctcccctcatccctcagtctctcttctccttctccctcttcttcaccagcctcctcctcctcccctcttcccaggcagctgcaatgcctccgaaaggcagggaatgaggggcccaggattagcgttccttaggcgggaatagaagttagcaggagagaggaaagaaattcttggagggaggaaaacttagtatttggcaccaatctcagggtatagttttctttaaaaaatcagtttaaacagtggaagcaaaggtagaagctctaagtgaatggtcatggagggtttaccattaggtcacagatctgtgagatgatgtgtgtgtcaaataccctggttatgcccagcagtcctctccagcgtttctcttggatttgactatctcaaaaactggattcagttagaagatctgcgtttgaggcttagcttttccacctactgactgcatgaccttggcatcacttaattggctgctcctcaggctcctcgtgagtggaactggaaagcctacgagccacctcacaggcagggtgtgtgcattcggtgctgtgctgtggaagaggctggcttgctgcctggcacgtggcagatgcccactatcaccaacatctaggggaatcacttcccctccccctgcttctgtcagaatattttgctgggtatataatttcaaagatactaaattaacatatgcttttctggtattgctgatgatataaattaatatcttttaaatttttattttattttatttttgagacagagtttcactttgtttcccaggctggagtgccttggtgcgatcttgactcactctgcaacctctgcctgccaggttcaagcgattctcgtgcctcagcctcctgagtagctgggactacaggtgcgcatcatcagcgtggctaattttttgtatttttagtagagatggggtttcgtcatgtttgccaggctggtcttgaactcctgacctcaggtgatccacctgcctcggcctcccaaagtgttgagattagaggcatgagcccagcctaaattaatatattaaaagtaatttttacagacagtagatcccggtatcaaagtactcctaaataaaatggctgaatattaactaaattaaaatccctgtttcatatggatcccattggtctatcaaacaacctcctagatcaagtcaaccccttcaggtacctaggaatgtattttaactcatacttatctttatgagtttcttgaggcaacatgtggcccaaaatcagggatctgtggaaacgccagacttttctaaagccacagccagcaatggataacacctgccctgagaaacttccatgccagaatagtttctgcccttctttatggcatggaactctggggatttaattgagcaattgttcatgtgctggaaaagatccatcgaagcttcctgtggaaacttctggcattacttgtagttatctctgtggtctgtctggagatgctgagcgctcccgtccaggaaaagaagcagttcccctgtttgtgacatcccactgcctacatcttggtttccagaccacatgaatctttctttatcagcaacttagaacaccagtactcctgaccctcatcagaggaaaccgctaacttcaaagaaccacccaaagcccagctgagagaagtgctatttatttatttatttacttatttttgagatggagttttgctcttgtcgcccaggctggagtgcaatggcacaatctcagctcactgcagcctccgcctcctgggttcaagcgattctcctgcctcagccttccaagtagctgtgattacaggcgcctgccaccacacccagctaatttttatatttttagtagagacggggttttgccatgttggccaggttggtctcaaactcctgacctcaggtgatccgcccacctcggcttcccaaagtgctaggattacagacgtgagccaccgcgccgcgcaagaagtgctatttagagaagatctcttagacagtgtgccctctacttgttcgtgtccacactccccatgctgtcccccaaccagaagacaacataactgagtggttaaaagacactgacaaaaatggggttattctaaaaaaaagcgttgccacataatttgtctccagtaacatcagtgtattttgcacctggaatgaggaagctagataaaaaacagttaaccaaaacacaggtaaacagaagtataaggaacaaatttccaagtaactggtgactttgagtgcatcactatccttcagttaataggaaactagaatctcataaaggttattggaggtgtcaagattatagtttaacaggaaaacgaataagaaaaagggaaagtgaaaatatttatttcttgaatgttttgaattcacattattaggccttaacacatttctttgaggcagtttcatgtccatgtacctatctgagtaacaaagattcaacatttgttttagcatctactgcatgctagacacttgcccatcttattagtgatttatataaagatagatgtgtatgtacgtacccataaacacatgcatagtcatagcatggggaagtcagcttgatcgtctcagtagctcagagtcatgttgcccatttacataacaaacctacaggctatttcattttcaagggtggagtgctataatttagcaatgaatctcagatgcagatgagaactttctaatgcttcacatggcagcctagaaatctgatttaaaagaatgatttttgtcctcccaataaatgatcttgtcccttctgtgaactactgttttcatcaaagtcaattacaatataatcataagaggcatacagatctccttacatcacgaaaacatttaaataaaataaaacaaaaaaactcaacatagagcatgaaaatgggctttatcccatgctactttgttagaaaaactgttaaggtcaagcagtgtaggctaatagcattaaaaaaccaacatgtgaacgtggacttatttgaacactgacactttgtattgatcttatctgagtcttttcttcattgtttttctgttctgtattatctggcaggtggaacagaactttatgactctttgacacaaatcccttctctcctttcgcacatgctagacctcacatagaaagcctatacgtagagtgttctaaaatgccacccctaattccccaccttagtttcattaggcaaaatggaatgttttctttgacttcattgggaagagtgaatacatatccaagtaaatgatggctttattttgcaactaaatccaaagcccagatgattgaggctctttcttcaaatgctcttcaaagctgccatgatggatactaaaagagccaactcccactggaggtcattatgaaccagacagccttgaggtcacttgtaaaactcaagactctcaatgtaaagtctgtaaagtctgactaagagtatgtttagaaaactgctatttttactaatctaaataaacagtgttctagctggtcgaacccaacttcaagacaaatcccctggtttctctcccaccagatgccaccttggcaccccttattctgttgaagtcttagggttattctctgtaagaaaggagctttatttgaatataattcatgaaacatctgtgtttttccattttttattatgagtcattaatctccctagctctgccatttgtgagttctgttgtggccatgggcgggccacattaagcctccgattcttcatctgtcaacacaggagattagggttcggtttttaggatcctttccagctaaaaattctgatcctggggtcacagtaattgataacaatgtataagttagaaatcacattttagaaatacttatggttagtaaaaagacaacagcctaattttaaagatcaaccaaggctctgaatagacaccttcccaaagaagatatataaatgaccaataagcccatgaaaagataaaggacatcattattcatcaggaacatgcaaataaaaaacacagggagacaccacttcatgccgactgggaaagcttaaataaaaaagacagataagaacaagtgttggtgagaatgtggagaaactggaaccctcttacatcgcaggtaggacttttaaacggtgcaacccactttggcaagcagtatggcaattcctcgatggttaaacataagagttgatcataatttaaacacatgactcagcaattgcactcctaggtatctacccaagacagatgaaaacatccatccacataaaaacttacacacaaatgtccacagcagtattacctataacagccaaaaagaaacaacccaggcccagcgcagtggctcacgcctgtaaccccagcactttgggaggctgaggagggtggatcacctgaggtcaggagttcgaggccagcctggccaacatggtgaaaccccgtctctactaaaaatacaaaaattagccaggcatggtggtgcgcgcctgtagtcccagctacttgggaggctgaggcaggagaatggcttaaacccgggaggcggagattgcagtgagccaagactgcgcaattgcactccagcctgggtgacagagcaagactatatctcaaaagaaagaaagaaagaaagaaagaaagagagagagagagagagagagaaagaaaagaaagaaagaaagaaagaaagaaagaaagaaggaaggaaggaaggaaggaaggaaggaaggaaggaaggaaggaaggaaagaaagaaagaaagaaagaaagaaagaaagaaagaaagaaagaaagaaagaaagaaaggaagaaagaaagaaagaaagaaagaacccaatgtccatcatctgatgaatgggtaaataaaatatggcagatccttacaatgtggtattatttggcaataaaaaggaatgctgatatgtgctgccacatagatgatcttgaaaacattatgctggcccacagagaaaacgtcatgtaagcacacaaggagaaagcagctatttgcaagccacagagagatgcctcaggagaaaccagacctgccagcaccttgatctccttgatctcaagcttccagcttccagaattatgagaaaataaattcctctagttttattgttaaaaaacaaaaaacaggccgggcatggtggcttatgcctgtaatcccagcattttaggaggctgaggcagctgtatcacctgaggtcaggagttcgagaccagtttgaacaacatggtgaaatcctgtctttaccaaaaatacaaaaattagccaggtgtggtggcatgcacctgtaatcccagctacctgggaggctgaggcatgagaatcacttgaacctggaggaggagatttcagtgagctgagattgcaccactgcactccagccctgggcgacagaaactctgtctcaaaaacaaaacaaaacaaaacaaaacaaccacagacacacacacacacacacacacacacacacacacacacaaaccccacaaatcattgtgctaagtaaaagaagccagtcacaaatggccacatattgtatgattccatttatatgaaatgttcagagcaggcaaatcctggagacaggaaggtagattagtggttgccagggcttgcggggaggggatggagggtgactgataatcagtattgggtttcttttgggggtgatgaaaatgttctaaaattagattaatggtgatggttgcacaactcttgaatggaccaaaaaccactgaattatatactttaatattcttgtctcttacagtcatattttggggtgtcatattctggtctcctatagtatgtgagatttacctcaataaagctgctatttttaaaaacccagcaactgatgactaaagtaatcacagagttatgttgaaggcctagaatatccagttattttgaaatttgttgccacatattaccccatcagtgtgagattttacactagttgtttttccagcttaaaactttagaaggctgattttagagacctaattttcccttaatgttctgtaacatcactacctaatagtagaagtttacaaacatgttgcaaaaaacttgctgttccctcccccgttacaatcttttcaatttaatttagtgttagttttaaatcactcctaattgcatattttgaattttccctatttaaatggaaatttttaacaaattatgtcactaggactctgaataaatctggtgtttccttttatatcaattttttatttctaatttatttgtttttaacttaaagctctgtatattccgtttatttgaaatgaaatgcatctgtctttgattttgcatactgtgttttcagtagtacataatcctgaatgataaatggcctctttatctaaatagagatccctaagtatcatgtttctaaaatttgaatttaagatcatgagccttttacaaaggttgttcgaggttaattaagcataattcacaataagagaaaatattctttccttaagatgtagcttattaaaggccgaaatctcatagactaaatctcatagaatctttggggttggtggcaaggatgggagaagggttaagaatgcaattgcaaatttccggacgctaccaacatttttatttgcgatgcttattcttatagggctctgaaacttaataaaaaaaagttaactcttagttcttaacctctgtgtcatatctctatccaagtatttatcagataatatgaagtgggcattataagtgaatgcctagattaaagtaaccacattaaatggagactacactaccagctatgctgacagggcccatgctttgatgaagagcattataatgtcccatctcctctcacttccagaatgatggagaaaggccagagagttcatattccatccaccaacagactaaatagaagatgtgaaagtcatggggattcgtatgaactgaaagcatattttttcagtcccacagttagcaatgatactaatttttaaaatgtcaggtttgtcttccaaaacaattggccttaaatcaagaaagaatgtaaagaaatgaaagaatgtgcacataaatacacacacacatgcacacacacacacacgcttgctgacacgcatgcatacacttttctctccatgagaacgtcaagtttgtttgagtggtggtggggaggttgatgtagaactagaagaggtttttggtgtgtgctttaattacatttttcattcagcttaggctcagggaaagctctttctaggcggggatttagaaattgacttgaatgtggcaagagtatgaagctgtgactcactgctgactaatcccttatgcagataagattatttgtgacttttacatgggcaactttacaaatatgtaatattttattttagagtaattgtgttattggtctttaaggtccacaataggactgaatgtttaggcagctgctgtccagcaacattatatttagtttgtagaaagtttctaatcctaggaacctgctttttcctttaaatctttatagtatattaaacgcactattttaccacactgatttcttgctttagaggttttgccattctaagtaatcctcaaactattagattcaatatgtgaagtctctgatctcaaagtctgaatagaaaattcaaaatagtcacgtatatagcatttatgtcttgaatccaggtgtcaaaaaataaatcaagaaattacctaaatgtttaacaccagcaactggaattggcacttctccgcaattatgttcatttcaataattctgctctggtttgttcattttaaggctgtcttacaattcatattttaattgtctgtcaatgaaactcatagataggttttgtagctcttggcacaaaagacatcacagtgttagccactgaagtggccaaagtctaaaatcatcaaaacttggacagttttcatcccatccatacatgggtcattgactttactcatttttccttaagcttcagaaaagttatttacacggaaaaaaatctgtgtggtttaaaatgtttaccaggaaaaaatgctctaataacgtcaacattcctactgtctatgtttatgagggaaacatgtcttccgcatgcctctctgagctttttacttgacactgccttctttgagggtcacagtttaacagggcacattcattgatcattaggcctgtcaccaggctaccatcagggacctacccttccaatgacctatagccatgcacaactccttttcatgtgacatcagagttaattaaggttggtttgggagaaatctcctgctgaccaaggagttaccttttcccaaaaaatgctctactcctacaccgctggtctgttattaaatgagttcaaaaaccacctccatagagctgtctaacaatatgtcatttcagtttaccatacgatgtcatgaaagttatctgagctgcctagggcaaaggtcaagatctggttgacagggcacgagacataactcgtaaaatactcggtagagaagtctggtagaccttcgtctggttatgcaaatggacacgaacagagaaaacactctttacaccctaaaaatgcatacaggaacgttttgtctgttaggaagggcttggacacatctctgttttctctatcagtggcaggacacttttacatttgaagcatactccccacgggcttatgttcttatccaatgtcactgtttagaggtctgagaggaaactgagctctgacgtcacgtcttatagaatggatcataattgccagtagtgttatgctactcagaagttgtttcaggctgaaatatacacattttcagattgtgaacacctggaagagacatgacaactgattgctcagtggagatgccatttcaataaacacactcaatgtatgtgagactaaatatacaggtggcttagtgaaagtaactgagtttttaaattagtttgttaattttttatcaatttgtgcatcctctttagaatcatagtgtctgatcagtgacaaaatgcttttagctgcaagagcatttgcatagagttgtattattaagactagtagtactaataacatgcttgaactgccttaactttagatttctaatctctaaattatttaggattgcaaatttcagttctgccaaaggcatcctccgtgttctctttaaataaacaattaccagtttggaagcatagcatggaatgcatgtgactcgcaatctaaaatggaaagttttctgttttacatagcatcaggattacagtttggtctatgtccagatattttaccaaatactctgctttcattactgttcagtgtcaaagttccaggcatctatagagatgatgacagcatgtttcaatgttatggatttgtcatttatgtggatccctgtgggttcccttagaaggaaagtctcacagaaaagatctgggagatatttgatcaattccgtataggagcttgccatgtaacagtttaagtataaaagcgggaattggaacttttaaattttattcaactacgtcttataacctgtcatgtgacataatcttcagatccacacacagttccttctggaaaaaaatgaatatgtcatggagctgtaatgtgatgctgttaaactaccataaaatgcatattgttccagtttctattttgattcccaaatagtgccttcacatttttgtataataaaatgaataagaaaggctggcaaacaggcagacagacaagtgtgcaccttagcactgtagctgttcatgccagaaaagccaaaaatgttattatagcaatacaaagccttatctattctcctcatgcagactttcagcttcagaatcgattacaaataatgacagaataccatttgctttgtatataaaaatggaggagagatgaaatgagattggaaggccgaatgtgataaagttctgatgttaattttcagcttactttgatacagtttatgaagtccaaattatatagaaaacatctttctggagtcctttagactgttcataaagggtattctttaaattcacccactaacaggaaagttgagaagatctctatctttgcaaccaataatatatacaaaccctctgacctttgagatttaaatggccaagagtgtgcaataaagttatccatcataggggaattgagtttttgaaagctacattagcaaatttctaagactcattaaacacattcttgatgattgtgttttctattgtcataatcagtttccttctaagttaaacaatttgaaatataattgcctttcattacacatattttggagattaatcatgcttcggaaatggggtggacatgttgattaaactgttattttttattctgggtttttctaatttcacattttcttaagatatccttcacgtagtaagtatttgtaagagctgtgctttcctaagatttcaaaaacttaaaaaaatcttatcttagatggaattcatgttatacaagttttgctgagagtcaaatttctggaaggaaaagtaatccattaaaagtagtacattttcaccagcagtatctgaatttttaaaagaaataatttaccgaatgtttttcactcatttcggcatgtgatattaaggccttccttacaaatacccatagaagactttagcgttgtttgtattcaatgcctggggaatgctggttttcattctcaggggatatatacccatacaccttcattactctatctagaactttatttctagaaattagcttttttaaaaatatcatccaagacattatatctctgatagaagaaaaacaacaatttctgttatcagttggccaccaacccaacagctttaaaataacttatgaatcagctcattctgtaggacaaaaccaaaaccaaagtagaagttacataaaaccaaaaggaacagctctgtggagaggtagtaaggtgcccaatgccgaagctgctcccatgaaattaagccaccacctcctttggatgagactgatgaactgagttaagggttggactcttaggtgcaatcccaggagtctgggaactccatcctcatttagctatgcttcttatctctcttttactgccaccaatcctggtttttcccctcactacattctctatatgacccctttctctcactcccttaccttgtttatttttccatctttaacctcaacatttattctttcatttaattttttgaacgtataccgatagagatacaacaataaacaagacaaacgaggttgcttcctttacagtgtttatagcttagcatggacaacagataaataagtatatatagatatatatgtaatgatgcataaaaataatttctgcttaaagaaatagaaaattacattatatttgtgtgttatcatggggaagtgccaggtgtggaggtacctcactcagcccagggagtgagagtcttctattagaataaagttggaggtgagacctgaagaatcaatgtgtatttgctaaaagaaatagcagggtctctttctccttcaaagacttccacatctttccaccctctaagcttcatctttccttttaaacaagtgttttcttctaacagtttcacatacatttccttgtttcttagaactcttgttttcctcagcctctgtgctgggaggagaaagctctatcatcttctttcaatgctgtggttcgcatattttttgtctggggtctacctgacttcacctgccactaggaaaaaagccacaagtaatcatactttagatacatacccaggtcacgttgtgcttgttaaaacagagcaccacggaagacgaccggggtggagactcagcaatgagggaatgaatgaggactgtcagatgtgatgcgttagccaggacttcatgttcttaacgtgtccttccttttggcaggtcacctagccagtaccacacatgacccagagccaagaggaaataattttcaaccaaaatgttctcattccaggtgacaaaacaatggcagcaatagtaacattacctagtgactcgggctctgttggtgtacctagaaattaaaggttccaatcaactatcttctgtgctgtttgggaacctaagccagttaacagtctcccagcaggaaggctcatctcaaggaaaatatctcctgggaagcaattctctagaagatgggcagtgtagatcctcattctcaatcctgagtctacagtcgagtcaggagaacatggccagcttagccaaaaatgagaaaatggtcactggacctagaagataacccaaatggaaggaacagaatattgcctgtgtattgggagaattgttgccagctcctggccatatttctcctaacctcctccgcttatacacacacacacacacacacacacacacacacacacacacatacacgtacttagaaggtgaaccaatgaggaaccatgactcctagaagggcctcagacccagagaaatggctcaggatatgatttcagtcagttcagccagtatttattgagtgaccattatgtgccaggcactgtactggattcacaattgcaaagatgggtcagaaacatttcttcctcttgaaggtctttcagctctaagctggcctcttaggggctgtcatttagaagtagaataggtgaatactaagaaatatggaagataatctaagtcaacaaatagagatctcctgcaaactatgtacactatgtctttaaggaacacatcctttaatataggaagtcacacattcttcaccaacataagtgatttatcttagtaaaactcagttaaattcacaaaataagaacacttattcaatgataaacatgtaacacaatgaatacaaccatatctatacctcaaaataaaatataatggattacttgatgataatcccttgagcatcttttaaatgaatgtattaaaatgttataaaataaaaatcttctacacattcctgaactcagcttggaaatagggcatgaatctagaataatgactggctataaaatcgggatcaggagaattaaatttaatatggctcatgtttttcctcatgcagttgtgggagaaaatacagacctcgccgggtgtggtggctcacgcctgtaatcccaacactctgggaggccaaggcgggtgggagtttgagaccagcctgaccaacatgaagaaatcccatctctactaaaaatacaatattagcccagcgtggcggtgcatgcctgtaatcccagctattcaggaggctgaggcaggagaattgcttgaacccaggaggtggagattgcagtgagccgagatcactccagcctggacaacaaaagtgaaactccatctcaaaaaaaagcctggacaacaaaagtaaaactccatctcaaaataaataaataaataaataataataaagaaagaaaaagaaaaaaaaagaaaagaaaatacagccctccaaatcattggaagaggaatatttcttaaacctcccctcctaagtttgtatttaacattatcccaaaatggtgaatgaattactccagcaaggcaattccatgcccatcggtttggactataaagcgcatttaagaaataacaacaaccaagcaaactttatttctacagtttaggattttactccctctaagaaaagataatctggatatagaaccactaagtttaatgtcagtctcaaaaggctaaagtgaagtagaaattcctgaaaattcactcctgttagtttcctgaatttcccatttgccttctaagtgactttgcgtagcgaatactttgatagggtatttttcattgaccagttttgaagacagaggatgggatgggagcttgagtggctgaaccacttttagcttgtacatcaacaatgtgtgtcaaatatttcctaaccctcaagaagttacaggtactcaaagtccattccagggcactgcaattactctatttccacacatatatttttctctagttctaccagaagtccttatggagaggattctgaagccataaaaattttcaaagaacagcagtgaacaaaaatctgatctagcaggagacattaagtggaaaaagagagttaaacaatgttttccaaaaagaaaacaataccattaatcatagatgcagtgttgttgccagagtttacactgccttttaaaactgtttgtttgtaatcctctctagcatatccctgcctccccatctgtttacatacatttttggtttctctaatgccaacttagagaaagaaaacaatcataaaaatccaacagtggatttttacatacatagacaccatgcatatttttacatagtatatacaccattccgtataatttccatctaaagcatgtatccatttgaccaaacgttccagctttttctttggagtgaaagataaaactcctcaataggtggcaggataggatttttctcagcttctggtaacatgacagtattctggttgaaaaagtgtccttctccgagtaacaggtcaagaaagaagaaggaaaacgctattttctccttcttgacttcttgcaggtctatgttaaaggaatgatctaagaaggagggagagacacaggagctacggggcttaaagaaatgctccccgtgttgctcactgtacaaggactgccaatcaaacagggaaatcaaagtgactgacagtaacttgtttaagaaaaaggctcttggatggttgtcttttctcataaatatgacagtttttttattccaaaccctgaaaacaaaactcttgccttttttctttaattcctagatttaatcattcaagatactttgagtaaatgttggtggaaagagtccccgatttcaaaattaaaaagacctaggtttgaatcttggcttggctgttccataaatggatggccctcagcaagtcagcagggtttcctcagccttggggcttcaatccataaaacaaagttacaggtgtgcacagtaggtggctaggaagagacttgatggagttaacacagaaagtgccctgtgctgacatgttcacatttttttcccttccctgggggacagttaatgtcctcccctatccaattcatgtagcatctgccttcagggtcaaacacacttccaggtcgttctgtgaggtattttagtttcattctggaaaagctgtgagctttctggaatctgaaaggtgcagaggagcccacgttggattcctggaaaccatctgtgagagggcagtcccagctttttcctcggacctgcctgatatgagcttttctagaataaagtgctgtcctcatgctgttgtttgtcatctgaactggtttaaagccatatctaggagagcagtttggaagcccacataaaatcatgtccttgatggctttggggctccttttctgactaagttttttgggaggtccttgaatgcctacgataagaaaactcacatgattaaaattctgtcttattggagatgtgaacagtgtctgccacatacagcagtggaatctcccaaggccactttaagctggagtagcagtggcttctcacattctttggagatggccaaactccaaggacagaaggagggaaagactagcacagtccccttgatgctttttccttctcctcttttcatttaggcttgaaggcatggtaggaggatccctaaatgtcgggtttgcaagtctgatagactcagattcaaataattccaagtttacttaccacttctgtgatcttagggaaagtatttaatttacctaagcatcagtttttgcatggttaagaggaccgtacctctcgggactgagtaaaataatatatgtaactcctgttgtggtgtggggggaggggggagggatagcattaggagatatacctaatgttaaatgacgagttactgggtgcagcacaccaacatggcacatgtatacgtatgtaactaacctgcatgttgtgcacatgtaccctaaaacttaaagtataaaaaaagaaatatttgtctgtaatatttaaatgcctaataaatatataattgaaataaaaaatatatgtaaatcaattacatatattgattgtatagtcagtagggtttggttgcctcctttctcccttccccaaagcatgtctgtccctgcagtctcggcacctccagaaaaaggtgctaaatcagggcctctatgataagagccccaagaagctgcagagctgcctgcactcagaatcttggggtcagctgtcctcccttgctggtgtcatgttagtcatcagaggctgctgcccagcatgcctgtcaggtactcaaaacaaaatttgaattaagaatagaaagctcttctctggggcctgttttattttttatttatttatttatttatttttactcccagatactgtttagaagggtcaagacattatgtagcatttattgttatttactataataagttatttactgtattttcttggccaaactccagcttaatagctagactgaaaagcaaacatgaagtgttacacaatggtgtggtccattgtgaggctgtgctcctctccacgcagagaggcatctgcttcccacccctcgcatctgagctgggcttgctttgaccaatagaatgtggtagagcggtgttgtaggcgttccaaagcctaagcctcaatatgccttgcagcttccaccatcacactcttgcaacaccgctgcccccagggaaaggaagccccggccaggctactgaatgaggaaagatctcatgaagagggaggcccagcaccaaggacccagtggaaatgccaaggactatagatgcatgagaaacccaggtgagacccgaagggaaactactcagctgagcctagcccaaaggtctagaagaatcatgaagcataatgcattgttgtgttgggtgactaagttttggcacatctcgttatgtagaaatagatggcagatccaaatggctattgtgcctcagccttgtagaaacagtgactgtgtggtagttcaagtgtatgctctttctgtatttgaaaataaaagcaccaaagtggagctcacgcaatattaagaattacatgttgtacgggttaccctggatgcccccaggaagggggaagcagtttgaattcttggtgtttcacaagaagtgttcccaggaccgtggtttcacacgatgggaggccagctctgtctccaaccagcagtagcttttcacaacagtggggacagaaccctggcacatcatgaaagttaggaggccaccctgcctccaacagatagaattcagccacccaagtgggagccatactgatcccagcaccggaaatgcagatacggaggcccggatggagaggaaattttgcagtcatactggaggaaaccagggctggaccaaggcacgtgggtgcccgggacaggccaatagtatggtgtttgccaatatttacatagagaaaagactgagcactccacagcataaggcagaagcataaggcagagaaggaggaccattgttagtctagacgggcaattcacttctgcccctaacgtacgtacctcactcggcaaaacagtccccctctcctcagaaggcaatttaatctagactcattgattcaatgccctggcatttgatctaagtattctttcttgcacactctactagcacatactcttcctggcaggaattctcgtaaatagtttcttccaccttgtcgtatgtctagtgatgatttagtgccttttacagattggcatttgggcaggtgcctcccatgtggccaggcctctcaaactggcccctgggcagaggttctcaaagtgtgatctctggaccaggcacaacagcatcccctgggaacttgttagaaaagcaaattcttggccctatcccaggcctactgaatgagaaactctggggtggggcccagccagctagttttgcaagcccaccaggtgattctaatgtgtgatgaaatttgaggttcttaacctcagctgcccattggaatcacccaggagctttaaaattacctatgcctaggtccctctcaagagctcatgattaaattggtcagaggtacagccaagacccgaggatttttaaaagctctccagattattctaatgtagagcccaggctggggaccacggccctagagagaggcaaaggctttcatagacatcacttggcagactaattcctaattagggttttgctacaggtggccttgagtttaagtggttttatatttgtgtataataacagccaaggcttttcatttatgctaggttcacttcaggcctcttttaacaaaagaatctgataattgttgtagctctgcctgtgtagtccacatgggtggttcggtggcttgagaggaaatccatttgtgctccacccattaaatagaaggatagaagaccaggctgagaaaaagtgcctgtgagcaccgtgataatctgtgaaaaggtaaaagcatttgtcaagactggcaatgatgacaaggaagaatgttaagtgcaaatacattccatttcaagacagtaagaggcacatgaaatgtgtgatcggcagcggcacaatgcagcgagacaatgacacctccctgacaaccaaaaattctgcaggatacttaccgctgctggtttttgccaccaagtcattttctttcaaaagcaaaaggcttgtagaactttatggtgaaaacctggctatttaattgcatttttactattttccaccaaatccatattttccaagaccttgatctcgccacccatgatttggttaaccatggtattcttcaagaccacaacctctgtttactttgattacaagtctaagccaagtacaagattttgtaaagaattttggaggaggacaccgatgtcccagcagaaggcggcatgagaccaacgtgggagccagaagagagaggttcctggctggcccaggtctagtcccttagtcacacacgtcaaagttcatcactagggtgttagtgaagaggaaatgggaccaggcgcggtggcttacgcctgtaatctcagcactttgggagatcgaggcgggtggatcacttgaggccatgagttcaagaccagcctggccaatatggcaaaaccctgtctctacaaaaaacacaaaaaaattagctgagcatggtggtacatgcctgtaatcccagctacttgggaggctgaggcacaagaatcatttgaacctgggaggtggaggtggcagtgagccaggattgcaccaccgcactccagcctgggcagcagagcaagactccgtctcaaaaaaaaggaaatggaccctgacaccagaactgactttggatcctttactaaaatcaatgcttctcgatttttaatgaaaaaacaaacaaacaaaaccacgtggggattttattaaagtataggctctgagtcatcaagttcccaggggatgctgatgttgctggacctcggagcacacagagagaagcacgttttggagtatgatgtgggaatgtgcagtgtgggccgggatgggggtgaggatagggaggcaccagctcgagcccaagccatgggattccaatttttaagaacatgtctcgcacctagcagggtagtcctgccaggaacccatttatatgaagggttgaggaaacctcatcctaaagaaagaggaagttagacagaccagtgtggtcctgtaaccaaggcccctattaaaacagagttgattctgactgtggccagacctctgtcattcaggtatgcatctcagcccagcacccaaggacttgggtttaagagagggcaagaaagtcaaaccctaaaatttgaggactctgttctctctaaaaattgtataacacgctgcaggaaaaggctgaggtgcttagcacctcaccaacagaggctaacacaggacttctgcagtgaccagagcctggctttggtggctcacaggccccagcgaagcatcatgcccacacaggaggggaggacatgagacagtttctcaaagagttgaaaatcatagctgatctcatacatctcaatcgctcactgaagaggacaaatattatctgttgagaacagttactttaagtaatcccttgtaaatgaggccaaatgaacaggcaggagcacattactatactggaataaactcatggaataaatttgtgtctgagattgcttctgcgaaatgatagtgtggccacatattcattcatttactcattcgttccaacacttaccgagagtctctgtactaggctttatattaggtgccagcggtctaaggacagctaagacatggggtctctaccaaagagaaaggacacagacacataaaatcctgacaatgcaaagtgagaattactgaaggaggagtacacctcagggctacaggagagcagaagaaatggcaagtgctgtctgggagctacaaggaggagctcccagagatggtgattactgggctggatcttgccagcaggagaggaggagacacagagggagggaaaaggtcttgcaggcagacgagcagcatgaacagagtgatgaaagtgaaggcgcctctgaagaagggggaataatttgtttgactagggtagagtttgtgtagctggaacccagtgtgtgtgtggagagaagtggcgaaagacaaagctagtaccataagccacaagtatgtaagccacagctgttcaggaaaaggataccaagtgctcgtaaggaaagttaatcttctcatcaaatctcttggcatgctactaagcagccatcattttgattcttagtttaaaccccttatgtgcgttaagaaaatagaagaaaacttcatattaaaaagatgtcatttcgaaagaaattttagcactgtaataatgttagtcaataaatatttgaacatctgtcttccgtctggggaagaggaaatacaccagtgaagaagagatgttgtctgtagcaggaacatcaggttctgttcctaggcctgccgctagccagctgttgaccttgaaaaacagcactggcctcctctgggccggttttctcatctctggcatgagtagattgggtcaatgaggttccatctagctcttacaacgtgtgtgtgtatctgtgagacaagatcaagttcctcaaagagctcaaaattgaggaaaggagcagcaatcagaaacagctttcaggcatccagctttaccaagatggatgggaaatccccaggaattcttgacatctccccacatccgccccagcggcaatgcaggaaatctagtccactatcttcagcagactcaatgcaactgtttccttaatgaacccccctgcagccccgtgagctaagtcagaggctttcttttcaagccctccctcaaataccccattcctccaatttccttcccctccctcaatctggtataaaatccagcaatttaatcagcagcatgcaatttccacagcacccaagagtgtgaggaaccaccagtgatcctggaaagcatctggcaggagatcttgtcatttcttacaagcctctcctataaacgaaggccaatggagcagaatggactgttcggttctaccaaattgcttaaaccaaatgccacagatggtctatacttttaactactcacagtaatatatttttacttaaaaaaaagtctggtatgatttcaaatgcccttcctcccctacctgcaatgacaaatgcactgaaaaatgatgatatttacttgatacccaacacacccctaactgtgagatccaaaccaagaattagacacgcctggcctctactaacaccagcaggcttcgcatttaacattcacgtgccaagatagcttctctcactttttctccattcttatccccacccacatacacatatcagtttaaagcactacagaagctacttactctgttatttgttcttgtcttgcccaactgcccaagccaggtcaaatatcagccataactctgctgtgtagatctcaataggctgcataaccttcctcgaggacattacattattttggtcaatatgaaaccattttttggtaacacatcaccttcaacttccatattaaataaatttaaagtagacttagaaatgtctcgatcatttttggaaagaacaaagtaattacttggtttgtttcttaaaagtcacgtaaagtagactcaattttaaataaggggtttagtatccctgttaaaatctggaactttttttaaaagaataaagccattctgttaatcaaataagtgttagctttaaaaattcaagaaataaataggggtttaaaatgactgctatccttagaagagttaatgcaactagagttttgagggagcatctactttatagagttatacattctgctagtgaaaaaagcccaagataaagatgactgctggctcaggcatcctctaccagcccatctcttccaaaacagcctattcaaggccaaattgactggctgtttaggtacatgctactaaagaaaaagaaagtttaatgtgattagcaggggaaacccagttcatcctaacagccccagcatcatatggtttctcatccactctatatacaaatataaataaggtggggaagagaaaagagaaagacagacacggtgttcaggccatttcttggaatcattcattgaattttggagtcagaaaagggccttagaaatcaaccacctatactaacgtcttcattttacatacgaaaacaaagtacccacttggtgatcgttagaaaagaaaccagatagcctattatagaatgtccaacagggaaattttaaaaatgtaacaaagtgctaaaatagtaagcaacaatatttgaggaactggagtaagtagtcacctacagttcctttgtaacatgatgcttcagttggaaaactgtaggctgccaaagctcctaaataattaatatttcgaatatgcaatttagaccaaaaaaaagtgcagcttcataaaaccttggagaaaacaacaaaaattgttacaaaaaattaactttattataagagatttattacattcaatttgaaataggtattttcatgtgcactttgatttaatattattaatatggacttccttcacaaaattcacaatttcagtatttccacttagttatagtaaattgtaaatgttagctgttcaagaactcaagaaaaatgagggcaaagaaaaaggtctgtagctttcatccaggttgtgataccttaaaagtaagaaatgagactcagagctggagaaagaggactggtatcctttatagagaaagagcaatagagaggacttgaaagtatctgaattattggcatctttttatttcccagaatgtctggaagaggtaaataagcgctttagaggggaaaggcattatctttttgtaatactgagcctctggttattttacctctcaatgcatgtgcacaccaggcatgcacacacacagaatattaatagctgataagtattcaaagattacatagtacctgaaggaaggcagacccaggttcataatgacgcaagagaactctgcagtggggaaccgtggcttcttactagacattgcttcccggatatgcagcctctcagttgagcatgaaagccctgatgcggtttgtaaagtaggcggtagctgattgttttactgtgagatgcttgttaaccagacagagaaactatgagttttcaaaagcacccatgatgccgactgagctaacatgaactaacagagtgttctgttaactgttaggtaaagaggttctcagcttgccaatgttagtcctttcttcccaaaaaagtgcaaataaaaaaaaaaaagaaattcagagttgcaaaactgctgccccatttaagtaaattataatctaagaaaaatcacaagaggatcccactcacatttctgtaaagtttccactgatctaagatgcttccaattacaaagaaaacgatgcttcactaaagtcagcatgttttcaaaataaagatataattatgtgaagcagaaaatctaataaatcacgtacttttccctccgtaattttagattcatgtaatttagctagatttatctttacataatagtcgagtgaggtatttaaattctctaagcaattatattttaatacaagtgacttttcaaaacaaaaaatgtatttgtgaaatagaaaatacaacattttatttaatatagttatgttagcacctttcccaacctacagtgagttctcagaagttaccacttcgccctgtctccgggtttagtagtttctccaatctaattggaactattacttgttacttggaaactgacggtctagttagtcttcccactgagaaagaatatttaattattactgctttttgggtttaacaagctttttgttgttgttgttgttgtactacgctccatcctattgacttttcttcccgggaatcattgcaatgacttattttatattactatattttatttcatattttaccttttctccacgatgcttaaaagaaaggcgctccgaaatctggctctctgcgcccaggggaacgaggcacaaatctccgccactcagccccactgagcagagactgcgagtccgaaccctcaagttcctcggggctttgacccctcaatggcggcggtctaactgctggtaaaacccccggcccctgactgttccaccgcccgtctcccaaacgcccagcgaaggctgacttaggtggcgggcggacctcatcgattcctcaaaccacatcgtttggtcaaaatcgcccgccctctcttcgctcggattttaaaggctaggcttgtaagtcagtaagttaacggtatttgggccctgggctgcccttgtgggtcagggtcactgatgtccgcgacacggactggaccgcgcaccacgcctgctcccggcagaggccccacccgggtggctgagcgcagcgcactggggccccgcggtccgagagcggcggggaggagcgggcgctcgccgagcgttccccgggacagtccggcttggggactcaagcgggtcatgggatgccggcgctggccctctcctgagatcctcctgctcccccgcaggcacgagtcccctccaaatcggctcccctcctacactctcgtgacgcgaggtcgcggccagtgcccaatatcaccaaagtcccggcctcagcccagccccgggcagcctggcaggctttcaggagcctctgctcccggctccgggggaccctgcgtacctgccccaggtcctctgggaatgggctctgggtgccaggcaggtcccggtgcgtgctgctcctagtgcccagggcctcggcagtgagaccccaacccgacagctggataagggatcagcgatcctgtcgcaaacggacagccccagcgcggacccggtctgagcgctgatgctcgcgggtccaggccagccactcctcgaggcgctccctcggagaaagggcgcagcggccccaagcgtgcccgctgcaactagtgtcccaggttctcgccgtagccagcttctccgggctacagcctcgtctccccgcgtgcaccccgccctggcctcggaggctctgccctccggccgccccatcgcagcccgcctcaggccccggcccccagccgcgcctcacctgtgagaagcagacagctgagcagcgcgcacagcaggaccccggtgtcccagtagctgaccatggtgagcgcgacgcggcctgctcgcccggtgcccgcgctccccgcggccaacgacccggccgccagagtccgtcctctcgttcgccgccgccggccccgcgccctgagcgcccgtctcgcggctccagccaggagacaaccacttccccgggtaatcctcgccgccaggcgcccgctggccgctgcacccgagccccggagcccgctccgagccgccgccgctgccggggaggagccgagaggagtgtccgcctggcgcgctccgagcctcccgcggacctcgat

SEQ ID NO: 5 - DNA, 3358 bp, Homo Sapiens
aaggccccgctgcgtcttccgagccgcaggcgcaggcccagctgagcggccgccgagcgggtgcgggtgcgggcgcatcggccatcaccgcgcggccgcgcagcggacaccgtgcgtaccggcctgcggcgcccggccaccggtgagtccccggcccgagcccaggagcgcctctgacccgctgcgccgcgcggcctgccgcccccgcccccgcccccacgcggatcttgcgcatccgagcgtggccgcctcgggtcagtaagttggtccggccggggcgcgcggcagctcgcggccagaggtggcggcggtggtgggggcggggagccgcggcggcctggagccggagggagggggcggcgcgctgcggcgactgctggacccgtgaccctgtgcgcccccggcccgcggagggcccatccgctctcggtgccagtgccacggccgcagcccctacccgcctcgccccacgcccgctttgttccccgcacgccccgtggtcgcttccatcccccacacacccccgcaccccgctgttcccggcgtaccccactggcaggcaccggcagccgatccaggcccgatccccccaccccggagccaggggccgttgggccctgttgttgggctcgcgggggtgggggggctcgggcctttgttggtcacagatggcccggggatttcctgggatagaaatagccgccggctccggccccttaaagctgcttaaggggcgggatgcggaggggagggtccgggcacaccccacacgtccccggccgagaccccagcctccgcgctgagctcccacccgggagacgccggcagcggcgcaggcctccggttgcttgtgagaaacgacccaagccccaaatcccgaggctggcggtcgtcccctcgcccggcccctcccccaccctaaaggcggcctagagccctgggaaggccccacggcgccgcccgtccggtcctcacgcgcttctccgggcccaggctccggggctccccacagcccggggcaaaggtcacggtcttcccttgcttccccctgggttcccagaagcaggtggagttgcgcagggctgggtcccgacgctgtcgtcaagccaactgttccactgttccttgtctgtcttctctaggggcggaccgcggaacccgaggccatgtcccatgaaaagagttttttggtgtctggggacaactatcctccccccaaccctggatatccgggggggccccagccacccatgcccccctatgctcagcctccctaccctggggccccttacccacagccccctttccagccctccccctacggtcagccagggtacccccatggccccagcccctacccccaagggggctacccacagggtccctacccccaagggggctacccacagggcccctacccacaagagggctacccacagggcccctacccccaagggggctacccccaggggccatatccccagagccccttcccccccaacccctatggacagccacaggtcttcccaggacaagaccctgactgtgagtctcaggaagggaggggtggggtggccgggagggcagggggaggtgcttgtgagtggcgctgacccagcctgtctgcttctcagcaccccagcatggaaactaccaggaggagggtcccccatcctactatgacaaccaggacttccctgccaccaactgggatgacaagagcatccgacaggccttcatccgcaaggtgggtaggggcatctccaaggcggtgggggctgtggctcccagcggatgactctgagcggctccttccccaggtgttcctagtgctgaccttgcagctgtcggtgaccctgtccacggtgtctgtgttcacttttgttgcggaggtgaagggctttgtccgggagaatgtctggacctactatgtctcctatgctgtcttcttcatctctctcatcgtcctcagctgttgtggggacttccggcgaaagcacccctggaaccttgttgcactggtaacccccaaacctgagcctctgtgcctgggtccggccatgcagtcccacacgcccactcttccgggcctggtcaccgtggttctccttgtgctcatgaggcaggggccggcaggggtggcatgggggcacacacccaaggtcagcctgtgtctcccaactgcagtcggtcctgaccgccagcctgtcgtacatggtggggatgatcgccagcttctacaacaccgaggcagtcatcatggccgtgggcatcaccacagccgtctgcttcaccgtcgtcatcttctccatgcaggtgaggggcctcccgtggctgggctgtggccgcaggggctgagcagctttcccaggcccagccccatggcccgttcctctcccacctgcagacccgctacgacttcacctcatgcatgggcgtgctcctggtgagcatggtggtgctcttcatcttcgccattctctgcatcttcatccggaaccgcatcctggagatcgtgtacgcctcactgggcgctctgctcttcacctgcgtgagtgaggggtgaccttggccgggggcgggatgctgggcaggcaggcttgtccctcaacaccactgtgctgtcacctccagttcctcgcagtggacacccagctgctactggggaacaagcagctgtccctgagcccagaagagtatgtgtttgctgcgctgaacctgtacacagacatcatcaacatcttcctgtacatcctcaccatcattggccgcgccaaggagtagccgagctccagctcgctgtgcccgctcaggtggcacggctggcctggaccctgcccctggcacggcagtgccagctgtacttcccctctctcttgtccccaggcacagcctagggaaaaggatgcctctctccaaccctcctgtatgtacactgcagatacttccatttggacccgctgtggccacagcatggcccctttagtcctcccgcccccgccaaggggcaccaaggccacgtttccgtgccacctcctgtctactcattgttgcatgagccctgtctgccagcccaccccagggactgggggcagcaccaggtcccggggagagggattgagccaagaggtgagggtgcacgtcttccctcctgtcccagctccccagcctggcgtagagcacccctcccctcccccccacccccctggagtgctgccctctggggacatgcggagtgggggtcttatccctgtgctgagccctgagggcagagaggatggcatgtttcaggggagggggaagccttcctctcaatttgttgtcagtgaaattccaataaatgggatttgctctctgc

SEQ ID NO: 6 - DNA, 55537 bp, Homo Sapiens
ttcaatttgaaagatatttatgggcaacaaagtaaggtcaggattagacttcaggcattcataaggcaggcactatcagaaagtgtacgccaactaagggacccacaaagcaggcagaggtaatgcagaaatctgttttgttcccatgaaatcaccaatcaaggcctccgttcttctaaagattagtccatcatcattagcaactgagatcaaagcactcttccactttacgtgattaaaatcaaacctgtatcagcaagttaaatggttccatttctgtgatttttctattatttgaggggagttggcagaagttccatgtatatgggatctttacaggtcagatcttgttacaggaaatttcaaaggtttgggagtggggagggaaaaaagctcagtcagtgaggatcattttatcacattagactggggcagaactctgccaggatttaggaatattttcagaacagattttagatattatttctatccatatattgaaaagaataccattgtcaatcttatttttttaaaagtactcagtgtagaaatcgctagcccttaattcttttccagcttttcatattaatgtatgcagagtctcaccaagctcaaagacactggttgggggtggagggtgccacagggaaagctgtagaaggcaagaagactcgagaatcccccagagttatttttctccataaagaccatcagagtgcttaactgagctgttggagactgtgaggcatttaggaaaaaaatagcccactcacatcattccttgtaagtcttaagttcattttcattttacgtggaggaaaaaaatttaaaaagctattagtatttattaatgaattttactgagacatttcttagaaatatgcacttctatactagcaagctctgtctctaaaatgcaagttggccttttgcttgccacatttctgcattaaacttctatattagcttcaaaggcttttaaactcaatgcgaacattctacgggatgttcttagatgcctttaaaaagggggcagatctaattttatttgaaccctcactttccaacttcaccatgacccagtactagagattagggcacttcaaagcattgaaaaaaatctactgatacttactttcttagacaagtagttcttagttaaccaccaatggaactgggttcattctgaatcctggaggagcttcctcgtgccacccagtgtttctgggccctctgtgtgagcagccaggtgtgagctgttttagaagcagcgtgttgccttcatctctcccgtttcccaaaagaacaaaggataaaggtgacagtcacactcctgggttaaaaaaagcattccagaaccacttctctttatgggcacaacaaagaaacgaaggctgaagttcgcctacccaaaatgaaaagtaggctttacagtcaaaagtacttctgttgattgctaaataacttcattttcttgaaatagagcaactttgagtgaaatctgcaacatggataccatgtatgtaagatactgctgtacagaagagttaaggcttacagtgcaaatgaggcgtcagctttgggtgctaaaattaacaagtctaatattattaccatcaatcaggaagagaataataaatgtttaaacaaacacagcagtctgtataaaaataccgtgtatcatttactctttctgcagctctatacgataggcaggagaggcttatgtggcagcacaagccaggtggggattttgtaaagaagtgataaaacatttgtaagtaatccaagtaggtgtattaaggcaccaaaagtaacatggcacccaacacccaaaaataaaaatatgaaatatgagtgtgaactctgagtagagtatgaaacaccacagaaagtcttagaaatagctctggagtggctctcccaggacagtttccagttgctgaatagtcttttggcactgatgttctacttcttcacattcatctaaaaaaaaaaaaaaaaaatcaaaattaaaatctgagtcagtccgcctgcctcggttctcattagtttaattcttaatgccttgcactttccggcaatcattcaatcaaaagagtgaaatgaagcacattaacaaagcaggaggcgccacggaccgcctccctccacaccgctccttccgccttcattccttgcccacaggcttgcactggaagctgaataagaatccccaaaactcaaacttcctagggatgccacccctttagtagctcacacctcccccctccaagagctaagaaacaaaggagaatgtacttttgtagcttagataagcaatgaatcagtaaaggactgatctacttgctccaccacccctcccttaataataacatttactgttatttcctgggcctaagactctatgttccagaactgtcacagctccccatgtcacactcactagcttgtgatctttgtcaaataactgaaatcttttaagcctctagtttcttcctttgtaaaacagagataaaatgttgtggtttttaagtgagataatccaagtaaagcacctaacatggagtagtgaatgaacatcggttgctactaaaagtggacatcctactgcatccttaatgccactaggcatttccatacaatctggggaccaaaacttcaatcatataaatgtatgaggttaattaaaaacactactgtaatctgcttgtatgatcacaaaccaccacaaaagaaaagatcgtgaagattacactgtaaacggactctcaaatgatcaggaggtggtcacttcgcaacttgctccctccacccaactcaaaacaggagctcgagcctgcctgtatttgagactggagctgcctgtatgaggactggatcaactgctagtcacgttatatccaaatctgcattatcattgggcacattttcacagaattttactgaattattccttaattgtttaatggttgggaatagtttgggaattaccttccatcaactctgctaagaaaggaatggattctggtagcaagacaatataattctcctttagtttttcagccagtgctaacacagtaatcaaagcagcaaatcgaacctgaaagggataaaagagcaaagaaataaaaagtagtgttactgtatttattatcttaagagctgtactgacttgagacaagctctaactttttaaacattagttcacatgcgtttattcacttcattatgttcattaagctttcatcttagaataccagtttcaccatttgggagctgtttgtaatatgtgcaaccttataaatagtgttttccaaactgtgtcccaggactgcaaatctttaatgtgaaatgtctttttataatctcttcctttaaaaaaaaccaataaaataaaatgccgcatgcaaactcaagtgtgtcaccagattttacttcattggcgctcgccagcccgccaggctggcaataaagtgcctccagccacctctggcaggtctcctcacccacagcccctgactggtcaccactataattgtatgaggggccaggacagtcgcttgggataaactcccatctcagcactgaataaaaaacattctgtgtcacaatatcctagttttggggctttaaaaacgtctaggtgttcctcacatgccttgtctataataaggaaagcaagcagtagttgggtattgttagcttttgaaacaaaagccctactggtcttctaattttggatattttaattaaagaatatctggacagtacaaagtgaattattaaaaaaccatttgtaactacctagattcaatcaggatttccttgatttgtgcaaagtaaaatattacaataaatttgatactgctacttgtataaaaacctatggtttaaaatgtgggggttcatcataatagtctcattgttagcatatcctaataaagaatttgaactaataaatcctattaataaaattctgctttggtctgttatagccagtaaagttctaatacaatcattagtttgagaaatggtgactcattgctaaaacagtttgaaattcgtaacacttgggtgtcaaattttgacttccactcaacctacccatgttttatttccactgccaccacttactcaacaagatcataagcctagtatctataaacaacagaatgtattgctctaactcaaaagactatagtgtggataaattcaatgcatttctctctggagcacaatgacatttcaatggcacttaaaaaagaaggaattacttcaaatctttgttatttaaaagtatttagaaagtattttagtacttctgcccaacgcaccattggggtggggatagggcattgctattctttacaaatagcctgtaagtaaaaaacaaaattttcttaggcacaaatttctgcctaatacaaaagaccggacctctagtactggatgacaaatagcaatgttcttccctgccagtttactagggggcctacatctgtgaccacctgcaggctgtttaggctatgcagtgaaaagatgcagtttcagtacttgtcacgcagttcctaaccttaggcgaggagtctctcgtctttagcagaatctggtagttcagtggtttccaaagagagtcatccgccatggccaccgaaaactgtgcgatgcatggtatcaggtgctttgtcacccgttcctggaatttctcttctcccccaagcctgttttccagctaggaagagtaagacaaagactttgaacaacaagtctcatttctttcttctgtttgaaaaaatatccaacatacaaatattttactatctttcatgatattagcaggttcaaaaaccaggcattattctaatactctctagggcaaatgtattgccttctagaactcaaatggaatctcataccctttatcatcgcccctttctctccagcagaacatctcagaggagctctttgctccagaggacagccatgctctgacgcgttctcagtgaggcccagttaaaacaaatgaatacattaaccatgacagcttatatcatgtctgtcttttgagcagtttaaaaaataaaaaataaaaaataactcagggccaggcatggtggctcacgcctgtaatcccagcagtttgggaggccaaggtgggtggatcacttgaggtcaggagttcgagaccagcctggccaacatggcaaaacctcatccctactaaaaatacaaaaattagccaggtgtggaggcgggcgcctgtgatcccagctattcgggaggctgaggcacaagaattgcttgaaaccgggaggtggaggttgcagcgagccgagattgcaccactgcactccagcctgggtgacagagcaagaccctgtctcaaaacaacaaaacaaaactcaaattccacaatgaagttatatctttgaaaaaacaattttcaaataaaacatttcattaaaaagaccagaaaaaacaaccttacaaagaaaaatcctagcaagctgtcatttgagcagatctaaaacctgccaagctcgaacagtgatggcttcctcagcaacgaaagatgattctgtttggttacctgatccaccagaggcatcatcaaggcttctgctctctctttacttataaaatgctgggtatcaaaaaggaagattttgtataaacagttcaaaataaactgcaacagcaagcagcacttttcagggtcattttcagagtcaaaaaatgcttcatctgtagacgtgggaagagtaaaaatgaaaaaacactgaacttaaccatttaatctccaatgtttacattgaaatcactattaaaataactaaatcagaagagtctaaaatgatctagaaatcataatcaggacgaaggcagaacacaatggatggtctctcgaagaatgattccttcttttagagttaagattctaacactcactctggcaagttaaattccctcaactgtcaagtgggtcacgtattagcattagagaataaactaatcttaatttttgcgttttaaagttacttccagtaactgacagtaacggccatttactttattctttctcccaagtgaggtgacttataacattcgctcatgatgctaaaacaacacttcactgtctgacaacaatgaagtaaaaaattcaccctccttagcttaggacttaagaacctctaaaatcttgcttccaagcactaggttgtgtcttactggtaccttgtataaggcacacagggcaagggtgacagctgaactgaagcgaccacccacctgttttggagatgttcacctggttcaaggtgtcagcaaaaggcttcactaagtggccggcaaacagagtaaaaagccctttcagcttttcagcaatgcaatctgccaagttgtaaaatgtcaacaacctgtcctttggggcatcttctgttttagcccaatcaaacagctgaaaggataagacagtattagtttcttcgacatcttgtcacttaaatctgagcacaaaagagaggaagaggaagaaagcgtcaccttgaagaacaggggcctgaatgtgacctcggaaagtttgacaaccatggctactagacagtcaatgatacaattttccgtttttccaacttcctccagatcgttctgaaaacagaagagcccatttattagagtgctgatacctgactgtaaattattttggcaagtaccactgttacacggctagattgttctcggactcttcaataggtggataacagctttaggatttggaggagtgaacctgagcttacctcagagtgctgggctcggaagtccagggcttccaggaaaaaggcggttagctgagactgatgggaggtgagctcttccttcttcatcaccccaatatgctcttgcaagatgctcataaacggacccatgtgattctaccaataacacaggaaagagatgtgccattttcaaatgattcctagagttcagcggtgtgtatttttaaaaactaaatcttcttctttaagtcaaagtttacacattgcagtaccacctctcccttctccaaagtcttaatacccaataagatctaaccttccagttcttctcaatctgcttgtaagtttttttgatggcgggcaacaggactcggggtgcaagtgtggtagccagtgtctttttaagagatgtgagacggatattagcctgtgacgcagaacccatttcactagtgattttctccagatgaatcacctacaggaatataaaaaaagtgatcagggccactgcagatcttcgctgacaaacacacacttacagagaggcttcatgatgaggtactagtgtttggaaaatgcttagcactttttaactacacacagaattccttttaaagtcagccctaaacgtcagtggataaaactgggcagacacctcttgcccaacttgcgatcagggacgaaggccgatggtagacgcagacgcacacacagcacccagacagatgattttcttagaggacaggaatgcaagggaccacggcaagagtcaagttgctaaaaaactgagaaagctcctcagagcacaggcccctttctctgagaaggctacttttaaaccctggctgtggtgtaagtgaagcggtttaatcatttgccccatggtaatgaaggctcctaaccttgtaaatggcaaatgatcaacacaatggaacagccaggtctcaacattcttgagcatcttcaatcataaataccactggcccctagcgtgttgacaggaaaccgctgacgtgcaatacaaaaattctgctttgcaagatgccttaggattatacctctcacagtagaaacagggcccatcaatttccacaagtaataaaaggcggctctaccagcccaactccaaagatctcacagaagaaaaaaaagccagaatacattccgcacaattaaagaagagaagcatctcgctaaaaagtgacccccatatcaatttcaagattaagtggcaaggatgatggaagagaaaaagtacacatttaataaaagcaagcacatctcttcagaaataagactcctttctgtcaaacggaaactaacccttaaagaaaaaacaaaatcactacatttgtgatcttttaccttccccagccaccctgcgtagcatgtcgtggctatcgtggctcacctgggagagaatgccttccagataggggctgatgaagtgcgggagagtctccacaaccttctgcagagcagccaaggcactgagcaggtagacctcgctggagaccagctcgctggtgttcttcattgttgtcagcaacgatggcatcaggctagaaacaaagtaagagctttagaagaacttgaagcagaaacagaggctagggaatggagtagagggcattatgaaaaaaaccagcaaactgtgcctattacatcgctatctgcttcatagcctaaaaagcagtgtctatacattttatgtggctaagcacaagaaatctcccagtgctaacagtacggacacaacagtaatttaaaaaataacaatgtctttcattaactgaacacttactatgtgtcaggcactatgcaaaactccttgcaagcactgccctacagaaatcctatgaggtagatactgtctctgttttatagacagcaaagctctaacaggttaaggaacatactggctgtacagtaaggaactaccacagccaggagcttctaacttccaaatttggcagcagaaggcagctttggccttgcctaactgggtgggcccctctgccaagaaccttcacccactgctttttgactatactagacaaaaggaaggaagaatggaggacgattaacactgcaaagtagtgcatctgaagataaacgggaaggctgcatctttctgtttgaagattaattatttttattattatttctttaagagacagggtctcactctgttgcccaggctacagtgcagtggtgcagtcatagctcactgcagcctcaaactcctgggctcaaacgatctccctgccttggcctcccaaagtggtgggatcacagccgtgagccaccacaccctgcaagatcaattctttaacaaattccaattttatgcaacgtctactcagaggaaaaaaaaaaaaagtcaccaaagtgttatttttcaatgtgtgccaggcggtaacagctcctgttccaagtctccggccgcatacctgggaagctgggggatggccagcgcctccagggtggaggtcacctctgctatgcacagcagcgcgcttcccaggacattcttctcctcctttctctctggagcaatcagtttcacagcagtgttcagcactgggacaaaaggatctggattttctgcaccaaaattcttgcataaaagctttaaggtatacaacgctgtctgtctgttgattgcttgttcttcttccccttcctttttcttacgctgcacaatggccaaaaggtctggaaccagttttaggaaacgggtaacctgaaggggacagccagaatccccaaatcattaaagctgcaaaaaatgtttgtccattttcccattgtcacagcttgagattgtctaaatggaaatcagactcgggggtcctgagtcacacagtcatgctaagcgatgtgcatgttctagccagtgtttcacttatacaaagcacccactgatctggagtaaaagggacttagaactatgctaaggctaaggccacgtaagctctgtagtaagcaagaattccactaggctgaaattccattctaagagctcttacaacacacatatattcccgttagaattaacgtcacattttaaaacatgtcatggtattatattcagaaaataatatacttcaatttgaaattgtaccactagagaaattgaagggagttaaatgcagctctttgataaagcaaagtacagtaaatgggtgtgtcctgggtcttcactcactattgtcttcttccaggatatattttgctgcagcttgttattcaaaaggtccagcgctttgcggcgaacagatggcaggggattgcccaccagccctctgatcacaggaatgaatgtctctgtgggcagcaaggcattgacctaaagagaaattttatatttaacatgaaaagaaaaacaaattaaaaaaaaaaccaacttcaattaagacagactgctgtccactgcacacctccaggcaccaggcacttccacacacattttcttatttaattcttaaaataacctttcaggtaggcattaccaaccacacattatcgaacaaaacaaaagcctgatgtcaggaggaagtgccaaaggcatgcagctaaatgactgagctagatttgaatcagcaatcctaacttcgaggccagtgatatgtatgtaatatacttcatacttttattttattccacttgaataaagtagaacagtatatattatatgacttaattattaaaatatacgaggtacatgttctcataactggtaaggaaacaattttttccagacaaatctatttctagtcatcaagagattgttttctaagaaaaatctgagcttcattatattcataaaaggaattgctaagtttattcttaaaaactttacataatttcacaataatttaaaaaacagcaacaaaacagtaattccagggagaaatgaacacctaccttatctaacaggtcgtaagctttactaaggagcgcgcgccagaacttcacggtgagtttgtctgcgttcctttccatggactgtgcaactgcactgatatagccgagaacggtctccagcaacctgaaacacagaggctcgctcagcaaacggcagctgaaggcactcagagaacttgttcatgtctaccttatgctaaatgtttcaagtagaaagacgagttaaataattctgtactaaattatttcaaaaactactcggaaagaaaggaaatgagggattattgccatagacagagatcatcaagaagtaactaggcgcttctgtgcagaagcatcgacctcgctcagactctgtgaggtgctgaataagcaacagatgctgaaagcgtttaaggaactcactcatatctagctcatgctcagtggatctcactgggctgtccaagtggggtgttcagggagttatggccctaggttaatggcaggtgtgtgcgcgcacacacacacaggcacacacacgcacacatacacatgcacacacaccatacaccatttatataaagagaaatattaatagaaatgaacatataacccacttctttcacattattaggagacaaaaaaaaaagactacaaacttcaaataacttgtaattagaaaagcacacaccaaattccaacacagctgccactggagatccccccactgctgccagcctgaggggggagctagagggaagagtggagacagaagttgacaccgcacagcagaggaggggagaagggggcgcagacaaaatcagctccaaaaacgaaagtcctacgcatagcgctacaagtcagcccacaggactggaactcagcagctcacattcctggctgcagggcaggcactttccagtggaaggggcaggacagtggccctgggaatgccatgcatctgaaaaggaggtacacagcaaggccaggaggcaaaccccgaggacatgggagagaaaggaaaattcctgcacccaaatatataatggcagcatatggattagaatccacagaataaagaattcatgagcccatagaaatcagggccagattaagacactaaacagatactgcaactcaatacaatacacagacttgacatggatcatgatgcagaaacacatgcggtgtaaaggagagtgttgggataattagggagactggagtatgaactgtagattacatcactggattggatcaatgttaaattttctgaatttgatcaatgtactgtggttttataagaacatctcttattcttagagacataatgtatatgatttactttcaaatggctcagagaaaaaaccctacatagggagaacgctaaggcaaatgtggcagaaagtattatcaaatggtgaacctggttgtaaagagtatatgaattttctgtactgtttttccaggttttctataagtttgaagtcatttccaaataaaaagtagaaaaagaaaaggaaacatacctctcttcaaggccttttaaaatctcaggaccaccactctcaactacctaatttttaaagaagacgtcattagaacggtagggaagtcaataataaaagtcatttcaagtcagttcaatgaaactcggaccattcactgaaaccttccacagcaactgttttctgacattacaatttaatcaggttcatatcatcttcattatactgtagtaactctatttctcttaatttattttaattacattctactggtagtatctaaaaagtactacaatggttcagaaaaatacagcaatcaacactcaattagcactaccgaattctatgacatgctgagctggtgagctcacatatcctttgttgagaagttaaacattacagattcagctggaatcccccaagtactgctccttggtcctattctccctctaccccaagccccacaaacaaaaccatcatcccaaatctgcttccaaatgtttcaaacactacatatcacggaacaacatgtttttctggaaacatatttttgagatctatgcatggtgacttatgttctagttccttcattttaactgcatatgatattcctctataaataccacttatctatccatttgcctctgttgttagatgtttagtttatgtccattttttccccttttactaataatgctagagaagaacatttttatgtccctttgatcatcttgggaagtttttacagcatatatacctaaggaagggaatgaccagatcacaggaattactggaactttcaacctcatgggatcctgccaattgctttctaaagtggttggaacaatcacactgtctgccactacgtacccaatccctggtactaacgacttcaacagttttgccaatttgatgggtatcacatttaatcacatttcctgcttactggaggctaaatgacattgtacattaactggccatctgtaattcctcttcagtgaattcatattctttgccagttgttctaatggaaactgaggctttttgatttatgcagagcaataatcttctctcagcctgtggctttctattgaatcaaaattttaaaggaattctttcctatcctccagtcacaatcatgttctccttgattttcttctaaacatttgaactgttgttttttacaatgaagtttttactctgactaaagttgtcttttctacaaggtgtgacatcagacttttccccaaatgggaaacaaatcatgccagggccagcacttggaccattctctcccccaactgctttgtaaaatcacctgctgcacctcttacctatgcctgcatgtgtttctgggcctactgttcagtcacattgatccatctgattactcctgcaccataccactgtccttggccccttacagtttggtatcaatgtatcaatatcatttcttaaaatgatataattgaaaaagcacactgagtttctagaccaatctgggcagatctgccacctttaaatagtgaggcttcttcatgcgtaaacacagtgtctctctatttcttccaagttttcttctgtgtcccttcatatcttgcacatttcccctgtaatatttgtgcacatatttttgtcaggcttattcttggtaccttataagtttatgtttgtattatacaggaaatctttttttctactctgttttctaatttgaggaataacaatattatataacagtggtgagactaattagttcagccagcctgcttgatacagatcacaacctacactgatctctagatagtgtctacactgatctctcttaagcaagcttactgaactcattattagttctaattgctgattctcttctttcctgattcttacacttcatttcttttcctgaatagaaacaatgacagaggagattcttgtccctgactgtagcaggcacaccattaatatttcatcattaggtatgatataaaccacaagcttcagattgtcacctttattaggccaaagtaattcccatctatcctgcactgctgagaggagttttttccttttttttattttttttattttttcagacagaatctcgctctgtcacccaggttggtggaatgcattggctcgatcttggctcactgcaagctatgcctcccgggttcacgccattctccttcctcagcctcccgagtagctgggactacaggcgcccaccaccacgcccggctaattttttgtattttttagtagagaccatgttagccaggatggtctcgatctcctgacctcatgatccgcccgcctcggcctcccaaagtgctgggattacaggtgtgagcgaggatttttctctcttaagttgtgaataagcattgagtctgctgaattatttcactgtgaaatgtaaaatgatcatatggtttcccttcttcatctgttaacgcattataggacctaatggactttacagtactctaatgtcaaaccatttttgtattcctggtcgtattcctttctttccttccttttctctcattgtttaaacaagtttaatacacaaacagagatgtatacaaatcatacatgcagaactcactatatccaggtaaagaaaggctgggcatgatggctcatgcctgtaatcccagcactatgggaactcgagttgggaggatcgcttgaggccaggaatttgacatcagcctgggtaatagagcgagaccctgtctctataaaaaaagttttaaaattagccagatgtaggtggcacacgcctgtagtcccagctacttgggaggctgaggcaagaggattgcttgagcccaggagtttcaggttgcagtgagccatgattgctctactgcacttcagcctgggacatggagtgagacctgtctcaaaaaataaaataaaatacaggcaatttatctactctgctggtagacactggagttgttaccagttttgtgctaccatgaagaatgttatgaatattataaagattcttgtagtttttttggtgtacaggttcataaacttctgatgggtacacaacacttaagaatgaaaccactgagtcacagagtttacattatgttccatctcagtagatcatgacgaacggcttttcatggtgaaacgtactttcttgttctattatctttaaaggcgtgcctcccattttcatgagccatttaccaagctacttctactggttgagaacagttccttggagacagcagaatacctttttataaacacatttaaagaacacattacctttttcagaaaattattggaagacaggagctgagacatgaaggacactgacaaaaatttaaaatgccgcagttgcttgctagtgtgagtctctacattaaaaacctgtagcatttcttcttgtgattcactcttattaaatgacactgctttgggaatggtttctgaaacagcaataaaacaagtgaccttactcattttcacctgaatccttcatacagaattaacagatataacctttcaagtaaaggacaattaacgggataacattttcccagagaaatgtgttcatctattacatccagtttctcctcttctaaattagtgaaaaacgtgagtgtatttgccaagaaagtacccagtggccctgagaagcgagtgtttaagacaaaaaacaaaacagggaaactggacaatcaaatggaagaaaccacatcacggaaggagtctctgaacttccaactgcaggtgtagatttctttattcaatgtgtctaatgtaaatggggttggcagtgcagtgttaaaaaccactagcctatagaatgacttactgctaagacacttccttacccacatcaccacatataccacatacaccacatactgtccagggacctccctcgtctgtccctgccaaacctgagctgactgcaggatgggacaagttactgcctcgccaaacagggatgacagggccaatggctggccacgcagaaaacagtctctgcggagctcttagagtaccttccttctaacgtgccttgtcgttctgcttcgaattgtagagaactaagaactatcaacacgtcaaccctttcttaatgaaaaaaagttttttttagagatggcgtcttactatgttgctcaggctggtcttgaactgcgctaaagtgatcctcctgtctcattctcctgggtagctgggaccacaggctaacaccatcacacctggcttcatcaaccctttcctaagccagcctcagtggtgctgcggttcgtgggattttcttcaaggctctgctgcatggtacaattttaatattttgctgccactcctgtggtacctactttttttcttttcatgtaaatgtcttcagatattttaatgagaagctgagagacagctaatgaggtcctgatcatttactgtcatttgaacctaactcatcctggataccagcaacattccacagccaagacgtcagcgcagagcacagaggtataaaagacaatgtgtgaggaatggcaaatggaattccgactattttccataaggattcaagaaactacacaatcaaattaaaatgattaacttactttaaaaatccttctgaagatgtactaaggataacctgcattctcttctgtttctctttagctttcagattgaacagtaagtgacacccgatctacgcttaccttctttttcctctggcagctttagtaagtactggaggatattcatcaagctttgtatctgatgctggacactaaactcacaacagactgaaaaccaaaattcagtgtctgcttctaaaatagcatcctgtgtagaaaaagaaaaaggtaacaaatctgtacttaggaattgtgaaggcataatttcaggataatgtgcgttaggatttctagcagaacagagtatactactttatttagagtgggtcgagatctactcccagatcccatgtctaagaagtcatttaaaaatggtcctcgacttatccaaacagggctttatccaaacaatcacctgtgtttgtgtcttactgacttcagggacacggacgctcctctatttccccacaaactgccttcaaaaccgctttgaagagacactgtttcattactcttcagccatactctgctgggcttaaaagagaaccacttgcgtggcaccagaactgtttctcagaaaagttaattcgccttcagatgttttgctgcaactgaggatattcagagtgctatgggctctgaatgcaattttttaaaatgccaaaaacctttttgaaaaaggttctgagcaaaaaggttctaaataacacacattaggcatcatcagccccatgtttaaactggacaatatcataaaatctgtgtgagaaatcaccattttccttatcttcccaccctaggttctgaccttttcgccataggcagccgccagcactgtttttgtgacatactgttcaaaaagcaagatgaggagaatccagaggaatttctctgcacccagtgtatcaacaagttgaacaaggatgggcaggcgcctgtgctccgggacgtgtggcagcgcatccacaaatacactaatgatttttaccacaatctcttcaacgtttcttgaaacttctatagaatctccactatcagactgcaaaacagcaagcagagacaatgagtaggtgcaagtaatcttccacaaaacaagtttaggtgaacaagataaggcttttagatgggccccaagaaattgccagaagaattttatttatttttttagagacagggtctttctccatggcccaggctgaagtgcagtgatgtgatcatatctcaccgcagcctggatctcctgagctcaaagagatcctcctgccccagcctccgaagaagctgggacatcccaggaccccaccaccactttttaaaaatttttgtagagacggggttttgctatgttgaccgggctgttctcaaactcctggcctcaaataatcccacctcagcctcccaaagtgctggtgttacaggtgcatgccaccacactcagccacaagagttttaataatcaaaggcctaacaataaatattcagtaagtacctgtcatgtcccaagcgctacttagccccaaggggaatacaaagtgtacgatatgagccctgccccaaaggagatttattttctgtatgaaacaggatacatggctgggcgcagtggctcacgcctgtaatcccaacactttgggaggccaagctgggcagatcacctaaggtcaggagttcaagaccagccaggccaacatggttaaacccatctctactaaaaatacaaaattagccgggcgtggtggtgcgtgcctgtagtcccagctactcaggaggctgaggcaggagaatcacttgaaaccaggaggcagaggtcgcagtgacccaagatcatgccattgcactctagcctgggcaacaagagcaaaactctgtctcaaacaaacaaaagaaacaatacatgtgtgaaaagataacaggaggcagtaatggcacatgccaaatatgtgacactgatagcaagtctgcttagactgcctgggaaggctgcacaaatcacacaggatttgggttgtgcctcaagaagaatgaagataagcagagcacagaaaaggccaacaacttcctgctgctttcagaataaagtttgaaccattttactccaggtattggtgatcaaaatatagttgttgaataaatgacagaaagaatgacagaaaacacttgaatgaatgaataaaccaatgtctacctgtctcaaccctctgctctccatcaatcaatcaccattacattcttcaaacatgctgtgcacattcctagatcatgccttttctcatactattggctctgccatcactgaacaaatcccatccttctttcacaccggtacaaattctatttcttatagaactttctggtcatcctggcccatatagactttcccctattctgaactctttagcatttacttattcgactggcactgatcatatgaatgcatattattatttttctttttaggtatatatcctatacttgccaacttggtggacactgagaacaccaatctaatactaaggttaaaagaaggtgctgaatatggtcatccctcagagggtcaatagcatgagaaaagacattaattaacaagtgaagggtacatagacaactcaagtagatgaacaagctcttttactcttgaggctacttttaacttttgaattgttcattccttactgggagagagaacatctcacctctctctctgagtttagctcttagagaatgcttggtaaacatttgctaaactgcatgttaacaaatttgtcactgtagctctaaaagttcctagcctcatcaacatgtaagaaggtattatcaaactgatgcaatgtcctgaaatagatggtggatgtcaatttaccccacccgaatgatgttaagacacttacagttacacactcacagcacagcagaaccagctataacacgtttgtttatattattgagaaagacattgccaagactgcttcttagcttcaatgttctaaaacttaagggcaatgtacttcagcatttcagaaaggcttttatacaactgttgaggatattaaaaaaaaaaaacaaaaaaaaaaaactaaaaaaaaggcttttaatgtcatttatatgcaaaatttttaaattaaaaaaagaaaccccacgatggtataaagagaccttacctgaataagtgcgggaataaccattttcactgtcttgttaataacttgaaaactgtaagtatcatctaggcgcatgacattggctcccataaatgtaaaaatagacatgatattgtgtaaaactttatcctgaaagaaaacacaactatcaacattttttatttctgttaatttctactaatttttttttcaagagatagcgtctcgctccgtcattcaggctgggatgcagtgcagttgtgtgatcacagttcactgaaaccttggactcctaagctcaagcaatccttccacctcagcctcctgagtagctaggactacaggtgcatgctaccctgcccagctaattttttttccttttctgttttgtaagggtggggtctcactatgttacccaggctggtcttgaactcccaggctggtcttgaactcctggccacaagtgatattcctgctcaggctaacattttccatttcaacaattcattacaactcaccaataaaaagagaaataacctgattaaaaaacaggcaaaggatttgaaaagacatttcttcaaagaaaaaattcatacgaaaagaatataagcacaaatactacttcacacccactagaatggcgataaaaaagacagtaacaagtactggcaaggatgtgaagaaattgggaactttacaggctgctggtggaagcaaaatggtgtggccactatggaaaatagtcttgcaagttactccaaagctaaacataaaattccgtgtgacccaacaattccactcctaggtatatatacccaggagatatgaaaacatgtccacacaaaaccatgtctacaatattcatagcaacataatttataatagccccacagttgaaacaacccaaatgtccatcaaccgatgaacagataaacaaaatgtggcatacacatacaacaatattattcagtcataaaaggaatacggattcaagcttcaacaagaatgaacctcaaaaacattatgctaagcagccgggcacggtggctcacgcctgtagttccagcactttgggaggccgaggcgggcggatcatgacatcaggagatcgagaccatcctggctaacacggtgaaaccccgtctctactaaaaatacaaaaaaattagccgggcgtggtggcgggtgcctgtagtcctagctactcgggaggcggaggcaggagaatggcatgaacccaagaggcagagcttgcagtgagctgagatcgcgccactgcactccagcctcggcaacagagcgagactccgtctcaaaacaaacaaacaaacaaacaaaaacattatgctaagcaaaagaaaccagacacagagggccacatattgtatgactcaatttatatgacatgtccagcataggcagattgagagagacagaaaatggattactagtggccaggagcagggtggtggtcatggtggtggtggtggtgctggtggtgacggtggcagcggcagggaggagggagaggaagagtgacagttaatgggtgtagggtttcttttctggggtgatgaaaatactcttcaagtagatcgtggtggtgattacagaaacttcgtgaatatactaaaatcacttaattgtatactttaaatgggtgaattttatggcatctgaactatatttcaataaaaacagaaaaaatattaatgattcttaactgtttctggattatcaacccctttgagaagcacagactctcttacaagaaaaaaagaaatcccatacagataaaactttgcatatgatttcagtagattaagatcccctaaagctcatggagaaccccaggttaaggagctctgactcaaatcctcaatatgaaaatagcttcaatctctttacaaatgtttaaatgatatttttcataaaagggacatgatttctttaaatgacatagtttatgatcaaattaattttctgaagtcactggttaaaggttactttgaggattacttgaggataaatgagatattaacttttcccaattaacaccaatacctactgttttattagatagatagtgtgccaggtattatgctaagtactaaccacaaattatccaactgaattcccccaacaatccagtgaagaaggttattattcccacttgataaaaagggaaaccaaagcttagcaagatcaactggcttatacagtcccagctatgaagaggcagggctgagagtctcaccagtgctggaagattccaaagcctaattgattaaatttaaaatcaacaggtgccagtgcatttctgtggaagaaaaatatctgaaatatctgctaaaatcttatatcattaacgcttaccggaaatattccagcaacagtgcccaaaagtaaaagggcatggtgatgggtctgcggcatctccgaaaggcggatgcactgaactatcaactccacgttgaacttctcctcatctaaaatatctacaatggtgagaaagacaaaaaccctaagtggcaggtacactcacgctcaaagtagataatttttctaacctttccttccaaaaagtacctacctttgggtattttgccaccatctggagatagtttttggcagatgttgagcagacaactaagaattaattgtttggtgtattccatatttccctgctcttgtggcaagggttctaaacatcttcaggacacccaaaagagaaatgatgggaaatgtaaaagttgtacaattcattgttacattaatggccattgtccagaactcattcaataaggaactcattcaataaggaataactaaaatactatcattaaacatcaagtctagaaataagatataagatttctaactctaattttctctcatatagacaggcgctatgtcaaattccacgtcctctctattgcactttccattagcctatctggaatcttacaggacaaccttcagaattactttgcctttcacatgaaagcacacgctacaattcatactcaatttacacacacacatacacaaatctacgtatatagaatatatacatctatatatatgaaaatatatttagatagcaaacactatatacacacatatctatatctatataaattcaacactatatcttgaaatgcaagtaatgacgtcccaggcacgctactgaaaagttcagaggaaagtaggctgtacagtgagtggccatttactacatgacacaggacactaaggtcagtttggggcaccagcaatggatacctaaaaccaatcttttaatttcacctatagtacttgctttattttacagactatctaaacaagagaagagtatgttgaaaagagaatgttagataagatgggcaagaattagagtcctattctctcacagatcaaagccaagtgtcattaccttgatagcaagttaaaaagagttggcaccaatatctgaggacttctgagcttctttttgtgctgcagtaattccaggatgagagttactctttgccagtaagaacctccaacttcctgaacagattctagatcttgtgattttctggaaaatggagaagacaaaacgttggaaaagcaaactctatcatgtgctaagtaaaaaccattgtgcctgattatagcaaattgatgagtatcaaaaagttccaatggtttcataacattcagagtcagggaacaacagcatgtgctcaatgcatttgtagctcttacttctgctgcattttttgccttcttttttgctgaactgtgcccaagggtttagctttatctggtggctccagttctattcggacttgttcagcattaacggaaatctgaaatattgaaggaagaagagttgatgatataatccattgggataaaattagagcaataaatgttaacccctaggaaggatttattcaattaagagggaagaatgacttactggatatgcatctgaaccccccccagcattggatgctactaccttgttacagacttcttgaaaaaccagaatgagaagaaagcaaagtagggaagagtatacactaaaagctctagccaacataaattcaacttcagattttcattttaaccaagctctcctactaccatgcacttgctttctatacaatttgtcttgggagtctcaagttacagccctgcacttgtcttgattatgatacagtatcacttctccagtccagagtcactcaatttcacgctcatcccttagagtggacaactagtaatgcaatacagaatcatccataccgattgtttccaagtgccggatcagatatgtatattctaatcagctaggaaggaataagacatatacacacatgcacaaaaacagatttactgccccagagattctttagatatggggtgggatccagatatctctttttataaggttctaacatcacaactaaatctttggattctgattcaaagaaaacaactataaaaaatacttttgtgataaccatggaaatatgattatgaactaggtattagataataccaaggaattatttttttttttacttctaatggcattgtagtcatatccacttttcaaaagatgcacactgaagtacagagggatgaaagtgcatgacattatgagatttactttaaaatatttcagcaaagaaaaagaaggaaaaaagattaatatgttaaaattctgagaactgctgaatctagatactagaactttgtattattctatattcaaaaaagagaataaccaggtggctattctgataataacaaggtttcaatatacgtataaaaccaacaagcagaatttcaattccattatatgtcattaaacaactatttaaattaagtagaataatgttacccagttcaatactgagccattgactcattcctattccttgcataaaggaataggtagattccgtctaatatgagaaagatcacacacacacatattcctacacatcctatctggttaaaattatcaacaaatacttcataaaataaaataatggtaaagatttaaaatttttattttatgcctctctctgacttacttttccatgatttttgttaatggtaacatctgacctcttacaagcactataaaatacaggactcttaaacatggtgtcccttggaagagactataaacattaataaaaaaaattacaagaagtttgcagcttacccctttaaaaacactgctgacagtctgagcacaatgtgagtttttacagttcaccaataaatcaaacaacattcttaaaagcttctgctgaactttttcatctgatatggctgcaaaaaatggttttgtaatctagagggggtagaaaaaaggcaactgagttcagtgaacaagtttaaattccagaaataatttttatatcaacctctctcaaaatacaaaattgtttcccacttaattttgtcagttaaaatgcaattctttttaatgacccatgtacaacgttcagttttcaaaaatgggtcaaatacatcattttcctttaaaacgtctagtccacctgtaactatcttctccaaataaaatattaatctttttttttttaacgctgttcctgttgccttctacctttaaatgcttgaacatgctatgccttagtttctgaaagaaatcactgaccttttcaagggctgtgatctgaatggttggcattcccgcgtaaagttcctttgttgtgtgcacagcttttataaatatatctagactcttcggatcctcatttaaaagggaaactgaaaattcattatactttcccagagtgagatgcagaaccatggcctcatctttcagcacagctgtgggctccttctggatcttttctagcagttgttcagccataggcaatagctgagaaagcaccatctaaagatccaaagacttagtagtaaatagttatgtatactgatatgtttttgctcactctacagagacactcaaagcctgctggaagatgggagtttagcctggaggaaaaaacccaatgatggtaacttcttagacatggagacagctattaattcacactaaggcactcaggtcctttctgacagttcatgtgtaatgctcaaaagtgctaaacccttcagagatgagcagaaagataatctgtgagcattcctcaagacttgagaacagaaaacacaaactaaaactttagagaataaaaataaagtttaagattccctaaaacactgtatgtgtccttcaatgtttccaacttggtataattaatattaattcaaattatgtatgtaaatctttaactgctaaactaggggccagcaaattatggcttgcaggtcaaattcaacagaccacctgtttttgtaaattttatttactgaaacacagccatgctcatttgtttacaccctgtctgtggctgctttcctgatacaactgcagagatgagtagctgcaacagagactgtgtggccccaaaagcataaaatatttcctatctggtcctttacccaagaaatttgtcaattattaatttaaactataccagggacaactaagggctgaatgcaacctgtttgttcctaccaagaaagtgtaatcaaatggtcttcaatccatttggctcattttagttctctaagcccacagtcagtctaggactgatgaagcacacaggcatttctgtaacactgggatgaaagaaccttttttatgttggtcagcacatgccatcacatcaacaagtgtttcacaactgctttcttttgtaacacaagcttcttcgaaaacacaatgaaagctctaaatatatataataaacgagcaaatgattttggaattttcatagactcgtgtccaaatatattcctttgtatagaattttcacttgaaaaacagagatgaaccaacagcttctttcagcagtgcagccccatgagacacgagactgttaagttcatttaaaataaacttaatgattagacagggacaacacatttaattttaaaataaaaagaaactcaccagtacttgtctttgtatcttgtatctgtttttctctacctcaactcatccccctctcaaattaatattacatttatctcttctgagcgcacacatgcaactcttacaattgtcttcttcacccacaagcagttacaacaattctttagtaacatcacaggaatgtacaatccacttaaatggcacatacctcaccgttgactccctgaagtactttcatcaaatcttttgctatataagatgggcaactatacacacaactaagtaagtttttcaaagtttcagacaacttctgatgagatttcagtttcttttctctctgtagttcctcaaataaagtagccaaatcctaagataccaaaaagaaaattggataaaaaagggttaagaaactacaaaggctaaatatattaattacggaagactcttacccaaatgatgtgacattgtttataattttccatttctccttaaaaccttaataagaaacgttattaaaaacacacagctggcttactatgaaaagctacacactaaacctttatccaatgaaaagaactaaattgaaatatgacattgctatcttttcaaaagtagggggacacagatgtacagatattgacctatcagttcctaaatccaatgacttagtccatcaaaatccctacacagtgaaatgtcgagaatggagaaaattgctccagtacacagaggcatgaacacactcaatcttctttgctaacgagcttacctgaataacataggcagcatctgaagtgatctcctctgctttagaaatcaaatgatctattatcagataaaacggggatgccactccactgagggcctggagacactgaatggcagccctacgaacttcttttacggggcttcccaggttaatgagtaaagatgtcaccactaaaatcaaaggaaaaaaaaatttaagaaacaattttaaaaactgaaacagtacaaaatttacatagtaccaaaggtacttgataaaaagtttcccttcgaattcaaactccttctctgttcactgtttgaatatttaatattccagagaaaggttaggcatatgttacctggtgcattcttttgaaaatacacaagagcatactataaactctgttctacaccaactgctatcacatatgagctggacattgcgcaatggtgcaatctcggctcactgcaacctccgcctcctgggttcaagcaattctcctgcctcagcctcttgagcagctgggattacaggtgcacgccacacgcctggctaattttggtattgttagtagagactgggtttcaccatgttggccaggctggtttcgaactcctgacctcaagtgagccacccaccttggcctcccaaagtgctgggattacagacacatctaaactcttgcgaatgttttccataagtacatacatatccaaattacatcattcttttttttttttttttcagatggagttttcctcttgttgcccaggctggagtgcaatggcacgatctcggctcactgcaacctctgcctcctggattcaagcgattctcctgcctcagcctcccaagtagctgggattacaggcacgcgccaccacatccggctaattttgtatttttagtagagacggggtttcttcatgttggtcaggctggtctcgaactcccaacctcaggtgatccgcccacctcggcctcccaaagtgctgggattataggtgtgagccatcaaacccggccaaatcattattttttaattgtatactccaatgtattttccatattttaaaaaccggtaccttactggtaaagtttaggttgtttctattcttttgtcatcaaaacaatgctgcaacaaacaccgctgcacatacagccttgtacaagcgtgcacgggaaattacccacctgtgcatcgtactctacaaatatttggtcccagactggtgtgttttgattttactttttgatagagaaatgttagagtcaagtttttcttctactttttttctggtgcttagaaaggccctcctcactctaagtgaatttagaaagtacctctctctatatttagagggagagatcatatgtacctcatgctttcttctaatgccagagctaagtttatgttaaatctttagttcacatgaaatttctatctaaggaatgaggttggagtcaaacttcctaatgtttccaaatggatagccagatgtcccatttaacaatccacataaccatctcacagatctttgattttgcctttattatattcatacattccataagtatttgaaacttgtctatttctgccggctagtacttctagaatcatgttcaatgagagtgatgatttcagcaggaatgcctttgttttcccaattatgaagtgaaaacgctagcttttgatttgaggaatttttgatcatgttactcctattctgctgtcaatcaggattactgatttttggctaatgccttttcaaatctttggacactttatgggttttgtccttcactgatacagtcaattatattaacatagttccctttactgaaccaattttatattctgggcatgaactctagctaggtaaatgatttttataaatatgctgctagagcctatttgcgaatattttctttaggatttttacataatattattcaaagcaacatgacctatagtttttgtctgtaggctttctcaattttcaatgttatgccagttttaaataaagaatctggaagcttcccttctctatgccctgcccagttcaacaacattgaaaaaatctgcttcaaagatctagtaggaatgcatctgtgagaccaactgcgctagggtttttaaaaagatgtctttggaacaaagagatatctaaattccttttacagtaattagttatttaagctttatttcatatctactgcagcaaactacggtcatttatattttgctagaaattttccattatactttccatttctgaaatactaagataaagcttgacaaggtttcaaacctgcctaagaagttcatacaggttgagcaaccttgatccaaaaattccaaaatctcaaattttcggagcaccaatatgacacaagtggaaaattccacacctgacctcatgtgacgggctgcagtgaaaatgcaggcatacaactgtttattcagtgtccccacagaaaaaaagaccctcccagccccctgcagctgcaatgtatctttttcacaaagcccaaattcttccacacaagcatgcccacaaagggcaataccaatggaaaactgaagttcttccatcttgctatttacagtcaaaatgacatatatgactcagaggccactgtcaaaggacagtaaacatttaataccaaattggaaaacagaaatagttatctctaaataaaatatatgtacctttttgaaaacccacaagtttagcagaaaataactattttaataaattgctatctccatacaatggaatactctgcaggcagttgtaaaaagataaatttttccatttattaatatggaaagatgtccatattaattgaaaaattaaagttaaaaaatgtatagagttgttcttatccaaatataactagaaaaaccttaacagtaaactcacctaaaataaagaccgaaattttgtaagcgaataaaaaattacttttgtggaattttattttagaaataaaacttgaaattacatatctactttaaatgtaacaaaatttggttacaaatgtaattatgtgctctttcaaagaactaacaaaaaataaacactgaggaattgttcagggaaaagtatacgatcatctaacttgctttcacagaacatttacaaagagtaattttggaattaaaaaaaaaacaacaagaaacaaaacaaaaaaaaaccaaggacatcttcaaatttccccagggccactcctatgcctctgatattaataacattacagtttgaagcattaatcatgtccattattctaatcaattttttcatcttcaaccattcttctctgatctaattctgccacatcccctcatgtcaatagctctgtaagtcaacccacttttcaatatcgcattcattgtttcatgaaattctgcatcttttgcaaaatttgcaattctacattataaaaaaacttaactttcagttatttcattagagaatgccgaacctgaatatgatttatgcccgataaaagagataaatgcaggagggttttgtttttgttagctcattattaaattgtattatgatgatctgacttccatatctaacccattgctgctacagctcagaaaatgaatagctgattattaagaactcatataatcacctgccatttctattattaaacttttgtgtttggtgagattttgctagtgccagtaacttaaaagcaatacttagaagtgaccagaaatatgtatagatgtacagccctttttttttttttttgagacagggtcttgctctgttgcccagtttggagtgcagtggtgcaatcacagctcactgcagccttgacctcccaggcacaagccatctgcctacctcaggcaactgagtagctgggactacaggcacgcaccatcacgcccagctaatttttgtattttttgtagaggcaggatctcatcacgttgtccaagctggtcttgaactcttggcctcaagtgatcctcctgccttagcctcccaaagtgctgagactataggtgtaagccacctcgcctggcctttatcgattttttttttttttgagatggagtctcgctgtgtcaccaggctggagtgcagtggcacaatctcggctcactgcaacctccaactccctggttcaagcaattctccagcctcagcctcccaagtagctgggattacaggcacatgccaccacgcccagctaatttttgtatttttagtagagacggggtttcaccatgttgcccaggatggtcttgatctcctgacctcatgatctgcctgcttcggcctcccaaagtgctgggattacaggcgtgagataccgcgcctgccctctgctatttttttttaagttataattttccaaactacataaaccatatagagaaagcatgaacagttggtcatgacaaaacataacaatgctacttttaatacctggagaagatatggatgccagttggtgtttacactgtgtcttctgagaagaaagcattgcacagcccacataaagagcttgagtctgcagcactgttttcacactgcagtttagtggatttgaaaggctagaaccataggtccataaaacagaacagaacttgaataactgaaaaacatcttctagatgcacctaattaaaaaaaaaaaaaagcaaacttttaattcttactcaaataagctggttccaaatcctcttctcactagtgtacaattataaagaaacaaataatttaaggcaaagttttgctttgtctaatcatttcaaattattccatattccatgttttaatgaactgggaagatgtcaatgaagagtgatattcagaagcctcactataaccttgcacttgaaaacacagaaccaagacaagagcagtatctgggacgcctaattaagaaaatacttcaacaatgtgctgagcaatgccaactccatgtcaaatgctgtagagagaacaagtcaggcaagaacaggaactgaccactgggcctggcaacatggaggtcactggtgctggggatgaaatttcctgagtaacttcacgtgtgctaaataacctctctgaacaccagtattcacatttttaaatggtattaaccaatcaaaaagactgggctgttgttatttttaaatatagtaatgggcctaacatattagtaggagtgtagcaatgttagtttctattcaacctaccgattagtattgtgattgtactcttttacagggcccgtgctattatatactcttcactgtttacaagtctacttttgtttacattataaactgtcataacccaaataacccacagtatctttttatttatttattattttttttgagatggagtctcgctctgtcgcccaggctggagtgcagtggagcgatctccgctcactgcaagctccacctcccaggttcatgccattctcctgcctcagcctcccgagtagctgggacttcaggagcccgccaccacacccggctaattttttttgtatttttcgtagagacggcgtttcaccatgttagccaggatggtctcgatctcctgacctcgtgatccacccaccttggcctcccaaagtgctcggattataggcgtgagctactgcgcccagcccatcttttttttttgagacagagtctcactcttgtcacccaggctggagtacggtggtgtgatctcggctcactgcaacctctgcctcccgggttcaagcgaattctcctgcctctgcctcccaagtggctgggattacaggccccatcaccatgcctggctaatttttgtatttttagtagaaatggagtttcactatgttggccaggctggtattgaactcctgacctcaagtgatccgcctgcctcggcctcccaaagtgctgggattgcaggccagccatatcttctttaagggtagagtacgcctgaaaaggaggaggcttgtacctttatgaaaagtttcatcagaactctgaaatgaacagcatcggcaccattgagcatcatctcaaacagcccaatgagcaagtgcagatagtccctgctgtcttctttcagttgttcaggattccaccatatatcacctacaaggacatggaaagagaaatgatgctagatcctacatgaacatgctgggagctttttattcaagacagtcattgtggagtcaatcattcagttttgcagagtatcacatttaaaagattcacagcttgtatcttacctttaggaaaagatttaggagctttcagtgcataaataaattttttcaaggaaaatacaagaaaaaccgagtcctccacggccaccctctgagtgctgttgagctcttctacataatgtgcccacagctccactgggatccctctgtctaacatcagttcaatgtgccattctgaggggatttcctgaaatgttaaaggaaacaaaaactagtacaaactaagggttctgaacatgggttatatgaattcctctgcataatatgcaaaagttttgtttatgtgtgcattttggtggggaaaggattaacagaactgctttggtcggatttttaaagaggtttatcactattcacaaggaaagacaaagttaaattttatctatgtcttaccttgaaacattatctctaaaaacaaactttattcatatgaactgtttatccaataaagggtaggaataaataggcatatttcttttttttttttttttttttgagacggagtcttgctctgtcacccaggctggagtgcagcggcacaatctcagctcactgcaacctccgcttcccaggttcaagcaattctactgcttcagcctcccgagtaggaaggattacaggtgcccgccatcatgcctggctaatttttgtatctttagtagagattaggtttcaccattttggccaggttggtctcgaactcctgtcctcagatgatccacccgcctcggcctcccaaaatgctgggattataggcgtgagctaccgtgcctggccaaaataggtatatttcaaaacaggaagataaacagttggattgccaagacatagttaaagggaattctttgatttcactgttttaccactaatctgaataaggtacatggcaaaaatctccaaacctgcagatgattttaaacaagcagcaaaatgttaggtgtttagaaattatactgtaagtgccaaaagaatgcagaacaggtgtaagaaaatgacaaatatgactctgtacaagcagtacagagtaataacttagaaggaaaataatccaaagccagatttacaatgtaacgtctccagtgagggatttgattaactcaacgtgctgctacaggcgaaaacatgctcatgacctcgagaaaggtattaaaagtaaagcaatataaaataacctgttatctacatatgtataataaaacactctatttgtccatacttttaacactgagaaccagtatagttcaggtcatcatacttcacaaaagacaccaagaaactaaaagttaagaagggcctatctggactatttttcaaaatatgaagattttactctttttaaagtttacacattttagctaacaatggccatgatcagaacttataaaatcctgcgggtatacgtaaatgtgaaaaagatataattcatttagtaaatcctataatgagaagccctctaaaatttggaggacaaataaaaacaaaatccttacatatagcagatattaaaaaaaaagtcttgctacctcaaaacatgtcaaatgtaaacagctgaaacatgtcctttagtaatactatgaaagacagtagtaggctggagggatacacatctatgtaatattaaaattatttaaagcctaaaagatctatttttagtaaacaattgaatgaaatagtattttgttcaagcactaacacaccaagtgaattcttcatcgctagaggtagttaggtgtagcttgggtaattatccaataaagacaataaaagagaggagagtcaggcatcagatacaaaatattgcaaccctaaaattttataattcaactaaactttccgcaaaagcaagggagtgcctagttgactatctcactgctacccaagactgcttcacatttcatccagctactatccacagactcaacatctcgcctctgattttcagttttgctgtgactaataggccaggctgttgttttattcaacatcccactttctggagattctgctttccttaccactgcagtaatgacactttcaagcttctttatttttttctgcaacaaactgaagactcttatcgcaaatggaaagtgggtttcttttaaagatgaacaacaagagacgagcacagacaggatcacatgaaacgttactttctgcttcaggttaaaggactcctcctcacccacgcttattaaatcctccaccttgaaaaataaacacactctattaccagttgctcttgattttcataaaacaattttttcaactcaggtctatctaggtattatgtgttttacatttaaagtgagatgacaaacagaaagcctttataaagtactaagcactgatttctaagtaattataagaataatttcagaaactgtaatgaacataattgcacttgccaactggttaatgtatttaaatcacacatctaatcctttacaaaggtttatttaataaggcaaagataattttctcctctttgggattatattttgctattttaacaacaacaacaacaaaaagactaatattttaaatgggaatgagaaaaaatggtggtaaaaaggatatattattcttatgggtgtgatatggatccacattgaaaaaatatataaaatgttaaaagatttcaaacattgcacagaatatattaaacaacactgcaacgtttaaagtaaaaccaagtactcaagaataaaagaaattttttttaagaaaaatctagtaaagcaaaagctgagaatttaataagagtatgagaaagaaatccagggggtggactttcaaagcatacttaccatctttaacattgaagaaggatctcctaaatttatattatcagccaacaactcaatcatcttctgatttgctacaccgattagttttcctggctttgtgcttttaattacattttcaagagctgtaaagtaaaatcgaatgcagagagctcttatgtcaccaacactcaaagaatcacatgaagaattcaggcaaacattttactattgtttatgaaggtttgctttctatttttccttgtatccgattctgaatttgtctatgaattggcttccttttcactgtatactttttatcttggcaaaaattttaaaagaccttactggcatataagcatgaccaacaataaattttaaattttccttgttttcttttgtgttatctgttcactttttctaaaaaaacaactgaattttttaccttcttcccagcctcttaatagagggtgcagggagcagattcctgattttgataaatatatagcaattttcatctcagcagattccgtatcatcattattgataaccataaatggcagcaaacatacaaccacctgatttgacaactgatcattttcactcagtatctcttctttaattaatatgtcagcggctatcttaagtacctcgtacctaaaagacatgcaagcacacttggttgaaagacacattggaaggcttcaattgggcaaaaattcatcattacattactccagcttaactgacaatatcctggtctcctgaccaaaactattattcagatacactaagacaccacttaaaatccatgccaataacagagttatctgtgacaatatttttatttatttattttttgtacaagtgctgggattacaggcatgagccactgtgcctggccaacaatacttttaatctgctcatcctgtctaatcttaaaaaaaaaataataatttttcttagagaaatcactagaggttaactataacataagacatatcacactagatgtctcaactctaccggaaatcaggttcactcaggcactcaaaaaaaatgaaccaagcacatcctacatgatagatatctacccatacgatagatacaaaaacacgtaagacacactctcatcctctatggagcttgcttactttttcttgcaaaaagctttggtgccaaaaatgaaataaacagagctcattaaaaacttaccacagatggtatcatgtgtctctgaacttattttttaatttgtttaacacattggtatttgtttttaattataaagtaaaaattacataaagcagcaaattagaaagtcctacccatcttacttcccagaatgcaatatcatacattatatacttccttttgcattttattaagagaaattccaaacatagagaacagtataatgaacacacacaaacacaaattaattaactgtataatgaaagagagtattacagtaagatctgttctactaccacgacaaaagggtcatgtaatcaaagccttaaaaaaaaaaagaagaagaaatagaaagaacttgatataagaacttcatcaattcaaaatagtatgaggagaaatgaatacataccattctccattctttgaaagttctgctctttgaaagagattcagaagatttgaaatcgtcacttctgaactgaagtgttctttgaaaatctaaagggaaaaaaatatccagagtagatttgtacttgcttcaaacatgtatggcgctttttaaatgcgaattttaaaaagaatgaattataaggaatttctcccaggaatcctagtacaaattaaaagttttaagatctatttctcaaaagtggcattcataagacaatttccacaggtcccaaggtatttgctattgataaaaatatgttaaaagcaatataaaaattcacaaaacatttttcctgtttgaacaacttccatatatatttaatatatcaaattgtgaatttctgtgagtttctcctaaccagacttaagtctgtgctctccagagaacaaatttcccatggaaaaataatttccaaaaatattctagtctcaagcagagaatcaagtgagaagggcaaggaaatttacaaaattgtatacctcaacaaatgacaaattcactcacctcaaaagcacttatagccgacaaaacaacatctatattatcatcacctaatcgggctaaaacagcttcttttatgaaagattcatcaacaccctcctgagcaataaaagaaaaacattaatttagctgttgccaaaaatctcttaaggctttgcactagaaaggaagtatggttttgtgaaaaacactccagaatgacagtctaacacaggctctgctctggatgaggactgaaacacactagaactagataatcgctaaagggccttttgagattaataattgtttggtacaaatccttttcaagttttcagtgaaaatatagtaaatatggtatactccaaatatagtttttgtagttaaggagttcatcttattaaagtgagagcccagatattgacgggatatagactaaagaataagaatgtctaatttaaatcctagctctaccacttactagttgtgtaactttagtcaagtcacttaacctttctggatctcactattctcacctataaaacaggtttgctaataaataatacctacctgcaagggttgttagaagattaaaaaatacatgtcagtctgtagcacagtgctttacacatagtactgttaaaagctagctagtattatctaaatttttacaaggataaggacatgtactacaaagccagtctgccaaaaatagagatcattttttaaatataacaaataaaagaaaacaatgtatattcattcacagagaaagaaaactaggactgctaatcaacctgaatatatccctatctatatgtggcaggcaactaaataatataaaaaacataggtcactctgttgggagaaaaatgaaaattcacagaattcacaaaaattaagttagtcaggcacagtggtgcatgtctataatcccagctactctggaggctgaggtgggaggactgcttaagcccaggagtttgaggccagcctggataacatagcaagaccccatcatttaaacaaatcctcaagagctaataagcagccatatatctgaacctggagtttagaataaaacctatgtcctgtcatcaatggagaaaagaaaatgaaacatggtatgcaaaggaggacatcaactgcaattacaatcctcaagcctgtaagttgaatgtatgcagggccggcccttcaccgaaaaacgaaccaaacccagagaacaggagagaaaggcagtaaaagaaggaaggatgagaataacttcagaaacagaagattccaggactcccctttattctagaagaatttcttatcactgaaatcctcctatcacaacaaagactattattcaatgaatttatttaacatatcgacaaaataaacctattggcagtttacaaaagcagaattcatgtcagatcaaataaagcaacatttctcaaacctgaatattacatcagtcactttcaaagaaacattctcaaagatctaaatgttgtttgttgtttatatatcaacttaaaattaagtataactccttcttaaaatatagatgacataaaacaaaaatttttttttaaatctacaagggaaatactaaaaactctataaaaccaataaaattcaaatgaagatgaacttagtgtgattagttgtaattagctgaaattaaattttactgatcatatgattttacttgtagtaagaatctgcttctaattgctatgacacaagttctagagttcggcacgtttacactgccatgtgctacaaggaaactaaactctgttaaccgctttactctgttccagaaatttctcaaatatgcaaatcacggtgcataattttagatatgacacagatggagcattcctattttaattatagtaactatagtaaaatgcatatacaattagcacctcacacccacaatttgaaggctatgtaaaaaaataatgagtccatctgaaataaagaaaaattgtgagaaaataatactactatcagtggtaatttgtaatttagcaaaaattgtacagggactgcttgaatgactaaagtttggaaactactattctatgtgcatcattaccaagtcttcataccaatgccttttggtataaatgcaaattagaccaaattatttacaaataaagtcagcctcaatacatatttgaaaccactaacattttaaagacaaacgaaactgcaggcaccaaaatcatggaacagtgttcaaaagttatcattcaaatgtcccaaaatatgtcttcatctaaaattaagactatcaaaatcaaatttctcggtttttttttgaaagagtcttgccctgtcacccaggctggagagcagtggcgtgatcatggctcgctgcagcctcaacctctcacacccaagagatcctcctacctcagcctctcaagtagctgggaccaaagcgtgtgccaccaaacttggctaattttttattttttgaacttttttatagagaagggggtctccctatgttgcccaggttggtctcaaacgtttgggctcaagtgatccttctcacagagtgctgggattataggcatgagctgctgtgaccggcccaaaatcaaatttcaaaactaaaaaaattctcagataattaatgaacctacgtgaattaatctacaaattccagtttgaaaaacactaaagataaacaactgtcaatgtggaaacataaaagtagttgttattaggttattgttaaaatggggacaactggcatacacagtcctaaatattagtctaaggtactctcatgaggtttattcaactcatctgtatcattacccacttaggtggtaacttcaatttcttattcagaattacactgctcatcataagaaaaaaaaaccatataaaaaagcgatctgaaacaaacctttgatgttttcatgatctttttcaaatgattcatggccagaattctcacaggagcaagtggatgattcaggctgagcatcaaagaagtatcagaatctgctaaaaactacagggttcaacatagttatcaaatgatttcacttaatctgaacagtctatgatcaagaataaaacccagagaaaaccaccccaaattgcccaacattttcagtaacaaccatctaactacagaaaacaaacaaaaaaatgcaaaatctttgtttctagaacatcacatgagttgatgaaaaaatttgtattgttaatggtatgatttcatgtatacttgtgtctatgtgtaggtttaatttagtcaagtaattctacaaagtaattttgtattttgtatgcgtatctgataaatcacctaagataaatccctgttttagcaccttccagaagacagaatgcaactcatctacatgatataacaaatagtgacactcaaattcgtgacaacttagttcacttacgcaattagactaaaaagaaagtcttatccatcaacctaagatttggaaatgcaacaccattaaaaatgaaagtctaattatggaagagaaatactaaaacaatcatatttctcttcataattatctgtttttaaggctaaatataagaactcctgcttaaatgtctaacctctagtataaagctttaggcttgaatcaccagaaaatttctcaagttttaatgtgatcatgaaatagaacccatctcccccttgctaatcaataatataaatagccatctgtggctggtacactggaaagcatagacctagatgaaagacagagaatgctagaaacctacatgaggccgtcctctgatgattcttaatgaatatcccatacaaaattctcaaacaatacttttcctgaaataagtatcacgttcatagttatgtacaaattattgtacctttctccaattattctattcctgcctcagagccgtacttcaggcaactaggcaaactgtagaaggttatctctgtaaaattttccacacaagggaaaaaagtggcaaatttccttctggagctcttcacatacccatacaaatgtaccccaaattgtcataattcctttggagaacaacatacctgatactttcctccacttgtagaaagagaaacaaactgatggaaaagctcttgttttttcagatctgcaatttcctttaagtgttcctctaatacaacatctaatgttctggggtatctgggaagcaattaaaaagtgaattcattattcttaataaatttattaatctcatacaccatacacatataaaggaaagacataaaatcttaaaaattactgagactgtgacttaaattttaacaaatgttgtaggtaaaaccaaatgacattggtcaagtgtgttactatgactactccaataacaaaatagtctctctataaaaaattatactctccatagcccccacacaaccactatttcctcttatatttcaaatatttttgattccgatactcgccccttcttgaagaacaaatttaaaaaggacagtctctgtacaattcagtatattaagatgtgacttgtgaatcatatctttatagaacaggaagtactttagaagagcataaacatacacacgtaacttacttgctttctaaaagcctaatgagtggaagaaattgttcattaagcaaagacactttattagaatccatttcttcctgtgaactatatgaaatatactcttcaaatagaaggctgtaaaaaaaaaaacagaaatatcagcatacataagagttactatttattgagtacctactatattctaagtgctttagaaatattatctctaattgtcatacttatacaaggtatagtttaatacttattttacagataaagaaactagaggcctggtgtagtggttcacaccactggcattataatcccagcactttcggaggccggggcaggagaactgcttaaggtcaggagttcgagacctgtctgaacaacatagtaagactacattgctattttaaatggtgctggctcacgcctgtaatcccagtactttgggaggccaaggtgggcggatcacctgaggacaggagttcgagatcagcctgaccaacatggtgaaaccttgtctctactaaatatacaaaattagctgggcatggtggcacatgcctgtaatcccagctaccagggaggctgaggcaggagaatcgcttgaacctgggaggcggaggttgcagtgagccgagattgtgccattgcactccagcctgggcaataagagcgaaactccatcttaaagaaaaaaaaaaaaggaaaagaaactagagtgtaagtcttccaatttgctcatgagaacagcaataaaaggcaacattcagtaagcccttctgtgccacagagtggggtttcacattttaagccccagtctgattctagagcctatgttctcaacattactacacgtgtatactctcctttaattcacaaaccaaccctctgagcaaaggggcatgaatgatgcacaccaacacacaggcactctcttgatcctacaaaatggcaaagctacatccagactaacctccaaaacttactatagccctggaagtggtaggcgcagaatttacacctatgtctgaccacaacgcctacatcttttcactgtatcgagttgcccattaagagaaaaaaaaaaaaaaaaaaaaaaagactgaattatctttaaagaaataatccttactctatgcttaccttcaatattgtttctaaatgacatttactgcgttttaattgtgatgtgttatttcagatattatggtccatttactaagagaaaacttcaaacggccacaaactgcatttagttattacccaaatttgtcttaaccactaactttccattttcatctataagcactaaagacatgcaagaaaaattacttttgcttttaatgctgccagttactggattaagtacttatagttaatgaaatgatacagacaaaacaagatatacattaaaaaggaatgctgggaaatttctaaccaatcttgaaaattatactgagtcacaaaaatgtaaatcaaaagcatgtcaaaaataatagcttacctagccaacaaatggtctaagttgttcttcagtgatatttttgtaagtatagcttctaagtgtctcttgtagatttgaccatccattccttcagtttcttctccttaatatgtaaaaattaaaattgtgttgggaaaaatttattttgcaagctaacattattaaattcacttatagcagaaaatcgttctcagaataaaacacacacactgatatccagctttttatctatttgcacaagtgcattccacttatttagtcatttatattttttaaagctcttttgtatagatcaccttcatttttcttttatctaaaattctctatttttaacaagtactatcatgcttataacaataacaaaacaaaagtccaaaattagtctttccccaggtcacattacaaattagttgtgatggtgccaatcaactatctctgaaaagaggttaaacttttatctcagtacccacccccttactgaaccaaaagctgtcatctatttcagatttataataaacatatgaatctgatcttagcccttgctttcaaagactgggacattactcattaccttcagaataggaagaatacattttcattttgctagtcacttttctaaaatgcatgttcaaaccaagatttggttacaaaaacctcatttttcagtagactgacataagtttagagaagtctttcttagtattctccaagtagcaacagaaccaaatgtttcttcctagcctttctgtatttattaaaagacataatgcaaataatcactttctaattattattattatttttgagatagggtctcactctgtcgcccaggctgaactgcagtggcacaaacacagttccctgtagcctcgaactccctggactcaggtgatcctcccacctcagtctcccgagcagctgggaccacagttgcatgtcaccatgcccggttaatttttgtatatttttgtagagacggggttttgccatgatctgcccatctcagtttctcaaagtgctagaattataggtttgagccacctggccctctaattattactttttgctttttgctttgtttcataatttggatttttatgtataaaaattttcttggtcttatatttttaattactctagggaaaaaacttttttggcaactggatgagatattcattataaatgaatcactaaagttcattaaatacctaaatgagaaggcaaaggtttactcagtaataaattttaaaagtattccagtctttttcatgtagagactatttaagtatttaagaacacagatcttaaaaaaagtaaaattctaagaaattactcaattaacaatgatctttcttcaaccaacctgctccccaccccagatgtttctcacttaagaaatagacaagttacacaagaacaactggaaaacagaaattttaaatattttgaagctgttaaccaggatatggttactattttaagatcaaatcttagaaaatttctggacaaaaaatataaaaccacacacctgtaacatgatgaatgatggagacgaccagatggggaagcatgtaatgcagaagaggactgacatcgtaagtttcagaaatcccatgaagtattgtaataagatcaggaacattacataagtgagggaatggcctttgaagaagcaaaagtacatatcgtgttgactttacaagttagacaatgagtaacaatataagaaaatatataatcacttatcttacaaaaaaaaattattcaaaataattttattcacctctgactagcaccatttctcaattcaattgtacatactttttcccaaggctctctggcttctgtctctgcaggagcactatcaagcaacttaacccatccttgatcaaagagggaatcttggtcaatgttttgatgatctgtgatgccaatgaattcacaaaggtattttccatggtcactttcacagaaatctgacatattatcatgtatgttgcagctctgtaatctggtaaagatgatttcaatccctaaatattttttaaatataaggaaaaatgataaaccatattattttctgctactttaaatgttaatctgacaaattagaaatgtcatagagattaatacaacctaatgcatagtcaatcactcttcagacataaacaataaaggagctgacccctttttcagagtggatacagagatgagacaagtctgttgaacgagacaaaggatctcagaaaatttcccaactcaaacatctaccacatgtcctgacaggagccagtaagctcttcttttatacataaaatcctacttatagtagggagacctcaatcagatcactaatggaagaaacaagtctgatgaaaggtcacaagttgggacactggtgggaagtgaaagcagtacctccacagggcacctgggaaggcagcaggcaagaaggcacttgggaaggagaaacgctgagaggcaggagccagtgcacaaagaatactgagaggttgcttacgcctcaaagagactgtctgctccgtcctccttccagtgaggtacaaagactgctatggaaatcaatctaggagatggccgcaggaccagacagccaatatttattcttaagagtcctaattaaggtcccaggccagtgagtttctaataaaaaagtgtcatattttcaacctaaaggctaaatctcagctatcatctgaaataaactgtcaatttaaaaacacttaaatctaaaaaaactttcgaaagcaagaaaattcctttaagtacaaaataatctacttaacacatcagcagtgccaaccttttggatatagggaaatagtttggcgatgatattgtctgatacgtcctctgcagctaccagcgccgacactatggtagaagcatagaaagccaagagcaccctcaactgagctgagctgcccgggtactcagcaaaaacctgaaacaaggaacacaaacaaaacacatttaacagtgaaagggaggtagaaggattgcttgaggccaggagttcaaggctgagatttcaatgaactatgatggcaccactgtactctagcctgggcgacaaagcaagtccatgtctccaaaaaaaaaaaaagtgaaaggccaaataaatatttacagctctcctgaattaccatatgcaacaatgaatacacaatgtgacaacaattaactgcctaatgatattcctaacatttttatttaaaaaaaaattttttttttttttttttgagatggagtctctgtcgcccaggttgcagtacagtggcatgatcttgggtcactgcaacctccgcctcccaggttcaagcgattttcctgcctcagcctcccgagcagctggaattacaggcatgccccaccatgcccagtttattttcgtatttttagtagagacggtgtttcaccatgttggccaggctggtctcaaactcctgacttcaagtgatccgcctgccttggcctcccaaagtgttgggattacaggcgtgagccaccgcacctggccttaaaattttttaaacagctttcccaggttgaatattcccgacatttctagacactctctttgaatagtcactgtaactagaatctggcaaggaatagacatttatttttgtagaaaaacacctttggtgataaaagactgattcttaaaaaaaaaaaaaaagatacggactctcaaactgctcctgcttcaaaacaccagaccatttaacaaaataaatttatccaaagtatcattgttattagggaatgttttagtatgttttcttcattcaaagcaagcaatcttttcataaaattatatactcatgaaacagactgctcaccttcacagattttgtcaccaaactgcaaatgaaatccatgaatccaagatctttgtagcagtgggtaatcaaagttcctttagctaacggcactccagattgctgttattgatggaaagaacaaactactagcaacattcatcaactgatccttattttaaagcatttaccctagtaatgtcttcatactgctacaattcataaataaaaaatataatctctccttataactggtggtggtgatgaaattaacacataaaatcatgtaaacttagaaattcaaaagagaaggtcagcaatgagggcagaggtatttagtgaaagatgtttgcttatcgtatgtcacattttgaaaggtatttatcaaaatctggattctctagattcttagtaactttactggttcgatttggtttctgagccactatgatacgcttctgtcattgctttacaataacactaagaacagaaatagactaggaaactgcacaacttataccactattcccaccatctagcgttgtacatggtatgtaatagatgctccataaatactgattaaataaatgaaaggagaattttaagtgaactttagtaggtgagtggagtttggctacctgcaataagagtgcctagggagcagcaagatccaaggtagattagaggaagaataattttgatgctatgggcagagtgaatgttgggaagagcagttaatgagctttatcaaaggctggccttctccaacattctttagttcaagtgctttacgttcagattcttaaattctccttctaattaaaaagtcctcattactcctatcttactaattctgaacactgaccccactaccatcatcagcctaatgtgcacagcctcgtgatctgttagcttaccttcatccccatttgcctccccccctaccctggatcaccatgcccaacatgcagtcaagttcctgctaacaacatacatctactttcctccaccatatgttgcaaacaaagtgctaacggttagtcagttggttttcctacaatagcatgctgtcttttcttacccagacccttcctgttatacaagcatccttttcttagtctgtaaattaactcctagcatcttcctcacaactttagtaaattcttgaaacccctgaagttatccttatccttttaatttttgtaagtattttctgcctttcttcaccttcaacttttttttaagttctcagttccaaatttaaaatgccaaacggcatggtacgatacaaaggcacagactctggaatcagatttgggttcaaatctcaactctgccactttatagttatgtgaactttggcaagtagcctgtcctcatctgtaaaaatgaagttttgtgataatccaagataatataatgtacattgcctagcctgatgtcagatactaaataaaagctaaatattattaacattaataatagtttcaattggaagtcaggaaataaaaatgatggaggtagttatctggactatccccaggagcaatgacttattttttcctaattaaatcccttaatcaagatctgtaatgattacagacatatgtcattcagcaattataccttaactggcaacaaccagaaccatctgtgctttgaattattaatttttagaagctgtatgactcgcacaaatattcttgtctcgtggtatggcagaacacaagcaatgaggctatcttgattatagagatgtatatggaacctggggaaaaaaagcaaacagtccaactgaacacaaaacttaataataagcacctatttcctcacatgcccaaactgtattattaataagctaaaacaacctagaacgagtagcagtaaaaatcacaaaattataagatacagagcatttaaaaagtccccaattttgcattcacatatccctcaacatggtccagccaattcctatgcaatatctttgaatattctacatcaaaatatacatcccattaactttctctcagctttacaatttttatttaattttttgaatagagtcttgctctgccactcaggctggagtgcagtggcacgatcacgggtcactgcagcctcaacctcccaggctcaaatgatcctcccacctaggtctcctgagtagctgggaccacaggggagcaccatcacagctggctaattttttatttctgtgtagagactaggtctccctgtgttgcccaggctggtctgtcaacatttttttttttttttttttttttttttttgagagggagtcttgctgttgcccaggctggagtgcagtggcacaatctcggctcactgcaacctccacctccaagtttaaaagattctcctgcctccgcctcccaagtagctgggactacaaactcataccaccatgcccagctaattttttttttttactttagtagagatggggtttcaccatgttgcccaggctggtctccaactcctgagctcaggcaatctacctgcctcagcctcccaaagtgctaggactacaggtgtgagccaccatgcctggctaagatgttttttctaattctgccaactgatccctcttctgtgaaaactctcctatccttttacatcgtgtactttttttaaacagtaccatacattgccttttattagatttttttttttttccagagtctacttggtcacccaggctggagtgcagtggtgtgatctcagctcactgcaaccttcgcctcccaagttcaagcgattctcatgccctagcctcccaagtagctggaattacaggtgcacagcaccacacccagctaatttttttttgtatttctagtagagacagggattcaccatgttggtcaggctcgtctcaaactcctgatctcaagtgactggcctgcctcagcctctcaaagtgctgggattacaggcgtgagccactgaacccagcctcttagtttgacatacggttttagcggttactttttccatgaagctttcttcaactattccaggcagaactatatccacaaaactctgcttaatcctttattatggcatttatttcaaaacagtaatcaacggcaacctacttatctatgtactgaacttagtatttgctgaataaataagttatctgaagacataaaatgaaaaatcaaatgcaaaaagtattccttacattaatgatctatttgggggtaaagttaggtgctagaaaacagatggaaatattacagacttttaaatattctttgtctgattgccctaatgttctgacaatcagaagacccaagttaaaatcatgttttcttgatgactcacttgcttcttgaaaaaaaattagtttatccccacgtctccattttttgttttttttttttgatacggcgtctccctgttacccaggctggagtgcagtggcgtgatctcagctcactgcaaaatctgtctcctggattcaagcaattctcctgcctcagcctcccaagtagctagaattacaagtgctcgccactgcgcccagctaatttttgtatttttcacacagacaggttttaccatgctggccaggctggccttgaagccatgtctccaattaatggaatagaaatctacttttaaaacatgtaagttggactggatgtggtggctcatgcctgtaaccccagcactttgggaggccgactcggcaggaggatcgcttgaggccaggagttccagaccagcctgggcaacaaagtgagacactgtctctacaaaaaatggaaaaacaaaaacaaaaacaaacaaacaaaaaaaaaactaggtgggcatggtggtgcatgcctgtaatcccagctacttgggtggctgagatcggaggatcatttgagccctggagatcgagtgggccacgatcacaccactgcactccagcctgggtgagtgaaatcctgacactcaataaaataaaaataaaaagacagccgtgtgcagtggctgtggtggctcacaccagcactttgggaggctaagacgagtggatcacgaggtcaggagtttgagaccagcctggccaacgtgatgaaaccccatctttactaaaaaaaaaaaaatacaaaaaattaactgggcgtagtggtatgtgcctgtaatcccagctacttgggaggctgaggcaggagaattgcttgaacctgggaggtggaggttgcagtgagatgagatcgtgccactgcactccagcctgggcgacagtgcgagactgtctcaaaaaaaaaagacatacatattgggagaataaataaaacaaaaatgtgtatgctgtgatgtgacaccaatatgtgagaaaataaactaagcttactgagacaattcccaaagcagataaaagatcagaccttggaaataaacttcagctgtatcctagctctgccacttactagctgtgtgactcaagaaacttaatccctctaagcctcagttttctcaactgtaaaacaaggataatacaaataatctcaccagaggaatgctgtgagaattaaatgagataatgcagataaagtgcttaccagggcctagtgtataaatgctcaaaaacacattagctatcattgtttttctcaagcaatggtatttcagaggataacattgcctgcttccccaaccatcttgttattttgccaagaaagcagcttagtactcactgcctcaagtgtgcaggaacaagctgtaatggcaaagtagcatgggctcttcagaactaacgaggttaggctgggcgaggtggctcacacctgtaatcccagtattttgggaggccgaggcgggtggatcacctgaggtcaggggttaaagaccagcctggctaacacggtgaaactccatctctacaaaaacacaaaactcatccaggcattatggcaggtgcctgtaatcccagctacttgggaggctgaggtgggagaatcacttgaacctgggaggcagaggttgcagtgagccaagatttcaatattgcactccagcctgagtgcccagcaagactctatctcaaaaaaaaactaatgaggttagaccatttactcaaaatcaccagtagttctacttttcactatcaacaaaaaagaatttaaaggcagaagagcatgcttatctcacacaatggacattgtatcaatctcttaatatacctaatttttcagctttaatttgataagttctcaactacttaattttttacaagaccaaagtgattaacccatagttatttctgtaattctattagctacctgtgaatcaaccactccagacacttctgtgctggcttaagcaggaagtaaggcgacaagtgaataaggaataatgaaatgttttcatccaactgtttgtttactgctttggtctgaacacttcgctccaaggtttttgctagctgactgaacaacggtgcttcaaactgctcaaaggaaggatcaattccaagcaactcttccaggccagtacatcctaaatttcaaaaaaggccagtttatttaacaattcttcgtaagcaaattcatcccacccctcttttacagttttacttacccctaagaagtttctgaattctttaagtacatataatttataatacagtcccaaacactgatttctagttttcaacttttagagtaaatcctatctcatctactagaacagaaagtacttcgtggcagggaacacttttttttttttttttttggatatcccctacaataactaggccagtcctctgagaggacttctccgtcaccccagtcactgcctccatcccccttttagctgttcttctctttgacatattagttgacctctctaattttgtttcttcatctgtgaaatccagatacctctactcataaacatttcaagcaccaagcacctgactgttatgttctctttcccttaaaaatatacatcaacatgctagaaactgctaaggaagaggacgggacagaagagaaaacaaggggaaaaaaaaaaaacagtaacatccagaaaacaaacgcttccaagagcttttctaagttaaaagatggctcaccaatggcgaaggcggtgtccctgtcgattgtggccgcttccttagggtcaaataacaaagaagcaacttcatctctagataagaggctggcatcactttgagggagggcgagtcgttgcagctgctgggctaaggacgtcatctttcacgccagcggagttttaatgacacgggctaaaaaaacgtaagcactttgataagtttctacgaaattataaggcgcctcgtaaacaaacaattctcttctgcactcagcaccgtcatggacacacaacgcgggtgtcctgagatttgtggaccccggagatgcaaagacgatggcagcagcgttaacaactaattacagtagcggcgaccgcgccaaggctttccttcaaccctgattccgcagatatccggaaaactcttaccctccctcgatatgccgcccccatccgcagccacatcaagcggctctgtgccgcttacctggaactgggaatttgggtatatcttggaaggcaacaactcttcacagcgcttcccacatggtaccaaggagcccaaccctcacccggaaacctaaggcatgctgtagagcaacttcct

SEQ ID NO: 7 - DNA, 11684 bp, Homo Sapiens
taactacaaaaataagcactttactaacaacaggattctcagggaatgggggctttcagaggtgtcactgggctgcactgttgaggctgtgtgcatcagtggagatgtgagaccgaaagaaattatccaggacttgctggcccatgcggggctttttccgactgcacggagaggacacctgggaccttttggaaccctgtgaaaaaatggaaggagggaggccttgtagttgggggagggggagcagagaatcctctccttgtcctctctccctttccccgactctactgatctagctaggcttagcctggaatgctgtagagctttcatcctgcctcaagtatctgccccatcaatcaaccctccaaaaggctgcctgagggaatcgaattgtcctaaaaatgcaaatctgactcctctctcctccacctaaaatgagtcagcagcctagggctcacaccctgactgacccagcaggccctgctgacctttccagctaaaccaactgctcacagctccttgagcactgcagcctgcactgggctccacctttgctcacactactcttgggactggaaagaacatcgctacggttgattcccctcccaaacctgaagaaaaggattcatttctaggacgaagattaccagctgcttcctccaaacagcctttcctgatccgtctcccaattagaactgatagctcccatggatgggtgtggtggctcacgcctgtaatcccagcactttgggaggccaagatgggcagatcacttgaggtcaggagttcgagaccagcctagtcaacatggtgaaaccctgtctctactaaaaatacaaaaattagttgggtgtggtagcaggcacctgtaatcccagctacttgggagactgaggcaggagaatcgctttaatccagttgtgggagattgcagtgagccgagatcgggccactgcactctagcttgggtgacagtgagactgtctcaaaaaaaaaaaaaaaaaaaaaaaagaactgatggctccacaattcatatcccacaaaactcagtacaggcatttcacacacctgtgacactggagagtcctcatcatttttttcctttccctctaccctgcaccccacaatggaaggtctccaggtcaagaactattcctccctccagtgaagcctggagtggagaatgttcacccagacattcgttagttaactgactaaaaacctatggactcaggcctggggagacacggttgggagaggcctaggagacttaccatacaggtccctggctgttggccctgatacacacggaaaacctagacaagaagacagggaggtgagggctggcactttttgcaaaagagataaaccggtgttctgcccttaacttcatgtcccagtacttttgtttaaaatatgcttttttggccaggcatggtggctcacgcctataatcccagcattttgggaggccaagtcgggtggatcacttgaggccaggagtttgagaccagcctggccaacatggtgaaaccccatctctaaaaatacaaaaaatcatggctgggtgtggtagctcacacctgtaatcccagcattctgggaggctgaggcgggcggatcacttgaggtcaagagttggagaccagcctggccagcatggtgaaacctcatctctactaaaaatacaaaaattagccaggcatggtggcgggcgcctgtaatccgagctactcaggaagctgaggcaggagaatcacttgaacccgggagatggaggttgcagtcaaccgagatagcgccattgcactccagcctgggcaacagagcgattctccgtctcaaaaaaaaatgctttttttcctgtttacacagtaatatattcatgtagaacatgtaggaaacacaaggaagtacaacaaagacaacaaaggtagtgcctttttcatggcggtggaaacagctgcggtgtgaaattcctcctgcgtcagccagcgagcacctggtggtacggtggtcactggggtctgcccttccaaggccagcccatatacttgatatgtcagcttgatgtgagagaaggtgtggacaacctggaggaagggtcaaggggttcaaataggcctgtggatatagcctcaaaagccaacatccttggctattccgctgctcacttacctccccaaggtgccggaggtgcgtggctgggaggggcccagcccaacgctgtagttcctgcagcagggccttgcgctgaagctgctctgagggctcccaggtcacggacgggaactcccacagtcctgccagcagacctgagagggagggcagccaggcaggggtcaggcctcagctgccgattccctccattctctcttgttactcatgccactgccctccacgcccagtatccaggtacctgagttgggcctctgcaccagcagaatttgggccccaagggccccaggctgttccagaacacaggtggcagagctctcctccctggggggcttgcggctggcctttctggggaagttgaccactcccagggtctggtcccagggctccgagggaggcaggcacaggtggcactgtccagtgttgggagctgggaacggagatccccgaaccctactcaagccaagagggctttaggggccaacctagagagtgggctttggccgggttctgcagaatcttactcaggttagaggaagaactggaatggggcttctgactgggccaggaagggttggggtgggggctaggtttggtgctcaccacactcctccacgtcaggactgcccgacaggctccctgaggctaagagctgttcctgctccacctgagaggcacagggttgagtgtcatagggcagagtcactccttaggacttctcactgccccttccccagtaggcttactctctggcgtgcccggcacaggctctccacagggcactggctgcacagtgggcgctgtggggtacacactgtggcccctagctccatggctgcttggttgaaatctcctggccgggctgggtccaccagctgctgggctagacccctaaaagaagggaacactgctgtgaagcagagctcctttgcagacacccctgaagcacccttgttaccccaacatcctaccagagctgctgggaaacaagggtgctgctgggatcagcaccaatggctcggacacggcacagcacccgtgctacgttgccatccaccacaccggttgcctggcacagaggggccaaagagttagcctgggctgggaggaaggaggctgggcacgcacaaagtgggggtgggctgtgagatcacctggccaaaggcgatagaggcaatggccccagctgtgtagcgccccacgccaggcaggagctgctgcagggtctctgctgtacgtggcatgtggccccctagctcctctaccacctgattggagtgcaagactcaagattataagacacccaagactcctgggttcctaccctcctgccatccccttaccttccgagctccctcctgcagccgccggccacgagaatagtagcccaggccagcccagagttgattcacctcctgtgggtaggatcagaggtcaaagagatcacccgtcagtccctctattgttcctatttcccctaccctagggtggctctcacctccagggaagcactggccaggtcctgcagtgtaggccacttctatagccacaggcaggcagaaagagacaaggtcaagggtgaaggtggtagaggaagccttctctacacccaccccaaagtagaggctctcatctggggtctgacccatgacccttcccttcctcccctggagtcacctgcatccatccggtatagtagttgatcacagtggcaacctgggtctgctgcagcatgacctctgagacccacactgggggaaaggggttggcatgaggacactgctgacctgcccctacctggcccacagcccccagacccaagggcctcgaggcaaagtggccctgctctcaggagatgtactgaccagcatatgcccgcctgtccaggtccatctcatcttctgcctgtcaatgcaaccccagatgaggagttagggtggagggggctgggtgcctgcctcccacccactgtccctgctcctcgcctgcctacccgtcttctccatggtaggtcccgtttctcttggtcgtaccagcttagcaggctccctcggaaggctgtgacttcagctacgtctctgaatagatggtatgaggagacagaggcctgcaataccacctcttccggctgcctggccaggcctgctggggccccaggacactcagcaatcatccctgcacaggctgtgcatcagggtcttgggacacagcagcctgtggcagtatgctcccacttagggcttcccccaactaacccccttaagctttggagctggagtcagaccagagttatgtaattgtgtgtagctgtggctaagtttctggccttaattttctcagggtggtactactggcttgtctctgagccataatgaaaacctaatagttttagccagctagaatgtatactggtgcaggaccttcctattcacaaaacactttcaggctcataaactcatttggtcccatgaaagccacatgagggaggaaatgctgaactactgctccattttactggtaagaaagcagccattcagagcaattgtcccaatgtcacacagcaatacagtcagaattacaccctcagtgagtctcttttgttttgagacaagagtctggctctgttgcccagactgaaatgcagttgcattatcttgactcagtgcaacttctgccttccaggctcaagcgatcctgtcacctcagcttcccgagtagctgggactacagacgctcaccaccacgcgagcatagagaggggatttcgccatgttacccaagctggtctcaaactcctgggctcaagggatccacctgcctcggcctcccaaagtgctgggattacaggtgtgagccaccgcacctggcccttagtaagtctcttaatgtcttgatacgtatcacaatcccttcccagcctgaatctgcctttcatggccaatgagccttgggccacaacctagttccttaccatcacaggcagaaggcttggcctgactgttgttcttagcatgcttctgcctcccttcctggctggctgcctgcttcctgtgaccacttcccacggctgctcgtggcttcctcatgatggcctgaaacaaaaagacccagccaaagcagtcagtcacaatgaggccaaattttgaggccttccaagggtgatagctatctccctctcatccaccattcacatggggtccagcttctctcaagcactctcaagatgctcacgggtttactcttggctggctgcagcactgagatacaactagtatagctgagcaagtggcctcaagggggccggcgttacagccctggagacatgcaaagactgtgaggccagggctgggatgggtcaaggatgaaagcctcctgtttgggagcatttgtgtatctctgatgcttactgtgactgtgtgtgtggataggggttgtttaggtgtgtctgggagaatgggggtaggcggtttctctgcctcttagagatgtagcatggttacactgaaacagcctgtagtagtcattaagtccaaaaccttcattttatcctagaagaaaccaaggatcagagggacaaaagatctgtctgagaacagatggcaaatcagtgggagaacagagattagctatttttattcctaatctagtaaaccataggtggctgaccatcaacaatgagaaaatgtgcctggttgattttcactgctccctaactgttataatggccgccttttctctaacagctaaaattagttgatattttgtgagtgcctactctatgtcagaccccatgaagagctttaccggatctctcaatctcctggtgactctatgaggtatgtactagtatcacctccaccttagttataaggaaattgaggtttatggagattaagcgacttgttctttcaaatccacgaccagcattcttatactgtgataaaatgcagtccctgctaagcctctgtatcaaactctccccccaaacctttgactttaccacctcattttcatcaaaagagcttgcctcctccttcagaaaaaaaaaaaccaacttcaaatctacctccatttgcactgtcttaccctcctcctcttcagggtcctgctcctccaatcccgtctaactgttggaactcagaaactaataccccaggccaggcacggtggctcatgcctgtaatcccaacactgcgggaggctaaggcaggcagatcacttgaggccaggagttcgagaccagcctggccaacatggcgaaaccccatctctactaaaaatccaaaaaaattagccagacgtgctcgcttgaacccaggaggcagagcttgcagtgagctgagatcatgccactgcacagcctgggcaacaaagacagagcaagactctgtctcaaaaaaaaagaaaagaaaagaaaccaataccccaaaatatggccctctgacatgctgaactcaagaagccgcaaggtctctctgatccttccaccccagactctcccaaagccaggataaagttgttctctggaactctttatctgcctaaagtccaaactcactaaaaagaatacttgttttttcttcccctcccaataagactaacatgtaaccacacctgaacaaaccctttcacaggtattgtgtacctcaggatcactcaaattccaaagagaactattaacaagtcaacctctgtccccattccattctctctagtaatcctttattgcccttcaacagaatctccttctggccaaagttcggtttatttaaaaacaaatagagctggacatgctggctcaggcctgtaatcccagcactttgggaggccaaggcaggaggattacttgagcccaggagttcgagattaggcttgcaacatagcaagaccccgtctctacaaaaacagaaaaacagaatttctcttctaccccttgtcaggcctctgagcccaagctaagccatcatatcctcagtaacctgcacttatacatccagatggcctgaagcaactgaagatctacaaaagaagtgaaaatagccttaactgatcacattccaccactgtgatttgtttctgccccacgctaactgatcaatgtacttggtaatctcccccccacccttaagaaggttctttataatctccccacccttgagaatgtactttgtgagatccaccccctgcccccaaaacattgctcttaactccaatgcctatcccaaaacctataagaactaatgataattccaccaccctttgctgactcctttttttcagactcagcctgtctgcacccaggtgaaataaacagccttgttgctcagacaaagcctgtttggtggtctcttcacatggacacacgtgagacacccctcccataatctgttttgccagatggtatataaactcacgaactctgtagggagatgggtaatcactttatggttctcccaatgtgcatgttaataaatttgtatgccttttctccagttaacctgccttttgtgagctgatttttcagcagatcttcagagggcaaagggaaagattttccccttggctcgtaacacaatcaaatcccaccctccttcccttcatagccaaacttccttcaccaaacctgcttacttccacattcattctacaatctattctccaaagagcaaaggaatcttttccagatcacgtcacttccttccttataaccttcaatggtttcccattcttttttttttttttgggatggggtctcactctgtcacccaggctggagtgcagtggtgtgatcttggctcactgcaacctctgcttcctcggctcaagcaatcctcccaccccaataccccaccccaactccaagcagctgggaccacaggcgcacaccaccaccacatccagctaatttttgtatttttgttagagacagggtttcaccatgttgcccaggctagtctccacctccagagctcaagcaatcaacccgcctcggcctcccaaagtgctgggatacaggcatgagccacggcgcctggtgacaccccattatattcttttattttctttcttttctctttttttctccctccctctttccttccttccttttttcctttttctttcttttttaaatactgtaggcctttactatgggtcattaaattcttgagcaagctggttgtggtggctcaacactgtaatcctgctactctggaggctgaagtgaagaacagcttgagcccagaaggtcgaggctgcagtgagctatgattgtgccactgcactccaccctgggctcagcaagaccttgtctcttaaagaaaaaaaaagattgagcaaatatttatagagccccctaatatgtgccaagcagttttaggcacttggcatacttcagtaaataaaacatcaaaagttcctgccctcagggagcttatattctaatggggacagaaaaggaataatgaacataagtaaattccataagatgttaggtgataaatattagcataaaaagcaaaaattagaccaagaggggaaaaaaaagagtgccaaggtggggtttaatgttgcaattttaaagactgtggtcaaggtagacccaaagcattctaagtgagtgcaaaggccccaaggagggtgcctggtatgtctgtggtacagtaagtaggtcaatgtggttagaatggaatgagatgggactgagtggtagaagaggtcagagaagtaaaccagatgaggtggggagaggagggtcacaaagtaccttataggccattggagggatttggctgccacacccttgctcttagaaggcagtcctcttactacagccttgcaggtccagtgatccgggcaccatccgcctcatcccctcactatgctctagccaaggttgactgaatttagttgcttaaacacctcaagtgtgtctgcccaccttggggcctcacacaatccatttcctctgtttggactcttttatgcttttacctaacaccttatcatttttcaagtcttgactgaaatgtccaaatcaggtcccctcatcttatcctatcacatatttctgccttgtagctcttacctaatgtaattttacattactttgattctttccatcagtgtgtacttcctgaatttgactgtaaaaaacgacttgagtgcaaggactgattctcttgttgattggtgtgtgtccaaagtcagtgccaggtaaactgtacacaatagatacctgttaaatgaattaatgggatgggggatagtcaaaagagtttcccttttttaggataggagaaatccaaagagtttttttatttttgttttttttttgtttgtttgttttgtttttagagacagtgtgtccctcactttgctgctctgccactcaggctggagtgcaataagaacatggctcactgcagcctcgacctcctgggctcaagccatcctctcacctcagcctcctgtagctgggactacaggtgcgcaccaccatgcccaactaatttttaattttctttttgtagagacaaggtttcactatgttgcccaggctagtcttgaactcctagggtcaagcgatcctcccaccttggcctcctaagatgattacaggccataagccactgcgcccggcccaagcagttctgaataatgatgaaatgggctcagttgagagaagctgaagattaactataaacaatgagtaacaaaggagcactggaaggcagaggtggatgggaatcgtagtgtttacggagggactagtctccaataggaattttttttttttttttttttttgagacggagtttcgctcttgttgcctaggctgaagtgcaaaatggcgtgatctcggctcaccgcaacctctgcctcccaggttcaagcgattctcctgcctcagcctcccaagtagtgggattacaggcgcccgcaccatacccagctaattttttttgtacttttagtagagacggggtttcaccatgttggccaggctggttttgaactccggacctcaggtaatccgcccgcctcggcctcccaaagtgctgggattacaggcgtgagccaccgcgcccggcctaggaacctctttcaaattcaatcaccctctaggtcgactataccgcctagctgcttcacaatttgtcccttcctcgccatccatactgccagccttaattcaagttcacattatcacttgattggattattacaaaagcttccctaccaatcggtcgctcttacaccctgggcagcctcctccgatggcccactccccgcctctttcactttctggagatcactgagctctccatcctctctgggaatttaccgatgcccagaacgcccttctttcccccacacgaccctctcctagtctaactcctgggcgtgctttaagctcagctcaggcagcgtcaccttctctggaaagcccaaacccagccaccccactacccgctacccgcggcccacgctgatgaagacagcagaacacggaggccccgcgttcccgccgcgagagcaggagagaaagattacctcccgcgagctctagcgcgcccggctttccggcgcactccagggggcgtggctcgggtccacccgggctgcgagccggcagcacaggccaataggcaattagcgcgcgccaggctgccttccccgcgccggacccgggacgtctgaacggaagttcgacccatcggcgacccgacggcgagaccccgccccatccccgactgcctgaaccgcgccaggagacggaccgcaagtccagcgtacccacagacgactcaggcgggagacgagcggtgtcatggccgccgacagtgacgatggcgcagtttcagctcccgcagcttccgacggtgagcggcttcccagaggtagccttcaaagcctctgcgctctgggagaggggaaggcctcgggctcatagttctagaggctcctcaagcttcagaggactgctccttccgcctgaactagccacgaggagactacaagttccgttgtacaccgcggctccggctgcaaaagcctggagcgttgggagcatggggctgatggaggcatggcgggagatgtagtctggagctcataacggttagtagtaatagttgtgattcagttcagtggagtggattgagcgttgtgatccaaaggaaggtaggacgtattgggagctctggtgtggggcactgccaggctctggggcttactgggagctgttgcttgtggcgctggggcaccatgagaacagtagtatggatccctgtgggatattaagggagctgagatcctcaagccctacaaaatgtttcctgcaggacatgggaaaaaagaatcaaaggtcgtctagtccaactttctcctctacagattgtgaaagcgaggtgggaagtaatttacccaggctcatacaagccagtagaagactcaggcttcctctccccaaattcagggcattctccactccaaggcctgtg

SEQ ID NO: 8 - DNA, 8924 bp, Homo Sapiens
ggtcagaggccacgcccccggaagcggcggtgcaggtacgaaaagcgcgcgcggggattccaggagtcgtggtgaccagggaggggagccgggccagcgggcggcaggagactaggggagctgagccatgggcttgggggagagcggggccgggagctcgaaggagaccagaagagcagggtcgggggctcgagggagacgaggagagcggggccgggggtttgggagagagacaaggagagcggggcggaggcttgggggagaccaggagtaaatcacaaaaatttactttggaaaccgtggcttctggcagaaacagatcagtgtcgggacaaagtacacgggcctggtgtgaaactaagccacaaacccatttaccctgtctgacctgcctccgccaccaggacccagtctcagtgaaatgggaaaggttcccttgtcctcctcgaagggcgtgcgatgaggatgtggctcacttcttcagtgccccgcttctcaagcctctaggggaacatacagacaggcaggctgaggggctcccaccccacggcagtgtctaggggtgaatgtttgcagctcctgaagccccagcaggcatgtgttagagggtgctctttcagtttagccttgtaggtggcttgtgttagtcagctgttagactccctgccttatcgcaaggacagagggctttctgtatccctaggtttcttgccttgatgtactggagcaatcagatcacacggcggcttggagagtgagtgcaaggttttatgagtggaattagccctcagcagatgggggagccagaaggcagttggagtgggaaggtgattttcccctggagtcgggctgctgagcagcctgggctctcctctgaccgcccctgccaaactcatggttccatcagttgatggcctgctggtgcctgttggtgtgctttccacgtcctcttgacgtccagcggcttgtgtctctgcccactataaaaaaccactggggtttttttataggcacaggacggggacgtggcgggctcgggaaatgcaacatttgggcaaaaaaacagaaatgcctgtcctcacccaggtccctgggcacaggcctgggtgtggagccctggccagagaccacgccctcctctacccagcacttccctgcccccttccttatcatctggtcccttttctcagacaccacaacttccaagaaggatcactggtcctgaaccctgtgtcttgtccaggtgtggaccccagaaaagttggtcctggctgggcgcagtggctcacgcctgtaatctcagcactttgggaggctgaggtgggtggatcgcttgagctcaggagttcgtgaccagcctgggcaacgtgacaaaaccccatctctactaaaaatacagaaattagctgggtgtggcggctcatgcctgtggtcccagctatgtgggatgctgaggcaggaggatggcttcagccagggaggcggaggttacagtgaaccgcgatcacgccactctcctccagcctgggcaacagagcaggatcttgtctcaaaataaataaaggaaagttggtcctggccctccagcatttctccagggtccttttttcagcagggacctggcggaggcatcgccctcagagtcctctggacctggacctgcacacctatgggagcaggaaggacccttgtgacttccagtggcccccctgggtgccaggtcccacagtagccacagcaggagcagagtgggtggggtataaactcctatcacaggagggaggactagccgggcctggctgggtggacctgtgtctacagccacacatttcctgggaatctggaagcctgctacagagaggccaggtcccactagactgaaagaagttcctgttaatccaaaggcctgacctgaggaccacaggataaactgcgtggttattttggtgccaatcaggcacggggactgttgttcctcactgtgtgcctataagcagggggttcctgggggtagacgcaggagcaagagcacgctctggaaaggtgatgttgtcctctgcacctgagtactgacttgtggagaaggaaggtagcgccggcctctgctctgcttgatcagccctgctgaccactgggttctgtttctaccccagaaaatcactggttcaatggcagttttccacctgccacaagggaagccacacgtggcagggctggggagttacagcatacccccccgccccccactgcctcccagagcacgtccccttcctcctggcccctggcacgtgcttcctccacgcacgtcatggctgactctgccctctcaccttcctttcagaacccagggaccatgggcgcctccaggctctataccctggtgctggtcctgcagcctcagcgagttctcctgggcatgaaaaagcgaggcttcggggccggccggtggaatggctttgggggcaaagtgcaagaaggagagaccatcgaggatggggctaggaggtaaggatggggcaggtctggccatagaaccggctttcccagggcacagggattcgggctgtagggccacacccttggtttcaccactaagagctaagtgacctggagcagggggttaagcgtgagcctcagtgtcttcatctcagaatgaagaacagtccgcagcccttcggactcttgtgaagataaaatgaggaaatgaactcgaaggacttagaacggtgcgcggtgtgcggtgcgtgctgagtgcgtgttagctgttgtggtgcggtggtgctgggggctgcagggcgtatctggaagcctctgtgcagcagcttgaattgaaccctcccagcaccctcactgttgccgaagggctcgtcagtcacttggttcctctgtctgttcagtggagctgatgatcgctttcatctcacactcgctgtgcacaaagcctcactgcatcctcaacacagccagcttcacctaggaaggaactgaagcccagagaggttgagccgtttacccaagatcacacagtcctccagacgcccctcaaccctcacagggtaaatgagatcatctgtgtaaacatcgctgcacagacgttagcccccgttcgtgtttttgttctgagaaaggtaggccagcttgcctggagaggagaactacagagtaaagagggtcctggcacggaggaaagccaggacgctgcagcctagtggctttccaattttttcatcacaacctgcagtaagaaatacgttttgtactctgatagagtgtacacactcaggtgtgcaggtacagctaaagtaagttgcagtagccgcccttattacataaaagggggctctacttttccgattcatttctctttttttctccagaggtgggatctcacccatggcacactcttggctcactgcagcctcaaactcttgggctcaaacgatcctcctgcctcagcctcacgaacagctgggaccacaggcacatgccaccacgctcagttcgttttttaattctttgtagagatggtgtctcattaactcccaggctcaagcgatcctccctcccgggcctcccagagtgctgagattgcaggtgtgggccactggcttgacccttttttttttttcaattgcaatccactaagccgatttcccggggtacatgggtcccaaccctcagtttggagagccctgtgtgtgcttcccctccaaggcttgggaccccagaccgcagccacacggacacgttcgatcagtcactgtggcaggtgccagtgcgacaggctctgtgctgggggccgcagctggggaggaggaccactgggtgtgagtcgggcatacagcgtgtccctgccaggagtgtgtgcagagcgaccacagcacaggaaacaggaaaggtggccccgggggttctctgcccagccctttgtctttgatctgctaagactgcccatcagctcatggatttctgtagcgctgctctgtgtggggcctggggacatgaggaggaacaggtcagtccctgcctctgtggagctctcgtgtcatctggctgccgggttcaggagacctgcagaaggaggtctggtccatacctcgtggccaggggcctccaggagaaaggaagggagaataactgggcaccaggaaaatgctctgagggcctgacgttggctgggagagtgtggaaggagggaggaaggagacatttgcagaagcacagagggctggaggagcgccagctgtgcagagaagtggtgggtgtgagtggagcaggcagcggtgctgaggaggctggatggaggaactccaggtggctggatttccgcttctcgtcctgctggtgacaagcaaagcacaggccccctcggcagccctgctttattttcttctgaactttgtcacggtcgaaggaactttcctcctaccctctgtaaatattacacaaacagagggaccatcactccagaccctcaaagctgaatacagtggtggcttgctgtcagaccagggtttgagggggggaactgaggcacagagccggaagcctgtgacttccatcctcgggtgtaacctggagacgggggtttcaccatgttggccaggctggtcttgaacacctgacctcacgggatccacccgcctcggcttcccaaagtgctgtgattacaggcgtgagccaccgtgcccagccgagaccctgtcttaaagaaagaaagaaaaaaatccttcgttggggagcatctgcaagcatgaggaatgggggacactggagccagacaggctggtgcttaggggtcccagggccccgggaacccagcagcaaacagcctcgccctcaggggatgacgtaccatcagccacaggccaccagcacggccctgggcttcagtacctgcgagtctgaatggatttgctcctggggcaaccccaggcccgtgctgctcaggagcgggaggcagggaggagcgtcggcagcccggtctctggggaggctggttcctgctttatccacgcaatacccagtcctattctatcaggaggaccccaagatgggccctaactcccaggccaagagccggtttaggcaccctccccgcttgcctgcagggggcaggcctgagcgcctaaccccagtccagagggctggactcagaccctcctctgtggggcaggggacaggcacgtagggagtactgaattgtgggggtgtgcagatttgggcttcaggcgcacagtgtgagccgacctttctagacagcatccctggtccccaaagactagcgaggccggggacacaggagcagcgatgggaagcaggcccgccggaacctccgactcccacctccccacgccacggacgctgcaccaccctgtgtttttgtttcatgtatttctcaccctgttccccgtgttccgcctggggaaccgagtgccatggacagagcagacacttgggcagaactgaacagcgtcatcttcgcctgcctggcgctccctgcctgggaaatggagcttcagctctgtctcccggcggattcttgatgcttcctacgctgccatgtgctagggaagattaactaaaatcagtcacaatatcccactgggaggtgacgctttttaagacgagcaacagccggccgccaagaggcgggtgaggccccactgagcacttctattgcatctaactggggagccatttatacccaagtagaagcacacgttcactttgtagctcaagcccaactttaattagccatctgtatgaataaatgctgattccaggtccgtttcctctccagtccctgcagtttaagctgaggaggcatcgcttaaatcagaccatttagaccaggcatggtggctcacacctgaaatcccagcactttgggaggccaaagcagaaggatcgcttgagcccaggagttcaggaccagcctgggcaacatagcaagaccctgtctctacagaaaaacacacacacagaaaaattagccgggcatggtaagaggaggagactgaggtgcccagcggctgcagcccgtgcatccccagggtcccagcacagagtgggtgttcagaagtgtctgctgagggactgagcaagaacccgactgagcacagcaagcaaacgctcagaacgggaggtcagcagcaccgctgtgcccaacacgggtttccaccataacccgaagttggaacgttttattcttccataccaaacaggagttgagaaggcggctgggttccttgaggtgtggaatgtcatgcactcctcctttcttgcgtggaaagcccgaggtataaagtgtgtatgatgtttgcttttttttttttttttttttttaagacagggtctagctcggttgcccaggctggagtgcagtggagtaatcccagctcactgcagcctccaactcctgggctcaagcattcctcccatctcagtctcctgaggagctgggactacaggcgagtgccaccatgcccagctaatttctgtcctttttgtagaaacagggttttgccatattgcccaagctggtctcaaactccggagctcaagcaatcaatcctcccaccttggcctccaaaaatgctgggattacaggcatgagccaccctgcacccaacctgtttgcatttttattttttaactttaagctattaagggttaatgtttgcatttcttaagggaaaaacagaggagaaagagccaaaggaaaaacactgaaatggtagcattcctgggtgatgagtttatggcgttttgtttcctggttgtctataacaaatatgtaatttttaaattagcaacagcgttagactacttcggggaaacctggctctgtgtgccacgaagcagggaagggcttgttcccaggcgcagcagcacttgggcatcccgtggtgaagtcagccccttacacctcctccaggcacagctgtggggagcatgtcccgagaaggcgcaggaagaggcccaggccacgtgtcccgtgtggtcagcctggggaccagagttaaaaccagagctcctccttcaggaaacagatcatagaagcctgtggtttcatcctgtgttctcagagaagaggcaccaggctggaaagacatttctttgggcagacaggcccagagtatagggcccaggttcccagagcaagcgtcccagggccccggcggtcgtaactaccgctgcatgggctctgatgctcagccgcggaaaagcaagtaaccgggaatgaaggaagtggggtcagtcccaaccctgccacgtgcgggtctcgagacggtggacaagtggctggactccactgggcctgggctgtcactggtacacagagggcactgggctagaactgcgttcctcccaccagaggctccacaccatctccgggcccctccccagagcctctcaaccaaaatcagtgtcttcaaagttcaagttgattctgaagctcagccaggtcgggaccagataatgcattctaggggacatcctcctgggtctcccatccaccctggtggctccctgggctgtgtgtagatgcccagctcctcctccctgccatcgtgtgggcatggcaccatgccctgacggcctccctcccctgcccacctctgcccgcagggagctgcaggaggagagcggtctgacagtggacgccctgcacaaggtgggccagatcgtgtttgagttcgtgggcgagcctgagctcatggacgtgcatgtcttctgcacagacagcatccaggggacccccgtggagagcgacggtgagtctcacagggcctgctccccctccccactatgcgggtcccatctcctggctgggagaaaggccatccgcccaaaccatctctgagtgccagggaccgggcagcctgcgtccccctccaccccacagtgccagcgtggggcccatgagccgtggtctctgcaccgaggctccagtagcgtacctgcccctgctctgcgcccaccctaaaatgagaaacacggtaatgaggatgaaatataaacgatcgtcaggttcctcacgatcactcagtgaactcctcagagagtcagtgtacgtttgggctggccagacgcagtggctcacccctgtaatcccagcactgtggactgtgggaggccgaggcaggaggatcgttgagcccaggagttcaagaccagtctgggcaacacagtgagaccccatctctacaaaaaaacatggttttgttgttgttgctgttgttgttttgagacgaagtctcgctctgtcgcccaggctggagggcaatggcgcaatctcggctcactgcaagctccacctcccaggttcacaccattctcctgcctcagcctcccaagtagctgggactacaggcgcccgccaccacgcccggctaatttttttgtatttttagtagagacggggtttcaccgtgttagccaggatggtctcgatctcctgacctcgtgatcctcccgcctcggcctcccaaagtgctgggattacaggcgtgagccaccgcgcccggccaaaaaaaacatgttttttaagcatgaagtttgggttgcacctcagtgcctcctcttcccccattggtacagaaatgcgcccatgctggttccagctggatcagatccccttcaaggacatgtggcccgacgacagctactggtttccactcctgcttcagaagaagaaattccacgggtacttcaagttccagggtcaggacaccatcctggactacacactccgcgaggtggacacggtctagcgggagcccagggcagcccctgggcaggagacgtggctgctgaacagccgcaaaccatcttcacctgggggcattgagtggcgcagagccgggtttcatctggaattaactggatggaagggaaaataaagctatctagcggtg

SEQ ID NO: 9 - DNA, 9320 bp, Homo Sapiens
tcagagttcccgggtcccttccgcctgggttcacgttcacgtttattcaaacaacagagccgactcgggcgaggtctgggagcggcgggcgggcggtgtcgcctcctgggctctgctgacccctggtggtggggtcggcccaggctgggacctagcccggcccccctcggccgctgctgaccgccatcccccacaccgccttctggagcccgcagagggaggcaggggcgtccccggggacagctcaggcggccacagttgggggcggggagcatcagcctgtgcggagctgggagcctgggaagcaggaggccagagggtggccccttcggttaagtgtctggggagcggcccgggagcccagaggggtcgtcgggggaagcgcggggcacgtgctcgcaggtgatgaggtgggtgggcagcgcctgggtgtcgtggaagatgacgaagatgctgggctggcagatgcagtccacggcgctgtcgtagcgcaggagcacgtggccaggaccccgcagagggggcgcccgcagaccgcggcggccctgcccgtagtcgccagtcagcacccgtgccacgaacaccgccttatggccatcggcgttggggggcgagtagcggtcctgcaccgacagggaggcgcgcctggcgaaatacacgcccttcccgtagaccgtggctgcagggcgagacggggcaaggtcagggtggtcggggtgcgcagagcccccgcccctgcccggctcaggcctcaccgttgcggccgcagaagctgcggttgaagccgtgggcgcagatgtcaggcactgccggtgccgtcgtgccgtggtacagcacctgctccaccgggcgccgctcgcatcgctgcagcaggcgctcccggtacagctcatactgctgctgcagcagcgggtgcgacacgcgctccacctgcggggaaggcccgggccaggattaaacaccctccctacgccctggggccgacgcagggcagagctgagcctggcaaccaggagccctctgttggaggagtccagggtttgagggagcccttgcagcccccatcatgctctgtccagcagcagacagtaacacctccgtgaagcaagtgacttcagagggccgctggggaggcctgacccctccccctcccgtggaggtctgcgggcgggcaaaccccacccactcaagcgaggcctctgcagagaaaagctgagccagggccctatgctgcctacaggacttgactccaacacgaggagatgccacagacctctcagtgctgaaagacccaggtgggagagaaggcctcaggtgaccaacctgacagccctgggaaacacttttaaagaaattttaaatagtttcttcagagagttgcaaaagaacaccatgtctattaaacaaaactagctgctatgaaaaggaactagtctgaaaaccagagtgctcctgcattcagaaagggacgctgagctaaatctagagggggtgagccaaatgaggaagtggttcaaactgaagacccagctagcgttctagatggagttcaggaactgatgcagagtgagaagctaacggaagagaaaggaactccgagggagcaggtgagggggcctgaggtctgagccggcatagcaggagctccaccggccggagctccagcacacacagggaagacgcttccctgagctgaaggaacatcttcagatacacaagatccgtgaaatgccaagaaggacaatgaggaaagacaacgcccctggcacccacgtgccaggaaacctcaaccttcagagtgaaagaaaaccctgcaagtttttttttttttttttctttgagagggagtctggctgtgtcgcccaggctggagtgcagtggcacgatctcggctcactgcaagctccgcctcccgggttcacgccattctcctgcctcagcctcccgaatagctgggactacaggcacctgccaccgcgcccggctatcttttttgtatttttagtagagaaggggtttcactgtgttagccaggatggtctcgatctcctgacctcgtgatccgcccgcctcagcctcccaaagtgctgggattacaggcgtgagccaccgcagctggccaaccctgcaagtttacacacacacacaacaaggtcaatatgcaaaccggaagaagtctcaccttctcacattgggtctctcattaccgacaccagatgctaagaaaccatggggggatattttttaactttccaagaaaaatattcttttaagaatgaagaaaaacagcaatgtcttcaaatatctgaggaaaaacatattttgaacctgaacactatatccagccaaactagtaatgaagaatgaggacaaataagggcatattaggacacacgagaacatggaagttcataccaacatcaaattacagttgcaaaatacctctaattgtaaagggcaatataaatttaaaagtcggccgggtgcagtggctcacgcctgtaatcctggcactttgggaggccaaggtgggtggatcacttgaggtcaggagttcgagaccagcctgaccaacatggcaaaaccccgtctcgctgggcatggtggctcacgcctgtaatcccagcactttgggaggccgaggtgggcggatcacgaggtcgggagatcgagaccatggtgaaaccccgtctctattaaaaatacaaaatttagccgggcgcggtggcgggcgcctgtagtcacagctactcaggaggctgaggcaggagaatggcgtgaacgcaggaggcggagcttgcagtgagccgacatcgtgccactgcactccagcctgagtgacagagcgagactccgtctcaaaaaaaaaaaaaaaaaaaacccgtctcagccgggcgcggtggctcacgcctgtaatcccagcactttgggaggccgaggtgggcagatcatgaggtcaggagattgagaccatcctggctaacatggtgaaaccccgtctctaataaaaatacaaaaataagctgggcgtggtggcaggcgcctgtagtcccagctactcaggaggctgaggcaggagaatggcgtgaacccgggaggcagagcttgcagtgagctgagattgcaccactgcactccagcctgggctactgagtgagattccgtctcaaaaaaaaaaaaaaaaaaaaaaaaaaaaaaaaccatctctactaaaaatacaaaaagtagctgggtgtggtggtgtgtgcctgtaatcccagctacttgggaggctgaggcagaatcacttgaacccaagaggtggaggttgcagtgagccgagatcatgccactgcactctagcctgggcaacagagagagacactgtctcaaaaaaattatatatataaatgtatatattaatatataaatgtatatgtttaaacatatatgttcacatatacgtaaatttaaaagtcaaatatgtttagcacccactcaaggagatactcccactaaacaaaagagtctgtgccaaaaggtgacaagcggggtactgagtaacccggtggtcaagaatggcctggaaaaaatgaagaaagtcaaaaaaagaaaagccattagccttgaatcctagaacatcttttttacagaacagaattttaataactaggatttcacttctctttctatggctcagtggtaaatgttttttcattattatagtatgtctaccaacctatggcccacgcatggaggctttgtgatagttacagaaacctttacgacataataaaaataatgtaactgaccaaattgagatggaagatgagggaggaggcaaaagagagagaagcgaggcccattctcctcatcttccatgcgggaaggcaagaaacaatctctaaagctgtcaagtgaaaaaaaaaaattcaagcataccatttaaagtcatcaaggtgctcactaaattcaagcataccatttaaagtcatcaaggtgctcaccggaagaaccaagtacgtataattaacaaaaccaccaggatatgaggtcagtgcgtctgggtggtggtgatcctggtggcggtgagcggtgacggtgtgttggtgaagctgacggtgacagtggtgatgctaatggtggtgatgatggtggccacggtggtggtggtagtggtggtggtgatggtggtgacgacagtgagtggtgaaggtgatggtgatgatggtggtgacgacagtgagtggtgaaggtgatggtgatgatggtggtgacgacagtgagtggtgaaggtggtggtgatgatggtggtgacgacagtgagtggtgaaggtggtggtgatgatggtggtgacgacagtgagtggtgaaggtggtggtgatggtggtgacgacagtgagtggtgaaggtgatggtgatgatggtggtgacgacagtgagtggtgaaggtggtggtgatgatggtggtgacgacagtgagtggtgaaggtgatggtgatgatggtggtgacgacagtgagtggtgaaggtggtggtgatgatggtggtgacgacagtgagtggtgaaggtggtggtgatgatggtggtgacgacagtgagtggtgaaggtgatggtgatgatggtggtgacgacagtgagtggtgaaggtggtggtgatgatggtggtgacgacagtgagtggtgaaggtggtggtgatgatggtggtgacgacagtgagtggtgaaggtggtggtgatgatggtggtgacgacagtgagtggtgaaggtggtggtgatgatggtgatggtgatggtggtggtgatgacagtgagtggtgagggtcatggtgatggtgtgatggtggtggtgatggtgatggggtgatggtgatgatggtggtgatgatggtggtgagggtcatggtgatggtgtgatggtggtgatgatggtggtgaggtctggggacagccagaggttctttttgcatttctgaccagctcctggtggagggtgatgctgctggccccacgcacaactttgggcatcaagagttgagagtgccccgtgcaaggccgggcgcggtggctcacgcctgtaatcccagcactttgggaggccgaggcgggcggatcacgaggtcagtagatcgagaccatcctggctaacatggtgaaaccccgtctccactaaaaatattttttaaaaaattagccgggcgtggtggcaggcgcctgtagtcccagctacttgggaggctgaggcaggagaatggcgtgaacccgggaggcggagcttgccgtgagccgagatcgtgccactgcactccagcccaggagacacagcgagatgccgtctcaaaaaagagagtgccccgcgcagtgtcatcagcacagtgaccgcagcgagcccgggcctttctgtggaggcagaagagcgcccagaacagcacaagggacgcatctgtggagcgagtaatcctcaaaatgaccacaagatggcatcaccgccccatgctccaaataaggaaactgaggcctggagctggtcccatagtccctgctgacccagccacgagtggcagagtggggaccctcactcaggcctatcagatcccaaggcccccactctgttccctcctgtttccctacccactttgggaacgccctctgggcagagaacagggctgggagcctgtcagctcctggtcagctgaccttgatgtaggcgagagggacaggccacagacttggcaaggcgctaatggtgcaagagcccaggacgccatgaggccagagagacagggcatggactcacacgaacgacgcggatgctgctgcgggcagcgtccagggtgtcgtagaaggcccgcaccacctcctggaactccccggtgttctctgccagacgctccaggttgttccagggccccttcagcgtctgccccgccactgatgcatggggaaaagcggggggtcagagccatgcctggggcactagcccctgctaaccagcccaccccaccgtccctcagtccaggaggtagactcacaggtagggcctgaagctgccaagggaaaggccaaactctgatcccaggggccagccagaagtgccaccaagtggcgggcagcacgggcagggtgggccccgaagccacggaggatggtgcagtcaccacgcagggcaacactcacaccatggcaccgctccaggcgagcacgcagctctgcaggcagtgtgcggcgccagggccccaccgtctcctcctggacgtggacctccaaggcagccctgagcgcccggtccagctcctccacatcctgctcaaaggccgagtgcaccaccagctgggccttgccatcagtccccccatctgggggctcttctgcctccaacgggggctgctccagcagggagagggttagggcttgccgcagggcagcagcctcctcctgctcagccacctgaccttgaggctccagtgaccggtggagggccagctgcagagcggcctcctcctccagccacctgggtgccacagtgctgggggccacaggctcctcctcctcatgccctggggtcacctcctcctctggctgctcctgaggcccttcctcctccagctcccgaggcagccagtcctccccgtctaggtctaggccctccagggtggccagcagttctcggacctcctctgggggcagggagaggccattgggtcaggggctggacccaggaggagttggaatggatgaaagatggggagcaagtttttagggtacagggtgggcctaagatgggtcagtagacagatgggagcacagagcagggcagggggtgaggtcaagtgagggccacaggatgtgctgagggctcccagggagccctacccaggctcacgtcctcctggtcaccacctgtactgtctggggtccacagggtgtgggcgttgccagggagcactgggagggcctcggtagggtccacctgtagggagaggatgtcaggaccactagcctctgggcaagggcagaggaggcctggggcagaggcgtgagaaaggggagggcaggggtgggactccatctctacctcttcaaggcctgtgtccaacgtggctgtggccaggcgctctgtcccaaagacacactggaactgagcctccagcccctggagaaggtgctgcccttctgggcccaggagaaacctggcgctgcccgggtgctccaggcacaacacatggcagctaatgctgcccagcaggctccgcagaaactcctcagccgcctggcaggaagcctgggctccacagagctgcagggccattgcagagatggagtttgcaggtttagagcacaggaaaggtactttgagtccccagtaggaggagggggctgaaggtgaggagtcctgaggggtcactcacccgaaagccagtcatatccggtccttcaagtggcaagagagcgacgtctcccaggcccgcaagaaggtcctcatggtagagctgcaggaagcgcatcgcccctggctccatcaatagcaccatctccaccaggccctcctgccctgccagcttcacacatcctgggctcacaggccctgccttctccagagaccccatggtgatctccatgggacccaccagcccctcttgctctggtgagtccatggcaatttccaccaggccctcctgccccagcaaccccttagaggtctccactgggcctgcagaccccacaggccccaggctcatgggcccctcctgttcctgcaaccccacaggcctcaggcttaccagcccctcatgttccagagaccccatgggcatcgagctgacttgctctgcctgtcccagagaccccatgggacctgtcctcagagaggtccctgactgccctggttcctggccagagcctgttgtcataatccctctaccctgcaccatgggacctgtcctcagagaggcccctgactgccctggttcctcgccagagcccattgtcacagtccctgcaccctgcagagccgtcaccaaccctccggtcctcaggagagcatgcttggtagccctaggcccctgggtggacgggtggtcccctccactggtgttctcagccagctcctcgggctccaggatgtcgtagtgggggacaaggctcagctctgagccctgcaaccggtgctcctgctgcaacactcgttctgccacttggaggaagggaaaggacagaaagcctgtcagatttctgcaggagagggacggtcggctgggtctgcccagccccactcaccttgccactgctggaaggaggcaacagtgcccaggggcccgggtaggcgttgcaggtcctccaggggccccccaccactgcggcgctcattctccaggtacaactccagcaacagcaggtccacagaggcaccatcccccaccacacgcaccgctcgggcctggggaacccgggccagggacaccaaggtcccctccaggcccagattctgggcctgctcctccaggacacggacatctgtggggtatgtgcaggtcagctcagggaatcccccctagccagcacctcaaccccaaccctgcctctcacctgcctcagaaaggggcttgggcaactggaccagagcccggtctggccgggggctggccaaggcacagcaaggctgtactgggagccccgaggcccgcagcaaggcctggacatgctgctccaagcgctggggcgtggtgccagggggcagtccttggagcagcaggcgtgcaggggctcgtggtggagctggccgcaggctcagctgggcaccatgtagttcgtgatctgcctgggccaagaccctctcggcgtctgtgggcaggggcggggcaggatgtcaggcattagaatatcagggcacccaggctgtcccttcagccagccctctcacctgcaggctctctgaaggtgaggacgcccccacagcccagtctctgccagctcaacacaggtccccctccagagcgtcggcggttttcaaagtagagagtgagcagctcgtcgggcacggcagggggcagtccacggacctccactgccacccctgcctctgcctccgccattgcaaccctgggacggggcatcaggtgggtagggaaacagcccattccacccctcctgcccctccccaggcccctccaaggtgtgtcctcaatgctcccccattatgggtggccccacatacagcacttacattccccgtggccgctaggcagcctcaggccatgagctcagccaggactcctgtgcctgcccctcagcaagcctaaccctgctgggagcaggaaaacaaaagtgaaactgaaag

SEQ ID NO: 10 - DNA, 16043 bp, Homo Sapiens
tttcatctgcagatttgtttttatttctgctgtgcaattaaaaaaaaaaaaaaagggtaagagctgtgaaaggaaaggaagatgggcttcccggaagccagtgtcccagtgtgtgctccctccccttgaccttcccagtcccaggtgctcctggtgcagacagacacggggaggtggttatggttattgttttctttttttaatgaaactagatcactgcttacaaaaccctgcacaagccctcctgcccatccccttcacagttcccttggctcagcctctcctgtctcacaggaactgcaacaaaatgggtgtggaacagccaccaccacgtccattgaacgacaggaagggagaggccctgggctccgaccctgggccttaagagggtgacagttcttccttccacatccgttcccatggggcctggagttgcatggatgagggtggtccatgccaccatggttctcaggccaccactcagaccagagtgaaatgatgtgaatgtcccaccccacagagccccctccccccatagattccccccacccccccccccaaaccctaattctacccctctactgagatgaggcccagcttccatcagaagggccagggcctacaggctgtagaacttgaggcttctgtccatgcctgttgaagcgatgaacttggcgtgatgcccgaaggccacccctgtggtcaggccgctatgctctgaggagaaagataagaggcaactgtgagaaggcttttcctcctttagtctgaacactgatccctaataacagattcccaaacaaccaggccttctctaattagtatttatcacaccgcaggctcctgtttgttttccctaggctgacctgcacactacccccagtgcctccctcagtgcctggcatttttcactggtgggatgaatgaataaagcaatgccagcccccccttctcacctgagctttctgggcaactgcagttcggctaggtttagttgaaaaacctcagagctcagcttgtttatgcctagtgctcactacttgctcgtaagtggaacagtccatcagcattttctagctcatagtgttccaaccccagggcactcaggcccctaacacagagcaggaccagataagaggcagatgaggctgggcaacattcctcatgggactccagaaattcatgaacatctggccaaattccttctagatttaggatcacacctggagtcaaccaactccccattaaaaagctcacgctgtattttcagctacctaactcggttctaaatcaaaacaccaggtacagtacagggtgaaaaccggtgagccatattgttaggatggacacctttgttatacaaacacactgagcagggctcaggagaatacggggcaagaagaaatatcttgtatcctgctcacaacctgctaatgaggacgagaatttcatcaacacacacagcagtagctcccattcatgtagcatcttaagtgagcatcaggcaccctgttaccagcatattagcatgccatctccacaacaccagctgtcacaccctgcaaagctgtgccaatattcccattttctagatgaaggagttcaagatctgaaagggaaagtcacgtacccagggccacataactgttaggttagaaaccctgttacccattctctcagcatctcatgcttttcttctctagcacttataattgcaattaaatgtgtacatgtgaaattaatctacatctgccttactaacctgactataaattacatcagtgcccaaatcgggtctgttttattcactgctctatcccaccacagactaagacccaatgctgagtgagaacaactgcaaatcctgactacgtgccagacaccgttctgacctatgtattcacagacggtccccgatttaccatggttcaacttgcaatattttcagcttatgatgcacttatcaggatgtggctccatcgtatatcaaggagcacctgtatgtattttcatctaaacctcaacaaccccactgagtctatagttaccattcccacttttctgagaggttaagtaatattggatctcagaaaacaataccccaaagtatggtggtttggcacgctgagggctttgaaccaaggtctctctgaccatgtcctgccctcctgtctcttgcccctctttctctaagggcaggtcatctgaaaggaacatcatgaatccccttcctgggaatctcaaccagggaaaatgaactggtctcacaagagagaagactagatgccagtctttgtcacagactgtcatgcattatttatctaaggtctgctctgagacaacttttattacctgagagactctgtagtgcacttcctccccatccccccacataacttgtgtcaccaccaccccctagaagccttaggcccctactcccttctgcagttcaggatgccatagagtcatgtgtcacataatgacatgtcagcgacggaccacacaaacactggtcccataagattacagtggagctgaaaaattcctatcaccaagtgatgtcataaccatcatcatgtcacaatgcaatgcattattcacgtttgtggggatacaggtataaacaaatctactacactgccagttgtataaaagtataatatagctaggcgcggtggctcacgcctgtaatcccagcactttgggaggccgaggtgggcagatcacgaggtcaggagtttgagatcagcctggccaacatagtgaaacctcatctctactacaaatacaagtacaaaaaaaaaaaaattagccagatgtggtggcacacgcctgaagtcccagctactcgggaggctgaggcaggagaatcacttgaacccaggaggcggaggttgcagtgagccaagaccatgccattgcactccagcctgggtgacagagcaagactcaatctcaaaaaaaaaaaaagtataacataattaggtacagtacgttactggtttatgtacagacatatctcagggacatcgctggttcagctccaggctaccaataaagcaaatattgcaataaggcaaggcacacaaatttttttggtttctcactacatataaaagttatgttggccaggcatggtggttcatgcctgtaatcccagcactttgggaggccgaggcaggtggatcgcttgagttcaggaattcaagaccagcctggccaacatggggaaaccccgtctctactaaaaatacaaaaattagccgggtgtgatggtgcccacctgtgctagaacctgggaggtggaggttgcattgagccaagatcgtgccactgcactccagcctaggcgacagagcaagactccatctcaaaaaaaaatgttatgtttacactatactgtagtctattaagtgtgtaataacattatgtctagtaaacaatgtacataccttaatcaaaaatactttattgctaaaacatgctaacaaccatcagacacttcagtgagttgtcatctttttccaagacccaccagcagggtcttgccttgatgtcgatggctgctaactgacaagggtggtgtttgctgaaggctgaagtggctgtgacaatttcttaaaataagacaacaaagaagtttgccacatcatttgattcttcctttgacaaaagatttctctgtgatggatgctgtttgatagcattttacccacagtagaactttcagaactggaatcaatcctctcaaattctgcacctgctttatcaattaagtttatgtaatattctaaatccttcattatcatttcaacaatgttcacggcatcttcaccagtagaagattccatcaagaaaccactttctttggtcatccctaagagctcctcatccattaaagttttaacatgagattgcagcaattcagtcccatctttagactcccctttggattctaattctcttaccatttcctccacatctgcagttactccctccatggaagtcctcaatccctcaaagtcatccatgagggctgaagggttggaatcaatttcttccaaactcctctttatgttcatagtttaacctcctcccatgaatcacaaatgttcttaagggcgtgtagaatggtgaatcctttccaggttttcaatttactttgtccagatccatcaaaggaaccactatccagggcagctatagctttataaaatgtatttcttaagtaataagacttgaaagtcaaaattactccttgatccataagccgaagattggatgttgcaggcatgaaacatctccatctgagctttagggtaatgaggtgcactgtaatattttgaaaggaatctatttttctgaacagtacctcttaatggggggcttaaaaaatattcagtaaaccatgctgtaaacagatgtgttgtcatccagactttgttgttctatttacagagcacaggcagagtagatttagccccaccttcttaagggccctacaattttcagaatgctaaatgagctttggcttcaatgtaaaatcaccagctgcattagtccctaacaagggaatcactctgatctttgcatcttggaaaccaggcattgacttctctctagctgtgcaagttccagatgtcactttcttccaatagaaggctattccgtctacattgaaaatctgttgttgagtgtacccaccgtcaatgatcttagctaggtcttccggataacttgctgcagcttctacaacagcatctgctgcttcaccttgtacttttctgttatggagatggcttctttccttaaacctcatgaaccaacctctgctagcttcaaacttttcttttgtagcttcctcacctgtctcagccttcacagaattcaagagttaggatcttggtctggattatggtttggcttaaaagaatgttgtggctggtttgatattctatccagaccactgaaactttctccatatcagcaataaggatgttctgctttcttatcatttgtgcgttcactggagtagcacttttaatttccttcaagaattttcctttgctttcataacttgactaatatttggtgttgaggcctagcttttggcctatttggcttttcacatgccttcttcactaagctcaatcatttctagctttggattttaagtaacagacatgggacactttctttcacttggacaccgagaggccataatacggttattaactggcctagtttcaatattgttgtgtctaaggaaatagggaagtctgagagggagagagatggggaacggctggtgggtggagtggtcagaacacacacagcatttcatttatcaaataaattcagtaacttttatgggcacatttcatggtgcccccccgcccaacaattacaatagcaacatcaaagatcactaacggacacaataaatcatgaagaagtttgaaatactgtaagaattaccaaaatttgacacacagacacaaagtgaacacatgttgttggaaaaatggtactgacagacttgcttggggcaaggttgccaaaaaccttcaatttataaaaagcaaagtatccataaaatacaataaagctaagtgcaataagacaaggtatgcctatactatactttttttggtattaaatatactcttcccacttataaaaaaaagttaactgtaaaacagcaccaagcaggccctttcaggaggtatccgagaagaaggcattatcatcataggagatgacaggtttatgcatgttggtgcccccgaagaccttccggtgggaaaagatgtggaggtagaagacagtgatgttggtgctatggttaggctttgtgccgccacccaaatctcatcttgaattgtagtgcccataatccccacgtgttgtgggagggagccagtgggaagtaactgaatcatgggggtggttacccccatgctgttctcatgatagtgagttctcacgagatctgatggttttatgaggggctttagcccctttgctcagcatttgtctctcctgttgccatgtaaagaaagacatgtttgctttccctgctgctatgactgtaagtttcctgaggcctcccgagtcactgtgagtcaattaaacctctttcccttatcaattacccaggcagttcttcatagcagtgtgagaacggactaatacagttggtgatcctgatcctgtgtaggcctagggtaatgtgtgcttgtgtcttagtttttaacaagaaaagtttaaaaagtaaaaaataaaaataaaaaaattagaaaaaagcttatagaacaaggatgtaaagagagacaatatttttgtacagctgtacaatgtgttttagttttaagttaaatgttattacaaaagaatccatttttttaagtttataaagtaaaagtcagctaaggcttattactgaagaaaaagttttttatgaatttagtaaaacctaagtgtactgtgtttataaagtctacagcagcgtacagtaatgtcctaggccttcacattcactcacaactcactcactgaaagcaacttccagtcctgcaagctcctttcatggcaagcactataccagtgtaccattttaaaaaaatctcttataccttatttttactgaaccttttctatgtttacacttgtttagatacacaaatacttaccattgtgttataattgtattcactacatttaatatgctgtaccggtttgtagcctaggagcaataatagactatactaaggttatagcaatagtcttggcgtgtagtaggctacaccatttagatatatgtaagttcactctacaatggtcgcacatgacgatatcacctaacaagacatttctcagaacatatccccattattaagtgatatataaactgtataagcttcaatcatctgacccttctgcagatctaatataatgtgggcctcccgtgcatatgcacgtaattaaaatggctctcctcctgtcactgtctaatgttcatttattttagattcagttatcaaaacttcagagggacttttctctccctttagtaacctgcccaatgccacagggcatggaagtggcagaacaagcactagcatctactgccatgcagtctgactcagttgcttccttagtcataaagctctgcctcaggtggtaacagaaagctgcttaggtaaattcatgcaagccctagaaattcctaacccagtgaggcttccctccgggcctgggcacctagagagatcccaggagcccaggaccagcctctacctgtaaagtgaagaatctccgtccattgtttgcagatgtagatctggacatccgtgcccccaagagccaggtaggtaccactctggtcaaagatcagtgactttacctgccagaaatagaaagagagaaggtcacacaaggggaacagaaactatggggcagttgcggataagcagaagcaattagattaattcaataaataattgacaaacaaggagacacaatggaaagctgggcggagggggaagggcacacctcaaagttgttatccagctgcaaagtcttaaagttcttaagcttgcgcagatcccagagcttgacagaggagtcatcagccgctgtagccaggtagtaaccattctcagagaaggcgatgctagtgatggggcccgagtggccagggaagttggccacattagtacgttcctacagtggcggtgggtagtaaaatacgtcacccacagatcatgagaggaagaaaatggggctcaccaaactcctacctgagatgtccctcacgtccttccaggaaggacagccagcgggaccccccagaccacaccatcatatcacacacgcacagccagtgtctctccaccttcagggccaggtgccacaagcacctaattagcactgcattgtcacaaacactccctctggccctgggcctcagatggaggcctaccatgtcctaccttcaagtcccagatcttgatctgagagtccatggttcctgttccaaagatgagtccgtcagggtggaactgtgcacaggtgagagctgtggaggagggaagagagacctgtggtcagagcccaccagggagagagactaagagcagcaaaggtaggttccttgttcttcacattcctcagtgaacccagcacaaagcccgcactagacaggtgctcatggtaaatatatctttagaacaaataaacaaatgactaaataaaatgtaaaaataaataataaacagcaaacaaaaaagctgagtgcctatgaggcaacttacagcagccggaggtctcatctgtcaccttggtgagcacacgccctgtctggatgtcagagaaagcccagtactggggaaaaaaaaagagacaatggagtcagtgagaaagtgggtcccaggttctggtggcccttcagcaagacagagcccctggtttggcaaaccctggcaaacattctcctttgaggttctggggaaccagctggggtgggaagatgttcctgccacccaggatgttcaagcttggggaccagcaggcctctccagggcactggctgggaccgcacctgatcatcggaggagctcaggagatagtcgccagtggcatgaaggctgaggcctgtcacagcactctcatgggcccgaaccacctgtacacaagaggcattggggaccgaccaaatcctgatagtggcatcgggggaagcagaaaacaccaggtcctacaaggaaaacaaagacagaatatcagagtcagaaaagagatacagaccaaaacaatcttataaaacggggctggggatgcccacaactgccaacaattgcttctcctttcagctctgccctccctggaaccacctatccacccaatggtgcccaagacagccaatggtaaacgctattaaagtgctaactcatacagcatcagggcttgtggaggcgtcctcgccatctagtggtaaaaaggctaactgcaacagagagcaattttcccatttccaggaccaaaggaaaaatgtagctagtacaattgagggactgaattttttattctatttcattgaaatttaaatagccacatgcagctaactgctactgtactgtatggcacaggtctgagcagtactgggactggaaggggctgcatggctgtatttcagtgcattccacttttatggatttccagggtaagttaattttccaaaagatttggggcagggagagaatttcgcgtcactcaccaattttttgtttagttaggatattaaaagccataaggtaaaaataactaccatctttttttatcaatacaatttcatgagacctaactattaataccccataagcaagaaaacagtgctctcaatttgaacaaatttagtcatgaaaaattcaccatgttattcttatatttctcatttccctaaggtccaagggaaatcttgactgcgaagcactaaaccaaccatgtcctgcagccccaaacccaaactgtcttaggcttaaaattcgaatcccataatatcattaatctggtcccatgagttacctttaccctgtaaaccagaggttctgtttacaacctacaccactttcaacagtcaacatgatttttacccatcttggaggatcatgggaaagcagatatatctgtcctcctcgtaagtgtgagttgagattgtgttgagctttgttttctgtagtttatattaggaacactataagattttttctttccctaatatgaaatatttcaatgaatatgcttgtcaaactacacatttccgttctctccctggctggaagatcactgctttagaaggtctcacgcagagtgaagggcaatctccacaactccaaagtgagcccctccaagtgcccactcaggagtcagagtcagagctctttcccagccccacttcacagagacagcagcggggtgagggacaaacaacagccaaggaaagaagaaccaagggtggcgaggagaaccccttacctgggaagggtgaaacaccacgctggtgaccttcttggtatggcctttgagggtagccaggatttgttcagaacttttgtcaaacacaacgacatttttatccgccccacctggagaagacccaaaaagaccaaacaatgagtcaggcccacccaggcccttttgctcaaggaaatgcttttgttcccatgcccatgaagaggacaaggagcatgcgccttccctgctgcccctccccactttggcctgccgggctaggcccagactctcaccagtgaggatcttgttggtgtcggacgggcagaggtccagggccaggatcccaggaatgctggcactgtgcaacccctttgcagagagacacaccaaaccctgtcacggccaaatcacagcaggccacaaagccacagacctcccctactgccatctccagtcacccatgttctcaggggagcaagagttacttctattccttatccatacctcttggctatctgcctggtacggtaactccctcactgcatcactaggaaacccacagctgggcagaaagaggagccctgacaactcagcagcccaggcgagaaacagcaccaggaacagcgccaggaacctgggacagctctgcactcagcactccccatgctggcccgcccaccccagaaacaaaacgggagggctgtctccaagacagtggagacccagacactcaccacgtgggatgccacctgccggtatttgctgagctcttctggcttcaccagctcctcaggcacagtcttccctctctgagaaaatgaaaagcccccaaagaagagcagcaatgaatccaagattcagccgccctctctctcctaaggagtcaaccgcctcccaccaggccagctctttctccaggcttcagaaagagaactcaccttcttgcgctccgtggttagcacagtggctttgtcttgaagctggggaagaacaggctcaatgtgagacaaatcatcttgcaaggagaaaagtacattagatgctggtcacacctgtgctttcaaaagcagcaccaagaacttgctatctgccaacttctacgttacaggcttaaaggcattctctcttcttacttccatcccagctttatgaggggggtgttgatgaccttattttacagctgaggaaactgagcctcagagaagtgaagtcaattgcccaaggtcgcagaggtgataaacagcagagcaagaatagaagctaggactgtagagctcccataggtctacacgccactaagccaagggctcagacacatgctgacaatttgaactgctcagaaagacactaagaagccctgcaaatgagaatcccactggacttgcaatcaggaagcccagctctgcctctcagatgtgtctttcatctgcaaaataaggattataattcctatcctattgccctcatagaaaaaaaacaagaaaatatataaaagtagtttactatctgcaaagaatctcaataacaataagagctaaaaggtgcacttatcagtaatgaaatcttttaaattcccacagcctgcctatacagtggatatgatcatattctcagtttagaagctagggaaatgagacacgtaagggttggctaagtaagccaaggtcataaagcttacaagtagtggcatcaaaatacaaacccaggcaatctggtcccagggtccatgctctgcaccactcaactcccaaaagcacagtgattttagtcacgatggactccagacagatggtgaaaagtaagggcccatcagcactcccaccaggtgagagcaggacttaccttctgaataatctctggggtcattcccaccagctcacccaaatccattggctcacccgcaccctgaagagaagaaaggtgagggtgagaggcacagagcaccaaagacacctgcataaggacagttctgtgggccactgtacacaaatgggctgctggtaagggaagggggacacttaccacaacacttggttgggaacttggcacagcctggggcacaatgaggccagcctgtggtttcagggtagccagagctgagagaaaagacgatgttagaaatgggatattacaatgcagaaccagcccagggtgggggatggcaggggagaggctgcaccttctcgggcagcagtgacttccttggtgagacgggcaatgacacggcaggcggcatcgtgctggtacagagcgtgtgacagctcttggcgggttgtctgcagctgctggcgcagagtgaagctgtgcagcatgactgcatcctgggagaagcaaatatcattgtaaggtgaggtggggggtgcagggagtacccagtggagtcagcccttggggaggggatgctgcctcctatcccagagcctagaccagtatcagtgacccaaacaatatccgagcaaacacgaatgtgccggcagacactcttgagctcctaccccaagcgaaccactgggcacacagacaggagtgggagccagctctttcccatccccaccttccctaacttactggcaaatcccagctgtcatgccgtcccctctctaaaagagaataacaacactgctgctgctgctatttattgatcgccctcgttgtgtcaggcactgtgccagacagtcctgcaggatgtattcaatcattcaattcataactctagagcacctactatgtaccaggtgctgctctcagtgctggggatacaacgaagaataaaacaaatccctgatgtcacaaagtttaccctctaaataatgctccatccttcctacccccaagtcctaacccagcaatgcattctcttcaagtggggaagatgctgattctcttgcaggaactcacccactcatcctgcaaagctttcagaatggccgggatgctggtggctgagggaggcttgggccggattgggtgagcaactgccgaaagggaaagcaggtatgaagaacataacccaggggcctcccccgccatcacatcttttccttttagccataaacagcccaccatctcttcctccagtgcactggcaccacctcccatcctctcaggctctgagctaagatggccctagactaaggcagccaataggcacctttgatgtcgatgagctgctcctcggagagaggctggttgttgatggggtcggtaccattctccgcaatgtacttctcgatgagccgccgctcataaacatgattagagacaggggatacacatgggtgctccggcacttcgttagagactgtagagaaaaggctggtagtgagcttggagtgaaggcaatcttgggcctagaggattcctcatctgctattagccccaacaagactaggcatcctcacactcaactagcagaaagcaagacatttgaccctaagccagttctgtactggccccagaatgctttccagctatggaactaccttttcctttagtctcctgactgaggagatagtctcctgactatctgacaatcatatagtcaacaaataattattaacaactactatgtgccaagcacctagagaatagcagtccattatcaccacctcatatctgaacaatgattgtgtactctatgaatacagtttactccatgacatggagatacacatgaagccattcaaatccctgccatccatcttagtctatagctccagacagattatcaaagaaattataaagtctgagaatacaggaataacaaactcagtttctcctattctctgacaaaacaaaatacttctgtgacctcagatgtgaccatctgggtgtcctccaattcaattctgacaccaggtacctggagatagtgtcagatcatacaggttgaggtctcagtcccaccagactccccgccccttcagatgccaatcgcaagccccaggttgtttgacctgttcttctgatctaccagctgtaaatcagggttcccatgacctcctttttgggttcaattaatttgcaacagtgactcaaacaattgtgggaaacacttatgtttaccagtttattgtaaaggatattacaaaggatacagatgaagaggagcataggatgaggtatgggagaagtacagagcttcccatgccttccctgggcaccccaccctccaggaacccccacatgttctgctatacagaagctctttgaatcctgtccttttgtatttttatgaaaacttcattacaaaggcatgattcaataaatcactggtcactagtgacgacttcagttcctctcatttccccaggtaaatggggggtaggactgaaaatcccaaccttctaataccctttagtcttcctaggtgaccagtccccatcctgaagctattgagtctaccagctaccagtcaactgattagcgtacagacacttatcacctggaagattccaaggagcaaagtggcaatcgctacaataaaaatatttaaaaatatttacatggcacatttgcatggcacatttctatgtgccaagcacaattctaggcatacagtacagtaattcatcttcacaacaacccgcaatagaggtatcatttacactcttgcctgcgtagactgtgcaccccttgaggataaggattacagctggtctctcacttccagtacaatgcagatgcccccagggcactcggtaaacatctaacaaatgagtgaaccatgccaggaaggatggtgctggggaacgtaaaagagagcttcccgaagattggaaggaaacaataaatgtgaaggtactttgcgagctgtaatttcttcaaagtgagggattccttttccatcatttcccttccttcttccccctctttggatcaatgtacaggttctgagaagagaaggaagtgaatagcaaaagggaggggaaacgagtaatctgatgaaacaacgaaaagggaaaggaaaatgtctgtacgtcatgataaaatatcaaagggaaagatagtggaaggtatgaaaaaagcatggattcagggtccaagatccgtgtcacctaactacgtcacccagctctgccactgactagctacgcatccttagataagccccgctcttcctgcgccttgcatcctcatctgcaaaaccaggatctttatttctcctttagggaattcttgtgaggataaaatgagatcatagacttggaagcgcgttgtaaaccaataagggcttataaatgtgcgctgtttttattagtcatacagtgtaaggctgggagccagatacctggctgccagccttgcctctacctctaactcatcatgtgacctttgcaaattgcaaaagctccgactatccgagcgaggcctcgcaaaacatccactgcaatgctctcgattttgcagatggggaaaccgaggcccagagccttgagccaattcataaagccaatgggaggcggaccctggacaagacctcgagttttctgactcctacattaaggctgcttcccttgcaccagctctctctgtccagacctgtttccactctgtagaatgaggcgaccggcctcagtaatgtctgcgacaataaacctcaggcactatgtaaactgcggggcactgcgcaaatgcaccccgctccgacggggggggctccggtgctgacaggccgccgctcggcctccggagcgccccattcccgcctccaccccggcccgggcgccgcagcggaccgcacacgctcccgcgccgctctctggcctcctgagacccgcgcttggccgcagccaacactcactggagcagattagggacatggcgccgtcaccgtgctccgaggcgccacacgccgggctccgggactagcttctgagcctccgcgagccacttccggtcccccgctgctgccgggactgctccgcggcgagctgggagccgccagccgagcgatgctagcgtagcgcttcacgtgggaatggggacagccgcgcgccacagccttcagcacctaacggaaattgccc

SEQ ID NO: 11 - DNA, 43484 bp, Homo Sapiens
ggcgcggagctgggtgcgcgccgagcctctgcctcccgccgcctcctcgccctccattcctcgctccccgtcttctcccggccacaccgccactgctgccgcctccctgggaacagtagccgggggagggggactggcgcggtcagagcctgcgaggaggtgcggggcgccggggcgtaggggagcgcgccgggccctgcccgagatcagataacagccggcgggggagggggtgggccggccgtgctcacagccggaccgagggaccgacgccagccgccccggcccaagcgagcgcccagcggccgggggcgccgtccaggcgcgcgcccccgacccgtggctggaccagggcgatccgctttgcagagaagacgcgcccctcggcatggagcgcccccgggagctgccctgaggcggtggcggcagcggcggcgatgcagccagcgcggcagctgccggggccaggaacggccgcccggagcttggaggacgccgagcgcgccgcgcccgggccactgaccgaggtaagtgcgcggccgcgggcgcatggtccctcccgggcccggccccagttccccgcaggccgcgcctcgccactagcccggcccggagctagcacgaggttgtgcagcaacagggaaggtggagcgggagggtgttttcttcctctcgttttatttttttccctcccttggtgagacatcggaggaaatgctgactgcgagcttttcttttcctgccatgtctccggctaccaccacaaggaactttgctcctggctaaccttcgtcctggggggcgctccgggaaactttgaggagccctcggcccccctctgactggtttgcactagggggctcgggagggagcgtgcggaagcactctggcgcgcggcacgggtcctacgcgtgaccttcccggagaccccgcgatcgaggtggggttcggaggtgggcgcccgggctatatgagccgccccgagaatgcctcccgtcagagacctgcgggttcttggagtcgtgtctctttctcacctcccgtgctgtaatggagtaaaaatattctggaaatgattccatgccagcaagtcagccaagtccagaggctcccttttgcttttagaagtcggccttgatctccgaggggatggccgctggctgagaagctcccagggtttcagggccagggtccaccctgcgcgcgcacggcctctccgggtgccctgggggagcggggcgggaatcaggggctcatgggcagagacagctggggtggggcgctccttggggggttcagatgggagttgaggcccaagcgagtgtctgtgcctcggttttgatccagcgtgcccatgtcatgtgaatattttaaaacctgtgatcagaatgggggtcaaagtgtttctttggggacggtcttgttctgggaggttttcctgcctcctcacagcctggactcgcccgcacctgggacctccccctccccatttcccagggggcgttcccatcttagagtaccgcgctgcctgtggccatttctagtttcttttttgctcccctatacccaggttcgagccctgcaataaagcgctggggacctcctggctcccacatctgcgccccaaacccaggttcacaggctccgtctccgagagcgccgaggcgcccacacgccactgaaatcggcagccgcctttggaaggtgcgaacccggaaggcgttagccttgggcctagccttcgccccctctgagatgccaaaggagagccggtccctggccgcgcggctggaccccagcctccctcgcgctgcgctgcacctccgcggcccctcctcgcgcagctccgccctggaccgccgccctgtggcgggcgagggtcagagaggggaggtccatctcagccctgggcgccaccagaggctttcgctctttttgaggggtactcccttctgtattctgagaagagcccctcagtgtctgctgggaccgccccccccaacaaaagacttcacagcgaagtctgcccctcagttctctggtggcacctccaaccagacaggggacccgaggttggcagctctaggagggggaccctgggggcctgccatttggtggggccaagccgcctgagagagagcagggagtgagggcggagggcactcactcgagcaccctggagacgaggagggtggctccagtgtgctgggccacagggacacccctcttctccactggagggccgctgtaggcatacagtaggcagtctgtaaatgctggctgttgacccagagctggcaggtaggggctccaagtcctctatcacctcctttttcccctcccaggggagggcatggctgacacccctcatccccagcactgaagggggtggagccttctctgggaggggcaggacctgagctgtcagtccatctctggacactccccctgcagctaccccgtcaaaaccccataaggtttccaggctgccccggaggggacccctccaggaatgtgcctcaactgtgctggaaggaagaggtgcctgggaagtggtggaggggtattgcctaaaaccatgcagtgggttgggtttggacagatgccttcacctagctctttccaggccaggcgcttaccccaccagccttcctgccccagggccatggtgtccccatccctgggtctccttgaagcaggacaaagtaacactgagtggccctgcaacagcaaaataataatgacagcagtgataacaggagtaacagcagcagcagcacctgcagctctgcagcactggggccggttctgcctatgggcagttttctctgcctagccaggcctccggtaccctgggccacagttggcagtaccaagcgtggcacccggaggccttggcatatggctggggcggaagtgagtgcatcattactgtcatcaacctctgtggccctcgccaggtccccaggcagaaggctactggtacacacggtgcccacccagtggccaccctcaccccccctgctcccaggcccagctctgggctgggcccttcctccaacaggtgcagctggtgcctgtggctgggccctggccagggctttactgtgagcgacacatgggtacacctgcccctccccgggcctgcccttggagccctgccaccggctagcgtggaggagagtcagggagggggcagcttgcgggcagcaggaggggtggaggcttggctggccacatggaaggtgcggtgggtgggggctcagccccacgggatggctgtgccgggaactggcagcgtgatggggacacggcagcagggaaaggctgaagatgaaagagagctggcctgaaactgggccgtgtgcaggttggccagagcttcagaggcaccatggggttgggggtgggggggggcctggcagaggcaggtgggttttctgaggtgctgggctcggggcaggaccagagcccccgctgggcactggccaaggacccagccctgggtcagctgacttaatttcctaatggcctgccagtgcagagggtggcattagctctattgtgcagacagggattggaggcccagggaggcactggaggcaccagcctgtggggctcagacccagagccctggtgctttcccagggacagaactgcaccttcccccattccacagacacacccctcaggggcatttgactgccaggctagctttctccctgccttaccaccaggcaggtcccacacagggcctgaggcctgcatgccatcccagctcccgggagctgtattcctaggacctagttaagccctggcacagagtaggtgcccagtaaatgctcgatgattccatgtctggactgcttcttccagccacagaggccttgctgtgctggtgagagctgtgggggctgagttctggggctggagaccccaggccctgttgcctagctgtggcccctgtgctgggtagccatacagaagtgcttaatcaatgggcattgcatacggggagacccagcccctgccctcagggatctcactatctcagaggagactcttggacagactcaggggggcaagagaggcagatgttgccaccaagatggggtcactcttcctggcctcagttcatcatctgtgaagtgggactggctccggagagtgctcaggatggggcagtaggaatgtgagacttggagcgtgcctctgggagttgggggtggggaggggctggtctcagtagaaatggacgtgtggagagggggatctgggaaggagggggtgtgagcatttgtggagccagagcctggggaactcgtcatttccccatccaaccttcccttggacatgtagggaagcaggcccagggcagggcagcgagttgctgtagcagtgggccccagatggcagtgggccccagatggcagtgggccccagatggcagtgggccccagatggcagtgggccccagtgcaggcctcctgtttcctggtgtgtcctcagtgtcccctaaccccaatcaccaccactggtgctccacagctcactccttcctgcctggctgctgaagtggcagcatgaggctgtggagaccttggggacccccgcccagccctctaattagccttcagccatgcatcattggacatggttccatttgcttggccagataggagtgggaacccctttctcagctgccccagggagcagttccgccttggctgtgcattaatgctgtcctagggtcagtgggcacagcctcctggatcctgcctgactccccctgcccacctggactgagccctccctcctgcttgggcagccaaagcctccctctcctgccctcacctgcagcccaggcctctttgaaggactcaggcttggagaggggccagggaacaaacaataaagcttatggagtggaggcttctaccagagccactctgggccattgttccttgagcactttctatgtgcctggtgcactctgggtgtcagggccctctgtcgattcccaccacactcctccctgggaccctcagggccctgcacagtctggcctcacttccaggactcttgctccctccccggggccacgctcctgcttgccttgctgtgcttccaacagatcaggcccactcctacctcagggcctttgcacatgctgctatctctgcctggaatgttctttcccagatctctgcacggcccctcccttaccgctttcatgtcttgcccagatgccaccctctctccaggacctcccctgattcccctgtgggacactgcagcctccctttcccccatgttccttttcctgctttatttttctctgtagaacttaatgctatctgccacaatatattttatttgctgatcttgtttactgtctatctttcccttggaataggatctcctctttttggacctattctaccacagctgtgtccccagtgcctaagcggtaggcaggagatggcaggcgcccagtaaacacagagagtgaatgggctgcttcagccaggcctggtgcctgacatgcagtgagtgcttggtagcaatggtagccagcattgtcagcccattctgcagatgagaaaactgagcctcagagaggtcactgtccaagaactgtggcgcttgttggtggacagagctggattctgaccttttctctgagcctttggcctgccatctgtctgtctggctgagtgggagggagttggggcttccttcaggcccctactctgggtggagtgctttatatctgtaccctcactgcttcaagctccaagccctgttgtgtcctctagcacttggcctgcttcagctcaggatgtccccatctgattccttctgaggatcacaagccgttcccattgcagatcccagcaaactgaggcctggggcgtggggcctctcatatctcagctgatggctgaatcctttctcctgccttcagcatacatgtttggagggcggctgaggggatggggctggcagggaggggacagtgtctctgtttcttgcccagttaagcattccagactccccacggtcattgagtttcatgtcaatgcatttcacctctcctttccagtcttttttttggaacatgacacccacgttataaaatgtttaaaaatgtttatgatttgcaatgatcaactccagcggctttagtggccagcagtgatcacctctgcaactatagagactggcatgctttctgcttgcctgagcactgcccgtccctcctcccctggatgtccatgttgcctcagaaaagacagggctggtggccccttttgtggggagcagataggttctggtcctgggcctcagccaggtgtgcccggttggccaggtgtgcagccaggtgtgccaggatgggagattgtctcctggggctcacctggggagtgggggcagaaaaggaaaccaggtaacatgaggactggcagcagggatacttctcagccctccctgcctccaccccaagggtgtacaggagggtgcgacgtgacacctccactgtgggagcgggcagcctgaggccagagagggtccccacagccggaggtcacacagttcccggaggaaggctggggcgcagccttgaggccacagaccctctgtccctgatgcttccaggcagcttttggggacttggcaggggaggggccggggagaagggagcatgtggagactgagatgtgtatgatagagaggatgaaaggccgggggcaggagaggtcaagggggatggagtggcctggtggccggaggtgtgcccttgcccctgcccgccccgcttgctccagctgcagccgggcccgagctggcggctccaggcctgcaattctccagcacttaaagcaaaaataaatcgctgccagcagctggcgttctgtgtggcagcagccgagccaaccccgccccgaccctctgcctcggggctcctggttccgggccaagccaggcttccattcagggctggggggcgccgaggccagagagggtccaggggagcttggcgtggccggagggggcgggtcctggcatgatcacagggagggcagaggcagatggagacctggggcttccaggggtgctgggatctggggcaggttggggatgctcaaaagtggggcttctgacagtcttgggtcttgtggaaatagggcctgggaggggcaaactcaggggtcacagccacctgtttggccctggggatccccaatcacaagccacccccagcctgtcccctggatgtccctttctttccatcccctcctttcccttctcagagaatcctagaggtcctagaggtcaggtatttgcgtggtgagctttgaggatgcaggattttggcctcattcctgagctcagcaggtggctggggatgtggcctgcacaagacccctgccctggggggctgacatctcagtgggtggggcaggatgaaatagacaaaaaacacatgagccatcacgggcattgtcatattttgttgaatataacagtttttaattataagagtgttatgtgctcacagtaaagtgataaacagttgtaaggggaaaagtgaatttctcctcctcaccccctgcctcccccacccccagagtttcttgtccttggggtgaccatcattagagaggcttctgggtttctcagtgcttatgcagacgtgaataagtaaatggaggcatagaaacgtgctaatatctaagttgcctttttttaaattcgtatgggaccattgcatacatgtcatggcgtcccctgcactatgcgcactgctgtgtggtgcccgtgcccactggacccagggggtctcatcctgtcgtcctgggcatggattgagggctgagtcttgggactgtaggatctttgtggcatctgaatgcacagagccaccgaagtccgtgagtcatgggttcttttcgttgtcattttagctgcgttgagacagagatcctggattgcaggatttggtttaagtaccaggagaggtaccgagtcctcgcctgggtgcctccttcgtcacatccctctgggagttgggataatccagatcccctgcctccatccccagagctcagagggtctggggggcttcagagtcgcagcctggggctttgggacctctgggtgaacctggctcccactcagggcagagtagacacgctggagctcggaggggaggcgctcattgctgctcccactggggtccttcttcctttagcctctcttcttcccttagccctgacctcctagaaacaggatcacttgttccctcactgtcttcaggctggggcaggcctctgtgtggggaatgtcactttgtttttttttttgttgttgtttgtttgtttttttttttttttgttttgagacggagtctcactctgtcgcccaggctggagtgcaatggcgcgatctcagctcactgcaatctccgcctcccgggttcacgccattctcctgcctcagcctcccgagtagctgggactataggcacccaccaccgcgcccggctaatttttttttgtatttttagtagagacggggtttcaccgtgttagccaggatggtctcgatctcctgacctcgtgatccgcccgcctcagcctcccaaagtgctgggattacaggcgtgagccaccgtgcccgacccaggaatgtcactttgacctgtctccaagcttccgcatctcagtgcctgtcccatccttgtcattccttggaacctggcctgagatgcatcagggtggtcccaccttactccaccagggccccttattagaaaggatctgctacactgattgggagagtgactagtctgtggtcactctcagtatctgtctcagtgtctgtggggatcagatatacctggtgcccttcttttatgagcctcactttccatgtttgtgaaatggggaggcagtccattctcgtgtctgggcatctgttctctccttccctctgggcttgggcactgcaggcaagacagggcagcttcctggcctccttgatccctattctgctgtgtggccggaggctcggccctgccatcaccccggcctgctgggctgcaagctgtcagcagcacctgcccagtcagagcggccaggtccctccccaggccctgggagccttgaagaccactggaggcagtgccccaggaggtagccgtggagtggccccggccctccctgggggttgtgtaacagaggagaccccgctgccctcctcttttcctctgcagggtggaggctggcctgggccctgccagcacagcctccaggccactcatgggtcctggcctccatcccacggtagatgccctgactctgcagcaccagggctcatgaccaggctcttggtggccttaggaccagctgccgctgggtggggatgccccagatcaaaggcaggtaatagagaggagactgggaggacagtgggtggggagcaggaaccctgggagcctcagtgtcctcccctgtgaaatgggaacactagagaaagtgggttgggcaaacccacacgcctaccattgcatctggggtgtggaaggagcactggggcaggagtctggcagcaccaccaaccaggtccagtaaagaaagccgaggcagggatcagagggcggcaagccagtgagaccctgtgttggtttcctgctgctgccaccataacagactgggtggcctaaaacagtacaaatgcagcatccgttctggaggccagacgtctgaaaccggtgtctgcagggctggttcctcgcggagcctctgagggagaagccattctggggctttcccccaacttctggggcttctggcggtcctggcattccttggcttgtgggcatctccagtctctgcctcttgtcttcacatggtctcctctccctgtgctgcctctccctctcctctctctcactctttctgttatgagacagtctcactctgtcaaccatggctcactgcaacctggaactcacaggctcaagtgatcctcctgccttaatctcccaagtagctgggactacagatgtgcaccactatgcctggcaaatttttaattttattgtatttattttttttaactatatgtttttttgatatggagtctcgctctgtcaccaggctggagtgcagtggcgtgatctcggctcactgcaacctccacctgccaggttcaagagattctcctgcctcagtctcctgagttgctaggactacaggcatgcgccaccacgcccagctaatatttatatttttagtagagatggggtttcaccatgctggccaggatagtctcgatctcttgaccttgtgatccgtctaccttggcctcccaaagtgctaggattacaggtgtgaatcaccgcgccaggacctctacttctaaggatgcttgtcattggattcagggcccaccctaatacaggatgatctcatatccaaactctatatttgcaaaggctcttttcatctgaataaagtcatattcacaggttctgtgtggacatctctttggggagggcaccattcagccactactcatggccaacccagatatgccaccctgcatcctttttctcttttaagaaacgtgctctccctgtagtcccagctactcaggaggctgaggcaggagaatggcgtgaacccggggggcggagcctgcagtgagcggagatcgcgccactgcattccagcctgggtgacagagcgagactccgtctcaaaaacaaaaacaaaaacaaaaacaagaaacgtgctctccattttgggaggccgaggtgggcagatcacgaggtcaggagatcgagaccatcctggctaacacggtgaaaccccatctctactgaaaatacaaaaaattagccgggcgtggtggcaggcgcctgtagtcccagctactcgggaggctgaggcaggagaatggcgtgaacctgggaggcggagcttgcagtgagccgagatcgcgccatagcactccagcctggcgacagagcgagactctatctcaaaaaaaaaaaaaaaaaaaaaaaaagaaacgttctcttttttagaaccatactttggagacatcgagcgctggggtgaggtgttttggcatcagctaccagcagtgcatcctcgggtgggtttcccagctgccctgtgtctcagtttcctcacctgggaagtggagctatgaatggtccttcccctgtcggagggtgtgggagatgacaccttttattattatgtctgtcagcaactggtgtgaacatctaactggtatttcccacaggaggctgtatttctgtttagttaactggcctcactgaagcgctcacttttaggtttccctccaaccctcagctgtcagtgatgtaatgctgctgtaattcctggacacggaggtcctcctgccccacctgtccaagagaaagttctggaaatggcctgtttgcttgaggggctgtgtctttgtggttttgaggtgtcactgctgtgccccccgagggtcgtgctggttggtagcccccttgacagagtctgtgtgcactgggtcccttccttccactcctcccccactgctgaggccaccagttctggccgtgaagatggcagccccgctgtcatcgttctgcttggcgtctcctttgttttagaggtgtagtggcttttcaagttaaaacctcttgttgtagttccatttctggcagctgccggctcctgcagggagggtgttttcctgaccttatccttcccggcagagaagccctcagggagtgggtgggatgccctggccacatgccagccctctgtcatcctcctgggtctctatggctcacccagggatggggagcagcggcctcgcttcagacgcctgagcggggcgttgggaggacctgccataccccatcccgtgccagcgttcttgcctgcgcgtggagcccgagagtgtggctcctcactgcccagagggaggggttgggctcatacctgtgacccccttgccacaccctagtccctctggaggtgggtgtaggtgggattgctataatgccccttggccaagggagcttgggtgtccttggccccctcctgtggctcccaactgccgccaggaaatttgggatccccagcaatacaaatggcccggtggtgaatccagcagcctgtggtgtcaccgggtgcctttatttctcaggaagtagtgtgacgtcgtgctgaggcttggcaccccaaaacaataatgaaaacgactgcttacccagcggcggctggtgccaggcgctgtgctcagtgctttcccgaacattatctcactgaattctcaaaatgtcccagccaggcaaggagtggggcttgagagatggggccactgggggaggcggtggccaagccagatttgaaccccaatcgggaagcctcggttctctaaagaaggccccgctgggccccccccgagggaaggtagagacatcctgggcctgggatccaggaggcgttttgccactgagatgtctctggcttggaatggcagcgctgggcatgaacttggggcctggattgacacgggctgctctcccacccccatctgctgtgtgacttgaggtaagctgcatcacctctctgaacctcatttccctactgtgagaaatggagccaaatttaccccatttaaactgcagttgtgcggggagcttgcctggccaggtgttaggctgtttcagaattccagaggacggggtctgagtcctgctattcacaggtggagaaatggaggccgggagaaggggagggactgcccagagtcttgcctcccacctgtgacctcagccacagagcatggctggtccaggcacctctttcttgcccctagaccaagctaagaggacaagccattgcctgagcactgtcgtgtgctgggggcatgggcagggagagaccctgctctcagggtgaggcctgccccttcacccgttccctagaggtgaaatggcctctctccatgtgtaccacatcccggagccctggccccctggctgagctcaggcttcccacgaatctgtgggccctgtgtgataccgcagtttgtggtggcggcagcttcgctgcttggggagtaagtcaatgacttacttacccactcactcattcacttaactttggggatccccagtcctgagggggaagcagctgtgccctcagagccccatggctgagtggaggtctctgcagagggtgggggtgtggtggggcagggacggtttcctggggaagaggccctggatcctggccccacgtgggggttgggggctgctgtggcacctgtgtcccccagcaccagtgttcagctcaggggagctcttacagagcctttcaaaaccatccctgggccccaggcagggaggtccccagccacctgcttcctagccctccctgtgacatgcagggagcaagacttaaagggcatgaaccctgagtccagctgtggccttgctgctcagggctgcccatcagccttgccctgcctctcactgcacgtcctgcttctgagctggggtgctggtcccagaccctcctcctcctgcctcattccagaaccttctctctctttctcgggcccagctcccaggcccccactcctgccccattcttggctttctccctcaagggtccctgactccccaccagcagggtaaccacctctttcactgagaaaatcgaagagaatttcaactcctgcccctcacagcttccctccccatgatggactgtcacccctcacccacagggcccacccctcttgcccacccaaggctatcgctgtctcaaggctccctccctccgctggaccctgcactacaccctggttgggagtgaatccttccaaaggtggcgatggagggcccactgggatgggcactgctccccaggccccaggacgctccaaggcacaaaacaaagtcctgccccacggagcttctgtgccagtggaccactgaccatagactccatgggagagggactcgcttctggagaaggggcccagacctgcgtggagtcagggcaggagctgggaggatgtccaagggaagcggggccggtggccagaggtggacggagcctgaccaaggggcgggggcacagggatggggagggggagcaattgcagggtctggaggctgcagcagcatttctggttttctttctttccttccctcctttcttgtaacaataagcatttcttccagctccctggtccagagtttggttgtggctctgagctgctgggaggagttggggttggatctgtcaggctgtggttggtttcaaatctcctttgtgtgtctcctcccaatgtttttttcttggaggtgaaatacagttcttttttcttgaaggtgaaattcacataagatgaaattaaccatttaaaagtgaacaattcagtggtatttagtgcattcacactgtcgtgcagccatcacctctgtctagttccaaagccttccaccatgcagaaaggaagccctgtcccattggtagtcactgccagtccctgcaccatcccctggcagccactaaaccgcttgctgtagctgtggatcttcctaatctggatgtcgtgtgtgcgtggggccctgcacgggtagccttctgtggctggcttccccatctccatcatgtcctccaggctcggccctggtgtgctgtgcatcagcaccgccttccttgccagggctgagggatgcctgggtatggatggacacactctgcctgcccgtttgtcatggctgctcagcctttggcacctgtgaacggtgctgccgtggacatggaacacaggttcccttggatgccggtttccagatctctccatgtacctagaggtgaaatggctgggcctgcggcagccccgccaaactctggaggggctgttacctttggaagaggctctgactccagggcacccttcctgtacccctccagcctgcgttcttgctgtacccccggaccacagacctcctcacaagactgtcctgctgctccccagcttctcctcatggccatcccctgtgatgctttggaaacgtttaggacagggttaccagtcacctggtttgtctgaacctgtgctctctgggaacaactgccttgcggcgctccgcccagccctcttcctcctcctcctcctccacttcttctttggagggcaggcatcttcccctgcacactcgctcccctgcacatctggcctcctgcagccccaggttcatgtctagcccaggcctttcttccccggtctgcccaggtgacatctcccttggggtctgtgggcacctggatcctacatggtcagaactgggctcccatctacctcgagcctgtggtccccccaccccagtctcctcgtcactagaagggggacaggctgaggacctcccctgccaccaggcctaccttggccagtgggtgggagggccaagtgtggggtcatgtctggcaaggtggtctcccagctgtggggcgttgcatggctccaggctacaggctggggctcctcatctgaaagtggctacaggaatccgtcttgcctcctagggctgtggttgaggtagaaccggctgacttatgctgagtgtggtggtggggactttgggctcctggacaacttccttccctctctcctgagctgcagtgacttcgagggaggtggtcacataggcagagccttcctgagccttcgtgtccccaggtgtgagtgggaataagaagctgccctaccctctgcacacagcaccactggaccactggaccactggacctaccggaggtgctgtgtgaagggcttccagaggtccaggcacatagtaggcgctcagtgtgtgctcacttgtgggtcatggaagctggctgtgtttgctcagagaacccagttcagtgggctgggccccgagggaaggacgagtctggccaccgcagcaaggagcaaaggcagacaaggacacgccccccaacaggggccctctgcctctggccccatgaggctgcagctgctcaaggcagggggcaggggcccagctggtccccactacttaatcatcttgttggcacttaggaccagcaggagccccaccagggctgcacccggcactggccttggaggggctccaagccacctggctcccttggcctgggagtgttggttctgtagtggggggatttcatggacccccatcctcctcgagtgggttcagagaatgaggcctgagactggctgtgtagatgggttgtctaaatggcagacatttgtggtccatgatggtggccacagcatttgggcagtatagacagggaggtggatggtggagacaggtggaaggcctgaaggtgggtgtgggcagcacggtcggggcaaccttgatggtgtgcctgcaggcataggccatatagctgtgtctgaatttcataggcagggcaggtggggtgtgtgtggagatgcacagatggtgagggttagggaggctagggcaggaagatgtggatagtgtccctgggtctgggaacaggatgggcccctaacttctgccccttctttccgagtcccctactctctggggaggggccgaggctgttcccaggccagcgctggaattttaagtccatgtgcctccctgcacggccgtaccggctctcccttgccctcccctgccctcccctactggaaaggacgtttgtcagaagcttgtgctgcttaggagttttgggtgctgcctcatcgctttctgtgcttgtccccattttacagatggggacgctgaggctcagaggtggagggaattttctgggacccatggtgcttttttgagccacagtagaggggtctggctctggcggatggggcagccctcagaggccctgcttcaggccctcaaacagtctgagtttgtccctgaggctggttgcaccctggggctgacctgcacaccctgccccactgctagagcctctacagcccctggcttctgcgtgcgccctcccctctgcctctggtatgtctccactcttgcttacgaagccagcactgcctgctggccatttatccagctaaccctgtaatgcccctctgggagcctcagacccccccgtgcgggttgagctgccagcagatggtggaggccggagggcagcacacctggcaggccctgagtcctggggctccacctcatggttccacagttgctgagcatctgttccatgccaggcgctggaattgtctcacttagtcccctcatggcccgctttacagatgaaaccacaggggcctggaaggcaccattcaatcccatgtgtttgacaccagccccgtgcccccaggccttcaccgcccgcctccaccctgagcagtagggcaaacacctggccagtggcctgaggctgagtgcatcctcccagggccactcatttgagcccatggagtgtgtggcctgtctaagtttggggccaagggtgccactgagggcactgctggtctctagtgctggcctcttatgccccacccataggacccaggcaaaggaggacaggttggagtaataaggggtttggtctaggctgtggtctacctgaagtctccagtgaaggctacctcccttggcctcagtgtactcatctgtaaaattataatatctatctcgtggggatctcgtcacgtgtcaatgacatttcagtcagtgatggagggtgtgtatgagagtgatcccataagatcatcaaggggctgccctatacaggtgtaccactttttatcttttatactgtatttttgctgtactttttcaatgtttaactatgtatagatacacaaatgcttaccattgtgtttcagctgcctacagtgttcagtacagtacttgctgtacaggtttgctgcctaggagcaacaggctccatcacacaacctgggtgtgcagtaggctgtaccatctagctttgtgtaagtctctctatgatgtttgctcagtgatgaaactgcctgatgacacatttctcagcatgtattccatcgttaatcgaggcatgactgtatggtactcaggggctaagtctgacacatagtaagtgctcaataaacctaagctctcattatagattactgttgctgtcctggaaacagacacagggcccctgctctgtgcctgccctgtgctgggtgatgcactgattctggagaggaattaggactggaggctcaactcgaggctgagggtggggaaggtgaagacagagactgcctggtgtggtcagggctgtggcagagagaaaccctggcataggcaccctgggaggggaccggcctggcgtaaggcgttggaggtgggagctgctgggagttcagtgttgccaggggtaaaccattagaaattgttcatcttagttccagaaattctttccaggccctgctggggccacagcaaacgggtccctggaagtgctgagggacccctgagggtggcaggcctggacacagaccatgaccacatgggatccatgggctgcttccttctttaacccagtgcctagcacagaagtgttgatgatgcctgggcaaggtggctcacacctgtaatcccagcactttgggaggctgaggcaggaggattacttgaggccggaagttcaagaccagccggggcaatatagtgagacccatctctacaaaaatgaaacattagctgggtttgctggagcatgcctgtagtcctagctacccgggaggctgaggagggaggatcacctgagcccaggagttcaaggctacagtgagctctgatcaagccactgcactccagcctaggcgacacagcaagatcctaaagaaaaaaaaaaaaaaaaaaaaacggcgcacagtgactcatgcctgtaatcccagcattttgggaggccaaagcaggtggatcactcgaggccaggagttcgagagcaacctggctgacatggcaaaacctcgtctctactaaaaatacaaaaattagccgggcatagtgaaacccacctctgggaggctgaggcaggagagttgcttgcacccgggatgcggacgttgcagtgagccgagatcgcaccactacactccagagcgagacttcttctcaaaaaaaaaaaaaaaaaaaaaaaaaagaaagaaaaaagaaaaaaaggaaataatggacgtgatgataacagggatagtgatataatatttctctatgccaagcatggctctaagctctttatgaagtcattaatcctcatgacaatcacatcatattgcccccatgttacagatagggaaactgatgccagagaggtgaaatgacctgcccaaggtcttaccacgactgagtggcagaggtcaggtagaggttgtgcactggcctggggagaggggaagagtatttggggttcagctgaggcagaggagtggctggagcccctctacttggtgggcagggccatttccagagcatgtcctgctgtgccctgcctgccctgctgtgtggctcaggcatggcctgccctctctgggctctgagcctctgcagccagcccaggatgtcctcgggcttctcggctgggccacagccctgctgtacctgggtccctgccaggcttgttatggtggctgccctgggcccccgggcgcaggcaggggccaggggtcattccaaggtgccagctgccctggccttggggttggcatgggggtgaggggctggctgggctctcgagaacttgctgaggctagagctgagtgctacatgcacctggactccttgcttttcctacaaccttgagaaatcctcagctaacaggcagggaaactgaggctcagagaagggcagccgggaatctgagatgacacagccaggaagtcaccgagccagctcgccgcaaagccctgcttcccactttgcagacgacgttgatgaccaccacagcttctacttgcctggtgctttgctgtgcacaggtcctgccaggcagcaagccctggcatgcccatcccagtcctccaaggggctgtcagtgcccatctgacaaatgaggacaccgaggctcagagagacatccccgtgcctggccggggttctagccagcttggttcgcaccggtctcaggagccagtggttatgggatgcccggtgtgggtatcagccccgtgttgatggggagggccgtcttggttggggtgaggggcccctcctctgtgaggatgacgacaagaggatgtgattcaagggctcttcacagtggtcactgtcctaaccactggacccctggagtcaccagagccggccaagctgggcctccacccagcatccaggggtggggctaaggcatcaggtttggggcccaccgtggctatggcctcaggtagccgtggggacggactgtgcagagcctcccagggaggcttcctggatgcacgcaggtgtttgggaggctctggccgggggtcatcgttcaagggggtctcccagggcacagattggagcacactgtccatcaaggtcatctgcctggcctccattcctagctgtgtgaccctgggcaagtgtgtttagctctctgggcctcagtttcctcatatgtgaaacagagatcctcatagggatgcttggggactgaatttgggagggcagatgcttggcagtaaaggcatgggcttgttccccagctctgcctcttataggctgtttggccttgggtaagaaacttcatttctctggagcttagtttcctcatccgtccaatggggataatagcagactcttccctgcagagctttctcagggcgcagtgaggcagtcaaggtaacatccctgtagctgcgatcacagctcctgctgcaggctctcgagcaagggccaccccaaagaacgcaggaggcctcagcttctcttgcctgagatcgctgccgtgtggggcttcagcgcccggctgcctgtggggagcggatcaccggcggtttcatccccgtgcactcttgtctgatgaaatataaatagcacgcgatgttttcgagcaaggctagggaagcgtctgtgggtcgtcctcccgcccggcagaggctgatgagctggcctggggacgggaaggagatgggagctcctgaataaatcatcgtgggagctgggctaatgcactggccacgggcagcgtgtgcaattagtgtgttaattgtccagagaggatgactttgtgagggtgtggcccagagtccactggtttgcagagtgcctgatgtctgggatgcctgcccccacgactctgggaaaggaccccaagccggagaatcagccagtgcggcctgactcagggcctcatactctgccctgcggcctccagctcccctggcagccctcagctggggctgacagcgcacagcagggattagcaagtggaccaggagcagagcctgggggccgagacttgccccctctcacccctcccttctccttttcttctttcagcctctttgtgctcagtggtttggttttgttttttgcctttgaaccaaggctgtcccagacttagcttctcttgccccgttgccaaggtgaccagaccatccctgccaccctgcagccactgccagggctgggtgagggacatagccctggacgtgtgtgtatgtgtgtgtgtgtgtgtgtgtgtgtgtgtccatgcctgtgtacatatgtgtacaagagcagacacacagagatccccaggtcgatagccccacacaaatgtgggcatggattcatcgtttgaggaagaacgcaggcccgagtctgtgtgcatgctggaggcacacgcaggtggactgcacacacccatgtgtgcccatgcaggagctccctggtcataccccacacttctctggtacccgaggccctgcccagtgcctcctctggccactggagccttctgcatgtgcagccgagggaatgaatgcgtcctcccctgcctggcagcccccgtggccagcagcatcccgaggccaggccagacctctacggcccccactgcccacagcatgctgggccatccctccaatgggcttccttgctggggataactctgaggcgtgttctatgcccaggaggctggagcccaggtatcctcagcggtgacctgctcatctatgcagtcatttttggctgccgtcctgtccccatctcatgtccccactcccttcctggtgcttcccgctgtcacctgcaaagtaaactccctactcccaaatccttgactcaagatctgtttctggggaaaggactagaatagaacacacccttatcctaggtcgtgtatcggtgtacacatgtgacatgttgccagcaaagatgcgtttacagagctgtggtgtgagagcaggcatgtgctagcatgtatcatgtgtgtggtgtgcatagcacatagcactgtatgctggacctgttctgggtactgtgcatagactaacatctgctggaccagggaggcagaatgattaggcccattccacagatgtggaaactgaggcaaggatgaatccataaatgtgtgccttaggggtggagccctggcaggagctgggacccaccctaggaggtgagaatttgtgcaccccctcagcattgctgcactacccaccccaagccctgcagatgctggcaggaggctggaggtggaagcggctgcattcatcttcagaccccatggagcgaagctgccgtcccccatgcctgcttctggccttgcaccccagcgactgtgtgcatgcgcccttcccaggatgcctggcccccagatgctggccgatcatgtggcctttgggctctggattccctctctgagcttatttcttcgtcttggggcaaggatagtccccagcgtgtctcctggggttgtcaagagatgcacaaaataggtcctttcttcctgctccaggcatgagaaagcatttcctggccatctcagtggccacccacctgctttctgagcagacattgctggtcacacctctgctctgggacaaatgtcctgctagatcccagctcagagaaagaccatagctccaggtcagtacagcacagcaggggccaaacaggggccagacaccagggccctaccccaccactcctgggtcccatagcccctgcctcctcacagcaccaattagctgccaccaaaggaatgggagagaggcaggcaagagccacatagtcagggaaggcttcctggaggaggtggtccaagccagacttggagtgactgtggtgtctcctagagacaccagggccaacgtgcgtggtcaaatcctaggtctctatttccacagccctggaagtcctgaatttctatcccagctttgccatggactggctgcgtgtccctaggcacagcactcatcctatccgagccccagtttcttgcctctatcaaaagaaactggtgtgaatggaagtggcatgtgtcacagtgacgagtgttcctgacgcacagcagttgcgcagtcccagtttactggggttggaaagcgtgtgtggcagtaagaggtccgtgcaaagcggtatggggtcagaacagcctctgtggggccccgctcgctaccgtctagctgtggggtgcctgagtctcctcactgtgaaatcaggccatgcagagccacctgctacctagtactagagggagtgcaggaaaaagtgcagccagtgcttccagacccttccctgtggcctgaagggctccccaccccacctgggtgggctgcacatgcaaaggccacctgggggtggggagcaagctcctggcctctgagcggcctgccccaccctgtccccttcagagctcatttccctgcccctccctcctgtctcctcacaccctgccttgtgtcctgggctggggactctgctcttgtttccagccctgttgaccctcagctggcctcgactccctcctcccgggtggtcacacagtccctcctgtagccggaatctcctgtgtttctccggtttctcctggaatgtctgtctcccccgatctgtgaggagccgggcacagggctgaccacccttttcatgctacaccccgcacagagcctcaaacgggtttggtgctcaggaaagacttgtttatggaatgaacggggaatgaacaagtggctggatgggtgggcgaggggccaggctgccctgtcctttcccgacaaggccctggccctgagctggcaggtgctcagcccttctccctctgatccagcgtgctgagctgttcgtgtgctagggatgcctttgacatcctccttctcagaataacacttttgagtgcaagagagaacccatatagggccacagaggaaaccagaaataagtgttgcagtacttatcaaaacattcttttaaaatgtgtgatctagtaattagcatgctgttgcttatgagcgccctaactagcaagacccggtggcagccgtcctactgactccatgggagcagggaggagagctgtgcagctccagcggtctgcattgctatagggcctggggtgagcccaggctcggtgtgtccagcatacatttcacagagaggttgaaggcggggaagttgatgatttttcccccatcaagttcacaaagccctggcttctgtccttgggctctgcggcaggacctccgggaacctgctccactgtctcggggactgcaaagcctgcccctgctttgcccggcccccttgccttgcccccagggtccttgggcagccctcctgggggtctggggaccaaggaagggcatcccgactgtgacctgagctttagtttcccagccatggtaggggagaagtggtcggggttggctgcatccccaggccctcacacctggctgttgtgtgtgaaatgcccaggccaggcattgtgagtccccaagcaaggccatagagcagagaggatttcccatcacccccaggctcggctggaaccctcctgctggcctggcagaaagctgacatttcctgccctgtgggccgagctcagagctcagcaggggtcagagagtgacagccatgctttcttcctgcaggggccaccctgctgtgagcagttcataagggaggaaggtggagacgccctgttcccaagctatggggcctctcatttgacaaatggggaaactgaggcccagaggggacagggaaggggtggtcccatggtgagctgaagctggagtggccttgggtgggctgcagtgctgcctgccgtcttgtgattcagactttaaggactctagagcactcttggggcacagggacagaatcctagttcccaatcccttaacttcccccagggacctggttctgtgctgaggcccctcaacgcagtcagacccaggttctaccctcaggagacccttggcctggtggactcagaaagaccggctgcacccagcatggtctggtccaggacagagggaagcacaaggggtggggcttggaaaggggtgttgaaggatgcataggagtttgagggagaatggggaagagagggccttgggtagtgtctggcatgcagcttcctctgagcgccatcgacgaagaggtgctcccatctgcccagcgtgctgcgcgtcctcggccaagtcccctccctttctgagctgtgtgcttctgtctcgccatccatctgctgtccctgcctccctttcccccacctccctggcacactcacttcagccccgctgccctcccctggcctcagcctcaaggcctttgtggctacagttcccacttgaaggagtaccctcttccctcattctcttctcactagctctccagatgtcacctactcaggcagtcttccctgacctctggaatagtctccacccgtctctggatttactcaagttctttttttttcctcagcctgtttttttttggtctgtcttgccccagcagcatgtgggcccccaggcatgatgtcagcacatagtagaggctgggcagacgccgctgagcgtgtgagtcaatgctgagtgtgattctggcagcagtgccaggccgtggcgcgctcacagatctgaactgtaaatggggcctggggcagagcgataggctttctggaaggcctaccctattttcctggactctacatctctgaggtcagcctcctgcccatggtagggtgaaccccagagccctgagagtctgtcaggccctcccagggaatcttctgtacctgaaataaggccagatttacaaaataaaagaaggaagctaagaaagcaactgtaacgtgctcccctacagagagcagacaggttatggggggctgaggccctaatcctggctggccctttgtgaagaaataaatgcacccctcaagctggggacttccttgctgggagcaaggcaggcctggagggctcactgaggggttggtggctggattacagagggactgaggcaggacacctgggtgctaggcccagctctggctcagactggtgaccttgggcatggctcctctctgtgcctcatttcctcctctcaaagaagcttgggccaccccacctgggacttctgtgatgcagtgagcagaagccaagtactgggtcctaggggctcaagaaacatgctaggagtactcacggaggagcaagggacttggggaaatcatggaagacttcatggaggaggcatcctttgagcttggaggatgcattgcattctgagaggcagagaaaggcatttcatggtgaggggcgagctctggctgaggctctgaggtgtgggacattccagagacattggaagcccaaccctagctctctgctcattcctactgtgtccttttttcttattgattcataagaactctttatatattaagcacatgggtccgatttaaacaaacacattatttttcttttattttacttacgattggttttgacaacatcatacatatttttatgttggcaaatttcccagcctttcctttggtggtctttctggtcccaggatgcttcttgtgtccttaccttgtgtccttgctctcctgtgcacatgctggctgctcaggacatgtctgagactcaaattaagttgaagctggaaaatttacagctgtatgaaaatcagaagccagggtgcctttgctgacctgtgcctcccgctggggttcctgcccatcattccttcttgcttggagtggggtccagctgaggccctaaaggggcctgtgactctctgcagggtgaggcagaggctcatagctgtgatgaagggagagggtgggaggacagggagttcccagctggccagtctccatgtattcactcatggaaaccccattgcaaccacatgagataggtgctatgattagttccattttataggtgagaaaactgcggttcagagaggttatgtggcttgcccaaggccacacaggaagggatggagacaggatttgaattcatgccttgttgccccagaactcttatagtttcaagctctcttatggcccttgggctccccattgcctttgggatcaagtctaggctcattaatatgacatccgaggcctcctggggtgatgcctcggcctctgtgcctgcacacgctgagcttccctgatatgatggtggcaaggctgtgcccatctcttcacaccttccccacaaaccccgaatagtttagatcctggaatggagggctggcagggcttctgtggagtagctgggccagccccctggtttgcacacagtcagggtgggtcttgcccaaggcctagtgcctggagagtgaagctggaatctgcaccaagactgcaggactctggtgctcctagctgtgtcactgtgctatggttggtctcaggcggggttctctcccctgctgctcgctgctgcctccccactggcagatactcctctaggaagcacccctcctgccactgggttagacacctcgcctgggctcccgagggcccagcgagttgtgactgctgacttctcaccgtctgccctgtgaggcagggtgccccatgaaggcaggcgcccaatgcttcctcttcaagtcctcggtgcccagtgaggacttgaagagggagacccagagagggacagagccctgctccaggtcacacagcaagttggggcagagccaggagtcctagaagggccccaagaccctccaggtctcccctgttcctaggacttaacggagcccagggatggggcagtgtctgcgatggccaccccagcagagggcactactgtagggcctctgttctctgcttctcccaggggcctggggccaaggacaccctctctccctcctgcccccaccctctgtgaagaaggatgttctcaagatagaaataccgtcagaaacattccctggtgtttggtgtgactgtcgtccactctgtggggccagaaccttctgacctggcctcacctcagggcttaagggtggacgtttgccttttctggccgcttggtgcagcctctttctggggtccatatgtccagcccccatctttacgccacggaatgtgaggggtcagtgtcactcaaggttcctgcagcttccactttctgagcatcctctgtgggccgggcgcatcccgagcatggaacagcgaggcagatcctgcccttgtgcgttttgtggctccttgcgggccaggggggcttctgaggacatccagcaggccacagggaggcttgggcacagccagctttccgtcctgttgggaagcctgtttctgctttcagtgcccacgtggtgtcaggaacgccggtcacagtgaacgcctgcaggacccacactgctgcatcgtctctgtgggacagatactgaagccagggcttggcttacccttgtgacagtctcccgaggtgtgtggggtctcctcattttgcagatggggagtttcaggccccagtgagctggggggctgccaggcctctccagggagggtgacagctgccacctcccagagacccgctggggcgaggcccagtgcccggactgcagcttcgtcaccaccttcaatttcatggcacaccctctgagaggcctggcaggcgacaccagcctcgtttttcagaggaagctgagcctcaggaaggggaagtgccttgccctgttccgtgggggatttcagccccagcctcagcccaggccctgccctcccctgcgggacgctgtgggccagcccggcctgttggccctcagtcgtggtcatggggaagcactgcccctgcagcccacctccccatccaggattgtgaccataaccccgggaagcatttgtgggacttggcggggtgagctcacatggcggctgctgtggcccctgcaggtggcgggagctctggccagggcatgtggaaggctggctcctgtttgcagggtcctgccctgcactgtgacttcaggaaagtctcttctctgctctacgtctcagtacccctgtgtagaatagagctaattttgccttcctcctagataagaacaaatccagctggatttgtggtctggggaatgccccttccaggtagtagggagtgagggacgaggttgggagagcctgctgcaagccaggtgaccagcaggacgtggataggggctgctgcccacacttctggcccccacccctgcttggcttcccatggccctgtggcaatatccgaccttcgctgctcagagttccagctccaggtgactgggcaggtgacttagcttctctcagcctcagttttcctatctgtccagaggggagaattgtccctcctccaaggcagggctgtgagcatcgggatgactgcagccagctgccaagcatgcagggcttgcacagtgttggcccactcggggaagggggtggacccaagtccctgccgtggaggtccccagctgtgtgatgttggcttgtgacagaacctctctgaacctctgcagctcatccacctgtccatccatccacccatccatctctgaacctctgtgtccccatcagttttgaggatggaatggctgagagaggcaaagtgtaggcctgtggcttctgctcccagaatgatgagggatggggaagaaggggctggggattgggggacttggagggtgaagagggactgaagggccactagagaccaggcaggccatcccatttcagaacaagctgagagaggggaagtgactcactcaaggtcacacagcttatgaggggcagagctgggatttgaatctaggtctgtgtgcctctaaaccactgtcacctgtcccaggaggctaatgaggtgggggtgacttaccaacatttgccttaattccagccagaaaaaccagtgtgacaaaccagccttggctgtaaccttggaaagggcaggccccatgaactccctggctgggaggtgcggaggtgagaagcatgtcaggtggctcaccgtggagatcctcagagccccttcccaccaacctcttctctgattctcacggcacactggataggaaggcagggggatccctttgacaggtggggaaattgcatctttgggattgcagggaccatgtaggatgtatgtgtacccaaggcaaatctctggcaaattactgatgtgtgcccatccacgtagttagccatgtgcccacctgctcatccatctagtcatctatcctactcgcccaaacaccctatccatccatctacccactcatcacccaccctcacacccatccacccatccatctatccatctacccacccatccacccacccatccattcacccatctatccatccatccacccttccatccctctatccattcatttctctacccacccatacactcatccacctgtccatctatccacccatccactcatccactcattcactccacccatccatcacccaacattccatccatccatccatccatgcacccatcacccattcatccattaatctgttcatccacccactcaaccatatacccacccatccacccagccatccctctatccattcacttcttcactcacccatccactcattcactcacccatccatccacccaatcatctgcccatccatccatcccattcgtctatccatccatccacccacccattacccatccatccatccacccatccatccatccatccacccattcacccacctatccctccattcattcatctacccatccactcagtcacccacccatctacccttctgttcatccatccatccaatcatctactttcacacttatccatccatctatccaaccatccatccatccatccattcatccatccatccatccatccatccatcctattatccattcatccactcatccattcacccattcatccactcatccatccttcctccatacagccatccaccctcacacccaaccactcattcacccatccatccatccacccacccatgtattcattcatccatctacccactcatccatttatccatccacctacccattcatccctgcattcatttatccacccacccatccatcatccatccatccatccatccatccatccacccattcattcatccacccacccagctattcacaactggctccaaggttggcgttgggaaggctctgcaggtggtggctgggagtacaggctgagggcctgaattcctttgtgacagtgggagaattaccacattaactacttctctggaatagtaacaacaatagttccaaccttgtgtaattgtgaggattatgtgagatgatgtatgtaaaatgcctactatagtgtctggcatgcaataggcactcaataattgtcagcggtcatttttctctgacaccccatcttgttctgctcttctctggttctggatggttgctatgctgtgaaggtgtggggcatcaaaggtgcaggccagaggcccttccacctcctgtggggccctggggaagtgagcagaaatgtggtttcatgtggttatgtcttacttgtgagcccctctgagaagagcagcaccgcctgcagtaacttggctttactcttttaactttaggatgttctagtgactggatcctttccagttggtgcctgggaaatggcagccactactaattcagccttgaagacagtaccgtgcccactcagcaccattacatagaagatagaactcaagaggtaagagtgaagtcattgacatgctcttgtgcatctaggcattccttccaccagactctcatctgtacatccttcacccctccacccaccatgccatcctttcatcacccattcccccacccatttatctgctcagccttccatccacccacccatgcctccacccctccatccatcccctcgcccatgccatccgttcctcacccattcccccacccattcatctgctcaaccatccatccacccatccttccacccacctagccagtccatctatctggtcacccctatcgtccacccacccatctgtcaacccgatttatccacccatctgcctgaccacccacctgttgattcaatcactgttccacccatctcctcatccatcccattcagctgcttagtccttcacccttcatctggctggagcgcatttcctgggtgcccctctttgctatacctgcatcagcctctctaggcctctgagcttggtcagagatggggcctgggcaagatcaactctcacacaaggtgggaagtagcttctggcctgaacgggaaaagcccagtgctagaggatcctaaagggggccaggggaggaggaggaggtggaggaggcagaggagaaggcggctcagtattgtggggcagaaggaggaggaggaagagcaggaggagacttggtgtggggcatccaggaggggaggccagggttcaagagcctttgctgtggagaggctactggagaccctatgaggaaggcccaggagacaaaggttccagcgcaagtagtttcctgggaggtgatcccaggaaataaggaaatgaggtgagaaagagaaggaagtgataaagggcatgtcattgatacagttactgctggggcactggagccgactcccgctggggaggccagggaagcagtgcccctcccaggggcagcttgctggggcccagccacctgctcccatcagtcactgactgaaagctgtcctggcagcatcagctcctcagcctgccctctgaatggcagagcgtgcccatggctagagagagcttttgggcagagagacactgtggttggtgtaggaattgagacaggtgggcctgaggtggtaagggcctaggatatcagtggggcacccaccaccccatgccctgcacacagtgatgtgttgctgctgcctctctcctcaggcctagcctgcatttggcataggaagccgtcatggcattggacccaaatgtttgagggccatgggttagcttcgtggacagaggtcagctgagtctctggtggggaggtttggcctggaaaggggattgggtgtaagaggtcatcatcttcttcccagattatgagacataggaatgccacccaccactctccctctcccctccacaccagcctgggttctcccccatccagccaagcttcctcactgcccccagggtgcccaacacgtctttgcctcccactcctggctctggcagtgtcccccaggagtgcccctcctggctgcctgtgcccagcctagccttgatgtggtcctataccctgggcagggcctgccatgagggagagcccctaaccctgcagccagccctgcctctcacaccctatgtgacggagcaagggcaccggctcagagcctcagtctccccatctgcaaaggaagggctgggctttccaggccccagtgctgcatctgatgaatggtgcctggattaggaaagattctgagctgctctggatgcagtggatgaagctctgtggctgaggaatggtgcttgcctgggcgaggctggagcaggcaccttgggcggggaggcgtgcgccagccttccctgcattgagtgatctctgaggggtcttccaacggtgaggcttgatcatgaggtagagtgccccatctccgaatgagggtgagtggccgtgggttggagtgctggtgagggcccttgaacctgtgcttttgagtgccgatttgcagcagtctacatctcatcaccacctgggactgcaggggcttgggaccaaaaggattgcagtgccacgcacacagtcaggcctcaggtcttggtgttgtggggcactggtttcacccctacagcccagcctggaagcttcactcctgaaaggctgtgtaaccatcacagtgactcaatcttcctaggcttccgtctgctcatctggaaaatggggataataatcacagtgtgatggaagggattaaatgaatcagtttattaaagctcttagaagagcacgtggcaggtagtaagcacttgatagatactgagtgctgtgttcgtgcctcgtgaggcgccccagctagctgaacagtctctgcatgggggatgggggctgttggcgcctccccctccgagtccctatgtcttaccctgggtgatgcaggcgcctgcactctcccttccggtcagtgctttcttggtgtctgggaatgtgggtccaggccttgccctgagctcctcccggatgtcaccgaaacctgagaagcccagggcctcagggcagtgggcatggggcatccagttccatccggaagcacctcccggtgactcctggaccccacccttaggtcacgtggcagctgccgtctggcatcctctctaaaagctcccagcccaggtcctggtctgttcttcaagtggactggtcgctgggaggctgcgtctgtaggcactgtggccagcaggaaagcagggatctccgggggtctgccgggcccgtgctctctccccactgcctgctctctccctcctgggtttgcttcactgccccttggtgttgaaaccgccttgtctagctcaggtagtgtaccccagcgcccctctcccattcccctcccggcgaccctgggaccctggcaggccaacctgggtgtctgcggaaaacggtcctacctttagtagtgagcaccttgtcttggcccttgaattgctttgtgacctgggacaagtctctttttctttttggacttggttctcccatctgtgaaatggggagccagccttcttgcttgctaaggcctcttccagcaaaacagtttctctgatttcatgtcttgtctgatttcactgtatgcaccccattgagcaagagccaaaaaggcctgtgtgtccctggtggaggatattgtcctatatttcttatattgcgaccttgaaggccgcatggttgtgtaacatcttgccacacctgtgtttacgcaggagtgttcttgagacattgtctagcttgtggtgctagggtttctatgccagggtccccttctgggtctgtctttgtggtgctgtattcaccaagtgcccagtgagggggctcccagcacccctggggagggtttctctctctctctctctcacacacacacacacgcacacacggcagagcagggctgtgtgaggctgaggactgacattctgggctccaactctctcttctgctcagtttccaggggtcctgggacaggtgtctttgtcagtttttggctctgagaaatgagggagtggggcatgaacttgaccttgttgatgctctctgtgtggtaaaaccacgcagagaggaacgtcgacagaagtgggggtttccaagcctgtatgacaccatctgggcaggtctgcggtgcccagccctggcagagatgccaggagctgtggcagcaccctcaccagtctggtagttggccagtttcgaggccgccagctgctgggagcacatgcagaccgggctctctggcctttaattcttgtgattctgttccttgcaggctttgagctgctcggagcaggggctggagcagccatgacccgctggaagtccctcaaggcccctgggccacacaaatccagcccctgtcagctggtggcctcacgccggcgtctgagtgccccggccctggctgcctctttctggagggtccaggaatctggggctgagcccccttcccagcacagcctcaggggtcccccctgctgccggctccctacttccaggcccaggcagaagcagtgtccaccattccggccctgcgtcccagctcctcagcgtcatggtgaggtggtcagccacagcggtgttgggggaggacggcagagtaaggaaaggcatccctgcagagcttgggggcccatggtgggggacggcgctagaggtggtttaaaactcaactctcctgcttaatggctgtgtggcctgggggaagtcacttaacttctctgaacctggatggtggctgcacccccgggttgttgagaggacgatctgagggcagctgttgatggatctgtcccccaaggcgcccaggaccccgcctgctctccctgtgtctctctcaggcggcagttgctgtgtgctgctcggaccagcgggctcggggctaagcaaccaggcagcccctgggagtgttccacagcctggccgggcaggcggctccaccatcacctgttgctcaggtgtttggagcagagctcagaggccgcacccgctccgaggcccagactagtgtggacgtggccagaagctgggtcacacagaccggggctgagtcctggcattgctgcctcctgcctatgggactgggacaagtccattctggcttctgggcctccaggtccttgtttgtaaagcagggtggcccacccctccctggagggcttgagaggcctgcagaaggctgtgtgcagcgcctggttcacagtggtgccatccccccaggatgttctcttggggcctcagtgtcttcgtaactgagtaatgtggctgcaggtgtgctaagggagaaggctttgtctagctctgaggttatggtgtgactggactgggactgggggtgctgggtccctgtgggcggggaggggtgggcctgtccagctcctccgtcggggctaatgctggaaggcccaggtctccctgcttccagcctagcccagccaaggcaggctgccatccagatgtggctgtgggccaggcggtgccatagcccctagcttgcagatgccctagcctgtcactgacaggccagtgtggggcctttagtgggggcagcacagcctgtgtgtcccgggggtgggcacgtcagtggctgagagcaggctttgttctggctggcatggatgccctgctgcggggcctgtcctggggtgcctgaatgtgcagtaggctggcctggagccaggtgctgcctgcagtgagctgagggtggtgctgggaacaggtgacacccctgagcactgcccaggtgctagggtagcagccttgcaatcttccttagagatgcgggaagcaggggctggggagggccctcggctgaggtcagccagggagcagcccatgtctgggtgccagatcttaccctctttggcactgctggtgaccaagaagctgcaagcatggcatgtgggtggacactgtagagtggggcatgtgggtgtcaggagggtggtgggacccagcttggggtgttcaaagtgggtggcgacaggggtggcaggccgcattctaggccctgggaaggacaacaagaagcaaaagagaaaacgtctcacgcctgtaatcccagcacttcaggaggccgaggcaggtggatcacctgaggtcaagagtttgagaccagcctggccaacatggtgaaaccccgtctctacttaaaatacaaaagttagctggatgtggtggcgggcacctataatcccagctgctcaggaagctgaggcaggagaatcgcttgaacccaggaggcggagatggcagtgagctgaaatcgcaccattgcattccagcctaggtgacgagaggaagattctgtctaaaaaagaaaaaaagaaagaaaagaaaaaaagaaaatgtgctacccttagggagtggtggtctcagggtggggttgatggttgagtgcccctggctacgttattgttattgctgccgccattgtgcccttagaaggggcagtgctgtggatatagcagggatgggacatgggtcttcctggggcacaaggaggcctctggtgccaaggtggcgaggcagtggcaggatgtcttgcgggagggtgtccagggtgggtttgagggacagcctggggccaggggctgtggccggaaggggagtccgctggaggaggctgggaggtgaggtccgaggggtcaggagcttccctgtgcaggtcctgcatgtcctggggggcctctggcattgagcaggggagggataggcaccgactcagcttccacaggccctctgtggctgccatggagactggggggccatgggcagaggcagagaggctggcaagttgtgccccgaactggctgggcaggcactgttagattcaggccttgagggtgggagaaggggtcggatcctaaatagactcttcagagccctcagtgtgggagtgaggtgtggagctgaggtttttggctggagctgctgggggcccgaagggggtggccattcgcactgggaaggcggagtggggagctggcttgggcaagaccagagcacgatcgtgggtcaatcagggtggaagcgtcctccagtcacgtctgggggccctgggatgggggtagaggagcccggagccaccagcccagccagacatgctgtcgtctctgttgcaggagccgccctgcctggagctagcctgggggcgagccagggtcccccaacccccgggatgaccgcggccagccgggccaacccctacagcatcgtgtcatcggaggaggacgggctgcacctggtcaccatgtcgggcgccaacggcttcggcaacggcaaggtgcacacgcggcgcaggtgccgcaaccgcttcgtcaagaagaatggccagtgcaacattgagttcgccaacatggacgagaagtcacagcgctacctggctgacatgttcaccacctgtgtggacatccgctggcggtacatgctgctcatcttctcgctggccttccttgcctcctggctgctgttcggcatcatcttctgggtcatcgcggtggcacacggtgacctggagccggctgagggccggggccgcacaccctgtgtgatgcaggtgcacggcttcatggcggccttcctcttctccatcgagacgcagaccaccatcggctacgggctgcgctgtgtgacggaggagtgcccggtggccgtcttcatggtggtggcccagtccatcgtgggctgcatcatcgactccttcatgattggtgccatcatggccaagatggcaaggcccaagaagcgggcacagacgctgctgttcagccacaacgccgtggtggccctgcgtgacggcaagctctgcctcatgtggcgtgtgggtaacctgcgcaagagccacattgtggaggcccatgtgcgcgcgcagctcatcaagccgcgggtcaccgaggagggcgagtacatcccgctggaccagatcgacatcgatgtgggcttcgacaagggcctggaccgcatctttctggtgtcgcccatcaccatcttgcatgagattgacgaggccagcccgctcttcggcatcagccggcaggacctggagacggacgactttgagatcgtggtcatcctggaaggcatggtggaggccacagccatgaccacccaggcccgcagctcctacctggccaatgagatcctgtggggtcaccgctttgagcccgtgctcttcgaggagaagaaccagtacaagattgactactcgcacttccacaagacctatgaggtgccctctacgccccgctgcagtgcgaaggatctggtagagaacaagttcctgctgcccagcgccaactccttctgctacgagaacgagctggccttcctgagccgtgacgaggaggatgaggcggacggagaccaggacggccgaagccgggacggcctcagcccccaggccaggcatgactttgacagactccaggctggcggcggggtcctggagcagcggccctacagacgggagtcagagatctgagccaaccttggccgacatgcagcatccacccccggctggggagaggccccgcggtcgctcaggggccccgggtttgagcagaacgggcccagtgccctgggttgcagactcagtagcgttttagtcgttttatgtttctttgcaacggcctcagaagtttggccggagagggggcagccagagcggcagcccccggcctcagaggctatcacaggctcagggcaaagaagtggcctcctggggggccaggccacgagggccagggcttctgcctgaagatggagctgcagcctgcggggaagcagctcagctcgatggtgggcccagcctctgctgtccaaggctggctagctgcggtgctccttgctggtttttaacttggggagaaacaccgggtttcagctttcttgaccttagcttgggtgagactgtttacaaaaaaaaaaaattaccatgcaattgaaaaaatttttttttaattcacagggggcaaaaagaacaattagaattccatgggtctgccaggatgcagcagctggctgaaggctccagagggttccccgaggtgggactggcctctccccgtgtgtgtgggcaccacagtccctgggcaagcagggtgctctgggaccgcacttcatcgagctcacgagccagctaggctctgtttgtgatagaaaaatcaagaccatgttaatgatcgtaataaaagctttctactgtcgttggggtggtgggtggggctgggaagaaactggtttgagcttttagagtttgcctttgtaccttagagatgtgtctcagggccaggcatgggacctgccatcgagggttcctccccgcaccctcgattttcctgttttgcttctctctccatttctgtccaggcctccgcccaattccacagtgaggggtggttaggagctataggccgggatggctccttgggaagggaagtcgggatcccaggctaggaggaagctggcagccccgtccccactgggcccacagtgtgagtcgtgccttagagactccgggttgtcctgttctttctgggcttgctcatctccccccaaccctgtcccaccccacccctcccatacctccactgctgaagttcctccagcccctctgtctgccttgtgaaggtggcaggggccaggtctgcctgacataggaccacatcctgtccctccctcacctggagcagcacagcagagttcaggcagggcacagccaggccctggtcagcgctgaatggcagaggaaagatcttaggaaaggagaggaatcgccaccccctcctgccaactgggatgactggggagggccacgctcattcaaagctgaatcagaaaccagccgtggaacagaattcctgccgagtcttccagggccgctcctccaccaccctcccccaggttgaggcactatggcaccctcatcaggaagaggtttggggtccccttgttgtcactgctggctctgccaccccatcttgttcatggcagctggttgggtcaggtccatggtagagccaggcccttcccagggctgcggagaaaacctgctctcttctagtcgggcttctccagaagccagtaatcagaaaggatgtgtctcctgctccaactctgcccccgagacagctcagagccagaaggcaccccgagacagctcagagccagaaggcaccccgagacagctcagagccagaaggcaccgaggactctggcccaagtggggaagctgaggcagagagcagagggggtcatgcagtgagtgggtggggtgcaggagacagagaggggctgggggcgtggggtgggggtgtctgcctcttccctccacctcctcccctccttagcagctgaagactcagccctgaggtctggggcaatggaagtcaagacacccgacccctacatcctggggtaggcccgactcagcatcctgtcccagcttcagccccacactcatttctggcatagaagattccgccgaggcagctctttcctctcggggtctgccaggggtgcctcagctggttcctgctcccaggcctagccccgaagccttaggggccttctcagccttagccctgggtactggggtgaagttggcaggggagagcttgacacttcgcctccctgatggccatgctgagggacagtggtgaccctggtcacttggtgctggtgtaggggcctgtgcccttccagggccagtgagacagccttctactcccccgacccagagctgagtccgaggaccccaggcccacctcctggccctcttggaggtctgtgctcttacctcccagcccccaccctgcgggagagcagccccagcgcctcatctccccaaaggcggcagatgcttgattctcctgccctctttcttccttccctcgtatttatttatttatttattgcttgtgctaaagaccaaaatagtctccctctttagtgcacttgaagcgggagggcggatgggatgagccaggagcgaggaagacttggcccctggggagtgtgtgtgtggaggcgtgtgcctgtgtgagcctgcatgcatacatgtgtggtgcacacatgcacactcggctcttcatgtgtatgactgggttagtaatacagatacgtgatctatacgtgtgtgtgtgtgtgtgtgtgtgtgtgtgtgtgtatgcaggcggttatgtgtctgtctacccccaggtgtttccgtgtacaagtttcctgtgagggagggcacccacccatcaggttgggcactggcacaggtgaaccccacagtccccgaccctctgccctgattatgcacgtctgctcctgagtggagcttgtgttccaggatgagacatctggaggtgagcgtgtgcgtccggctcgtgtgtaggaggctgtgtgtgtgcccatgtgaaaccgtgtacttgagtgtgtgtctgtgtgcagcctatgcctgctgctcagagcacggtggccaccccctgagcctctgctggtgctgtgctgcgtggtccccacccagagggtcctggggggcggggaggagccaccgttgggaggcccctgtacggggtgtctgccctgcgtgagggcatagaatgtcaaattattttaaatggtgaaactggagagttttcatgttattttcaatacatagcagtatctaaagacgtaggcgatgagactagaccacattaaatgcattttgatctctttga

SEQ ID NO: 12 - DNA, 303800 bp, Homo Sapiens
gtgcccctcggccccgcccccgcgccccggatatgctgggacagcccgcgcccctagaacgctttgcgtcccgacgcccgcaggtcctcgcggtgcgcaccgtttgcgacttggtgagtgtctgggtcgcctcgctcccggaagagtgcggagctctccctcgggacggtggcagcctcgagtggtcctgcaggcgccctcacttcgccgtcgggtgtggggccgccctgacccccacccatcccgggcgagctccaggtgcgccccaagtgcctcccaggtgttgcccagcctttccccgggcctggggttcctggactaggctgcgctgcagtgactgtggactggcgtgtggcgggggtcgtggcagcccctgccttacctctaggtgccagccccaggcccgggccccgggttcttcctacccttccatgctgccagctttccctccgccagctgctccaggaagcttccagaagcccctgcgcgggccttggcttgcagcaaccctttagcatacttaggcagagtcccatatttccttcctgctggaggccaagttctaggggccttctggttactatggctggtgtttgtgtacatcataccctaactgtattcatcaacacttagagtaagcaaggctcgctggagagccacacacactgggcaccgtaatgtcggttataacaccgcagaggagttctgaactatgtatttcgcactcctgggttcatcatctcctgaaatctcagggtggtgtttgctctcagttgcttcagctgagtagctggctttctgtcctggaaagcagactttgtacatgtgtgtgcaacctatgcctgctgagatcatcatcagacagggaagcggcttggtccagagagctgttctcagtagaatgttaagcacagagagctgagaattagactggttatttacatagacatccaaatagaaacctatagagtatctgttaagtcaggctctcccgtcatctcccccatccctgggcaggtgtctaggagatggttttgttattttcagggccctctcaatggctaaaacactctgggagatgaacaagattttaaaaacccaaagcttagcgcacctggtgggtgggggtgtgaaaactttgaaggaaaccgcgtcaagagcctggctgattgttaatatcacgttaactcagagggccaggatacttgcccagacccggagtctgcctgcaagtagcagaggagagctggccttgctctgccgcgtgtctttcttcctgggccctctgtctcgggttggaatttgaatagtggagtagtgtctgccacagtcaggggcctggatgaagtagaccaccagtacggagctatactcaggtacttttcaatgtatatatcttcattaaaaaaaaaaaatctgggccaggcacagtgggtcacgcctgtaatctcagcactttgggaggccgaggtgggtggatcacctgaagtcaggagtttgagaccagcctggccaacatggtgaaacccagtttctactaaaaacacaaaaattatccaggcgtggtggtgcatgctggtaatcccagttacttgggagactgaggcaggagaattgcttgaacctgggaggcggaggttgcagtgagccgagattgcgccattgcactccaacctgggcgacgagagtgaaactgtcctgaaggggaaacaaaaaaatctgtatcaaaataaggatttaactaatagtattaggcactactttaaaaaggctttgctgttagtaaggttgaaagaaatagagccctaggtatacattgggtagcaccttgttcagctgctcagattcttgaaccttgttgaggtcttactttgatatcacctgggccttacttttcgttgtttgggtttcctccccaggtgtctcaatcagggcctcctctgtccttttgcagggaagaagggggtaggaagggcctgaaaaagaacttgccttccccattgccccctcagagtttgttcctctccagtcctcttcccaccctttcttaggacaccaaaaccctgactctttcagtattttataataaaataaagttactaaattgtctgttctgttttgcagaggacacacatttaggagccagtgattcagaccttccatttttctttttggtgctaatgctcttttcagtatattctctttgatagaaaaaaaatggaggcaaaactgaattttctgcattatcttttcctttagcattattcttgtttctgcacttcattctgacccccttccccagcataaagttccatgtccagatccacttgccctgagatttttgacttccgtttgggactctagtccctccaggggacacattgagcctcccagaccctgcagggccctgtgctcattcggctcttgggctgttgctacggtccttcctgaccctctgtttcctgggacaagtagtttttaatgcagctactttctgaaagagctggggtcttaccgcagaatattattttattatttttagagacaaggtcttggtctttcgcccaggctggagtgcagtggtgagatcatagctccctgcagcctcaagctcctgggctcaagcgaacctcctgctttgacctcccaagtaccagggactacaggtgtgcgccaccatacctggctaattgttgttgttgttgtttttagaggccagggtctccgtatgttgcctagggtggtctcgaactcctggactcaagtgatcttccctcctaggcctcccaaagtgctggaattataggcatgagccaccatgcctggcctcgcaggatattatttaaacgaaacctgaaggatttaaaatcagagaagacacataaaccatcacctgactgtggggtgagagtggtctttatatagacactcatgatgcacaagccagcccttcgccccactcttgttttgaagtgaaaggatttatatgggagggaggaggtttgagctgtgcaggagggtccttggttggcatgaggattttgtgaacctacgctgttagctctgcaggcctgtcttggacataggtaagtagaagttggagaccttgtgttgtggaccaaatgttgcaagatgtgtgttctgtggcttttcattaactgctgcatatctgctggttggtggacatagtctagttttcttttgacttaaaaaaattaacagtacagcttatatcggagggctgcatagtttgggggaaactaatgaatatagtatggaatgtaatgaatgactgacttcttcatagagctattgaagtgatttatgaagaggaagaaatcatttttgtgactttgttgatctttgaagtattagagtggctttggcaggtgtggatcacccggaaaggaatcaaacactgagtcctgccaaggtgctcggtcccggcagcaaagccagtcctcagcagcctgcgctcccgaagctcctccagctaagtaactgaataggccgccctgggagctgcccatgcggatgctctgaatggtgaaacttggttttgacaccacaagttgttttcagttaaatcagtggctcagcagcagagcagggttctccaaggaggcctcgtgtccccttcaccccacctggaggtagctgttctaaaaccagtaaaaaattctacaaaaacattttcttagggttgttaaattagtcatagtgtgtgtaaccatgaaaggaatggtgagagtgcaataaatgcctggtgtgttcactctcctactcctaaaagtttcttggtagaataatttcctacctgtgatgcttgcgaagtcagcagaggctcccacccagccctgccgcccattcccagaagtctgggctgggggacaccgaatggatagtccaccagcggcgtggcttgtgaaaggaggtacttgttaaatctatgtgtttttattatagacatcgttctgccagtcgcaataatgtgtttatggacatttttctgcaagcacagcgcgggtggcagtttttactgacaaattgagtcatatgcatagaggtttagaaagcgcttgccttattgacggatcaggcaattctggcacgggatgttcagagatatttaggtgggtgaagagagtgaatgaatctcagggcagagaaggagatggggcattatatgttgaaatgcaataaataatcgctagttatttatcatttgtttttaaacttttagctacattgtacttcccagtcaagaggactccggtgggcagccggggatatcatgttcaggtgtctctcctgcttgtgtggggtaagagccactactggaatgcgattccagcaaggcctgacgagtcacagccccttgaacctgttgctctccgtaaagtgggatcttcacaggcaacagtggaggagcgtttgagggtgacctgggccctctgcatcagaattactgtgggtgctggctagagaggtctctcgattgcagggccccatgggagacctacaggaccagaacctggggatgccaggggattctggcagaccctaatgcttgagcacctctagggaaggccttaggatcctctgggaagtagcactctccagcccaggcaagatccgagtcccccttccagaagtatccatcggcagttggcattgctgcaggttttctgtgcatatgggtctgagtacggttttgtaactcctgagagacgtgaatctcttcaaattgcaaacccaacatgttattattgcttttgagttttcagttttgtggttatgacaagatgcagatgttaccaaaactttggcgtcagttttacaaacacacgcgaagcacgggcaacccgtatcatatttcaccccttctttccttttgagagggttgtcttgtttttaatccccctctgggtcaaggcattttcctggtctcaggtgagggtgcactttcagaggcacagctgaatacattttgtgggactgaattgagcttttctacaggaagtgccaggccgtgtgtgggagtgatgctgtttcctagctgggtccccctgggcaactcttagccctccaggcacctcctcatccattgggtggggacgattatgcttattcggtctacccgggtaagtataggcacacgagacagtaaatacatatttttttaaaagtaaaatttctatccactacatggatagaaattttaatttggagctgagtctcacggaaggatgaaacgagaagacggcgaagaaccatttcgagccctcgttttccccccagtccaatccgaatctgtattttgcagatctgcacacacccaagccctcactgggggcatgtgcacggtggtcagaagtgcaccttctgggaacagatgggcttccgtttggacctgctttacaagttacaatcctgtgcccttgagcagagttacttaaccttccaaggccagatttctccaaaagcagggccagggacagttcccatccagaaggaggcctggcgctggggaggcctgaatgaaggcggttggtgtttgcggatgcagagtcgctctgttttggtggaggcaggactggaggtcgggatcacttggccacatttgccacctctggtgcgtctgaggtcacagtgcattgtctgtgtgcagcataaggtagttccctattcatttactaggtccctgaagtccttttgtctgtaaagaggctactggctctgccacctgcttctgtcttttcacagtagacattctcgacgtggcagcattctaaaggttcaggtgtgccacatcggcctagagtgggcaggtgggcttcatgtgtgctcctaggggcacttggcagttgctgatagcccgagacactgggagccttgacattattcatctgttatattgaaagaacttcccaaaggacggacacaggatctgacacgatggcagtggccaggaaccagcagtgacaccagcatgtgacagtattttcccatgtgtgacggccgtttagatcacagcagtgaggggtaacgcaggtccgctgggtaaacttggtcaaaaatgggaagtctgcagcatttcgtgtgtttgtggaaatgggccttatttttatttggggtgtctccttaatctcctgtcatggttcagctcaccctggtggttattctgggcgtgctgcgcttgttgccttgtacagaccaacttaggaaaggctcaccaccaccccatgaaggagaaggcgctgtgagtgtctttattttgcatatgaggaacccgggcctcggagagtttgagtgacttgcacaggtctcctgggatagaggtagagttttgttttcaacccagatttatttgataaccaagtgcaggctcataaccacttgtgccaggctggctttgcaacgatgagcctgagaagctgttagaagtcctttaaggggcaagacagggtgtaaacagacacagacctgtttatgtagctaatgttttctgaacatcaatgtgaccaagtgttgtctttagcattgtgggaaaagcaattcgcccaagtgtattcctgcttgaaggcgttgagccgtagctgaggctgggtgcagtgaggacttggggatggcaaagctgtccctgcgtgtgccttgtgcctaccccgcaccccactagagagtggaacgaccagggcagtggggccagaggaaagatgggaggatgcagagggccagccatgtcccgggactgtgcacacgcttcaccatgtccctgcaggccagggacccatgcctgattccctctgaaacatttgcgggactgtggctaccggtcaggtttctccaagtggcccaaggggtgggcattttgagcagagcagtgggactatggatgcgggtacatttggggacctggccatagttgaatttgagcagggtgtggcaagcatgtggggctggacaggaaggcagagctagccagtggggccagggcctgcggagcccaaatgctgcgctgggtgaagggccttgggagtcttgtgagtggggaacactagcctgtcagtgcttcccagagaagatcacggggctggcaggggactgattggggcagaggatgcaggatggtggcagcaggcctggcagggcggggacagttccaggaggtatagctggggtcaaccctggtggcttctggtgagagcggagcaggtgggagtcgcagagtgtggttgtgagggactaagtttagaatcgcttttcttattgagagagacgaaagccttggtgtgtgtgctttttatgtgagggaagccagataaaggatctggctttggaagggtagacaggccgccctctgccctgcctggcatctgggttctgaggcgggagatttcccgactgcagccgcgttcaggcgaggatggcagcggtggacccaggctcattaccattgctcccaccccagcctgtccctgttgggggcaacctgtacgtcctgcaggagtcacggaattttaaaaaccaaaccgtcaggtgttagaggtacagtcacatcagaatgcaaattagaaatagtgtgtgctggggccttaaacaccatgacgtgtttcgtgggctggtgcggctgagtgtgcccctgggcagcagagattgacgagggtggctgggcttcctccgggccctgggctcgcagtggccttgtcttcaaggggctccccgtgtggtagggagacgtgcttgtcacacccatacattttgtaggtactggtgagggctggctagactgaatgaggtgaagagcctggcctttgttggggggggtgttggggagcttggtaagtggttgaagatgttgaagaagtcccctctgaggaggtggctttcgagtggagatttgaacagtgagaggtggcaaggtctggggaggaggcttccaggggacgagtgagagctgcaggtgcctagatggctgcaggtcggtgtgttggaagcacagatgggaggtcctatgagggtcacggggtggggtggggagcattgaggccactgttgcaggcctggattcactctaggagtgttaaagccagggtctcagcctcctgcagttgtcatctagttaaagtcatgccagcagggcagggctgtgtgtgtctgggtgatgggggatcagatgagaaagtgcgtgccaccctcagcacagtgcatgagaggcgtgaggcacggcggatgctgcgggtcttataaggcctttaacgctcgaggggaagttcctagaataatgggcgaagaaaaggaatgatatatttctaaaagttactgaatttagctagctagcccaagaaaagcccatgtgtgctattctttattgtgcagaaaaattcgtttctgtcaccattgtgttatcatcagattaagctgtcgagtcagatggatgctgtggttgtgcggggtgcgggccgatcagcacactcccagtgcctctgcaggccgtcagcctccagcccaggccagcctgagaggcaggcgacgtgggaagggaggggcttcccaccaggacacaggaggttgctgaggaggttgcttccatggtgccacttctgaaataagaactgttccttggaaggaatgcacaggttctgaagttagtgttcttaaagttcaacgttatctaccctcttggccatagttgaccaccctgtggtcatccttggcccagcaagagcacaggctcttggaaagccacaatccatgaccatattcacagctgaccaaccatttgccaggaggcaggactttctgtgctaaaatggggatgtcccaggcagactggggtgggtggtccctgcctccctcggctctcattccagggtcctcctggacatcactgctgtcactttgccactagcttgagtccacctgggccttgaggcagaagcagtcgttgaattttctttttttttggttctccggaagcatgggcttataagccttcctgttgtattttgccatgagtgtaattagaacatctcccagagcctgggtcacttccctttagctggacatggcccccgctgtccttgtcacattttttggattgtttgtcactccagaaagccttcagggtcatggttctcacttcctcagacatttttctcttctgggtgtgaggatcttttgctcataagacttgccttctttgggcctgagacgcttctcccccagctgtggagatcatgacagttgcagcagacggcttcttggaaaggtagaaggctctggtgttggctgaggagaagcagctccgtggtctccaggggtgtcctgggttcccaggaatcccatggctcctgggggaaccgctgcctggggcagtgctggttccatggtctgttggggttcctgggtgctcacactgccccagcttagccggcgtgactcaggatgctaggacccatcgccaggctgctgggagtggctgggtggggaggtcagctctggcaccaaggccatgctggggctgcagggcttggctggaaggggtgctgccctgtgtgtcctgctacaaggggccggggaccctcccaactcagggtgtcctgcacgcccacactgcctccctcttctatctttaagacacctgggaagcttctggacatgtcaaacccacaccagactgagtggcagggtccaccacaggagtagcttagtgaagaccagaaatggttttgagctgggcactggcacagacagggtgagagccagccgcatggtcctcgcagcctccccgcctgtggacccctctctcaggccaggcaagtctgtgggctcgtgggaccccggcagtgctggcctcctgtgtttgggcctctgcatctgtgctctgccctgaggttgggtgagtgggggactcgtgtccctctcttcccagagcagcctctgctctatcctcagggaacctcttctgacccgatccccacgcagacatgctctgctgccctctctctcaatcttccccactctcacttcttccagaagctacttcagcccccacgatctctctctgtctggggcccttcacacaccactgttttctactagacttgtattgtttccatctcttgatggtgggatgctagattggatgctctccaaggcctggtgtgtggtttctactggatggaaggcccagcacagagtgctggacacagggtgctgtggactgaaccgtgtccccaagattcacaggctgaagtcctgacctccaatttggctgtatttggagacagggcctttaggaggaaattaaggctaactgagtcataagagtgggatcctactctgctaggattgatggccttggcagagaaagagaggatcttttttcttagaagagaaagagaggatctctccctcccataccgtgtgaggacacagcgaggaggaggctgtgtgcaagccaggaaaggagccctcactggaaacggaatcagccaggaccagcagctctcacttgccagcctccagaaccgtgagaagataaatgtctgttggttaagcccccagtctggtattttgttacggcagcccaggcaaaccaatatataggtgaattacagactaaagttgtttcaaaggcacaaaactcatcaagggattgtgtatgaagttggaatttggggctgaggataactttgtcatcagacagtgctccaaaaaggcactgttctcaggtttagctcttggcatcccaaaagatatgagtgtattgcagtaaaaaacaagtaacaaacagaaacccagatttcatgaccagaaacatcagtggttgtgggaataggggacagcaggcaagacaggagactccagaagccagcagaccatggaaaggcctggtgctgtcctggccctgggtgggcttgctctggtaagcggtagaggaacctgcgccctgatgggaaggagagaccagctcaaatgctgccagactgggtttttaaaaccagtctctacaggttcattgggattctttttgttggttggttgattttttccccccctccagattggtcagtatacacacactaatccagcctggttcaaaggacagcatgtggtcgtctggttggacaccagctacatctctcagaaccatactctttgctgcttttcaggctaagatagctctctgagactgtttggaggtctctgttgatttaggggccttgcaagacatttcttgctgaaagccccgctggcccacacctcaccaaattggcttatgtggctactgatggggggacatagaaaaggtagatagaaaaggttaaatttacttctgtctaactcaccaattcatgctgtggattgtagatctgcaaaatatatcaagttcacagggattttatgattgttgcaaaggaaactcaaattgtcagccttttcctgaaggatcttgccattcctaagctctggctatgcccctacttctggctggctgtggccttgcagtgcaggctggcactgtgcccctggcatctggctttggggggcccagctgtgcagggagcagatgctgtggtgaatacaggtgaagccagagtcctggcttggggaatgtgttctgcttcctgtagtgctctatttgaagtgtggatttcagttcttcgttatcttttatttatttatttacttattagcacagcttgtttgttgttcagttccatagtgagaatctctaagaatatgattaaccttgagggtcatcttatcctgtaattattaatgattgattctgtttatccttgaaatcaataagagaggcataatggtttggtctgtagttgggcgtgatttcttacatttcgtaaacacggttctgtgacagcagttgtatcagtttattacccagaacatgtttgatgaatctgaagtgtatgattagttttatataattattgtgatatgtagtgttccttacatgagttatgttaatatggcaaatagtgttaacatctcctgccactaatagttagggtggggacatataataattgatcttcctgggagtgctgtaatgtaaaaacaattcaggctgttggaagtatattttacaagtatgcgttgggccttggggatgttatattgaaaaacccaattgtacagttaccatgggaacccaattaaaatagattggttgatttttttttgtctttcatcttgaccaaaaatctaatgtattttaaatgttttcatatggaattgtagtcatatactgacttgctgtgccaaagtattctgctcgttttttccaactttaagctaaaatagtgaaaagttctcgagtggatccttatgagaacgtctcccaaagagaatcagtcatgtttttgtggaaaagtttgtgtgagtgatgatggtagagtggaggtggtggaaagcttttatgaaaaaagggagaacaagcattttcctacgagggcagacaagaaccctcatgttcttcctttggtggaggacatgagtgtgtttctccgttctcacgtttgtagaaggtgagattaggtccctaaagggccctctccgtgttgtggaggggttggggtgggggtggagtggtggggtgggatctgtgtttgccctccttgctgggggtcctcacattgtttggtctcagagcctttttgcacagttaaaacttatgagggatcccaaagagattacctgagttatatattaataccccattagaaattagcagtgagaaattttaaaatattgattcatttagacaataaacctattagctttttgcataaataacattttaaaataaaaactagctatattttccataaaaaccaattagggaggaatgttatcagtttccattttttaaaacttcataatgcctggatgaatagaagacagctagcttctcctgcttcattcagtctgttgtgatatgtttgggttgaagcgcatcaagagaatctggcctcactcaggtaagtaattaaaagggaatagtgttttaacagcttcctcagataattgaggatgttctcctttgacactacatcaggactcggcaagtggtaatttcctgagggtttgtagcagggtgcaatccgagacccgctctgtgaactttttgctctctatgacgttaaaatccacaggtatgccttgcactttgagtgattttgtagcgtctttcatcggccctgtggaaaatgttgcttcattgagttatacagatctttcaaatattgatgtttcctaatacagtcctaaaaataatatttgttaatatcaccacctttctccttaggaaagtcatttagtattgggaagccatggtggtgggtaccagtattctaacattttaatcatcacttgaaagttctggctgggcacactggctcatgactgtgattccagcactttgggaggctgaggtgggaggatcacttgaggccaggagttggagaccagcctgggcaatatagcaagatcccgtctctacaaaaacattttttaaaaagaaagttccccttttatcatcagcagcagatactgtcagttgtgttcattacaggtacagactattcatttttgagaaaacatccgccagatatgcaagtctgaataactgttgtttgtgagtcattcacactagcaaagcttttgttctaaaatgaagttggtaagttcatcagcagtctctgccatttgcggagccctcctggtggcagcgtcattctggtttgtggcagaagtgctttgctgcgcttcccgttaggtcacagaatgtttagaaggtcaagatttagtgaagtttgattgcttcctcagggcattctgaagtgaacctgcctgttgccctgaccgtgccttcctcctagagtttggtgtcaatatcttggcccttgcggaggcatccacggttttccccagcatggcttctgtgttgtctttcaccgtgcggtgtgtggtcagccatagtttgtgcaggtgccctttagcagatgggggatgttttactcttttctgcagtgaatatggtggataactctcattggtttccatgtcttcaaccaattttgtgttcctggataaatgcccacctggacttggtgaattactgttttcatagattgctggatttgacgtgtggatatgtttgaggattgtgtgtctgttcatgagaggtgttggtcagcagcattcctggagtgtctgtctgctttgttaggagggcaatcttgcactcataaaatgaggcctcttctatattttggattagtttgtgtaccgttagcattgtctcttctttaaatgcttcataagatttaccagtgaagccatttgtgtttgaagttttctttgtgaaaataacattaactatgaattcagttttttttagtagctatagggccattcaggtcatttatttcttcttgagtgactttttgggattttgtatttgtcaaggaatttgaccatttcatctaagtttgttgaatttattggcctaaagttatttttatattcctttattatccttttaatgtctgtgggattttgagtcatgtccttatttttattcctgatattggtaatttgcactttgtccccttttttgctaactggtctggctagaggtttatctgtttcttttcagagagccaactttcgttacttgatttttctctcttactgatttctcctgtttattattgctttcttgtgcttactttcagtttagtttgctttcttttttgtagtttcttagggtagaggcttagatcatttggttttcctttcttcttttctcatataaacatttaatgctaaaaattctctctaagcactgctttaggtgtgctcacagatagacatgctgtgttttcattttgattcagagtggcgtatttcccaattttccttgtggtttcttctttaatgcttgggttatttattagtacatcatttaatttccaagaatttggggatttaaaaaatatttgggtactttcccagtatttttctgttattgatctgcaggggtgagttaccttgtaatcagaggacatacctgttatgattttaatcctcctagatttgttgagagttgttttacagcccagaatatggtctaccttggtggatgtttgaaaagtgtatactctgtggttcttgggtggagtgctctttaaatgtagttgggtaaggtttgttgataatgctcttcaagccttctatatccttattgaattttgtttccctattctaaaaattattaggagtattgacatctccagctatgattggagacttattacccctttcagttctgttggttcttggttcatctgttctaagtgatttcattaggtgcatacatgtttagaattttaacatcctcatggggaattaacctttactcttatgaaatggccttctctagttttgttgtcatattccttttttgaaattatttgatattaggatagccactccagctttcttttgattagtgtttctgtggtaactgtttttccattcttttatgttgaacctgttcttgtcattacatttaatgtgtgtttcttgtagaaaacacagttgggtctcttgctttaaaaaatctaatctgacaatgtctttgtaaaattggagtatttagaccatttacatttaatgtaattattaatatggttgggtttaagtataccatctggctgttcatttgtcattcaccaatttgttctttttgcccttcctccatcttccgtagcttcttttcagttatttggatatgtttttgaatgattccaatttaacattctgtctacactgttggcttgttagctatctctcttcttttttagtggctgctttaggatgtgtaatgtacatacttagcttatgcttatcataatctgcattcatgtgatataatacaacttcacatgcagaataagcaccttaacaaaagtatgcttcaatttctctcatcccattttttgttatattattgctacatatgtaatattctccaatatatagagttactatttttatgttgggcaatcagttttcttttaaagagatttaaaaaatccagaatttacatttatttgcatatttactgttttttgaaatcctcattcctttgtgtagatcctagtttccattgagtaccattttttttacacctgaaaaccttgtaccatcatttctcaagtgcaggtctgctggtgtctgaattgtcatgcatttgtttttgttttttgaaaaaagcctttgtctcacctgcattcttgaaaaaatgtgaattctaggttgacctgtttttttgctttttaatactttaaagatgttgttccattgtgttctgccttgcatagtttctgatgatcagtttgccgtcattcttaaatttgttcttctgtatgtaatctggcatttttgccacctctggccactaaggttttctctttgtcacttgttttcagctgtttgattatttgtttttatgtttcttctgcttgggtttcactgagcttcttgcatctgtgagaatgggttacatatcccttatctgaaatggttgggactagaagtgtttctgattttggattttttttggattttggaatatttgcatagatagataggtagataaatagatatatagatagatagatatagatatagataccttggggatgtgacccaagtttaaacatggaatttttgtttcacatataccttatccacatagcctgcaggaaatcttatgtattattttaaataattttgtgcatgttacaaaattttgactgtatttcaactgagacctgtcatacaaggtcaggtgtggaattttccaattgtggcattgtgttggtgcagtttttgggttttggagcattttggattaggtgtgctcaaccttgttttacctcatatagatttttcatcagatttgaggaaatgtcactgaatatttcttcagatatttttcctgcctcccctttttctgaggctccaattgcgcatgtgctgcttcatactgtcctgtgtctccctgagccctgctcatttcctcagtctttttgtgtttctgtgccttgatagtttaaaaaacgttattttctcattgttgctattttttccttctgctgcatctaatctgtacatcctatcgattgtattttttactttagagactgcattttacatctctatatgctccatatgggccttttaaaatatcttctatttctcatgtcatatgtgggttctcctctatcttctcaaatatggagcatgtttataagaactgtttttatgtcccagtccccttgttttacgcatctctacttttctgggtttggttctgttgaatgatttttctcctgattgtgggttatatccctctgcttctcatgtgtgtgtgttttaaatgggatcctagacattgagagttttgttgtggagtgctagattatgttgtcttttaaaaaacagttttggactttgttctgctgcaggttcagtttcttgaaattgtttgtatcctttcaaggtatcatgctttttttaaaaaaaggttttgttagggcaggtccagaccaggttttagtccagggatagtttagtcctactatttacataatgtctttactttataagggtgtgtgtatgtgtatatatgtatgtgtgtgtgtattatatatatgtatgtgtgtattttatatatgtgtgtattaaatatatatgtattacatatatatgtatatatatgaaaaataaggcagctctgaggtctttacctgatgaatgttgtattaggagatctttccacactggctggtgagaacatgaaatattcccagctctgtctgtgatcaggaattatttgggctgctacttctgggcatctttctttgacctcagggagttccttctcaagcagtgtctcagtagttaggcagaggccacagggactcttctggagatgcctggcgtgttctctgagtaggcccttcttccctggtactccatcctgatgattctaggtgttttgttctttttgaattctaatctctctccccactttggtgagagcacccactggttttgtgccagatgaccctcctcctccttggcacagcctggaggctgcatccagccgttctctggcggctggctcacttcacttccctttccttggggagcatagcccctggctgctgttgtccttgttctgaagaccattgttttatataaaagttgagcacccctaattcaaaatctgaaatgctacagcatctgaaaatttttgaacattgacatgctgctcaaagctgatgctcaaaggaaatgcttattggagcattttggatttttggattagggatgctccaactgtaagtatttgcaaatattcccaaatccagaaaaatctaaaacctgaagcacttctggttcccagaatttcaggctactcatcctggactttatttcgttttagctgttacatgtggttcttgctgctctgtcatggctagaagtgggatccccaccaagttattagtggactcataaaaataaaagagaggcctgctgggctgttaccagactgagattgctcagattacacaaagccctctggccctgaccccagactttttaccagcctgaagtgggtgaaaagaaagcttcactgactgctttctaggcatgtttaagcctgcttattctggccctcacagaataagaattcaaaggacaataattttcaagaagacttaatttaagttcatctaccttattagacttgatatagatagatagcctttttaatttttttttctcatggaaacagagttgaagaaaactaatttaccttctaaatttaggcacagctaaccaagtcaaggtgtggttctgttcttctctgttctcttctcttctctttttttttttttttttttggtggggggtagacagagtcttgctctgttgctcaggctggagtgcgatggcatgatcttggctcgctgcgacctctgtctcctgggtttaagcaattctcctgccttagcctcccaagtagctgggattacaggtgcccatcaccacgcctggctaattttttgcatttttagtagagatggggttttgccacgttggccaggctattctcgaactcttgacctcaggtgatccacctgcctcagcctccagaagtgctgggattacaggtgtgagccactgcgcccagccggttattgtattttctgtatgctttttggtcgttcagctcatactcagtctttccctgtactgtttgagaaattcacaagtgaatcccagatcacaggtgtttggtgaaattggtataaaccttaactgactttctgttaagaaacataaaaaaatttatttgtatttctactctgaagaaggactgttcaaactttatatggaggggacccaagattgggaaggcagaggaaacaaagggcgtctttgattcacattatttttctcttgtcatcattgcaggcttaagtgtgtgtcatcactagaaatgtattctgttgatgtctgtcatttcagcattttcatgttgtcaaaaatgagaccagacagaagaagagtgtattctttcctgctagaactcgcacaacactgtcattaatgcctctggcagtcaggactttaatcagttaaatgtaatagtggtgataacgttaaagccttgtatggcagtctacccgggcagcctagagagccctgtgcaactctgcatttgaaaaatcaatcaactagggctgtcttttgtcctgggctacttggatagctggtatgaaccacccagcactagcctcctgcttgttgagatgacacttttcctgaagccatgcccactcttgacaaagaataattaggtgccctgcataagtgtatggggacctgcaggtggcttggatggtttgccctgctctcatgggggtccacatgagcatacagaatggaagaagtcatgatggttgcagtggttcctcagaggaacagtgagtttttcaagtaggactctgattatctgtaaaggccaaacttgttccagtgacatcacatctctggggttgctaggaagtaaaggagaaaatgggttcacttgcacagttttggattacatgtaagttttaaagaataggaatgtgtgtgtgtatgtatggtatatacactatattatcattaccaaaaatgatgcctcctatagacttttggtagaaaggaaatttctttctcttctggttgtctgaattttgttttcctttttttttgcttccctccggaagggaatcaaaaaattgtatatatatatgtacacacactatatatgaaatgcctgttcatatcctttctgcctgtgtttctgttgggatttctttttcttattgatttataggattattttatatagtctggattctaatcctttgtcaggtatattggctgcaattttcttctcccagtttgtggcctgcattttcattttctttatacactgctaaccatgtaggtgtatgtatgtatatattctgattgtgggttatatttctttgcttcttatgtgtgtgttttaagttggatcctagacattgagagactgtgtgtgtgtatatatataccatataggggtgtgtgtgtgtgtgtgtgtgtgtatatatatacacacacaaacacacataggtgtatacgcaggtatacacacacacacacacataggtatacacacacacacacacacacacacacacacacacacatgaatatacctatatggttagtagtgggaagccaagctgtttctcactgtcagatggttaagttttgaaattttctctcattctactcaagggtagaatgattggagtgtcagtgttcaatgctacaggacaataacttttgtaaaaatggttaaagcagattagaccccagtcagttaatccacctcctcaccaaaacttggagttatcatgctactaacactgctaacctactgggtaaaaatcctgtctcatagtgatcttaattagcacttccgattgagagcaaccttcagcatcttttcgtgttgccattcatcttttgcgaaatgcctgttcataccctttctgcccatatttctgttggattttctttttgttattaacttataggattatcttatatagtctgaattctaatcctttgtctgttatatgtgctgcaattgtcttctcccagtttgtggccatgttttcattctctttatagtgccttttgatggacaggagtttctaattttaatatagttgcatgtaattgaatttatgattcttttcctttatagtttgcacattttgtgtctcgtttcaaagtgcttccttatccccagtcataacaattccactattttcctatgaaagtatcagttttccttttcatatacaagtctgcagctcatttgaaattaacttctgctgtggtatggagtggaagttcagttcttttttaatatgaataatcagtggctccagccccatgtatagagtaaccccacctttctccagggctctgcagcggcttcactgcaaatatatgacaaacatgtgacatgtggatatagagcaagagaggcactgcagagccctagagaaatgaggagagacacagtaaatggtgctggagctgctgactattccaagtggacgcatgcctttttctaggctctcctgttccattgatctttttgtctttctgtactaacgccacaatgcattaattactatagctttaggctaactcttaaaattgatgagtcagccaggcacagtggctcatgcctgtaatcccagcactttgggagactgaggtgggcagatcatgagttcaggagtttgagaccagtctagccaacatagtgaaaccccatctttactaaaaatagaaaaaattagctgggtgtggtggtgtgtgcctgtaatcccagttactcgggaggctgagacaggggaattgcatgaacccgggaagcggaggttgcagtgagctgagatagcgccattgcactccagcctgggtgacagtgcaggactctgtctcaaaaaaaaaaaaaaaaaaaaaaaaaaattggtgagtaaatcctcatatcttgattttccattttcctcttcaggagtttcttgattcttttggggcctttgctcatccattcgcatttcacaatgagcttgtcacattcttagactaacctgtttggtattttgattgacgtccttgggtctgtagactaatgtggggagaataagatctttaggatatgaatctgcctcttcaggaatatgcgctcttgcactctctgtctctcttggatttccttaatgtctctcacattttaataagttttttcataaacagcttgtgcaccttttgaaatactccccgtgtccttattttttgttgttgccattaatattataaatggtatctttttctaggattagatttttctttatgactgatatgcggaaatgctattaattttcatgtcatctttaatttactttctaattttttaaaatgaatataccacatatatattctttgttttttctacatagacagagttttgcttcttctactctgtaaaccatttctttcttttacttgtcatattgcactaggatctccagttccattttaagtcgatgtggggataatacactcatcttgttgcttattttaaagggaaaactgctaactcttcattaacaaaaatgatgcttgctatagacttttggtagaaagaactttccttctcttctggttatctgaattttgttttcttttttttcttttttcttattttgcttccctccaggagggaaacaaaaaattgtcagaaactatttcagagctgaagaaaacttcttaatctccttctcctctactgttccttgaaaactttttaaaaattatgaacaggcttcaaattttattaagtgatttttctgcatctatttaactgtttatgtggttcccatccccatatctgttagtgtggatcatgacttctagggaattattaatgttaagctatctttgcattcctgggatgaacattacttggccactaagaatcatcctttaaacacctgctctagaccaagcttattaatttattgcttttaactttggccaaactagtggtttaattgtttttaaggttatttattctttattgttattaagattattcttttttaaaaactggttaggttaattatatgaagctatatttttgcacagtctatctttttctaccctttagctttcagcctttgttcttatatttaaaatatgtgtaaagtaatatagttttaaaaatatccagtttggtagtctttattttttaattatttagtccagtcacattaaaataattatagttgagcttacttttaccatcttgctatctgtcttctatttgtcccatctttatttgttcctgtatttctaatttattttgctttctttatgattaatagtttttaaaaccatttttctcccctttctggttatacagatttgtatgtttcatttagtgattagcctagagattataatatacaccctggacttactatagttcacctaaattgctactttgccacttcctgaatagtaaaatactttacaaaatgttagtcatttccctttctcccagcttggatgctgttgtattttaattatatatacacatttaaaatgcagtagtcacttttgtcactgtttaaacgtttggtgtttgtgtcaccgtgccccatgcttgccctccagtgctctccattggttctccatcatcatgccttcgtctggggtgacttctgcttgaaggacttgtttgtttacttagtttttaatgctagtcaactggcagtgaattggtccatttttaaacactaatagttattgattgttgagttagcaattctttaccttataaaatatgacattccatcgtcttctggtttctgaagtttgctgaaaagtcagctgtcagtcttattgttgcacttttgaagataatgcaaatgtttttactctggctgcttttaagattttttctttggtttgaagctaattgtgttatggttctttgaggttttcttcatatttattctgcttagggtttgctgaacttcttgaatttctggattgctctctgtcatctattggcaaattcttgaccctgatcccttcaaatattgctctgcctcatccaatctgtcctttcctctcggagttgaattataggtaggttagtccttttgactgtccctcggatctctattcttgttttctttccattcctttcccctttcttgaccacagtttggatattttctgctgagctctctggcagatcacggaccttgttttctgatgtgtccagtctgttactaaacccatccaatgaatcctgaattacaaattttgtatttttcagttctagaatgcccgttttgtactttaatatatattttaattctatatttaaaattcttctctttcccacttatgttgtctgtcttttcctcttattattaagtgtatccattgtaattattttacacttcttatctgctagcaccagtattgtggacatctattcctctgcttgtattttcttcttttttcccttctctttattattattaaatacatgtttttgctttttgcatgcttttaaaattgtgagtgtttgctggacttgtgcataaaggactgtaaaacctctggattgtcgtgtttttcatcaaagcaaaagctctctttgcccttggttaggcatatggagtgaggggtgaaggaccttggtttcatgagggattgatctgggtcagggctggcctgttattttactaaaactcagtccctagttggaccttccctttgagcatggtcttttgattggaagcccatggtctctttctcctcagcctgtaaatgctttgggagatcccttggttctccccttagaaggttttgagctgagctctttagcttcccacgtcccctgtttcaaagtctcctaaatgtcctgatgggagatgtgactatgtgtgaagcaggcccttctctctctgtctttccgcctacctttcctcccaccccagtctcgtaagtgctattagattaagggatagtgtgcttttccttttaggagccctcacttgacccagctctctaggctcatgaacgcagccccataggatagcaaattgattgcacttttggggttctgattctgatctttcatgccatccccaatgggccacccagagcttccctggtttcccttcccaggtggagtggctttgtgtggactgccacggtgctccccatctgcacccaggatcagcaagtgtttctgggcagcaaagggcagtctccactgtacagtcccagtccccctagtcctggttgcttccacagctctataacattttaaaagacgagttttgtaatttttctgactttttccagttcctgtgggaacattgggctgcctccattagttcgttttgcttggaaatgaaagtccattctgagcacttgcttgaaatcttgattgaagtctttgatttctgctttctccttggtcatgctttctcctgtcatctatcttcctttgcccacacatttcataaatgcttatttcgtattctacacaggttgctttaaatatctgcaatcctgtgggtggagtgtgggctttgtggttttcatctttctgtgatttcttgtaactcttacgatgacacgggaccttgtttgatgacttggttgattattaatttatatgggctgagcctgatctgtttgactcctgagtgcctaaattagggatgcttttccctaagggtgggtgtttgggtttctgttgcctggaaccagggggtctcaaggcagcaccactcagatctaggactttctaaggcttctcactcaatcagggccctcgggttgtcagggaggccccagtggagcgtctggaggtcatgaggtgtgcaccttctctgctgatgctgcccactttccctctgcttcctccagccctggcttactctcctttttccaagtgccccgattctctttggattgcccctgcttactagagaggccattcaggaaactttgaaacattgccatttattcaatatctagtgcatcgtagtcccttaatccaaaacaactggtttggtttttgcataaagctaccagaagataaatatagataaaaatcttgaagatttagaaaaagtaatattaaaatagatccttagatatgttcttatcaacatctgcaagtgttcatcccaatatggattccatcagttagaggggttttaagaggggtcactgtgcgccaggcccagtgtgggatctgggggaggttgtcaaagttgtcttctaatccagaacaacttgctcactaatatttatatttctgccttcaatctgggaagcagcccttttcagaaaggtttgctgcaatactctctaggggacaaagctgagtgaaactctagaggcttgtcttatacgcatagacatcacgtgcacacttacaccccagtcatttccgcatgtgggatcatcacagttgtgtgtttgactttttcacctgaccttgtaagtgcttagccatatattgaactctttaatatcatttttggagatggcatagtgtcctactgtaaagatataaccttcttccattgttaggaatttagggcaatttcatatctgagactctgtcttaaagaattaattaaaattttgtgcacaaagatgtttaatatagtgttttgagaagtcaaaacacagggaagacttcttgtgtcttacactgagaaattcttagccagcctcttagtttcctgaattcaggactgtgttgtgtaattttgaagccccaatagtgatatggtcatttttttcatatcttcattcaaaaaacctcagtcacctggggagtgggtggggtgtgtgctggaccctgaccttgaactgtccagacaagttcctaaccacgtggagctcaagcttccctggggcttacctgaatgacctgctcagtggccagccacttgctgcgtgtcagccggtgaactctgggttcctggcttatcagagacttcaagtcctcattaccttctgggtctcagtttccctaatatgtgcaatgacaggattggccagggctttccaacagaagtttttgcaatgatggaaatgttctgtgtctctgctgcccaatgtggtagccactagtcacattggctgctgggcacttgaaattgactcctgtggcttagaaactgaattttaaattttattacattccaattaatttaaatttaaataagtagccacatgtggctaacagctgcgtatggacactgccagtctagacggatatgatgcttgtttaatggtcttaagaggtctttagagtctattctaatcctgacatctggttttctttgcttgtttgtatttatttgttcctttatttttaccacgactgctctgagtaccaggaactcctttttgggatgtcacagatcaccaacttccttctctgtgctgtgtcaatagggacgtcacccctgtggggaaaggaatttgcctgaacaagacactaaaaagataaaataggctgaagcggagaagaataaaagattgtgctggcatgagctagttttgcaaaacccatttaaataaactcaggatattaccgaccccatgcacacattctttccttgactctgcaatgttccgttaaaccagattgtgaatttttttcaggattaacaatttacatttatgattctattttcttttataagtaactgctatttgtaaatgagactaattatttgaattcatggtacaaataacgtaatttagagttacagaactcttgatcctctgggtctaagcaaaataaacgtagtacctaatgctggaatagagcaagagttttctttgaatctcaaaatatctgcattgtgaaactgggttaagttattttggaaactataaatagtcacttggtaattaggtgtttggttttatttgttctaatggagtgcttattacagtcggtgcatttttaccccacggatcagaagcttttataggccaagtgatgagagaccatcttctacatttcatttgctgattgtgactcatcactgatgatcgatggactgctgaactttttaattcctgtttgcttgtagagaaagaaaattctcatctcttttgataggtcctactccaaaattctgcagccgttttgtacaatcataaccttacacgatatcacacaaaggcagagaaacgattgcatggacatgccttcctgtcaaacgtgtatggaatctggcccgtcctaggcttatctctttccaccaggattcttcttcccatttttctcagcagagcatcttcacgtagttcacatgacatcagaacttcatcaggatgtaagttcctgcagaaataggcctgtgtctggtcagtaaacagagaatgtaatgacattcccagagcattcacaggccagagtctggtgtcctccccagcgtccagcaggctgcggatggatggcatgcagctgacaagattgatactgcattagacattcctggaggtccctgcggctggggactggcactcgcaggcctccccctgcacacagctgtctttggagagcacagagcaatgggaggcggttttgttttactatttgccatttagagtctcacttttaatttatcctcactctttaagaaataattggtaatttatttcttagagatcaaatgttgctacaagctgaaaactgttttataaatatttcaggaaacttgaatgcctggaattttcatcgtcacgcttaagtcttcctccaaaaggggatggacttcgttccatcccgctccaaaagctggtccgattcttgcctgggtgttgtatgctatttgccttttccataggctccaataacaataagtacatcttaaaattgatgaaagtttaatgaatggctagcaagcagagagactacttttataacaagattaataccttggctcaggggacataacattttagtaaaatcaaaatttgtatagttatcctagcggtgcttgcaacctctggcttccatataaaaatgtctaaataaaatactggcagccgtctctagccattatttccatctgctctaggtggcctgacccggaacccactcagggtggtgcactctgggccggggtctctgggatttctgtcgcatcagcttgtgcagccgtggaatggggatggggcactgaggctagctgtcccgtgctctagaggttcctgggaaaaaaatacagagagaaataactcacaagggagccagcatttggtgttgttttaaataaattcattcatcatctataccttttccccttttaattactacactttaaaagggatcttggtatatatttatttttgttttgttaatttttttcttttttaaaaaattaattgtagagatggggtctctctacattgcacaggctcgccttgaactcctggcctcaagtgatccgcctacctcagcctcccaaagtgctggggttacaggcatgacccactgtgcctggccagttttttttccccctttttggcaagggaaggctatcggggtagaagttctgaagcaagtactctgaatggtttctgattttaatagggggagcatcatttcctgatctaatttataatgtgatataaagctgctggccagctgacactaatcttaatttatgatctatttaacctttatatttcctagccacagctcgtaccactcccccgtctctgcaccagcatgtttcagaggcaggcaagcagcatcagttctggatcctggaggcaaggggagggttttcacggaggggcggtgcacagctctgtgcctccccggtcagctggtccggcactgcagtcagcagcaagggcgtggtgagggccctgcagattcttcacactgtcctggtcctctctcctgtttctgaatggcaggactttggggtcagattagaccctgcatgtacatagatgacaacggaatggctttttggggggactttttattttgagataaattttagacttgctgaaaagttgcacaaatagcacaaagtttctgtatgcagccaccatctggtttctgccagcactaacacctcacacttaccacaaccagggcgctaacacgggtgcactactgtaaaccttgccatctctcctttgtctcctctagtgcaatggtctgaatttatgcttcctccaaattcctgtgttgaaactctacccccatggtgatggcctttggaggtggggcctttgggcaatgactaggtcaggctggagccctcagaatgggattagtgtgcctataaaagaggactgagggagctcactgtcctcttccaccacgtgaggacgcggcgagaaggtgctctctgtgaaccaggaagagggcccttatcagacacgggctctggcggcaccttgatcttggacttcacagcctccagaatgtgcgagatgaatttctgttgtttacaaagcacccagtctaaggtattttattccagcaaccagaaggaactaagacgtctaacttgtgacagttcctcttgccttgttttttgtgaccctggaccctttcgaagaatactggtcaggtattttgtaggatgcctctcgtttgggtttgctgatgttgtctcacagagagacagaggttacgtgtttttggtaagaaggctcagaagtgatgtgcccccttgggccatcctgtcctggggacatatgtctgtcagttactgtgatgttagcttggtcactgggtatggtgaatctcttgtgcatttcctcttggtaattgaagttttcccattggtaattaataccttgggggagatattttgagaccattttggttctgctcaggctttcacccactcatcttagtgaccgtgggtgtgtcttgcctgtggcagttattactgtactgtttccctaatgtttgtatttccctccttcccttttcatttaccaacgggaactgttctgtaaggaagagctgtcttttctttcccttttatttattagtcattgaattattcacatcagcgtagactcatggatatttattttaatttctggggtatagtccagtgctgtctttacttaattttgttactcaaatagcccccagtttggctttttggaaactcttgggtttggctcctatgtcttttggacctgcccatcgtttttctagcgctttcctactttctgggatcatagtatgatccaggtgtatcttgtgttttccctgccccagccctggattcagtcacttctccaaggagcctctcttccttttagctggaggatgatgtttagcagccaagatctgggtgctgagtgtgcttgctgctgctgagtcactgctcttcctgcccttctcagtagggggagctaggggctgtatgtgtgtctactgacccgtgcatctgcatttatttctgtgtctgctgtctgcatgcatgttaaaaactgcaagttcatctgatgcctctaacttgaattcatcacagcaggttttattctaatctctgcctttcctctttgtagctgccttctccaacattgagaaacctggccctctttatctgcaacatgtttgcttatatggtggcttcctttaaaaagaatctggtaaaacctgtgtcattgtgtttcagccactagatgcagatgaggcttagtaggaaaagccctacttgtgaagaacagtatttcctatgcttgcttggtggaaaaagtcacagaattttctatagaattctctgtaaacatggttaggaatatagggttgacatttggactcaaatagaaaatgaaatccttttgtttcattacttatttcgttactcagctttcaccttgactcttggaaaactgatggcatgtttccaaatggatatgccagctaattagcttatttctcaaatatccatgttggatgtggaaaacaaataaaaataaagcaaggaagaccctctactgttgttatgtgaagaataacaattacctttaatagcattttctgctaatttagagatttttctttttcttacacttattttctaactcctatgatttgtgtaattcatatcttatacctacatctgattcattatgattcttaattctctttgttgtaaacagaaatattgaaaattcattcgatgaacctaaaaccctttaaaaggtctggttaaattttaacattaagggtgatacagtattcatgctatagaacacagacagtcagaaatcttatgaagtgttggagactttaatggatactgtactatgtagaatctgatcacgagactcctgcttcatcacgtttttactcgaattgggtttcctggtgacaaaagactgtgaagtagctgacggaaatacatccttatgtcagttttcacccgatgactgaaaattgttggatatatgcgtgaaataattaggtcttatttttggaagggagagaatataaccgactgaaaaataatttggagttaattgtcctgaaaattcacctactgtatattaataggttaggtgtttcctaattctttctttcttaagcatatcttccttttccttacactctttttgacacaaacttttgaatatggactcacattataaatcttgggattggaaaggccataaagattggatttttaaaacttcaacaatgtagaggaataccagtgttgtatttgttcagaaagtcctcattggcgctgatttgggcaccgcctggtttcctaccgtagaagcgtgtgctgtggtggggtgaactgggcgggggattcacaccagcctgggccctgggccatggggggctgcctcccagggctgcttcagccgacaggagggtgcggtggtgaagaggcagggctctggggattggaatctccacgcttgactttaggcttctactgctcactcgaaatgggacctgaggcaaattattcacctgcattgtgctgggttcctcacctgtgatacatggattataatatcatctctcttcatgggttattgtaaggattgattttattaatatttcgaatgttaacgttattatttatttattttgagatagagtctggctctgttgcccaggtgcagtggtgcgatctcagctcactgtaacctccacctcctgagcaatcctcgcacctcagcctcctgagtatctgggattacaggtacccaccaccacaccttcctgatttttgtatgtttttgtagagacagtgcttcaccatgttgcccagactggtcttaaacttctgagctcaaactatccgcccgccttagcctcccacagtgctgggattacagacatgagccaccgcacgcagcccaaatgttaagtgtatgacataaaattcagggttactttgcctaaacagttcagtgtctctgattaatgtgatttctgtttcactgacagctttcatgtaaatttaaaactagatagaattacagagcttcagagttgtacagacttgtagaggtaaagtaaagccaaaacattgagctcagtgacggggtcagtcacttcctggtgtcagagtccactgacaggctctggcaactcttgcatcaaaatcctttgcacacaggtcctttcttgctcttagccagtagcagctgtcctgggcagagttccctcagtgaacctggaaacggcagtggctggaggtgagaggtgtccatgtactcacttgttcaaagttgccccctcttccctctctgggcttgggccctgatacctctcagagctaccctgcctcctgcgggggtgggggaggatgcctttattatctctaggccaaaggttggacctccacatatgtccatgatgagggacagcagtcatccctttcaagaccgagaaagtatttaactccttggaaaattgagggtttattttgcagtggtttggaaaatgtgctgagggtggctgtagagttaactaaatagaatgtttcagagtcacagagatttgtaattggtgggcttggtttgtttttatagtgcttactcctttttatctgccttgtggatttatgcatttatttgataagtcagtcatttacctccccattctttggttttcatgtttctgtttatcatcaagataagcaactgtgggttttcttccatcgaagcacctgccgcaggtgatgattttaatggtatgactgccatggtcaccacgaccattccgaggactctaaacatgtttcttgtccaacactactttaatttgaaacaaagcctgaattgagcagcattcgtgtctgtggtagaccagggaggcagggctcacctctgttttcagttcccctttgctggatgtgcaggaggactgccccgttccactccttcaagggtggcttggtcatggacttggtttggctaatgagcgtggcctggagtggcatgtggtgcttcttggtagatgtgtgtgcacaccagctcttggttctccccatgtgatactgggacagctgtgggatgggatgggcgcagcctgtggcatcaagcttgcatgaatcaaggccgctgctggggctagcccagacccgtagtgggtttggtggtggttgttactgcagagcgtcccagccatcctgactagtacagcgtggagtgtgtctatgtcctggagcttggggagagtcctggccgcagtccaggctttgaagaatgttgacttgacctggaatacccacctgtccctggagtgctgtgttcttaggctagttccgtaacctccctgtctgcttcttcatctacacaccatttgatcttccttaggtttgctgtaaggagtaaatgagataacgcatgtaaagcacctggcccggtgccaggcatatttagttaatacgttgcgttcctacccagctagaccttttaacagtccattggcatcaggtcacctacaaaaaggtacagaagctgcctttctctgtggtatttgctttttgattaaaaaaaggaaataaatgatcacataattgttttattttgccttaaaaaatgagtaaaaaaaaaatgtggctcacatatgccagaggtgtgatatgtgagtcgtctctccctgaggaaggctgcagctgaggttgggggtgaattttttcccctgcatgaagaggggtgactggggatggggccgcctcccttcctaaatttccgtgctccctgttggtgtaattaacttaggggaaaccacacgtggggattcaggggcttctccctttattcttttccttaaaatcaagttacatttttttttgagcaataaactttagaacaaaatgaggaatagaaaacaagatgtcgagacaaacaagccttagcgaggcagctgttaaaagcagccggacccaaacagagcataaaaatgcatgtagtccagagaagcactttttctttttacggctctaccccgtatttcatttatatttaaaactgagttgacgaatatgaatacagatatttagagttattgtaaagtcgtatttgtttatgtgcgtggtccagtttccaggccatatcttacagtttaaaagggagagcagttaatggtttcgcccacactgcttggatttttttttttattattatcctccagctcctattcttcaggtgtgcagctattttagtattatgaagaatgatggatgatgcaggaaagtttctttggaagcacttctgatattgtgcaatgcacttgggggtcagctacacttgactgatgcatgatttatccaatgtccctgccacttcccgagataaagctgctgctttatcgaaaatgccagcaactgtgatttagaatttataaacctccgttttcaaataattgttctgattactttctgccttggcaataaaatgataaaggtaattgcacacaaatgtgagatagcaccaaaatacaataaaattaacctgaattagcttgacttgtcgatgagaagtatttatgaaatgtggtgttgcaataagggagggagagtgatattatggctggaaggtgagttattgctttaatgtgatactctttgaaatttaaaaaagagactgtttctgttgagggtgattgtgcttttgaaattaagttgaagtgattcttataattggcaacgagaatgcattttgaaggtaatatcttttattgtgttatgcctagttgcatcaccttttatttagctgtttctggcttcagcttttctaatactcaggtagaagcagacttggaattctgtcggatccaggggctgaaatgttgtattctctttgtagcaatgcccctggtcttaatgttacagactttttcctcctacatttgattaaattgtttagatatcaaaggttaaatattatagctagttaatgtttttttaagtttaaaggcggttttagaaatgtgttttgtttccctgtctttgtgtgcactgggaacatctcattgtagcctgatggtttcaacagtatcagatcagggttccatgtctgatacccatagttcgtaatctgccttttacattcctgaaatgaaattcctggataatatccatctacatgtactatttaaatgaaacactttaggagcagtaatttataataaaataacatgccttcagaacaggaatgcttgggcaggactctgctagcagacataacgtggcaatcaggtgtatgtacctggaacacagcagctgcaaatggagattgagacagttttgtttattggacattcatcatctggtcaacgttgacattggtgatataatttttccaaaatggtggacagcttttgtaaagtttcaaagaaaatgaagttcacctttccattgagttacaggatagttgtgttcttagaaaactttgtgtagagaaaaactgtgcagaaaattttgtgtttgcagtaaacagaattctagtttagggtcttatgaattttagatttgaatgtgttgcaggacagttgaaagtgacacaggttgcaggacgacactgttgtttgggatgggagaacattctacattcttgattccccccttttaaatgtcgatagctcccacaaccattgtgacaactaaaaagtgctttcaaattctcaataaccccctcttgagaaggactagagaggatgccctccagaacatcctcccctggccagattgtgattagatcaggagcttcccagcaccctcctgctcagagagcctgtgccacctcacatgccaccatgggaagcctgagattttggttcccactgttgcctgggaatccatttccaaatgagtggggagagagatgtcatcaaagctgagagtccttggcaattgattgtactgtagtgccctccaccacctttaggacctgattttgtctagcctaggtttgtgtgaatgtggtagggtttttttttctgacttggtaataaagtttgtagtattagtgacttgtaggatatctaacaaagatgaagttttggaaactaaggccaactttggaaagtgttatagacttaaaattgcagcgtgtgtttccccctgttgactttgggagtacagcactggtatgctgtttttccaaggagaatgaagtattgggaaagaattgctcaggaaaaatataactagtaggattttttccagaaataataaatggaattgagaaaattgaagtgaaacaagattctgtggtagataaatatctcttttagtcccccaaccccacttttattttctagtctattgataaactgtatattattatgatagcctactttgactcttggtttgtaaaaatgaaagtataatacaggctttatgattaggctagtgtgaagttacatgttaaaatagggggctgacaacatatcaaatacctgtgtaatttaatattatgtgataaatatgtaaagtaaaaactgagattccattttttccaacattttgacttaaggctgaattttaggggtcattaaattatcatggagctcagatagatacacggtggttctttgtcttactctgggtgtgagcaagctggtcttttccttctttaaaaatggttgagttactttctgtctgcatctgatacatccagtatctcaagtctttgcttgcttattgtacattcatcatctggtcagcatggatattggtgacatcattttcctaagatggtagacagcttttgtaaagtttcaaaggaaattaaagttcaagaacaagctaataaagttttttggcttgttcttgctcatggtgtcttatttccatgttttcctgtttctttgattatactgggcatcatatttgagagattgctcattattcatgagagcagtgtgaagcctgaggggttgtgcttgtccctggggtagtttgatcccttcggtcaggtgctgagcacaccaacaggctttgtgaattgctcagatggccacgagctgagacctgcagagtggtctctcgtctgcagttgctatttttttttttttttttgcagcatttcctcactaggccagtggttttcaactgggggcagttttgtccctcaggggaactttgtcatggtagacatttgtggttgttacaactgagggggtgctgccggcatccagtgggtggaggccagggatgccagtgaacatcccacaacacatgggctagccccacaacaaagaggaattctctctcctgcaatgtcggtactgtcgtggttgagacagttcattggtctctgtagaacttgtttaaagcccagcttgtccctggccccaccccggatttccctgcctaccctcggttcatccatggcatcccatcctcttgggcaggattctcttggtgccatcttggaccccttcttctgttgtgtctttcccatcaccctatggcaaaagagttttccatttctgtggttttccaagcatcccacacctccccttgcagccacatacttagggctggtgaagtagccgttcagtcatctcactggctccagattgttctccaggcatccagggggcatttatgctcatgcccagcgctggtggctgcctcgatgctattgtagatgtccaagtcctgagccctcggactgctttcaaagccccagctgccctaccctgtcctcccatctctcgttcctataatccgctctatccgaaagagtcgacttgccatttgtacaactccatacttcacatttttcttttctctgcctttgtacactctgtttattcaacgtacatagtacaaataccttcttaatctaccccctttaaactcctaaccattgttcaaaactcctcctcctatgaaacttttcttagtccttggatttggatgttgtcatcttcagggcatcttctctgggtttctttgagatcaacacaatatagtcagggctgtgggccctgagcccatctgaataggatcccagtcttcactctgccacttaggggccatgtgtccatcaccaggttacttgagatccccaaacctcagtttccctgtgtctaaagtgggggttccagtgctatgttatgatgctttgccaggctacagtggagagctaggtgaaaatgttcctgcgacgaccagttcctgtgaggaccgggtgaaacaggactgatctagtgttgaaaggtctctgtgagccgtcaggcaggtgacgttggagccagcctctccagggtggtgtgcgtggtgctgcagtctctgcatttatcccatgtccttgggtttggcttccagacggatgtgaatctcccctctggagcatgtagatggaggacaaggcctctggggcaggggtggcctggagacatcgcagtggtcttgtctggtggcacacagacatttcccagtttggtgcgggccgccctgtgcacagctgtcctacagcatcagagcaggctgtggaggcagggccaggctcactgggagcaatggccctgctggaggagatctggctttcagtccctgttcacagagggtcctgctgaattggggacaggggtgccccaggagtgagctctgcagtatgtaggaagtcctagttccggtgctgggggaggaacgtcctgagagtgggccggaggagatggggatttatgagctgagctgtgggaagcaggcttgcagagcctctggtgagtgggccaaaatgacaaatggattctgtgcaactttttattgtccagcctcacactgtatttcttcgcgcactgctgtgtttgccagggttttgattgtattagttacttgtgagatggagaaacctttccgtctcccaaaataaatatggatctgctttcaaaatgttttagctgttaaacttcagcagctagcaaacaagccgaaagcttttgttctcattccaccacaggtttgtagagtttgaatcccagataaaacatgtaccaagccactggattctgggtgggatactaagtcctttgcagggaggtgacgccctttgttctgtgacatttttgtttttgaggagtctcccatttccttctctcaccaagttagttttctgtcttgggtggggctccctaattcttagggacctctggtacagcccagtagcagttctcagcctgtaggtcctagcccgtaggtagacagatgctgtggggcagggccagcccttttgtggagtaaaaagcccttttgcgggtggttctgatggccacaccactccagcccgcctggaagccgccatagagatagctttcacatacctggtgatacgtggcaggtcctagaaggtatgggtgaaggtggtgtgtaccaggggttggcaggggaaggaggaagagaggagtcgtagggctggaaaaggagaaaaaagttgatcttcacctaaaacagtgtgtttgtcagttgagaaaactggttttacacttagaagttaaaggtggagtatatcgaggtaaatgggtgctgacctctctggtatacaacagatttaatttttctttctttcttttttttttttttgttttttgtttgtttttttatttcttttgagatggagttttgctcttgttgcccaggctggagtgcagtggtgcgatcttggctcactgcaacctctgcctcccgggttcaagtgattctcctgcctcagcctcccaagtggctgggattataggcgcctgccacatgcccggctgactttttgtatttttagtagagacggggttttcaccatgttggccaggctggtcttgagctcctgatcgcaggtgatccacccgtctcggcctcccaaagtgctgggattacaggcatgagccaccaggcctggccagatttagttaatttggaaaaccccattaaatagctcagatcagattgcttacttggttgaaaaaaaggcaaaggtaatattttctgtcatgaacaaggtttgtggatattgctaattacttatttgaaagaaataataaaatgaaattcagtaaaatcaaataacttggcagttatttgaaggaagcggctcttttctgctgggctgcgactttgaggagcagttgcgtcatttccgggtgaagccaagagcccttgccatcacctggctccaccagggttctctgtgtgttttccttttgggttgaaattttcccttttagctgcatgagatgtttattattgctactcagaagtgcctggaatctatattgctttaaggtgtgggatgaagtttcctttcatgatggtttaatttttattgcgttcgcatagagcgttgccgccgttcacaggatgcccatgatagtcccgcccctcgagacgacatgcaggattgcaccttccacgcccagcacacaccaggccctgcacacggttcctgtgtgcattagtgtggttgggctccttctctgtgtgtgtgcctggcacattcggatttccttgtgtccttgtgcgatttctatagaaaaaggtgtgttttatcaagtggaaaatagcttacagtaatggtagttaattattttggagttccaagttgtttagaattgatcgaattcctaaatcttgagttaaaattctactctaggatgactaagaaagacatgctgtgtttacgtgtattttccagtttaaccagaggtgactttagacaagtaattctgttctgccaatttatttctctaagtattgtcaatttagctttttcatgggattctgggatacagagttgcttggtccattgaaatctatatatgtaattttgtttttaatcaaacctaacttctgggttttagaaagcatctcctgtccacagcttttgagaaaggtcccgtaaattggatgacaccaaatggctccagcaccagaatgaaaaggaagagcagcagagacttggggcacccacctgggggctgtttcctagtgctgggcagaatcctggggtcagggttggagggccttaaggccagattggaggtgggagcatggcaaggttgccgtgccaggatgcacagtgtccatctggggtcctggagcggcctgggttcttcccgcagggtgctgtcctctgcctgacaagtcctgttccctgtctcctcgggagaacaccagtaccaggactccaggagttgccaggtgggggcatctaaggaaaggaaatgttcatgggatgcgccacagagatgatccctcggagaatattttccggtctttcatagaggctaaaatataacatagttgttagaaatatgtggttttgtaggaagttacataccttggggaaaacgctggaattgacacctgagaatgggtgaaatgttggaagatgttgaacaggtgagaggactgaatcggtgcagagccacacctggtggtgggagcacgttgagggcctgcgggtgcccttgaggaagggttttggtggatgacaaatatgataggaaccacgtgtcttggggaaaacactggaattgatgagtgagaatggatacattattggctctattggaaattatggctgacagatctgaagctctgtcatgcattgggggcttgctggttatttcagtttagtaatttcattgatctgtaacagatatgtgtcaaagagttttaggaagttgatagaagtgtacatattgatgaaaataaaaattcgtaagaaatagatgatgggttcaggtacagaataagggcaggaaaataaatgaaaccagtataccagatgcaggcatgtgcttcccatgatgggaaccccagataccagacgcagccagatgcagccacgtgcttcctgtgatgggaacccggtatactagacgcaggcacgtgcttcatgcagtaggaaccccatatatcggatgcagccacatgcttcctgtgatgggaaccccgtataccagacacaggcacattcttcctgtgatgggaacctggtataccagatgcagccacgtgctttccgtgatgagaaccctgtataccgtccgcagccagacacagacacgtgcttcctgtaatgggaacccgtataccagatgcagcctggtgcttcccatgatgggaaccccatataccagactcagccacgtgcttcatgtgatgggaacccagtatactagatgcaggcacgtgcttcatgtgatgggaacccggtatattagatgcaggcacgtgcttcatgcagtaggaaccctgtatatcagatgcagccacgtgcttcctgtgatgggaaccccgtataccagacacaggcacattcttcctgtgatgggaacctggtataccagatgcagccacgtgctttctgtgatgagaaccccgtataccatctgcagccagacacagacatgtgcttcctgtaatgggaacccgtataccagatgcagcctggtgcttcccatgatgagaaccccatataccagacgcagccacatgcttcatgtgatgggaaccccgtataccagacgcagccacgtgcttcttgtaatgggaaacatctttgaatatgccaggaattaagcagtgagcttcttgatggtcagaacactgatggcacccaaagtagttgcgttaagccagcaccaaggttctgggttgtgtgttttgtttaacacagccatattcacctggccatcagttttttagtgaggagaccttcccagggctattggggatcagatgaggggcctagcatatactaagggcagagctctgaataggttaacaagagccctagatcccattagagctgggactagttttatctgtgcaggcctagagcccccctatgcaaagtggcgtctgggctggcagcatcacctgggcctacccactcctgctgtatcggaatccgcattgcacaagctcccagcactggccgctgtggagggaatggcgctgtctcgtggtaccttctccccaaggctggctgctgctcttccttaggtctgagtctggctgtcctctttccaggtcgaggatttaaagccgcctagctcagggctcagtcctgggtgtgtggctggccaggaaagggcagtgaattcaatttgctaagtgtctgctctgcagatgcaggatgctggagatggggggcgcagaaagaaacaggccctgattctgccctcgcacgtggtggggtagaggcggcgaggtgttggcagccatccctgctttaattgacctgagttgtcattccctcagcgatcagtttcacctgtttgcggactgcctgtagtactgcttgcttcttgttttctttatatcaacttatttttaaacacccgctttaacttcttcctaaggaattgcagtgagaacaagtgtttgctatgctcattttgtttattctgttacacgttaatttaaatctatagttaataaactagtgtctcaactaatctcaccacctgaggcgtgttcaacaccctagagtcagaccacagcctccctgtgacttccccacaccaggtctctggaagggtcgttctcatgcctttgagcttcgggtctttcatcatcagaggaatggactgtgtctcatttgcagggctcttgtaaggattagagaagaggaaagtgagtgcctggcatgaaggaagtaccatcaatgtcactaaacaactcttactattaagtgtttctgagttgagttgtggcttagcgatgcgtgaagcagttgttgaattgtagtctgtgccgttcagtgccttgaatataagtatatttgataacgtttatgataagtgttggtgaggatgtggagaaattggaaccctgtgtgttgctggtgggaatgtgaaatggagcagctgctgtgggacacttctggaggttcctgaaaacatgaagcatagaattcccatgtggcccagcaattctacccctaaggacataccccccaaaattgaaagcagggtcttgagtagatatttgtacactggtgttcatagcagcatcattcacagtggccaaaaggagaacacacacaaacgtctatctgtgagtgaacagatacattaaatgtggcctatccatgcaatggaacattattcagccttagaaagggtgggaattctggcacatgctgcaacatggacaaactttaaagacattacgctgagtgatataagccagtcacaaaaggacaagtactatatgggtccacagacatgaggcacccagaacaggcagattcagagatcaagtagaatagtgggtgctggggggtggggagagctattgttaaatggggacatagcttttgctgaggttaatgagaaaattttggctatagatagaggtgatggatacacaactttgtgaatgtatttaatgccactgaattacacacttacaaaatagttaacataaatattgcattttgccacaataaaaatatatttcctaacatttaaacaaaaggagtgtctgggacgttacctctgacacacctggttatttggcaccaccggcgacccctggctgctggcaggtgtctggagcagcagctcagagcaggaggcccagaatccacagtgccaggtctaggagtgcaggggtgtggcaggaaacgtgaccccgcggctcctcttcagagcctcggggaccaccaaggcagttcttgacactttatcctggccttggtgttcagcatcggaaaacaaggagaactagaatgtcttgactttctaaaggttgttgtaaaacaagggaaggccatgatgcagtgagttttatcacactcttgctgtgaccttcatgaggatgttggagcgtcttttcttcattgcggacagaggcttccaaactccacggctgagccccagttacagtcagtgtgcagtaagtcctgtgggtagtcgtagaagtggagaaaatggcagtatcttttctctaaaaaacgtttacaaacagatacttaatgtgagtttgcttgctaataggttaggttcttagagtttaaagaagtagttaattatcaaagctttttcattcttgacaaccagcatttttcctctaattcaggctacctttgaaatgaacactgcagatctctgagattttcatctgtgaatgttgtttgaagaattcattctgctgcaatttagataaaatgtacctgctgaattttgtaataacattcacaaagttttatatttttgttcgtgtttgaaatatacaatagaggttttcctcgtgatagtgagaatatatcaatatgagagagatacaattatatcaatcaattatttgaacaaagattgggtattgtttacatataattttgtaataattcctatttccaaggaagaacaatgcacaatactttgtcattgtgtcatttatttttattgtagtcttttgtttttattgaaacatagattccatgtataaatgtggattttatgtatatctttccccgtgtatattagaagtatttcaaatcaaataatttggccaaatgatttttctatattaaacattatattttcatttaaaccactataatttctcctagttcagtctgattccttcttgcttttttgcatacagtgagtactatggtccaaatgtttgttctcccacaaaattcatgttgaaacctcgcccgtaagttgttggtattaagagttggggcctttggggggagattaggttagtgcccttatgaaagagactccaaagaggtagagccctcgacgattgaggatgcagcaggaaggcgccatctgcgaggaagtggggcctcaccaggcactgaatctgccggcgccttggtcttagacttcctggcctccacaactgtgagaaagaaatgtctgttgtttatgagccacgcagtctataggattttgttatggcagctcagatggcctaacacagtgagcatgccccacccggagatggccttgcccctcttgctgtcagcatcaggactgacagaagctgggcccatgcagattttccggaagctgtgtcaggtattgggggtcattggactctaaccagtacccagcagacagatgggacctgagagaaagggttggggtctgccccttctccgctcctcagcttcctgcagtggctgggggcaggaaggagggcacagttcaggggattgagagacgtgtgctgactgtccagcagcagcagatccacctgcaggcacagtgcagcctggtgtctcgtctgagaggacacgtgtgcaggacaggcgggacccacagctgctgcttccccactcgccaaggccccgtcaggagcagcagctgcggccctgggagcccacagtccagccaggaggtggtgagcacagggcggagtgtggggttggggactccacttgtggtgttcccagatttgggggatttccgcaaggccccgttgaagggcagtgctccttagatacagtgcagagtccttggggtgagggtcctgtctcattacttgatagcacgtgtcctgtctcattacttgatagcacatgtttcagctggctctttaatgggaaagttggtgctttagtggaagctccagtcccctagatacagagtgtattgcggatatttatcccttcctggctgagcgcggggcagtttctgcctgcagatttgggctctggctctgggttatggacctttgaatgtggccatgccagagtttgtgaccttgacgtcttgaggcatcctgtaagtggtatgacctcaagggaagaaagctagcgtggcctgcatacaggtgggcctgtggactgtaaaagcaggtttacttagcgggagtaattacccatgttgatgacagcctctaacagaggtgcagtcttcaaattcacatttaaatgtctctgcctgctactgagaaatccacagcaagggaaaagagcaaaacagtctttctgtgaagggtctgttttattttttattttattttattttaattaatgagacggtgatcatccagggaacaggatctaaacgcagtctttgaacttgaactctgtatgtggtgtctacaggtttgggtgtgagcagcctcactctgtgctggttcccagcttaaacgtccaaggaagagctcatgacagtttttatattagttctttaaatattttattgtaagttcgtctcttcccagcccctcttgctatttttattgctccatttgaagttccagccaatagcccaggccctttctgtctttgatgtctgtatggtgggcaagatctcatcacgacccacatcagctttgctgttagaaacgtgttgccacagaggagcacattcataattgaaatcaccaaatagggaattctttctagaggcagtggctgcctcagtgaaacgtgcatggctgagcagagcaaggaagagttagtggggccgggggcgtgctgatatcacagtggcgtggggtggggtgaagggatacaggtgtgtccctcctcttacccggcatggtgtttccagaaagcagatgggagagctgtgtgatgaacaggtgagacactggctggacccaggtgagctgctatagaagcagaatcaaaaccgtgtagcacgttgccttccctttcccaatactgtaaagaattcctcttcaatggaaatctacttcaaacttttatcagattaattttaataaaaagctgaatcaatacgaagcagcttgggaaaacagctttcccccaccccagcccccaccaccaataacattttacagattcaggcccagtatttcttgtttctaatgagatggaaggagcggtattcttggcacctgctcatctccttccctttggaaactcagccaggtttttgtcgttagcttatgggtcgctaatgttatgtgcactcatagcagaaatggaaatccgccatcggtgaaagtggagacctttgagaatttatgcagcatcaaaatgtaaataccaactcttatagaatattggggttagcaatgtcgacagttctaccccgagtgcggttggtggtggggctccaatggaaacaaactggtgtccagcagtcagctgtctgcgcatccgtccctcccactccagcttctccaggtaagactggccatgtgagcacagagggtagaagaaggccttagggacaccttagaatgggaggagaggtcatagctggagctccgcttgggggtttctggtgctccgcccatggctcctggacagcgaggggcagtcttctgaatggacctcagaggtcctgtggtcctctttggccagagggcacgggcccccttagctcatttctagtaatgggatgggtgggtgttaggaggaaacacgcagcccagcacaggctccccagagcacatcgtgaatctttctgtcgcctccctgccccacctcacctctgttctgtggcctccctgcactgtgcccctcctgtgtcctcagttgccacatgactgacacgtgcttggggctcatttgatggctctggcaactttctctacctcggtttaccttttggctgcccagtgctggatcgccagtctgctttactgttcacgggaggaagggtgtcacggcgtcacacatgggcatggcacctgcgctggggctcacctgtctcatgaggccgtatgtcgcacaaggcttcttgagggtggggtggccatgagcgagagcgctcgcctctgtccttttcctgttgcagaggaggaaaaagtctggggccctgtttgctcagggtgggctgaggcccagaccagcttcctgtctccacaccctgactccaaaccctcactgtgaccccacgggaaagcatattcccaaatgtaactgcgacgccgcagcccgggactgctgattgaatgaatgagtattctcctttgggtttcccacagaagttttcccccagttccctaccatgatgggttgtggctttgtcacccgcagtgagaatatgcgaatgctttagcagatgttgtgtggctcgggcctgcctgccttatttggagatatttcgcacctctgtgggctcccagtggcaggcatctctggggagggagcgctgtctccatcgtcctttgggaggatgtgggatggctgcaccgggcaccactctcacatggtctccacatcaggaagcgtatctcaccgtgtccagcattggtgtcctggccagatgctctgtttataatgatagaaaaaaaatttttcatctctgaaatttgccaccttctttcagcagcatttcacttggtttacttccttaattcacgaaatatgtgaaaaaactttataaatcttaaagatgagaaaattctaaatgatgtgtgtacagatacacacacatacacacacacacacacacacacacacacacacacacatttggcccttggacaagacaggtctgaactgtgtggatccacttacacttagatgttcttctacctcagccaccgcagagacagcaagactgcccctgcccctcctcccctcccttccccctgcccctcctcccctcccttccccctgcccctcctcccctcccttccccctccccctcctcccctcccttccccctccccctccccagcctactcaccatggagatgatgaagaccttcatgataatccacttccacttaatgaatagtaaatagattttcacgtccttaggattgtcttaataactttttctagtttattttactgtaagaatacagtgtataatatgggtaacatacacaatatgtgttagttgaatgtttatgttatcattaagacttccattcaacagtagggtattagcagttaagttttgggggagtcaaaaggttatgtggatttttgactgtgtggggcttcaacagcccaacccctgcactgtccgagcatcagctgtatacatacatattttgccgtttgtattatagtagctctgtgcatggggcatgtctccgcaggaagagggactgtcctgactcttgggcctggtggtgattgtctggggcactcctcccagagccctgactactgacaggtcacttcaagaatcaaagaacctcgactatgatgtcatttttctgtaagccctggactactataaattatgttttatctgtcataattaagactcggagactaccaagctgtcttcgaggggaaaggcctgtccctttctccagagaaataattaattgttagagtatatggtttttgaagaatttactgtaagataaaagactggtattttattcttgcatttattagtatttaatcaaatggaaagtgcactttcagcctggaaatcttggcttcagctgcaggattagactgaattattgtttaaagagtaaaaggtatagaattatatgttcaagttatcaagccactgataggttttgggtataatgtaactaatttagaacataaaatttcctgccttgtggactagagcatcggattaatcatttggaagcggggcgcacttcctctgctgcgtggccttgcggtgagatggagcctgtcgctccaggagcacgagacctttacggagttcagtgccgtcaaggcccacttgtccacagccaccggagcatgttgggaacaccgggagccgctggaacgtgtctggaacaccaggctcttccattcgggacactgagtcataaatcatcccatgtgtctcatgcaagaattcttccctgcagaaatttcatgaaacttagtctttgctaagggtaaagaggatttaattctctttgttctcagtggtgtgcaggcttaatgctcatgggtgttgactggtggccggcacatcagtggctcgtgggtgttgacttgtggctcctggcattgctttgcattagaggatagccggcctctctacaccatgacttagaaaattccagccaggcacagtggcttacacctgtaatctcagtgctatgggaggattgcgtgaagccagaagtttgagttcagcctgggcaacatagcaagaccctatctctaccaaaaaagaaaaagaataaagaaaattccagaaaacgtttgtgacagcatcactgttgaggttgtagtgccacaggcagtgcagcaagcatctggtttatctgcgtgagctcatgacgtgttcatcagtgggcagaaaaagatgggatcagacaaaacagatgctttcaggatccttcagatcaggatggcaaatgtttcctgaaatgggccaggccagaaatatttctggctctgtgatgtacagccgctggcacagctacctgaccctgctgttagagctgctgcagacaggacccagaggaggagtggggctgctacccatgatgctagaccgaggttgccgaaactggagtgtcccattgtatgcacgtgtcctaaagcatctccttccatctccttgtctactcctaccgtgcgcatacagagcccctatggtgcgagtacagagcccctgtggtgcatgtacagagcccctatggtgcaggtgcagagcccctacggtgcaggtgcagagcctctacagtgcatgtacagagcccctaccgtgcaggtgcagagcctctatggtgcggtgcagagcccctatggtatgctttcagagcccctaaggtgcacctacagaacccctaaagtgcaggtgcagaatccctacagtgtatgtgcagagcccctacggtgcgggtacagaacccctacggtgagggtgcagaccccctatggtgcgggtacagaacccctacggtgagggtgcagaacccctaaggtgtgcctgcagagcccctatggtgcgggtgcagagcccctacggtgcgggtacagaacccctatggtgcatgtacagaccccatatggtgcgggtacagagcccctacagtgcgggtgcagagcccctatggtgtgcatacagaacccctacggtgcgggtacacagcccctaaggtgtgcctacagagcccctacggtgagggtgcagagcccctacggtgcgcgtacggggcccctacggcacgcaggcttgccccgccacctgctgtccccggattcctgtcagatgtccgggtgcccagcctgactgggcatggccctcctggaagcagtttcagggccagttctgatctcaggtggggatggagagctggtgtctgggcctctcagagctcaggccccgcacatcgtcagagtgacctcaccagctccaagtgccccttttccctcagtttcattatttgggaagtgaggaggtcacaccaggctggacacgggatttcaatccgtgtgtccccctgttgcccggggtggctgcatgcagggtgagttcagggaagctctggatgcagtgagcgaggccccgcccagcctcttggtgggagtcactggcctcacagctcactgcaattcagagacctgcagtgtgaagattcttccagattactggatggaagggacttcagtgacctcatgtaagaaaggaagtcacccactggtagcctcagagagggaacctctggcagtctggctcacagccggggctagattcaaactgtatccaagagcagctgctgagagacccacctcagtcctgcaggagtccaggctctctcccaggcccccagggagggtgtttccacctggtaccttggggagatgtgaccagagctgctggagggagcgtctacctgctggggtcagggggtctccatccgcccacagtgtcggctcaagaagtgtgtgctgtccaccccaggcccagggcaagtcccacgaggccgaggctgcaccttgctgtccagggggccgcagctgaggcctgtgcagcctccccggtgctagtgccagcatggtacaggagtcgcagctccaggaggacatgcaggctgcctgccatgagaacatccctctgctgtttgcagaccgaggcccatgggtgcagaaggaagcgtgccggtgcagggcacgcagggccgatgggagatggactgaccagtggtctggaccgagcaggcagcaaagggccctgtgtgctgaactgagctgctgggacttaatgcacacagaaccacagaaccacagaacgtaatggagaagaattgggtaagggtgagtgggagataaagaagccatcagaatgctgctgagtctggtgggggttggaggtcaccggaaatagctcctcccaagttttactcagatcttcttggcagggtgcatcttagcatttgtagaatgcaccaaggaatgcctgggaagggcatgggggccctgcaggggtcacaggctgggagaggaggggcttactgccttgggcccctggacacaggtaatgcctttgcctcaggtggccagaagtgcctgtaggctttgcagaaagctactgttcctttcctgtgtgggtgtgtgactcctggacggttgccggagattgccctgaggctggggtgggtgcccgtcctggagcccccatcccacagtgctctttgtccgtaggatctgcgcacacaagggtttggttgttgaacctggagacacacattatggtgaatcccagtgttgactgattatatcattaagtgggtcacatgacacaaaaaccacacgttctgaatgtacaaattccatcccagtgcaggtggaaatttgtattaaccatggctttcttcacatggcttctttgcaaacaaacacttggtactttgctagtacaaggtccttccttggtggggaggggtgtaatcccatgtcgatgtctggacgaggagaaagaggaacttcccctcagccagtggacgagactgtccaggctgctccacagtggccacagagagcccccggcacctgctcggggcaggaattggtggctttggccaccttgcttaattgagaaagttgatgtttccgtcagatcttcttgtgttcgcacatgttacctattctctaagaagtcagtgaaacttcacccaactttagaggctataaagaatgaggttattttctgccatgacatatttaagctgaagcttcccaagccataacagttttaagaagtgacatttcattttgaacaccagcctgccacctctttactcctcatgacagactgtcactgtgcagcgcagcagttagttggttcctgaagtgccagaaaattcccaggttgtgaggagtgtgctgctggtggggtgagatgtgcgacccggcgggggcctcggcgggcacaggcgggagacccgggccagagccctgtggggtgagcgccatcctggccaggccacacggccggggcagcttctttcccttctgcaaggcagttggcattatcgcggatgttagcataggaagttctagcgggactagttaaaaatgagggaaaacatggtgttctctcattgtctttttcctagtaaactaaaggaatcatgcttgatgaaggctcaagtgtagtatgattcaatcgggcatgagactgtgctgaggtctcggatgtctcgggcctggggtcagcttgaagagattcataggcgggtctcgaagcccatgctgctgggagggccgggctgccgacgtggacgggtacagctccctggttcacacaagacttggggttccctccaccgtggaatccgtcttgctttcacgggatttggggactgtgaaatctcttctcttctaatgcattcccgttgtctagaggctggggagcaccatttgattttaaaggacagccacagtcctgccagctccatagagagagcagaggtggcctcatgttctgagcagagggtgccatggtatttctgaccaggcgggaccctggctggactcacgagattgtgtgagtccacaatgtgcttgtcagaagccaggcgtcctggagttagggtcagattcccatggtgggtttcattaccctcctagagactggcggggtcccagcctcttggaagtgtccgctcagacactgccaggtgccttggaggtagcagaagcatctcttgatggcaagtgtccattgtgacctgtgttgaagacaaggtctgtgtgagaaggtgcactggtacctactgtgtcctgatgacctgggagtgtcgtgaagacagagcagccagtgaccttctgaaaccaaaagagtggctgcccactctgcctcctggctctggcacggggacggctccagggttctaaggcctaagctggctgcactacctcccgccctcaaggacgattggcatctctggcgtgctcaggcccctgcagccttgccaaacaaacaaacaaacaaaaacaacttgtaatttttcattttatctgtattttgccattaaaatgttgttctctacacaattagctgcaggacgcacagtgtttagcctgtggacgtgtctcccagctctgccatgcaccgtgcgtgtacacctgagtgtactcaggtttgcatacccccgacactgggacattgatgtcatggaatctcttcatatagatttttctttggtctgcagtgacatggcaagtggtaaagccttttatgaaacctcttaaagaaacagatgatagttactaagaagcttccaaaaagactttttttttttttttttttttttttttgagacagagtctcgctctgtcgcccaggctggagtgcagtggcgtgatctcagctcactgcaacctccgcctcccgggttcacgccattctcctgcctcagcctcccgagtagctgggactacagacgcctgccaccatgcccggcttatttttttatttttagtagagacggggtttcaccgtgttagccaggatggtctggatctcctgacctcgtgatccacacgcctcggcctcccaaagtgctgggattacagttgtgagccaccgcacccggccccagaaagacgtttataggctcatcttgacagtgttctggtatcacaaaccaattgtcagttagagctagagttggtttagctaaactgtcggaatggatatgggagtggcagttataatctggaaacattgttccaaagtgctttaagttccagggaatttttggagcaatttgttaaaactgtacacatttacgttttctgcccttttctctaggtgtgatctatttctttcacacacacacacagcagtttgtatgttaactgcttgctgactgatttcctgcttgattgcacagattcaaagcagtgcatgagcttcagaacagcgtttatcttcctgcattactcatatttagttccatatatgtaccaaagagaagagttcagaaaagaaaaccagattttattttaagtatgatttttaaatgtagacaggtgccagtttatatctcaaaatgggtgatttaaagaccagtgaacagatttccttagatgtccgtctgcttctgggatctgatgtgtaggcatcttcacgttggttttataatgtgccacgcgtcaggtgttatttcgatgactatgctgagccctttaataagacgcacgtgcctggggtgcttctggaaccttgccaccagggctcattctttgaccatccctaattccccagggctcttgttgttagagtattctttacaaccaaagcatcattaatcagaaaggtgctgtgcggtgcggggccggctccgatgacagtaataaaaaccggcacacctcctgttccaggacccagaccctggaagtctgtgcctaagccaagacatgagcagcgtttgtggaatgcggcttcagatagaaaccttctttcaatttgcaggcctggttatgtaattctaatgcagaatctcccccttcgtgtttgcatgcgtgtagccgggttcacagaactttagccacaaacaggagtgtttccctttttccagggctcccgtgttaggcccccaccaggaggctttggggtggcgtttgggaacgccgtttggatcccttctcagtttgacatcctaggtggcagctccagttttgtttggtgaaacgatttcaatgtaacagaacccctttcggttgtgagagcagaatgaactgagccgcacttgactgtcttgtgctggatgtgacccagccgaatccacggggagacccctggttacagcggggaccacgggtggggtctcagccgtggccctttatacttggtgagcatcagccacaccacgtggccaggtttatgatcaggtgatagggatgaagtgtttttgacacatgcttttctttttttaaattaaaatactatctcatgcctgattttgaggtgggctgagcatgagtcctgaggatgagaggggcttccccaatgccccttattccctgttcagaagggagattgcaaagctagttttcatcttgtgatgtctttgtgggaggttgtgaggcagtcagacacggtcctcttcctcccccaggtgagccaatctcccccttcacacagacccgaagcccaggccacaagggacctgggctaccttgtttgtaaacagcttacaaggaggctggtgatttctcccttttaacatgttcgtttttatgtttttgaggtgtggtctcactgtgctgcccaggctggtctgcaactccaggactcaggcgattctcccacctccgcctctggataggtcggaccgcaggtgcacgtcaccacacccggctagtctgtttctgtgtgttttcattgcacaggataccagcagtggaaatggttaagagggaaagacacagagctgcaaagatggtcctggaaggacggtttttagacctgacagtttttagtgcagcaggcctggaaaacgactaccagtaggggaaaaagaagagtttctgtttctgggtctcttccttttaatatggcaggaactggcctctggcgccaactgcttaattcagaacattgttatttaaacgccattcatgttaaaagggagatgaaacgaaattcatttttccagaggtctccaaatagccatgaaaaataaatttttttctgccaccaagtaccatcagccactcatgtggtttaggtggatgccgtggtggtgccgggagcactaccagcctgtggggccgtgggcttgtgcttcgccggagtgggaagtggggacattaggaagcccgactgttgaatcgcctgggcgtcctaaatgtgggctgtgttgtcgtccctgtgcaagcctgagaggcagacagcactgagtccactggatgcctgcttgtctggttgccccttagactatggtactctcagcaacacggctgtcccattatgtgcacatgccctgttacagcttttggagccccccttaggaccgatggttcgaattctggaagtcctaaacatttgggtcttccacgtcgctgtttattctgcagatttgaggctggcgtgtttgagttagacgggacactggggctgcccgctttcctttgatggtacgccgagggcctctctgccccgtgtgttccctgaggttccagtgggctgcttcagggaaggcgggccgggaattcctctctgtaagacaggccccgttttatgcagctgtgaaccttgtgcttgggtgtagtaggtggtcggctcttttcttttctcctgttcacagcacgcttatagccagagcagactctatggtttgcctggagagagcttgcacacacatcgtcaccctgtctctggtggttgtggctgcagcctcccagacgcctctccctgtccccacccttgacacgcctggaatccgtgttctccctcgtttctccgacttcatcccaggacttggccctcacggctccaggagctgctgaggcagcttcatctcaaagccaggtcctctccctcctggtgacctggccaccaccttctgctccttaatgctctgtgctgcttccagcgccagtgcctttgcctgtgcgcacctgcctgcctcagtctctcctctcctcctcctctccacccagaaaactacaacactatcccttctctctcagcacctcctccaggaagccttcctggactccccaggacatccaaccccttgatacaggctctcattaatcctggagttctccttctgaattcctatctcaattatcattgcatgattcatataattagatattttgttcaacatatatttgctgagaaatcgtgggtgccaggcactgttattctaaatgctggggatacagcagtagatcagctaagactactctggtttgaagaaaaaacaggaattcctcagaacacagacttgaaaccagcccaacgttcctgttctcacacaaggagaagcctagccagccatggagagctgcagtggtatagtggccatggagagctgcagtgtagtggctgtggagagctgcggtggtgtagttgtgcttctctgagaaagtgacgtctgagcatggttgtgagtgggatgacagtggccactgtgcaggctgggaaggagacagcagtagcacggaggctgtgaagcgagagcgaggctggagtgtgaggggcagtggcggggggagcgggggcgtgggtgcgatggggtcatgggggactgaggccagagaaggaagtgtggccctgccgaatttgggaccatttgggctagggggcccccaaagagacctgccgtgtggagactagccatggagaaccgtggtggcggagtggccgtggagagctgcggtggtggagtagctcacagtgttgggccctgatctgtcaaggcttttggccttttcctcatgatcactaggtggttgccacagctccagccatcacatctgccatgtcaaggaaggaagggtaggggatggtgccatctgactttagaaaaagtatatgaaaacaagaactctctgcaggcttctcctcgctctttggctacagttgtgacacatttgctgcctgtattggagcttacattctagtgaaggtgacacaacaagtaagcaaatcacgtcactgtgattccaggtcatgtaaggaaaataaggcagagaaagaaggggtggaggtggtgactgttttcggcggcttctctgagaaagtgacgtctgagcatggttgtgagtgagatgacagtggccactgtgcaggctgggaaggagacagagcggtagagcggaggctgtgaagcgagagcgaggctggagtgtgaggggcagtggcagggggagcgggggcgtgggtgcgatggggtcatgggggactgaggccagagaaggaagtgtgggcctgccgaatttgggaccatttgggctagggggtccccaatttttttggcaccagggaccagttttgtggaagactaacttttccacagatgggagtggggggatggtttggggatgaaactgttccacctcagatcaccaggcactagattctcataagaagcgtccagcctagatccctcccatgcacagttcacaataggcttcacactcctatgagaatttaatgctgccgctgacctgacagtaacgctggctcacccgctgcttacctcctcctctgtggcccgtttcctaacaggccacggactggacccctggtttaagccatatccacaggaagtgttttctcatcgtgatggaaatgaagggaagatgtgatctgatttacttgtgtgtgttttcattttattctaatctttatttttttaactcagaattattttacacctcagtttttattcagaaaagcattaaccatcatttgttttgcatataagacatggtgagatcacaataagtggagaatgtttgccatcgtttttctacttgacatcaacagtgtaacattagcttttttttgtatgttatatttacccatgtattcataatttggggtactctttatttctttgtatagctctcatttttctttttccttttttttctttctttttgtggggacagggtcttgctctgttacccaggctggagtgcagtggcactaccgtggctcactgcagcctcgacctcctgggctcaagcaatcctcctgcctcagcctcccgagtagctggaactacaggcacatgccaccagcctggctaatgtttttatgttttttagtagagctggggtttcgccacattgcccagactggtcttgaactcgtgggctgaagtgatcctcctgcctcggcctgccaaagttctgggattacgggtgtgagccaccatgactggcccagattggatattaatacagtttttttctccttgaaaagttgactcgtactaactgtagaaagctgagagaatgcagataaaaaaggaatagtttaaatcatcctaccttatttgattttttaaaaataaactgattttggaataatcttagatttttggaaaagttgcaagcaacgtatggtgtggtttactttttgtgggtaatttttctccccccaggagatcacatttgtctccttccagtttctggcaccttagcccagtagctcctgtgtaggggtgctaaggcattggttaaacgtctcttgatcgttcctggtttgtttcccgttattttgtctcccttttgcttctcccctggttgggtttctcctcacttctcagtgggttatttccacaatcgaccttggttctggaccagtcttgacagagctgccagagggagcctcgaaatgcaaaccagctgcatctcctcttgttgaaaactctgtggcttttcagggaaaaggcagccagcaggaccggcctggccatggcggcctcagggcccgagggtggctgtgtcccccacgcctctccaggcacaccaggcctcatcccccagctctcgtggcgggtgccttcaccctggcctgcgtggctcctcgcccgggggcccctccccatagttcagttctctgtgtaggtgtcagtttctccataagctctcagctgcccacactctccccccgaagtgtggccccagccctgcggagtggttccctaaccgccactctgcccacctcgtgctagcctgggtgtgggcttgcctgctggctctgggctcaggctggggtgctgtcagggttgcaggggtcacagtgaatcttcatcttccgtgggccagtccccttcccagcgtccctcctggggctgtgggtctggcctcccccgttgaatggccctctcttgaggttgttgggcattggtgaagatcctgatggggtctcatcactggagtcagacgtctttcttcctgggtctggggcatggcggtattactgtgcgggctgttgggagagggtctgttaccctcatggctgcttgtgacctgtccaggccaccactgtgccagcctttgtgtggctggtattgtggcttctaagttgagcctccgcctggctgggttgcgatggtttcactcctgtcaggttttcatgctattgaaactcacttttctcactgcctgatttctgccttttgtgggtccctcctggtgtccgtgatgccctcatttagtctgcaggcatccccccacctctctgctcgcccggtgtgcacacctgctaggtcagccctgggcatcgcatcagagacgctgccgtgctcggtggcctggggcttctgtcctgtagaggcctcagccattgcattttaggaatcggcactaaactaacttctactgctgcccacagaagaactgtgccaaatgctctggttgtctaccggaaaaaaaggtagtatgcaggtttcagtggcatatcaaattccatttctgtgggcctttgtgggaggcttgctcttagcgggggctggtgggggtgggggggggtgggggtttgtgggggtgggttccagctcattgttgtgttcaggtgaaatgaggcagggctttattttgatcctatttaggttgtaagcaggtctgaggaattcacttcctcatgcttcacatacctaaataattagccagttggatatggacaggagctggaatctgttgctcatttgtaagccagattctgaactcattcattgttgcagttataaactggttgccttttttcggttcttggaatgatttggatggagctcacctggtccccccagctccctgctttgtgattgattcagtgtgttcccatggcttcaggccacctttgctggtcaggggagctggttcagagggcttgaggccagcctgccctttggatgagaggcccatgccatgatgctggtcatggggatagcaccacagggctcagtcggggatatgccagagctttagggtcccttgggccagcagctggggtccttgggcatttcctgggtggcggtgctctctggggtgcagagttggtcattccagggcaggcagttcacttggccacaccaggtttggctggaagccttctccaccgcattcccaaccgctggcctcccaagtttggcttcttgtggtcagggcccagaccatgataaccttgaggactcctctctccgggagactgtcggggctaagctgcctgtggccctccaccgccctgctccttcctccgggtgggggacaccccatcccccatgcccctacttcagcttgctgggattcacccccagtggccttccaaggctcctacctttctccctggccctgtctctgcacactccaatgtcttcccctttggctgacgcttggattgggggtgaactcgaggtgtggtctgtgcagaatggcgtgacagcccttccagcccgtcacggtgtgtagtgcccaaagccctggccgtggccatctcaggttagaccctcagagtggcactgtcaggtagaggagtcaggggtcttattgatgaggaaatagaggcttgagagaggagtgcgcagctagtgtctgaccagcccccacatggggcactccccagtccgaatgtctgcagtgcagcttcaggcgctgatgtgggcaaacccttcctctcccaggccgtcccttcctgcagctgctcggacactggcacatgttggcaggcgtcagcaccagggctgggctcctgcctgggactcgaatcgggagcaggtcccacggaggcagagcagccgagaatcaacggtggccatagccaccacatcctgtttccaggggcaatggtggcaacagtgccagctgccctgcctgctgtgcctggttgccccacagatgtttcctgaagcttgattttggctgtgattggagcgtggccagttctggttcctgctattttctgagcctgctcctccagccttcccagaagttctttgagttgtggagtagcctttcagtaaacggcatttgtgcttaaattagcccgtgtcagtttctgacacctgctgttaagagtgctacctgatgcaggtgctcggggctggccaggatccccacctgagtctggagccctgagcccaggcctcctgactccgacagcctgcagccctgcccgaactgggatgatagagcagcaaacatggctccatggagagcgaaacccaagctgggctgtttactgccagtctgctgggagctttgacccaccatcgtgcagggcgagtttccaagaaatggcgagagagcatccagatttctcacgttgcctctagagccctgttgtctgaccagtatcttctgtgaacatactttgggaaatgatctcatggacgcttggcctggatggtggtcacactggtaattcagttccacaagtattttatgagccccttgtgtgtgtgatgtgtgctgttcttcagggagccctgagcagagctgccagcatcctgcctgagaagcagtggcccgggatggtgggagatgtctgcaggcgcagggcggaggctgtgggccaagattgtggctctgagaaatggagatgggagaaggggaggcagtcactttggaagaatgggcgggatggtgatgatttgaatgagacttgggggagttggggcagcgtactccaggggataagatcagaggtgaagggggttgggctaaaatgttgatcatggtgggaacagtagtgatccccaaatcctacagagcctttgggaagcctggtctttgcatacgttccctctaaactcgtgccgacgttgtgatttggtctgatttatcctacagacaaagacagttgaagcaccaagagtgattttctcacagcaaagggacagagggtgggaggccgtgatttgcaccccctgcctttatctggcccctgccacatggtaagtggaaggcaggtggctccttccacagggctctctttgccctctcgggaagcctggtttttacccttgaggcagcagggaggctgcagggtgagatgttgaaggagtgtgatgtgggcagagcctctgtgatggggcatggtttctggcacatcccatttccatattctggggtgatcgaatgggatccggttcaaatccctgtcagtctgcacagaaaaggggaggttttgcaggcggctctggagtgtgacagttgaggattgaatcttgagagtaatgcttctacaaaacacttgtgtagtttgcggtccgctgcccgaccctggtccctttaagggacataaatgcacctctctctcctcgttcttggaaagacagatgagagaaccaaagagtggccttagaagcatatgtaagacacagaaaggaaagatcagctggagtgctggtgaagggtttcacaggataggagaccaggcagcaaggtgcccagcggacaagcagggagggggccttcagtgaaggcgcagagatttgggatgcatgtgggattcagacctgcttcattgtgggaacagagcaggaaggtgccagtgagctgcccttccaggggtcagcagacctttctgtagagggttccaggggtccgcaggccttttctgtagagggccagagagtcagtgttctgcgcttgcagggccacactgcctctgtcacaactgctcacctctgccactgtagcacggaagcagcaggagattgtgtgtaaataaatgaacacaattgtgtctcaataaaactttatttacaaagacaggtgcagtgagtgagctttgccccacaggctctaatttgttgcccctgctccagccccttgatgtagggagcctttgctttgttgttctcagtgaactttgagggctgatggttgggttggagtggaaagagcccaggtgtgatgggagccgtgaggatggccttccttgagtagccacgagctgctgtgggtcttcctgagaagctgtggcaatgggaggacagaggtaaaatagcaagacccagtgcctaaggaggctgaagagggaggatcgctagagcccaggagttcaagactgcagtgagctaggattgcaccgctgctctccagcctgggtggcagagcaagacctcgtctctaaaaaaaaagaaagaaatgtacaagtgtaaaggtagcctatagatgtgttcccctgtattccccaggctctattcttcagcctcctgagcagctggaactacaggtgtgtgctatcatacccagctaattttaattcttttggggcagggtcttgctacgttgcccagtctggtttcaactcctgagttcaagtgatcttcctgtctcagccttccaaagtgctgggattacaggcatgagccactgcacccagacttgtacatctctttaaatgtaaattaaatgtgctttccacagcattagtggaacaccccagcattgctcatcctctccgggctggctcctaacacaggtgccgtggcataggtgctgagttgaatctctgtttttgtaagtcattgcatacatgcttcattctaaaatgtactttattccaaatattgaacagtttgtcttcgggatttattgtctgtggtagttgttttattaattgttttagtaaaacaaagttagcttagttgtgggaattatttaaaaggagctcttaccaggtcagcttccttcggtgttgcgttggttaaagataaacgagaagaatcgggatacagtaattttaggaaataaaaggagactgtagtattggttggctgctctaggtaatggtggtaattttctgtcttcagagtaatcatattgtgaaaatgatgcatcgtataattccaaaaatgaggaagagctttggaatatattttgtgtcttaaataaccagtacttctgttgtgtgttttatatacgaccagcctcttacctatacactttgtcttaaaaattatttctgtttaggtacttggaaaaatggacaaggattgtgaaatgaaacgcaccacactggacagccctttggggaagctggagctgtctggttgtgagcagggtctgcacgaaataaagctcctgggcaaggggacgtctgcagctgagtaagtatgagcccacgtgatcctgtataccgcacatgctgaagcaaccgaggagtatatgtgataacggcatgttttccattgatggcagggtaacgcatagccttacccccacaaccgcaaccacgagtccgtctctcaaaacagtgtgctgcgacggctcctgcatttgcagcttccctgtgtgttgcccaggagctctccacctccgatgaacccagggccgttcccttcataccctttcattagtagctctaagatgtttgattaaggtgtacgtttacagaggagttggttggtgatgagcattgaacatttgggttcttcggcatatgtctctggaaatttagagacagggagatgcaggattaatcttgattaaaaaaaaaagcccagatcagcgttccctgttcctccagagtctgccaggtgagtttcatactaggactgcttgatgttctggaatcccttaaccaggagtcccagttgccttttgagagccgtggtcagacccttggcgagggtgtggctgaggatggccctgccagggggaagggcccgaaagccccttttcagcatgactttaagttcttgtcatttctaagagcgtacatgtttctctttttgtgaacagctcccactatatttctctaattgcaaaaacgtaagaaatgtaaagcattccttagtgttttgctttgaaatgtaacatttaatttcctccgttcattctattaaaattgtagctcttgttatttctgaccaaagaagaagaagaaaaaaaaaacacccactcctatgcttggtgtttctcttaactggctaataaacacaatgccaagaacattagataaagaaaatacataagaaacataaaaattgattttaatgggcccctgtccgagacagccataatgagcacaagcgcagtcataaatatcagcactcgcctccgctgtcgagatttttcctgtagagctgcacgttacaatcaatatagtctttttgagaccaaaaaataagcaaacctttgaaccatgtgaatatactcttttcagtttctatgagaaccatctggctgtagtgttcagaaagtcacaggcaccaaataatttgtaggggaaaatgtcattttgtcttttagcatgttcagttgcacaataaatcatagaaattatgtgttggttttttttttcttttgggaaaaaggtacaaagtgaatttggggaagaaaaaggaaaacaaaacaaaacaaacattataagatatgtttagttaaatgcccattgtggattaggcaaataggatgaagacgcttaattttgaatttctactttatgaactttctgaatcaagttaggatcaggttcaggtgtaaaaacagccgtgaaataatgctaaatcctgaataggatctggctgattgctctcatgaaaacacacctgtggacaaaccatgggagctggggctggtgccttcatggcccctgggaacttgggctcctctgagcttggggtctccagatggtggtccctgccctggtgcttcaagacagctcctgggcctctgccacaggtaggggagaaagaaaggagggcgtgtcatatatgggctaaaattaggtgtcttgtgagtaaggaaggagtgggatttggggggcagccagcagtatttgtgtgtagttaattttagtggggggagcatttaaaagtttgagaatagtatataaaagtatatgaatagtcaattaagtttaacattttatcatttttaaaatttaggtaaaaattacatagaagtcagatttcaagtgtacaattcatttgacaaaagtgtacaaccgtataactaccgccgaagatatagaacattcaagatatggaacattccagaaaattcccttgtgccccctaaagttagtcctctttgtgaatttttgtttccatttctccagagtaaattcctgagtgtggaattgctgggctggatggcaaatgtatgtttaacttgacaagaaattgccaaaactttcttcagagcgggatggaatttccactagcagtgtgtgagtttcagttactccacgttcttggcagcacttggtggtgtcagtttttcagattttagccattctggctggtatgaagtatatctcattgtggttctaatttgcactttgctgatgacttatcctgatgaagtcttggccattcctatgttttctttgtgaaatatctactcaagtcttttgcccattttttttttttatttctttgagatggaggcttgctctgtcacctaggctggagtgcagtggtgcaatctcggctcactgcaacctccgcctcctgggttcaagcaattctcctgcctcagcctctggagtagctgggattacaggcacgcaccgccacacctggctaatttttgtatttttagtagagacagggtttcaccatgttggtcaggctggtctctaactcctgaccttgtgatctgcctgcctcggcctcccaaagtactgggattacaggcgtgagccactgcgcctggccaccttttgctcattttaaaattagaggtttcttgtttgtgtttttgttgatgttattgatttgtggttctggatgtaagacttttgtcagatgtctgtattgtgatgattttctcacaagttggaggcctgcttttttgtttttccaatagtgtcttttgatgagtagaggttttaaattttgaacaagtccatatgtctttttttccctttatgtttaacactttttgtgttccctgtaagaaatatttgtctactgtaatgtctgaaataaattctcccgtaatttcttttaaaagctttgtagttttttttatgtttagatatatgtgatccattttgaattacctttttgtgaggtacagagtttattttttccctgtagctatttagttgttttagcatcatttgttggaaaataaaaattgtctcctttcttcattgaattaccatcagttgaccaagggtgtgtgagcctgttcctgttttgctctgtttggttcagcctacctttgcctgttctatgcccgttccatgctggcttggttaggtagctttgtgatacatcttttgttttgttttgttttgttttgagacggagtcttgctctgtcgcccaggctggagtgcagtggtgtgatctcgactcactgcaagctgtgcctcctgggttcacgccattctcctgcctcagcctcccgagtagctgagactacaggcgcctgctgccacgcccggctaaatttttgtatatttagtagagacagggtttcactgtgttagccaggatggtctccatctcctgacctcgtgatccacccacctcggcctcccaaagtgctgggattacaggcgtgagccaccgcgcccggcctgtgatacatcttgatgctaggtaatgtgagtccatgaatcctctaaatttatttatttttgaaaggtttggcttctatgtctcttaagtttgcctattacttttagaattcaggtgtaaatttctgcaatgattcttttttggatttcgactgggagttcattgaacctggttgtcaattttgggagggttgacatcttgatactgaagtgttcagttcttggctttgactggcgtctgcatttgtttgggttctttcattgtcctcggcagcgttgagtggtttttcagcctggaggctttgcttatctggcagactccatttctaaatactttgttcttgatggtattctaaattaggttgaaactttttaaccttttaatttattgctgcttgtgtttaacaactgacttgtatgttgatcttatattctgggatcttgacttaattcatgtattttttccagggttgttttgagattgcttaggattctgtataaaaattcatgatgtctatgaataaagacaataggcttcttcctttctgattgttatgctttaatttcttctattgagctgtccagaaccctccaggatgacttcagtaagtgtggtgacaacagacgtccttccctgtttcctggtttgggggagcttgcaggatttcaccagtgaggacttgctccccatgttgggtttcagaggcgtcttcctcactgtgtggaatttttgtcaaatgatatttcatgtatgtgttgacatagtcatgtgctcttgctcctttattctttaaatttggtagaataaatttttagaattttaaaccaggtgtatacttttctttttttggtactgtctttgtcttgttttggaattagtctcattctgatgacagatcaatttggaagcattccctcttctattttctgaaagagttaagtgttggattgatattactttatctccaaattttgggatgaatgcaccttggatgccatctgggtctggtgtcagaagccttttgtgaagcttcctggtttagtagaattgggtgctgccttccctcatctcggggtgctcccacctggagccatctgtgctctgtgtggctgctgtcctctggttgctgagtgacagtggctgctgggatttggggcagcatcctgctggctctggcccctgccctcacccttctccgagtgcctatgagtcccagggtggtccttgcttcctctgaatgggtgtttctttagtagataaattacaggttgaccactgggccttcttcagtgacattgcatctgtgcttgtgtacaaagtgtgattcccgctccccaggtgaatccacttacctgtgtgtggcttcgcacggggaccaatgacttccttgcatagttacctttccctccctaaaaacgtgtgagaagcacatcagttgggaaagtggtatattttccaaaagggaagcaacataagctgcttttaagttagtttcataactgcctgacagtatcaggtttctgtgaatgccatcacgtccaggagcacttggcctctgcaagagcggagcagctcccccgcgccatcttcccgcagctgcagagctctgacctcgtcagattccctgcagtgcccacagtctaatgagaggggccaggctgtatgtgtttacttttctaatgttattttggggcttgtttagttttccataatgttgattgccgtatttgattacttgaaaaaatggaccgtatcaccctgggtcatacttagattacaaaaatagtagcagtaggacttgtagatcttggaagctggggagctaagggggctcatctttcacttaccaagggcttacccttgtttttcattcttttatttttttcacataagccttttcagaaaaatataggaaaagctgatagagtccaattgaactaaaccactttaaaactttttgtattttggaaaatgtggggactacacacagactgtcttctactgcagaggctctttttctgtcttcatggtagggatccatttacagggtttgtgggtctgcttttggcatctggcccagccagcccttggattgaggctgggtggggcatgcaggttggccctgaccctcttctgagcacctggctggctggacagatagggccttcagtcaccagctaggctggcctgaccctagaccctctggaacgtgagaacgtatcctgccgggcctctgtgttgaacctgggaggagagttgtctgatgtcattggatgccctatgagtttctgccctcgaaacgtgccccatggaaagcgtgaagatgcctttgagcttcccgaagggcagctgcagcaggaggtgacctgcgttttgcctctctcctgctcatctctaaatgtgttcaggaactcagtcgaccctcagccgtgcatggggtcccggctggcttggtatgtgcacctgccgagtctgtgctgccagttatccccacggcctctccgtgcaggtcggtctgaccagtgccagtcggatggttcctcaaggtccacgggccatgagaaccttcctgggaacttcacgaattcgtttttttctgacagattgggaaattaatacagacacttgccgcattcacgttactataattgatctttcaaggaggagaagaaactgttcttaaggacaaacacttagagaagcactgccagtaaaaataacatccaaaaaaacgcgctctgtaggacttttacctgcggcaagttcggctgtctcattgcttttcctcagtgccgtgaaataatgatttgtgttgtatgtgcttaaaaaatgtgattattttactttatagagtgttccttaaggaggtctcttgagtcaaataagcatgtttctgtgaggaaaacttgccaggcgctccttggctttatagaaatcgtctgtttttcaaaaacgaatggctgaatgccctggcgagcctggaaccccttgttcttgcccctgctggctctgcgattccatgtcggtgaggcctgtccacgctgacggatgttgcctcccgtttctgcctgagaggggtaaatgatcagtggtggatagggagttcctcttgtgacttatgttatcaataacacaaattgtgcatatacttcaccccatgctaaacatttatagtgcagtgtcctttagaagccagacaatggcctcgtctttcaggttgatggctaaaaagacaagacaggaagccaaggtgtttcttttcagctccacagatccttgtgatgaattatgttccgtgacgagagggtacgatgggggccgactgctggcccccggacacacagtgctgcacatggggcctgcagaggtgttagcgtagcccgtgatggtggcagctcttggaccttagtaaaataaagggaagcagcataacatatgcttttaagtgagggtatggcgtgaaaaccctgccgttgtgtgataggagacgggctctgcaggctgagccttccaagtcgtgaatgatgaggtttgctgtgctcctctgattggcagctgaaagggcaggtcagagctcctctctacagcactgcggagaatcccaggctgtggagcactggcccatccaccccaggacagagctgcctcgccacagaagagcgaggttctgggattcactgtgaaattgttgtatggtttctgatctagaaaatcaaacctaaacaatgcgcaacctcaccagcttcggtgctcttgatgttttctccctgcagctggttctttgctgacctgggggcagagtagacagtggtggcagccaggtggatagtatttaaacaagtgtcactgagatttagggtccttatgtgctggactcatctaagaaaaaaaaaagcaatgcaaaagttttatttctgtcaattttgtaactgtgttacaaggagacagagatggcaaacgtgtgtgcctgtgtctgtgagtcagaagcaaacttgttcatttcatttaattttaagtctgccaggaacttcttggaaggaagaaaagaatggttgaatgacagctacaaataggtgagttcagaatatgatccaaagtgtcagagcaaaagattttttaagtttccaacatttggagtaaaagagcactttagagtaacaggtaaatgggttaacttcaggcagagagaggtggatgtttctgcctctctggtatgttaaaataaaaccccttaaatcccctgctcttaacaataagtttccatttaagagtcattgggcttcacctctgttcggctctgtttgtgaagggagggcagcttttctggggagatcatgcccctctctcctttatgtggccacagagatcctttccctgttttcatgaggaggaaacatggaaccttggcacaatccagttctcatctagaattacattgtatgctgtgcaggccaggggaggaaagatcccggaagtggcagccaccggataggcacgttgccgccacagccagcatcggcgtctgttcaggtttcaggaaggtcacttcttggctcaaatccctggtatttccaggttgtcttcagactgcggctttcaccctcaggaagccccagcatggccttgggcccagcttagaggcttgtgggggtttgggtgtagccccgtgcacagtatcctgtctaggattcataatcttgcaacagccatccctgatgggattgggtaagatgacagtgtcctttctcgatggccctggtgccctgtggagttgggtcctggccctcactaccctgttgcgtgggtgggccacgcccctcctgctgatcagcctctgttgcagagagtctggccctgtggacccctgcccccggccccaggccctgtgtctgcgctgggcttgcattgcctgcctctcggtcccctcgcctcattgcagtttggtgcttctaattagttgtggtcttgaaaagctggtgaacaggcttgtccacattgtatgggaaataaggttcaatgaacccctgtgagaaacgccaagtgtgggatttctgacagtatcccacagaaacatctcagagcccatttctgtttcctcctggagtctctgtttctcccagaagaggcggcgtggccaggggtcaggcagatgtcaaggaagtgaggactcggagggactggcacctgtggaatagcccctgcttcgtctgtctggcctggtgggaggaggtgtccttccgtcactgcacttcgtccttgggacccctctgtgaagttgttggcatcaatgtgcgtttaccaataagagaaatggagatggggtgagggatggtgggttacaagtcctggggaagacttcagggaagaagtgggtattccctctacttagctgaacttgcagtagagactgccactctgggagtgacttctgttctcctgtgaaatcctctgtgactcttgcctgcagttgagggagcctctgagaccatcctgattgggatttggtcagtgggaactcaagtcagtattgtcctgggggcctgagtgccagtgtcttaaaaatagagtgtcctccaggtaatgttggatttggaagttcaggctcagcactggatttgtcctcgtgatatcactcgcctactgtacacatgagtcattgtaaagttacgacatgagctcgcatacgtgctggtattagagctccttggacggtgatgtgctgttttagaggagaaaaagctgagatgaaacaaaaatggtggtggcagttacccagggccacgtctgtggatgccatcctcaggatgccattgcatctcgggccagcctccctctgcttttgcaaaagcacaaccgtctggcctctacgaccaccaacacacacctctcatactctggaatttgatttctggaatgcttttttattcttcctatatctgtaagattttctgatatttaaactggctgcaactaatgaatagttttcagttttgttttaaaagtgttcatgtcatttaagctctaaactctcacaatatacttggtttgttaaatgtaaaattttatcagtaattagatcagctccttgatattaatgtacagggtagctcttgcgtgctgatcagttcagaatttaaattgagttaaaggttaaatgagtttaatttttgaattgaactgaagcattgtcttgtggcaaattcatccagaatttttatttccagttgctgtacaagtgacggaagtgggtctttttgcgataaaaacattgtgaatacatttaggattcagtgagcttctgtcatttactcgctcattctctaaacgtgtgagtgccctgctccgtgtcagaccagatggcaggccctgcatggggtggggaggggccagaatgtgcagccccacctgcagcccaagcccagctcaggggcagacaggggcagacggggaagtgggctgttccacaccttgagattggtgaattcctcaagacagcggctggcaggggcccaagcctaggtgactggccacagagctgaatggggctgaccgagttaggacatcactgggtggtgaaccaggaggccctggctgctgacaggatgtaggggcatggaggggtagcagaaggaggcagttaagaggctgcgagccccctcttgggcatctgacggggtggtgcttcctcccagggctaggggagaggtgagcaaagaataacctcaggaaaagaaataaaagacctggaggaacagtttaacaagtgggtggccatgaagagctaccaatggagactgaaggaaaaccaagaaggaccagagagagaatggagccaggaggctggaaggagagaggcgggttttgtgtcaggattgcccagagctccccggagaggagcatctctcctctccatggcagagcacagagggtggaacactgacgtcagatcttcttcaggccctgaacgtaagaattccttggtacctggtctgctttgagactgacatgctgtgtttgattagtttgacttcgggatgccagctaaatgctgtttgctcagcatatgcctgaactggaaatggttccatcacaaaacaaactgaatcaaatagaacgtgggggtggctcagtggggacacagagccagaggtgagtctccttcaccccaaacaccccaagttctagatttgttcttggagctctgtgtcagggttggggtggacaggagggagagaatatcctccgcagaaacacagtttatcacactgcagaattcttagtgttcttctgacaaggacgtttgttcagtttccctctagactgggccatgctctctaaatagaactgaaatcatagttacaactcaaaggcagttgagagaagagttctagctttgttccataacgtcctgtgtcttgatttcactgtatctgtctgttcatcctgctgggggcgttaacccacctcttctcgtacagggtcatctctagtttcactgaggacctctgagaaccctagtccctctgtccatacacatcggcaggagactcacctcccccctttcctcctgtaccccatctgatccacatgcacaaaacacacacatgcaaatatttaaaagtagaaaggcttatggactgtatgacttcagtacacctgcagattcatggagtggttctggagaacattggtccttctgccggcctggcagctactttaatttctggtgtccattggcagaatacaagctcatagtgtgtgctgggggctgggtggggcaggggattaccgttttcttgcagtgattgttcttgatggaatccacattactgctttcaaagctgcttttcctgtgccttcttccagaaagctatcctcccgtccttggttggctggggcaggtgaagcattaggaaatgctctgtctctgcattctcttcgagtaacactggggagtgttcatggcttctggcagaacagcaatgttagccttcagctgctgaagcaagccttctgctcattctagaggcatcttctaaacagatctgcactggtcaggtggggctggagaaggactgggctgagagcacagctatgggaggcaatacttgttcttgttcccaagaagctgatgtgtcgtccggtgaggtctctcgtcagccgaaggttggcacaaggtcgccaggcaagggctttttgtatgtgaagtatgcacattctagccacagagttttctgccagggtgtttagacaagctaaaagtggaatataaactgtattcaatttgctaggttgcaattataaggacaaacatgtttttaagacttaacccattatagtaggaaaatacaaggcttggggtatgctgactctttcccttgttcgtctctcaaatagaaaaatggtgtgtgtaagtaggtgtttgtatatgtacattataagacattctagaaatttctgtcctatttctttaatattcttgccactaaaaatatatgctcctgaaactagggaaaaagaaactgtttatcattcttctgaattattacagataccccaaaagtagcctcctccaaatagtggtttttcttttctaaaaatcacctggaaaaatactgagctttctgatctttattttatccttttcagtggctctgtttggaagagttattgtacaacccagcactgcttttattaaaaagaaaactgggccactcatttccttcaaagtttttggtgtgtttaaatcttctctaggtaaacaaaacttttattgaaaataatattttgagaccgtgacacccttctcacaagaagcggtgctgaaagcccccttgttggctggtcctgcaggcagcctggcgtctgctttgcctgtgggccgtgcagggtgctgggggcagtggggagaggcgtcagtcccacctgcagctttcgggggggtgctggggaggcagatttgacatgaacgcaaataagtgcaaggaccatcagggcaaagagacccaggagaccaggccaggggaggaggcagagagcctggtcaggccaggctggtcctccaggtccaggccctgcaggatcctggaaggcgtgaagatgggctggaggtgtgagcaccaagaatggggcgcggcctgaccttgggtctctagaagttaccctgtggtggcattttctataattgatgtcataaatagctggcttctttgttagaattcatttacttactaagtttggcaaatatgttgaaggaaagaaatgtgagtgtgtggatggatttcagcacgttgacatcagtgcctgtctccttggtgcctgttggagacaccgtgttggaataaggatgaggttcctccctcagaatggttgatccatttccttcagttcttcttcagttttgcagcttttctcccctaactgtagcagaccatctcctggaatctcatattaaaggcataattaatcatgtgatatcctctcgttttttgcatcagagttttcaagagccctccagatttttattgcctgcagatccgtgtgcttagacatagtaccgtcagcagtaaactggcttctggagaagaaattgacaaacaactttatagttgcatttttagccttaatatctgagggcgagaagaatgttcaggatttatgaagttcctgaatttaaaatataagcaataaaatgttcctaatgtggggtccccatctgcatctattattacaaactcttaaagtcactttagcctaacatgtcaataggagttttcttctctttctcttttctttttgacaaattgtgtccaagcaaattagtttgcttgcatgaagcgtcatctgtgtttgcaagctggaacagttttgctggttaagcagtctagagatgataaaattttttgtccgagtatgactttggtggtgaatttaaaagaatcacggccgctgctggaagctcagaggagaggtccattttaaagggcgtctgctgcactcagcccaaagcgttacggggattgtttgaattgacaaaatgaaaatatgtattatattttctctttttaaaatccatttacagtttatttgtctgatatggaggagcagaggtataaattacagagaaattgtcatcatatcctctggatgataagtagggccagggcttctgtttatttcggtggttggttacccactcaggacagtaaaatcacaaagttttagctaaggaaggagaaatcccttctgcctgtataataaatgttgttttgacccaactacactgtttcttgtgataaaaatatgtcacttaaggtttcctgcatctgccatttgtgaacgtacagttgagcgacattagttggtgccatctgtgagtgcacagtgcagcaactttagggggttcacaatgttccgcagccatcaccgccgcccagcactggcatgtttcacagtgttccgcagccatcaccgccacccagcaccggcatgtttcacagtgttccgcagccaccaccgccgcccagcaccggcatgtttcacagtgttccgcagccaccaccgccacccagcaccggaatgtttcacagtgttccgcagccatcaccaccacccagcactggaatgtttctgtgttttgattcttttttttttttttttgagacttaatctcgctctgtcacctaggctggagtacagtggtgcgatctcggctcactgcaacctccatctcccaggttcaagtgattctcgcgcctcagccccccaagtagctgggattacaggtgcacgccaccacgcccagctaatttttgtatttttagtagagatggggtttcaccgtgttgccaggatggtctcgatctcctgacctcaggtgatccaccttccttagtctcccaaagtcctgggattacaggcgtgagccaccgtgcctggcttcatctccagaacttttctgtcttgcagaactgaaacccgtacccattaaacactaactccccatttctgccagcccatcccctggcacccaccctactcctttccgtcttgatgctaacacaccttgtgtgggttcctccaagtcaagagaaggagtgtccaaagacccctgagaccagaaccctctgccaacgttggtagtgctgtttcggcctggagggcaggtgggcctctgggcacttcttcgtcaggacatggagccatttcgggtagggccctgggtctaccctgtcccagccccgttccctatcagaaacccgaggcccagaggtgcagggcagctgcagcaccagggtggacagatgttgatgatcagtgggaaggaattcaaagaaatagaacattctacacaaatgtggggaggtatctttagtaaaaacaggacccaagtacatgcaaagtgcactgtgagggagagagatgctctgaagaaaggcactgtttttacattaatgagcatttaaatgatgctgggttaaccatttggctttttgtaccttgtcaccatctcctttatggtgtgattggactttcgagagaaggtggaggaaggttaatagataggtaggagagttgcaggcaggaaagacagaaggccccggggatgataggtggggcagagggagggatggagaggtgacttcaggaagagcatcagctgccgcaggccagggcaccctcaggaagcaggccccccatgcttgcagctgcccccgggagccctcatccccagtctgacaactcgaggtagatctgggttgctctttattttttgatgatttttgcatagtttcaaggatcagtgtcttctacactgatattctatctctgtaagtttctccgaggtattttcacctgtactgacattgtagtctttccttactctcttatttatttatttaccagaccccaccactgggtgcagtgatcaaaaccaaaatatcaaaccagcaccagaaactcttcagcagaccggtggaacatgccttagagaaagccagaggggtcaggcatagcctcctgtgcctggcctgcgctcgcctgggaagggcacccctcgctgtccaagagtgaccccaggccacagaaaccacgctgagtaccaaaggcgagtccccagggtgtgggcaggctccttgctggcatgttcagcccaggcttgccggaagtggggctcaggctctgtctgtgggataatgatcagaagcttggcagtcatgggaccaggataagaagaaccaaaggacagctctcctctcatggttatgggccaaaaaataggtgattgttttaactgtggaaactgacccactaagggggacctgctgagaggaaggccagtggggccgcagacaggaggggaggccacagccgcccacccgctcatggccgagcgccccgtttcctgaacatgtgggaggggcaggctccccacatgggaaccactgggccgtgactgtggcgctccagctgctggcagtgcacacccggtggggccctctgtggcttgagctgcgtcaccatgacgctgcatgcccaggtggtcatccaggaggatgactctgtgcagacctgtgtgcccccgggcctgggcctcctgcaccccagaggtcagtgacagtggaaattgccacagacgtgggtttgtggccttcaaagccttcaatgtcacagaattctgagtctttagctaaattaagtacatgttcacgtgagtgtgtgatttctccatgaggactgagcctcatagtttgtccctgtaccggtgtcagttcatcgctttggtcttggtggagaattctgcatcgcaggcacatcgtctggttagcgggagacatgtttggccagcggtgaaagactgccttgcccgagttcctgagacttcggggctactgatggcagggagaggctggccgagggcagggccacgcggtccccttctgctgatgtccgtgaggactgggcacagctgccagagtcaagggcacggaagtgcaagcagtccgtccttttctgaagcctgctctttttgtttttccccacgtgtgtcaccttttaacgtttttttcctggctttttcattaatgtatgtaaaaatattaaaagcccttgtatattacatgaaaaactatgtcagctgccttgcttttttctatttattaaaacttttcaagcagtaaaaacattttacttgttaatgagggaaagtgggaaaattaatgacatagagcttggatccaccacgatgtctcctcttaaccatgcgcagccagcttcccaccgcatggagtttaatttctgcgatagggttcagtaagcaaatgcaaatagatttaatgatttgcatcagtagatcatttctcagtttaatatcctctgatattttgggtcaaggactctttctttgggagactagtataatttctagaggtagaattattaatattagtgatattacattatgttgaagtgaagtgagatagatgtatcattttcacaaagtcagatttctgcgtgacttttattcattgtggtgcaaaggaaaccctggctgctgaagtagacttaggagcaggcagaattcctggacgcaggtgccttggagtgaggtgaccctctctggcccccagcaccttgcgagcagtggtttttgcatctgttcaccagcgcatgtgaacctgtgggcccgggggacacgtggtccatttttgttgagtacgttcaacaaaggaatgaattaaaatgagaactcttttcagcaaacgctgatggagctttctgtgtctcgtgtgtggcaccatgctgacggaatgacgagaaaccacaacctggcctcaaggagctttgtctactgcgggagacagagatggtggcagatcagtcctggaggcacaaggagagagtggtagaaatacacaaaaggcattgaagaccagtggagcatcagggtcactttcacagggaggaggccaggggtcttgttgcctgcctgccccaaacgtggcctccattccttctttctgtctcccgctggaaaggctgagtgcaggtgccagctctctctgcctcactgagcgggtatgtgtgagaagcgtaggcctactggcaggctcctggggaagacgtttctcccctgatacaaagagcagcatgaggaagactctcccggctccccagtctgcggacacagttgtgtgaatgtgattgcaggagggagctgggcagctgttatgtgaccatgagggcgtgggactggggctgaaaggtggcgtgctgccaatgagaaagatggggagagctgggcacctgctggccctgtggccggccaggccgcctctgaacacctattctgtgacctgatgtgcatcctcatcacacactgcagccgtgagcagcacgcaggtgatgacgggtcatacgccatctggggacttgatgctccttttagcaaatacagaaagtacaaaggaaataagaatcagttccattaatcagtgatagtcttttggtgtaattccttctagctttttttttgttttcatcgacatatttaaaatcagttttgaattctacttaattttatatcttaagcatttttcttgttctgacatctttttaagcatgatttttcaaggtctgtgcttggttctttgttaaggcctgttgcgtggttgtacgtggtggtattttaactgtctatgtcctggtgaacctctatgtttttgtttctgtttactgggctgcagtaaacagtctcgatgaacactatgtagccctgggtgagtgcttcctgagcaagcttgctttttggcctttctccctgtagcttttttgtctgtaacacccctttctgtattgcaggttggcttctgaaatcaaatgtgaccctaagtgactcctcactgtttttaagataagaaagcattagctctgtgttttcctagcccctccgttcttgtacttagacccttcactctgaacagcaggtatgccagcctgtacttcctggcattattacccagtggcccatagctcagaagtgacattgtgtggtgtgaacgctgtctccggagcgagattcctaactcctctactttacagctataaagtggacaaatcacttcactccatgcctcagtttccccaggtatcacacatggggactataatagcatctaaccacatagattgttggacaattaaatgagctgaccagcaggaaactcttagaacaacgccaccccatagtaagcactcaataaatggcaactgctgccgttgatgaggatgacgatggtgctatttctaccacttcctaaggtcgcccctgcgtgctcagcagccacctccaccctgccctacccgctgcccacatatttcataggcctccttagatgtccctgtctttgagccgggagccctcgcactcccaggcttgcttcagatcccttgcctgagcctgtccagcactttgagcccgctctgcccgagcgctgttctccttccgtgccgtgctgtctgctgtgagtcctggagaacagggaccatgtctatcttgctggccttagtacccctcacagggcctagcccagggggcactcaagaaattgtaaagatccataggccgggcgtggtggctcacacctgtaatcccagcactttgggaggccaaggcaagagactcacttgaggccaggagtttgagaacagcctgggcaacatagattctgtctctacaaaaaaacttaaaaaaaaaaaattatccaggcctggtggaaggcgtctgcagtgtcagctactcaggaggctgaggcgggaggaccgcttgagcccaggagttcagagctgcagtgagctgtgattatgccactgcactgcagcctgggcaacagagtgagaccctgtctctaaaaaaaaaataaaataaaaaataaagatcctgtaagtgaagggttagaagagtggaatatatgtgctcttaacaaagaatggtgtgattatagagatgggaggtgaaaagtagcacgaattccaagttttattttcggcaactccgtcagagtcctgaatgttctttacccagtttctcactcccactgggactctctagggccagcgggaaccctgcaggcattcggagaactgagcgctggctggacctcctcaaaacggggcaccctccagggagctgtcgaggggctcttctgcctcttcagaaaccatcatcagctgtgaaatgtgggcttccaagtggttttgtgtctcctcagtttacagagtccatgtttttggtgactcttgccttggaccctgatggcgctggggggtttcatcgccatttaaccctccgcgtctcacagagaccaagcagtgctttcgggatcgctctgttggtctctgtgtagcacgtggcccccaaaatttaggtgttgaagtcctcatcctcagaacctctggatgtgacagtatttttgagatagggtctcttagaaaggtgattagggtaactcagggtcattagaggagcccctcacccagtgtgaccggtgtccccatgagatggaggttgtggcacagacacacggagggatggccacgtgaggaccctgggagaaggctgccttctgcaagccaaggagagagcgccttggagaaaaccagctgtgcctacaccttgggttcagacttgcagcacccaggctgcagggcttcgtcagggcagccctggcggaagaacgcagcctcgtcggtgggtttggtgatgctgtgcagttcagctttaccgtcttgctgcagcgggaacgtcctgctgtagaagaggcgccgccatcccagacagtgttcataaacaccgacggcaaagtcaggacgggcaggagcgttctaggcaaatgatgaaaatggtattttacacatatttgaaaagaaaggtttgagaaggcatccattattaaaaccaaattcaacagagaatttaaaaactggctgtggtgagcaatgttagtcccaaatcactttttcacaacttgtttctgttctgtcgtagggctagtgagaccagctttcccttgagttctggggcgggacgtggaatgtttgtgaggctacccttcattgaaggggggcccgtgatgttgagtgttcaccgtctttcagaacgtttgtgcggtggcgtgtcccttctgtaaattgctgtgacctgggctgcatgctccacagtcagactcgcttcgccctcttactggtcttcattaattcgtggtccctggagtggagcgggaaatacagatatccacctcctctcattatccaaatacaataacaaattacgaagcatcttatcctaccaaccattatcctatcagaaagcatgtgctaatttcgaggaagcaagaggaactatgtcagatgtgccatgagatgtaaaatgtactcgccctgtatcttggtcttctcctagcagtatcttgtctgacaatctccttgtttaacttcttgggctttttctttgacatcttcccacctttccctaagggtttaactgtcttagatctccttgtctgcttctgcccgagactctgggtccctgtcaactcgggtagaattttattggtatttttaggctctttaacatactttaatcattgtgttgctgcatatatttcttctaagatagaagtaaattgtaattgtcctcagataataacctaggaccttaaaatacacacaaatgtacacactaatgaattttgtaaatattacataactcggtaattattgtttcaaattagataatgcagaaatctctggatttttatgtcggtgtttataaagcattttaatgataattggggaagttggttgtgggtttttagctagaacaggaacccattataatttttcccaattataataatgggacataagcctctgtaacctgaaattttcctctatgacatgttttcagaagtagaattattagatttgatgagtgtggatgcctaggtttgtagtcaactttttgaactgagctaatcaatgcatatttgggaagagcatataatccaaaatattgggtctacaaatgtaagattgcctttggtgatgagttggtgtcatctgtcttctgtaggaaatgaagggcctcttgcagtgtgctgtgcctcattttaaacctttaactggcaagtggtcctgatcttccctctggacagctgcgggaagaggtttcccggtttaccttggcccccgtaacaccacatcatcccacgtgtgcgtgaagagcccgcacaggccccctgtgcgcccggggtcaggtgtggatggggtcggggtatttccagtacttgcgcttcggagtctttttaaaattgagagctcatctattgttgataaatggccaaatataaatgtataacaccttgattaataggctgctatgaaattgaaggtggtcttttctaggaaatcctcattgaaatactgcccattttgaataagtctaatagtacgatgaaccacacccttagtggaaacgttataggatgcaaataggaagatttgtgggtgtttttccttcatgaatttgttgttatctttgcagaagtgaagaatatcaatattttatggcctttctttgggattcgtgtttattaccagtgatgcagagcgtggccctggtcctcagcgcctctgcctttgtggtggcgggggccagtttgcctggtggggaggtgtgtgtgttttcaccaagttagcaaatttcctgttttctcttttaaaatggaaggctagcttcctctcccattggctttttctggagattggaaatggtattacagtctttgttgtgttattgtggaaatctccggcgtctctcctgatgttgccgccctgcacggccgttggagagtacttgcaggcagccccgctccacaccacttttatcatcttcattttcattcttttgtgaaaatgtagttgctttggagcctttcgaaaagtgtgtcagatcatttttgccatttctctttttccttttactttctgttattttccatttcgatctcagatacccttcttaggaagctgcatccccgacgccgggctggtctgttctgctctgggggcggcgtgtgctctcatttcactcccataatcagctttggcatatgggattcagagacgcagtgcttggtcttctgagatgttttgtgcagcagctaggtgatgtcccagttctcctggaatatttgcatcgaccaggatgctgtttctgcgtcggaacgtggtgtctttgtttacccttaggcattatcttgcttgtttacctaaatctttaactctccttaggtgagtgacttcactgatactaagagtgattaaaataatgtgatgtatggagtcaacttaggcaatacatttacctgtacaccacacgtccaatatttattcagaatgatttttttcaaatatttaataagaatgaataattgaatgtactatagccttcttactttgccctgcgatcccataagacctttaaagctaaaactagtttgggcccttgaggggtttatagaaattaggtatgtctgagtatggaaatggctggcatggtgaaagaattgagtccttaagtaatttgctattcccagtgataattagaagaaacccctgttctagctccattttcccattttttttaatgttttaggggagatttctttaggtattagcggctgatcttttttttcttaccatgtactcccgctgtaaggtgagtggttttggcatattgtgttgccttgatgggttattaaatcgtcacttggaaggatgaatgtgggttatagagtatgttgtgccatatatcatcttagtcatcaggaatgtttcagaaaactgaataagagtaaagttttttaaatttatgattgaaattagcaattttattaggtccttttaaaaaaacctacaaacttttaaagtttttctcaaaatatacatctttgttctcagaagaggtctgcagactgccctaatttgtcttttgaaaggacacagaattttagcagaatacttatgctgcagaaatggacaaatgcaggtgctgttccttggatggtcagcatggaaggttgacgtgctccaagatttactgtgcgtcaccttagccatcagtcccatcgtattcatttaactccactaataagaaacggagcaaaagtggaattatgagttcagtagtattctatgaaaggtcagttgttaaaaaggcagagtctgacattctgtgaaaaaggtgccttcattaatcattctgatgggagagcacggggcgttcttgaccaataccagtgaaccttgcaatgcaaagtttcagggtctgatgtgtaagttcttatataaaaacgaggatcgtttgaatatatgttgagatcattcaaggaattgctttacctttgctgtttaaaagtgtgtatatgatatagaacacgttattaaatgtgcattactgttttgaaaaaggaaaaacacctgttaattttatagataaattatggaaatctgtggtagacacagctccaggcagtaatgcatttccaagcgaatgaatggacatttcctatatggatcatctacagatattggtaaggtttctttaagtctcttttgtactctgcattcgtggctaaacctatgcactttgaccctgttctgcaaaacaaaccatggcctactttcagactctccttcgttcttttgctgttggttacggtggcagagtgcctactgtgtacacagaatctagacatttcacattgaattatctgagtatttatgtgccctgacaattcagcgttaaagttcaatacaaatatataaattattaagcagttaaccagtgacacattcatcagctgaacgtcttttattgtggcctgtagacagattattttcattcagccattaaagcacaatattgtcgggtgaaattctgtttctggattttctttgtctctgttgctgctatggaatttcattgaaagcatcgaaatatgagactaacacagaatactgagtgtttcttttcagaaacgggaactttcagacattttctctccagctgaattcagtaaagagcagtgtgtgtgtgtgtgtgtgtgtgtgtgtgtgtgtgtgtgtgtgttcctttcccagccagcagtgttatatctgaagggaagggtggggatgagctgtggtgccgcccttcacgccattgagacgggctgggaaggtgccctttcaccctctacctgcagttggtgcctagtgattttaaagattcaggaatgtctttcaccgtgattctcactattaaccaatctcacgtatctaactttccttactatattattagttactactttctatacaagagagaggtggagcctgcctgtgtcacgatggggaaggcccttgggattcgctctgtgggtgcgggcagcgacaggggtgggtcagggtgcaggcggtgagacggcgagcgaggaggtcgggaaggagcctccacaccccagcagggcccattccacacgagaccccagacgaggggagcagaagctgctggtgcctctctgttctttgccggatgctaccgttgtctgtggccacacttgcttcttcaggtgtggaaatagaagctcagagaagttaaacaatgcgccaaatgttacaccttcccattctaacgattttgtcaatttcggtgtcaaggtgatatcttgtctgatggtggaggtcatagttgtctgtgaggacatggtatccaccctcaagcatgtaattatgcatggagagggctcagttcagttttaccgagacacagtttattggagtctacaaatagcataaactgctatgtctgcagtgttaccattctctttccttattgtcataatttttgtttaatggctgtttgtgctacattgaccaggtccatgggttgcttaacataaatgattacatttgcttatgattaaaaacttcctccattagaagcactgcacccaggacttgtaaatgatttgttgttaaagttttctacttcattagccacgtcgttgactccagagtcattgtctaagagttaggaacacttgtaatgagctgtataatatggaccctcgaacgaaatttaaaaagagaccaagccttctaggaacagcttagcatgcagataaaaggctaggaaaatgtgtgaacagcgccaggctgtaggctgaggcacgttccattctgactcagaatggcatgggtgaataaagtcttttatgatggagcaagacttgttgtaaaaaattatataccattcatgaccaaaatccttcaaaacactccgtcaccattcccttctgaaccctatagcttaagttctaagcatcttgtgagtctcttgatagagcgttgaaaactccatgcaatggtctttgggacgccattcgaacctggcctgccccttgctggcaccttgttcgtctttggctccatccggggatttgattgtcagtgacccacctgattacagtgggctgccatggccctggcctcgtggtacaaaaacatggacgattttgtgatttattatcggaggacagctagcaaagagaacttcctggaataactgcattaaatgtgatgggcatttttgtgacagatgtaaaattcttaatcttgaaagcagttgcatgtgtcaggcagactgggtgttaattttctgacagcagtaggaggagctttttttccccattacagatggaattaggtctactttgtacacagtactttgtgacagtgactctggccaggggaggggatatgctggttctggagtctgagaagatggggctgagccagctgtgactcggccacacgtggctgtgggacttcgcactgactacgcagcctctgccaggtttctttgtaaaagtgaagttaacaccgatctcacaatatctggggaggaataaataggaacacacatgctgagttaaagtcctcagttatttcgtcttcagcgacagatgatccccgacttaccgtggttcagcgtttgagttttcgagctttatgatggtgcagaagcagcctacgtgcagtagaaactgtaccacaagtgcccgtgccaccattctgcgtctcagtacagtattgaataaaggacatgacacagtcaccactttattataaaataggctcgtgttcactgatgctgcccaactgtagctaattcaagtgttgtgagcacgtttaaggcaggctgggtggaaccatggcgtttggtgtattgaatgtgttttcagggtcgatgtttttaactttcactgaatgtatcaggatgtagccccatcataagtcgaggcacatctctgtttgagtgcctgttacgtgctggccatggtcccaggcctgcgggatgcagaggcgaggacagtgtttgagtttctagcgtgctcactgtgtgtgggtaggatgaccctgccggtctgtgccctggcttagtgaactagatctcgttggtgtcctgaggccgagtcttctgtggtttctctggagagtgtggctctccctggtcagtattgtgacctcagttaccactttctgtcccctacattcatatactcccattcatgtatttaacaattctttactgctgtaagataaatggttttcaattatgagttttgtcatgaaaatttaattttttaaaaaaaatcaaaagacctggatgtggtgtgagcatgcggagctcccctttctgcccaggcctttaccttcctgctaggaggcaaggtcagcccagggacagtgctgggagagagcggagttccgtcgttcatgggttgctaatttttggagtactgcaatacaattaaatatacttaaccttaaaattacccagaatgtgattgaatctgtgattcacaggccccttctggttctcccgtgcctcggtgtgatcattaggaggatggatcaacctggtgctatcgggaacgcactgcgttaatggcctcagtgcccagcaatggagaactttccactgagtatccgcatgcagcgtgcccggcggaaggtgaaagcttcaccctttgtctcccttgccatcctttggccttgtgtgtttggaagtagccagaggtggtggaacagtggtgggctggtttgggtcttgttggcagtgccaaagggacaaaggctggatgtgggcacgacctcagcctcgtgatgggcaagacaggtgggggtgactttctgttctgaaaatgacctcctccccttcttcctcccctcaagcttcctacctttcctccccctccccctcccttcttcttccactcccccacttcttcctcctctccccctccttcccccttccccctcctcttcccccttccccctcctcttccccttcctcctcctcttccccctctccttcctccccctccttcctccccctctccttcctcccccctctttcctccccctctttcctcttctccccttcctcctcctcctcttccttcctctcccctccccctcctcctccttctcttcctcctctaccccttgctccttctcttccccttcttcttcctctctctccccttcctgtctttccccttcctcctcccttcctcctcccctcctcctccccttcttcctccacttcctcattttcctcctccacttcctcatcttcctcttcttcctcctcattattttcctcctcctccccctcattttcctcctcctccccctcctcctcctcccctgcttcccctcctctgcttcctcaccctcctctccttcctccccctcctctccttcctcctcctcctctccttcctcctcttcctcctcctcctgcccttcttttcctctgtcttcctgttttcttccctttcccctgctgtattccttcctcacacgcccccctcagcctcttttctggggactggctcttctaggaggcctgcctcaaggccctcaggccagttcccggggcagccactgagcagaaccgcccctcccagcgcccacctatggccactgccctcagggtcccttcctccagcatggtgctggcggatggcgccataaacaggctgtcactcatctgcaggctgccttgtctttcccccagcagattaaagccttcatgaaaaaagatggagggcgcttgactttgcgacacgcacattctgccgtcttgggaagggggaaagaggggcatctagctgggcgctgcgtgtagcctgcccggcggggccggggtgtggcaggaccgaagcctgctcctcgtgtggggcccggcgcgaaaacagcttgtgcagccgctgagtgactgaggaccgtgtcccagtgtagtgtcatttcctcgtacatgtggagtttaaagaattataggtaccttgagctactggcaggtaaaagacagtaaaaaaaaaaaaaatagtgaaagacacagtctaccctctgaactgatctacaaggctatgaaagcatcactttgaataatatgcagtagatatgttagaaaaatgtaatattggtgtgtggacccctcagcctctttgacgagtgttgtaatatatcttgttgaatgatgaatatgctaccgtatgtttcaactattcctttcttgtggctgaaagaaaaatatattgaaaatgaatgtaaaatattgacatttagtagttgttatgctccactgtaatttcttgttgctttggatgtggtagacacctcactaattacacggtgtgtacatgcgcacctgtaacaggagccgcgtgaaagtctgattggaactctgacttgatcagcccatgttcttctgccatagccacaggagcatctgaacgtggtgatggaagaagaccctggcgccccgtctccccgtggattagcggccctactgtgagatcctggtgatcttgatgatcgagggttatttgaagcagttcattttgtgctgcagttcattgaaatgccaccacccagaagacccctgagtttccagaggtcctggtgctttttttgctggggcttggaccggagcgtctttagagtgaccactgccagggaagacaccgtggtcggggcctgtgattcctgccggggccccaggcaggctggagccacaggtctgagttctgtccagttcaggttcgtaggccactcttgcagctctgttccttcttcagctcctctggtcattcacacgtggcctggccacttgcctattgtaccagctctccagggctggggacttgctagagcagggttcccagtgcccccaggctctactttgctctgcctggtctcagggtgtaggggatggagagctggacttccagcctgcttcttggctgtctaggtgccaggggctcgggacacagagctcctggaggccgagcacaagccttgggcagaggtgaggcagagctctgactgtttcattcgactacgttgccaaggagatgctcgctcggagtggttgctctggctctgggattccaaaccaagctgccttctctgatgtggccttagtgctctgggcggatgtaccttggctctgcctggaccctctctctcttccaggcctctgtcccaccaggatgatgcctatccagagctcattgtcctctcccacttcctccccgagcttcccattccgtgtctctctggagggcccatcatcatcctggtggaggtgttgcactgaggaccacagcagccctcgcattcctacacatacccctttgcccgtgggatttttgctgtttctcttctcccactgttggtcgttggctggatctcgttgaaggcctgcggagattcaggtgccatagggagggtctgggacttttctctcggaggccccatgaagttggtattcctcagctctgccccagggtccctctgattccacggaggagctgcggaaagtccacatttttgaagagctgcaggctggggagcccccgtggcgaacagaggctctaagagaggggtctttgttttggggcagtgagactgagtggccagtgagcaatccgtcatcaatggagatcaatacccaggaggtgccatctctcttggcgggtgacacgtaactgttacaaatgggtgcctgtccctgtcacgtcaccggagtgtgcgtcttgatgccctggctccctgaggcagctcgtgttttcgagtgtttccattttagagacccggaaaagggatccttagagctgctttgttttcctttttcaccagaaacaaatgcctttgtgcttctcccgcctgcggactcccactgcgttcagcccgtgcgggtggtcatcggccagacccatccagcctgtggcccgtcccctccacctctcacagccacctaggaaagtagttctcagctctaaggggcattgtctgttccaagaagaatgactgctccctgccacctcccacccccatcccatgtccccatcatagacccagcaggacagacccccccagagagccagtggccttcttgcccataactcgttggtgctggagagctgtgggtagcgtagcaagtgccactgagcatcctggaaaccctgggaggggtcccggcgagaaagagccatcaccctaagaagattcaggaatgggatgatcatggggttcagggtgccccaacagtaggttgaaaatcctgtccctggccaggaggcagggaagtagcaaccttattcaaggggaaaaaaaacctcctggagtctagatacagtatcttagtagtaataaaagcacgggtacagatttactggtgtcggagttttaactgtaatactgtggaatggtaggttattttgtgttcaagagctacatttatcacaaaaatgatgatatacaaatcacttccatatcacaaaatgttcttggtcaaaattggcttgaggcaagtgatatcttcgagtaaacagtatatgaagaccatatcttaaaatgatagatcacctaattttgttctgacagaggtttttgccgcaacaaacatctgtcattgaaataccaattcagagatatggaagccaaattgtagaggttttcctggatttgtcactcctaacttaagaatgctactgttcccatcgtagcttttataagatattaggcagtgttgcactttaagagacattaaaacaaaataaacaattcagagaaatacgctttaaatgcaaaccaaccattaaaaagtatagaagtcaggaatgggccgagacagcctggctgtttttatgtgcagacatcacattaagctcgctttacttggagattttgaactgtagaggcctccaggcctcctgccttcacttgaggtttttggtgctttttaaaggactgtgataatgatgttattcccaagatgtgaaggaccattctggtgctgtcctgacaggggagcaggtttacagctcaggacactggggtgccacggggacctgggggtctccttgtgcctgggattcctcctcgtcaggagccctcactcaggaagccctgcacgggggcaaatgtcctgggattggagaggcaagcgtgaatcagacatttccaaagacgacaccgaagaacttctgctgtattccaagttaaaaactaattgatcttggtccaaactatcataggatagttaaaaaaaacacacaatagaatttctgaggtgcttgggagacattttagaaatatgtcattggtgaccactttttataggctgaattaagaggaaaaaaaggtaaaatatcttttaaagtctccagtttctgagacccctctggagatgatttcattgagttcctccctctgacagctcctatggacctggagggctctggtttctggagtagcatgggagctggccctggtcctggctctcctgcccacctctgcccccttttccctgccccctcctgactgcagccaccagtgcccgccatttcttcctgcgctgcaacagctctggccagtcctctccttattctgtaggttgaagtacattcctggaatccaggttttcaaagcattctatgcagtttcttgcatgaaatacaggagcagcctttcctgggctgcctcacacattgggcttctgtattcctttatgacagtgtgaggcaggcctggctaatgtcttccagcccattcatctccccacagggtatgagatgatgggctttagcgtcagacagctgggcccacactccggctcggccacttacgggctctggcaggttacctcagctgttgaactcgtgagctgtgacttcctcctctgctaatgcggcactctcatgcctgcctcgcaggttcagatgtgacgatagacataaaacacctggcccggctccggcgcacagatgctgaagtcagttttctgaggtcgtggtgggggcgggggtgagggtggcaatggaaatagtgacaacagtagttggcgttgtcatcctgtttacggctagcctgcgagtggctcaggcgaatccagcacagccttgtcctcgggttagctgccctctcagagcttcacatcataactagttcatttatcatccacgctagagactggtcttccagaggatattcctacctcagagccccttcctcccgacgtgctgggacggcccctgctgttgcctggctttgcctggtattacaagggacctcaacctcctgtgctcttacccgggcctgacttgggtgatgcccagaatcccagtcatgaggggaccatgactgtgggccagttgctgacaaccttggtgggttgtagactcatgaaagaaacactcctttgcctcctgaccttgtgcatcagggaggatgcaggaggaacggaagattgagcccggggagtgctgtctcggcagtgccacttcagacaagtgagtgtccctttgtgggacgtgttctcaacaggcacaggtgaccttataggtattgggatgatgggggtgtgcctgcaggttgtgaattactttttgccttcagagccaccaacacattcacacaaacatttgttttccttttgattttatcaggagaattttgtttctttgcccgcctgaacattgcttgccctccataattgagtgtagactaactctgcagcctaagccaaagtacatcttttgtctgtgcgaagagaaagttccatttccctttaccaagttatctccatggcccttggccacagcaccctccgcagaccctcacgtgcatggccgcagcagactgcccacacatttgcacactgacattggtcttattctcatcaactaataattaaaccagaatccaagtaagtgcaagaatcaaaggctttgagtaggaacaaaaggctatgttactttgtatccttaactaagaattttgttgttcaagaaatcctgggcttttgttggtgtagctctgcaagtcagcagcacccgggttccacccggtgcttacaggtcacgagtccagtgacgctgattgaggtgtgtcaccaaatatgctgcagatccggggccagcccacctgggcctccggccacggtctgtgcccacgtgtcacgaggcacatcccgggtcatccggagagggacctacaaagtctattttcaaaccaagttattttgtgaaatattgtagtgaacttatcaaaactggtgaagttgatgaagtgaaatgaaaatactgccatgaaaattattttagtgcaacataatgagttctgtttttcatatctggcagatattacctactaaatctaatctgcaatgctgagaattatgccattttttatgatttgtttaattttgactgaaaaaaattgactattcatcgattcttgacctgcgagtattgagggaaaaatttagttaataagaattttcatgaggtgtaaatttaaatgtatgaggattctgcctatcctttaatactatagacattaatttaaaaattctataagggcctgagggcctggggtgtctgaagaacagaacatggaggcagttatggttgttaactggtagacaaggtctgtcaagataatataggaatattttggtgttttccctatatccttggttatatgtggctgagcataattagaagttaaatttgttttagataatctcttcggctgtgaaatggcatcaatacacttaagagtaacaagtcgaatagaaatcagggcctgttgttagtgtatgagcacacaccacacaaagtttcttcttggttccctatttccgcagttcaaagggggttttaaagaagtcataaaaaatgaaggatcctaatattgcagttggagactgagagtgaatgacatattctttacacacctcaactgtcaacatttctaatcaaatcacccagccttcttacttcttaaatgatacaggcgatatttcctgtaataaacacccctaagtctaatgagaggccctaaggcaacttgaaatatatgaattcattataattgaacaacataatctgcagggcaaagatgcctgctacccagctctgaacttcacagagcttgggtgttttatgaaaaatgttatacgttttgtttacaacgtatggctgctgtttgaagtattgtatgttcctgtagtacataagacggggccgcataatggaggaaaaatcaaggaggcaatctttcattttgttctggtatgaaaaattcaaaagactgaaaactcacccagagaaattttgcaagcatattattttccaatgtttcgatcaatttgtctgtcaaccatgctgagaggtggaaggggccagcaaaagcaatttagcttgtgaggtccaaaatagaaatgttttagggaaccttgtcacatgttatttctttatattagaaccgccgtgtgttttatttgctggtcataatatgaagagaaattgatatcaatcatctaagtaagctatgaatatctgatataaatatgacttttatatgcatgcatcagaatacaatataaattaacctcttcatgcatgcaagaatcgttagtgcgacagcgggctccctgttttggatttttccatttgacaattcacggtgcattttaattgattgtacccaagtgacactccgtggaagcatcttgcatgtgaacgtaactgaccctgccagggctttaattaagctataatcttcctttagtcagtgcatctgggattgataaacatatgtaaaccatgctgaccatctaagtgttgctttaaagaaaaaaatggtgcagatatgggagttttaaataaacggctttgatgttacctccagttgaatttttagttgggatttgttaagatcaagttatcttaggagtagttaattctaaggtgaatatacaatcttggtgaaacttgtcctggaaaacctgtaattctgtgattagtctgtgtgtaccccaacactttttcttcaaatcttagattaacactgaatacattaaggttatttttcaaacaggttatagttcagagaaattaatttaaatcagttggcttacagaagacccagtttagttttaatttgccttaacagccagggtcttcctgctctacttacttagacgtcctcagagtgtcttctgagtagttggctaccatttgcatggcatgattccgctctcggagcttgatatctttccagattttcagaatttagaattaagtgtggaagtcaagcatactgaaagttttttatactatggatgctgataaatagaaataaactatgacaaattaattcagaaatctttccactcagtgtagatattaagttgtggtcatacggaagaagtcttgaaacacgatttacagtaaattatgataatttgggatagagactgtgccattaagagttgttaaacagcatgattcagacagctctgttttttccagtgactgcctattcctttattgtatatgtgtacccaagtgatgctctcacatttatcttaagtccctattattaatatacatttaaagtctcccgaggttttgtttggtttgctttggtccttttttggagtgatttgaagcaaagttaattgtggaacctatttatagacatctttctatacttgcacaagtctgtgtataatcaattctgagaagtagaatttaaaatttagtgctttgaaaattgtcctcattttaattttttggattttaattaggtaaggttgaacatttttccttattttcattgattgtttggggttccttggtaaaatgcttgcttttgtttcctgttgggttattttgtctttttcttattgatatgtgagaactttttgcatattaaagaaagaccatcatttctattttgattttgcccagggaatttttttcagaataagaaattcaactagatttttaaaaaacttttaattgggcaataatttcagatttacagaaaagtcacaaagattgtacagatccttcacccaggatctcccaatgttaacagcttacataaccatagtacatggtttgtcaaaactaggagattaacattggtccattgtggtcagatttttaagtcccttcctatggcttctaaatttatgaggtgcttacacaaaggcctttttaaccttaagattttttttttgttttgcttttgttaatcatatatgtttatttccttctactttttaaatgttgtttttcatattttcatctctatttatttatttgaaatgtgttttaatttaaagagtcttggttggaacctatctttattttcatctaaatgctaactaaccaactttttcagtatcttttgaattactcgactttgtgtttacacacattttacaaggacaacaaaaaagtgcctgctgattgactttgtagtcaatcataacccttgaccatattttttttggtggtacttcatatatgaaagagtataaaatctaggttatttaatgttgttataaaattattctaagatcaccgaatggagaatacttagattctaaataagtgactttgtgagaattgaatttttatatcattaaccaattctaagacattttaaagaaggcagaatgatctaacccaatacttcatatacttagttttactgtggaatcccaagggcaacatgtcccccgacccaacgacaaaataacatatattcctattaagtttagggattgatggagcttgtaattgttaatttgtcacagatgatactgttatttatgcgcagttactgtctccctttggagagtttcatgtgctaaattttcagcaaatagtttgagcctcacctacagcttcttgaccttttggggaaaaaactatcactttaaaagaccttttacgagtgagcaaatatatgcttttctgttttcacagtaactttcagagaaacccactggtctcagcatggcctatgccttggcagccctttccacccgtagcaggttgttctttacctttcgtttttaaggtggcttccagttcataccaagctcacatactgtggcgaagagctttctgagaaacttcataagattttgctaagatattaatgaataatttagtatattgttgcatatatgactgagtatcacatttcagtaatgtttttactatctttaaatataggtacataaatcctagcttggggtaaaaggcattgacattttctcagtaatagttctttgtagacagacctgggttcaatattagctctgccacccctcgagctgtgtcaccagaagtaggttgtcctgtacgtctaacttcagtttgtctattaaaggggattgcaccactgacggcttgatcagggttaaatactccagcattccttggaaaacacttctgtgagcattgtcgcagacttgatgatgtagcaactattttccctaagtttcccactttagaaattattaaaaatattgctgccttcatagctttttcaaaggttttctcttatttctgtcagatctcttacatctaatattctcattcccagcagataattaatctattaagaggcaggctgtgggcccctctgataccagggaaagtgaaaggcaccagggcaggagttctgattctagcaactgcctggccgctgtgtgatctccacacagcatcaaaccttgcagagttctaacagaagtgaatagaagattagtctcccacacaacaataatgggagactttaacaccccaccgttaacattagacagatcaacaagacagaaagttaacaaggatacccaggaattgaactcagctctgcaccaagcggacctaatagacatctacagaactctccaccccaaatcaacagaatatacttttttttcagcaccacaccacacctattccaaaattgaccacatagttggaagtaaagcactcctcagcaaatgtaaaagaacagaaattgtaacaaactgtctctcagaccacagtgcaatcaaactagaactcaggattaagaatctcactcaaaaccgctcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatctaaaattgacaccctaacatcacaattaaaagaactagagaagcaagagcaaacacattcaaaagctagcagaaagcaagaaataactaagatcagagcagaactgaaggaaatagagacacaaaaaacccttcaaaaaatcaatgaatccaggagctgattttttgaaaagatcaacaaaattgatagactgctagcaagactaataaagaagaaaagagagaagaatcaaatagacgcaataaaaaatgacaaaggggatatcaccaccgatcccacagaaatacaaactaccatcagagaatactataaacacctctatgcaaataaactagaaaatctagaagaaatggataaattcctcgacacatacactctcccaagactaaaccaggaagaagttgaatctctgaatagaccaataataggctctgaaattgaggcaataattaatagcttaccaaccaaaaaaagtccaggaccatatggattcgcagccgaattctaccagaggtataaggaagagctggtaccattccttctgaaactattccaatcaatagacaaagagggaatcctccctaactcattttatgaggccagcatcatcctgataccaaagcctggtagagacacaaccaaaaaagagaattttagaccaatatccttgatgaacattgatgcaaaaatcctcaataaaatactggcaaaccaaatccagcagcacatcaaaaagcttatccaccatgatcaagtgggcttcatccctgggatgcaaggctggttcaatatacgcaaatcaataaatgtaatccagcatgtaaacagaaccaaagacaaaaaccacatgattatctcaatagatgcagaaaagacctttgacaaaattcaacaacccttcatgctaaaaactctcaataagttaggtattgatgggacgtatctcaaaataataagtgctatctatgacaaacccacagccaatatcatactgaatggacaaaaactggaagcattccctttgaaaactggcacaagacagggatgccctctttcaccactcctattcaacatagtgttggaagttctggccagggcaatcaggcaggagaagggaataaagggcattcatttaggaaaagaggaagtcaaattgtccctgtttgcagatgacgtgattgtatatctagaaaaccccatcgtctcatcccaaaatctccttaagctgataagcaacttcagcaaagtctcaggatacaaaatcaatgtgcaaaaatcacaagcattcttatacaccaataacaggcaaacaagagccaaatcatgagtgaactcccattcacagttgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatattgtgaaaatggccatactgcccaaggtaatttatagattcaatgccatccccatcaagctaccaatgactttcttcacagaattggaaaaagctactttaaagttcgtatggaaccaaaaaagagcccacattgccaagtcaatcctaagccaaaagaacaaagctggaggcatcacgctacctgacttcaaactatactacaaggctacagtaaccaaaacagcatggtactggtaccaaaacagagatatagaccaatggaacagaacagagccctcagaaataatgccacatatctacaactatctgatcattgataaacctgacaaaaagaagaaatggggaaaggattccttatttaataaatggtgctgggaaaactggctagccatatgtagaaagctgaaactggatcccttccttacaccttatacaaaaattaattcaagatggattaaagacttaaatgttagacctaaaaccataaaaagcctagaagaaaacctaggcaataccattcaggacataggcatgggcaaggacttcataaccaaaacaccaaaagcaatggcaacaaaagccaaaattgacaaatgggatctaattaaactaaagagcttctgcacagcaaaagaaaccaccatcagagtgaacaggcaacctacagaataggagaaaattttctcaacctactcctctggcaaagggctaatatccagaatctacaatgaattcaaagaaatttacaagaaaaaaacaaccccatcaaaaagtgggcaaaggatatgaacagacacttctcaaaagaagacatttatgcagccaaaaaacacatgaaaaaatgctcaccatcactggccatcagagaaatgcaactcaaaaccacaatgagatgccatctcacaccagttagaatggcaatcattaaaaagtcaggaaacaacaggtgctggagaggatgtggagaaataggaacactttaatactgttggtgggactgtaaagtagttcaaccattgtggaaatcagtgtggcaattcctcaaggatctagaactagaaataccatttgacccagccatcctattactgagtatatacccaaaggattataaatcatgctgctataaagatacatgtacacgtatgtttattgcagcactattcacaatagcaaaaactcggaaccaacccaaatgtccaacaatgatagactggattaagaaaatgtggcacatatacaccatggaatactatgcagccataaaaaatgatgagttcatgtcatttgtagggacatggatgaagctggaaaccatcattctcagcaaactattgcaaggacaaaaaaccaaacaccgcatgttctcactcataggtgggaattgaacaatgagaacacatggacacaggaaggggaacatcacacactggggactgttgtggggtgggaggagggggaggggtagcattaggagatatacctaatgctaaatgacaagttaatgggtgcagcacaccaacatggcacatgtatatgtatgtaagaaacctgcacgttgtgcacatgtaccctaaaacttaaagtataataataagaaagaaacaagatgagcttgtggactgtctttcacatcctgggaacttatagaaaggtagttaggattattaagcaactaaaacattttcctttatttttccttccttaccgctacctctcccaagttgtaataatttaatagttacaactattagtacaaatagttttaaaagtctctttgagttgccaccctggagtgtgtatctcctaatgggataatacttaaggcattttataaactttaaagtgccatggacatcagtcatttgtgcatttgtgagcactgcctcatttaagcctgccgtcgccttaatgtactgtgtacattagatacgacttcagttcccttatcccaggagggctgaaacttactgggatttctgttatattgacctaacagattaggatgattttaaaattttactcattttctatattgaattaaaacaagaaattagctgagcattttccaagatggaaggaaaaacggccattgttttgatttctagttatgtaacccattccaaaaattcaaacatgagattacacggagtgctgtattaaacagatgagtacctgctcactggcttcctttcacacagtcgcctggcactgcagccacacctgtgctcacctgtacctgcctacctgtggctgggccaggccccaggagtcccgtgggtcaggagcatggcatggagggtgggcagagctttctgctcatccccggatcatggcagcgtcagatggaactcggcctgccccgtttctgtgcagctgtcaggatgtatggggttttcccatgctccgtgcctccatgcctgcggcactttggaaggacgttaaggcaggacatctttaggagaatgtctttattgactttgtctttatttaccttgggcctggcgctgttatctcagctgagtgtccgtgtttaaaggcgacacatggaacgagcatggctcataattttgagtttcttcttctggagccttactattatatgctcagaaaccatctctgtctgcgtggtatctctcctctggcagtgcagtaggtcacacatcgttgaggttatgagctttggagactcttagacatcagctctcatgttaactctgtgattttgggaaagttgacctatatgtttttgttttctttagtgtgaaacaggaatgccttctgcatagcgaggctgtcagaaaagcccttgacactttctggtcccagagagggcaccgcagccacccaggcctgcccgtgagaggtggcagctctgggaggaacactccttaggccggtgtgtggtactgtcaggtgcttatttttgtttcacaaacttggtatttattaggtgttccaggctttgttcgacccgggtgggagggaggatctttgttggaggactctcactttctaattgcgggtttttgttctgaagccatagggtgtgttgccgtctcagcagggaggagtattccccattaacgggcaggtggcatcgtgggagaagcacctgctgtgcccgggggggcgggactgcgcaggatcagggggatgcgcgggagccagtggtgctgacactgcataccatgtgtcaggagccttggaagtcggcttaaatggtttaatctgatttaatcttcacaaaaaccttgagggataggcattacgattaggcaccacagtagaaactgaggcatggagaggtgcaacagtttccctgaggtcacacagctcttcagagggggagacaggacttaaacacgaggaggctggctccagggcccgtgggctttgagcgaggaaggccttctaggtctagacgttcctaggctggggctcagtgataccctaaagcccatgcacacctcctcagacctggctcctgagaggcagtcctccagagtggcctctttgctgagactgtgagcctgggcttctgtctctaaccactagctacaaaaggatgctggacagacatcctgtacctagggacaccccatgatggcttgtcccccgaccacagacaccccatgattggggataccccgtgaccatggatgccccataaccacagacaccccacaactgggcagctcaaggcagcaagtgccttccttgtgtgcttccgttttgttgaggtctttgttgcaaacatcgtttgttgagggctgccttacccttagaagacatagtaccatttctgggaaccatggttgctgttgagaaatgcatccttacacgcccagatccagccgctgtctggtcccactgacatggcacaggaatcaaagcaggtgcttgggggatgtcaacagttgaatttggattcctcataaagcaatgttagcacatgacactctgtgaggaaataatgatgctactttgtaagataagaaaggggaaacagctgcgttggtggataattgttaacggtgcagctgcagtgtgagttgcacactggaaggtgtttgccgtgacctgtcgcgggctgagctttttggtagcctggcattgtggtggatgcctttcattccatccgctgtggctgagttctgctttcctgcccctggttctgcagtggcgtgactgggctgcttacaggccctgtctttccaagccaccatttaattggggagggctactgacatggcaccattgaacttgagacctgccattcctccggtggcagtccttggagaacagggccccaggtctttctgaccccacatcattggcatggtctcgcagccaagtaggttatgttttctgaggaaatcatcatgtcattcccatctactgttaatttttaaaaagctgtgattcctgatgaaacaaactagagatgatgcaggaactctggatctaaatggtcagtcactatcttctgcaacttgctggagtgcagacacgtctcagaataagatattctcagactagtcagaacattgtttcctttctttaaaaaacaaaacagaaaaccactgagcccagagttcaaggcctcctaaagaggaagagggctttggctacctgcagataagaaaggttttggtggtaatgctcaagtgtgagttaggtgtgggcgtgagcatgcccagtggccgtcccgtcctcctggagacaaaaccatttccggggtatcccctggctaagcatttgaaagcagcaatttattttcaacagtttctatccttaatatttaaaaaataggaaagtgtactcaatcagctttctgttgactttctgctgcctggccggcgtcttgtaggaggcgctctgcctgtctgtgcaggaggctgtccagggtgtgcgagccacgtgggccagcctctgtgggcggactgtcccaggtgggtggtggtgagggggtgaattcctccttcacatttgcttacaagtgctccttttttgagtgttgggagcacatctgtgtatgaaggacatcattcggacgctttccagggtggtgggaagcagcctcccttagcccggctacgtctcatgaatgtgcgtggaccccgcctggccttctgcccgacatgtactccaccccgccttctaccaggagccaaggctgtgaccattgtgatctgaacaagccgttgagagtgtgctctgttgtcagtgaattagttcagagagtccctcctcgtgttatagttctcatgaccactgcgcagtgttgctgtgctctgcctctgacgggtggctgccaggcattgaaaaaataacatcgtaagtccttactgctaacactgacttttaaaaacatttaattgtgtgccttttaaacttttgttctccgtacaacgtcttcccgatatttagattttaacttttaaaagacagttacaaattatttctaaagtataaagtctggttgttgtttttttttttgatggagctgtgaggaggaaaaaaatgagatatagaattttagtgtaggtgatcttgtgctttaggataaaaccatttttctgttactgctttttggtatctaaatccccggcagtttcccccttcggataaagcatcatgtaggttttagcacaccagcgggttcctggctctttagtgaaaaggtggctctgaggattgccctgtgcccgccatgaccatcctggtggcttggcgacttcatattgactgcaggccctgtggacagaaagaattatttcttttttagagaaaagatatttatgaccgaaaacagtgctaaaaacatgagaatattgatcatggttttgagagatgcttgcactgaatcacttgatatacctaaatatcggctttattctatcttccctaaaagacagattgccaacacaaaagatgaaccatcttgagggaaaaaaatcttatatctttctgataggctgtcttgcttccttccataacaatggggagaaaagaagtctgtgtggtttcctgaaataagcaacaaatataataaatggtgtatcggaagcttctgtaaaactgccttgggtgtactttatttaacttgtagtaataagttaaattaacatcaaatggaaattcaaatagctaaacatttaaccaatctaacagtaaacaattattctaaaatcaacataaaaataaagacccattatcatcagaagacctaattcattgtttttagaggtaatctcttggggttctgtggaaatttataaaggaatgagtgaggctaattatttactcatcagatttttgaaggcaaatacttttctgttattcttaaattttagacctattttggatcaagatggtgtgttgcttttgtagtttaaggtagaagatagtgaggctgacttccttccttatcccgggtagaaagcctgactttttctggatagattgcagcctaggggttgtggttttggtcctgttctgcccttttcccaaattcttcttcattgcatctgatacatcccccttgcctgcagggcagggccctgtctctgtggcacacatagcaggaccgtttacatttcctctgctcacaggtgccgcccacaccttgcttcctatttcatgtcctcctcgtctctgtagttgagggaagagtattccattcaacagatggaaacaccattgcatctgactgccatgtctttgaaacctgccagaccaagtcttgactttcgttttgttttttttggtggagctgggaggagacagatgggccatacagtctatgtgtgggtgccttggtgtgggacacaagaaagtgaggcaggacgtggagcaccaggtcatcagagctggcagaggctgctccaccgtgcaccgaagacttggcatgtcagtggagccaggaagtctccgatgcagaagcggaagtcagtgtggccacaggagcgaggtggcaaagtgctggccttggaggaagagagaggtcagagagtagacagagggtgaggcctggatcatcatcagatgagcagacatgaaagccgctctcaacaggattagaaaacacagtttctaggggattcttgcagggaaacagacatggaggggcaccatttggtttgtaaaaggaaggtatagccctgaagttggcaagctcttggcctgctggcctgatgcagcaggcagctgagaattgcttggcctgtccatgggggcctgacaggtatctcaaattttaattgccagcacacacgaatcaggagatttcatatttcaaaaagcatgtatggctgctgtttcttttttgtataaggcttaatttgttttttttttcatgttatagctttcctgagatacattttacatactctaaaatttacccatttaaattgtacagcatgctgggttttcatgcatttatacagttgtgtgtccatcatcacagtgtaattttagaagatttaaatctccctcttccccactgcccctgccaaaaaagggaccccagacctaccagcagtcatttcccatccccctccctctggtaccagcccaccactagtctgtctgtgtctgtggttttccctgttctggatgttttgcatcaacggaatcctgcaccatgtggccttttgtgcctggttcctttcccttcgtgtggtgttttcaaggttgctccacgctccagcatgtgtcagaacttaattccctgcggccaaacaatatcccatcatgtggatgaaccacattttgttgatctatacatcagttaagtcagtttcgccttttggtgttgtgaataaggctgcagtgaacatttgtgtatatatgtgttcatttctcttggggtatatatacacacacacacacgtaggcctaggagtaggattcctgggtccgatggcaattgcatgtttagcattttgaaaaacttatggttttctaatacagctgccccattttacattcctgccagcaatgtatgagggctccaatttcttcatatactcaccaacactttccatgttgtctttttgattttagccatcctaaagggcgagaaagatatcttcttgtgtaaaacgggcaaataatcaagctgggaatggtaagcagggtttttattcacaatagggctggttgatgggattcacaattacagaaggccacagagggaggacacacttggtgtactatttctttttgtcaaacaatagcattattgagatgtaaatgacatacagagtatacatacagtagttcccccttagtcatggggaatatgttacaagaacaccagcagatgctggaaaccgtagaaggcaccaaacccttggtatccctgaggggttggctccaggactcctctcggatactaacatccgcaggtgctcaagcctcttatataaaatggcatactattcttatatagcccagagacaccctcccatattttttaaatcatctctagattacttatgatacctaatgcctagatatcacttcattcttgtgaattcaacgtagtccttaacatatagcaaattcaagttttgcctttttgaactttgtagaatttttttccgaatatttttgatctgtggttggttgagtccgtgagtccgtggctgtggagcccatgcatatggagggccggctgtgcagtatcttttcctacacatacatccccataataaagtttactttgtaaactagcccagtgagattaacagcagcagtctatggaaccattataacaacatgccagcatcactattcttgcacttcagggccattattaagtgaaatgtgggtgacttgaacacaagcactgcaatgaccttgatagtctatctgatagataccaagatagatggctactaagcgacagaagggcgggggtgtgtacagtggggatgcaccggacagagggatgattcgtgtctcaggtgggatggggcgagatttcatcccactactcagaatggtgtgcaatttagaacgtatggattatttatgtctggaattttccagttaatatttttggaccacggttgatctcaagtaattgaaaccatggaaagtaaaactgtggataaagggggccactgtatctcacatatacagtttgataaaatttgcctatggatgaccccaatcaaaataacaaatattctcatcacccccaaagtttcctcttgcacctctgtgattcctctcctcacctcaacccgctttcctttctcatccccaggcaatcactgatctgctgtcactgtgcattagtttgattttctagaattttgtgatgcacatatatacatatatattgtattttacacaaaattttctcgttttatgaatggaattataacgtatagtctcttcgtgtctgagttcttccagtgtattgagtttgatattcatgcatgttgttgcatgtgtcagcggttgattactctttttgctgagtggtattccattgtgtggggataccacagtttatcattcgtttgttattgtacattgaatattgttctttctgctttcggctgttgcagacactgctatgaatatttatatgaaagacttggtaaggacgtatgcttctaattctcttaggtaaacacctaggagtggatcctatgggcaatgggtgtttagcattttaaaaagttgccaaactgttttccagagtggctgcatccctctgccgtttttatgaacagtgggtgggaatgcaattcttgcatatagtctctgatttcatatcattttccttttgcctggaagacttagcatttcttctgtggggtctgatggtgatactgtcttttagtgtttttaatgtctgaaaaagtattttcatatttaaaagatatttttgctgtgcaaagaattttgagttttctcttttccttttcttaaagatcttgttccactgtctctgacttgcattgtttcggaccagaaatctgctgtcatccttattttccttcatgtatgtggagcattttcccccctccaggggtttttgagttatgttctttatcgctggctttgaccatctggctcattttttgggttggtgtgcttgtcttcatgtgtctagtgcttgggcttcattgagtttcttggtgccatcaattacatctatatttgtctgttttaagttatcccacagttctctaatattgtgatttttttgttttttttgcagtgttttattttggtagtttctattatgtttttgagttcactaatcttttcttctgcaatgcctaatatgctttgaatgtcatctagtatgtttttcttctcaggcatggtgattttaatccataaaaatttgtgtcatttttatatcttaatttttctttttctttttttttgagatggagtcttgttctgtcaccaggctggagggcagtggtgtgatcttggctcactgcaacctcctcctcctgggttcaagtgattccctgtctcagcctcccaagtagctgagactacaggcacaacccaccatgcccagctaatttttatatttttatcatgatccacccgcctcggcttcccaaagtgctgggattacaggtgtgagccaccgtacccgacctatatttttctactcacctttttgacatgtgaaatacagttataacgactatgttaatatccttgtctgttaattctaacatctttgtcagttttgggttggttttgatttttttctcctcctagcagttgtatttttattcttttatgcttttcttgtaatttttgaatggatgctttatatgcaaatgttacctggctgggtgctaggttatttatttaataaatatcctttagctttgttctgggaggcaggtaagttacgtggaaatagtttgaatcttttggatcatgctttgaagattcactagttgcaactacagtggtatttagtttcaggctaattattcccacaaccaaggcaggattgtaagaggagagatcatggccggggactcatggctagacaaaaaacaggacctcagtcctatcagtgcaaggaaatgaattctgtcaatacatagtgagcttgaaagagactcgcagcctcagccctgggagtctcagttgcagctgacattttggtttcacccggagaaacccttagcagaggactgagtccacccgtgcctggactcctgacccatggggcggatgagacagtagatgtgtggtggttaaaccactgaatctgtggtaatttgtggtgatttgttatgcagcagtaagaggtaataccgtatgcatcttcttgcatcatttaccagctttttattatatgtggaagtcttacgtctttcctcccttttttattgccctctgagtaccttgttgtccctttctgtgtcacattcttcccactcgcacgcatgcatccaggaataagagcactgtggctcggtgtggccaagacccactgtgtaccttccatgaaagatgtttgtgagtagcatgggcccccgaaccctgggtccagtcctgcctgtactgcgagccagcactgtcatcatggatagtgccctcagcccatactctcctctgtgaagtgtgtgtgccagcacactgacatcacagggtgcctgcagcatttggaaaacacgcagcatcatgcaaactgcctaggagtgctcaacaatttggagctggtatctttacacttaccacgttgaatattgcatgcagactacatatttgcagagcttaatgaacagagaggcattttaggacaactaggagaaactcgcgcagattcccctcagggggagggaagctgttttgtaggtgtctctggcagtagcctaatgcagttgctttagaccctggtggtctggatactgcttcactgtaggctttaattgcattgctccaggtctgtggaaggctggaagaggccggtgtttttgtgtcacttttgctaccccctactctctctagttgacaggccatttggagcaccagggagtacaatctggctgaagaagcggtatccaaggaggacgtcatggtgtctgttctcgcagtcatggagcctagtgccaacaggccttaattctgtgttctggtgtctcatgagtggctctgcagtgggacgtcagagcagccaggcctcaagccgcctggctggggtggggacaaagtgtgtgttgtcccttcatcacgggagtgtggggcctggcacacgccctgccagggcctcacttgggccatgcctcagagcatgggtgctactcacctctgacctcttgagttttgcaggcaaactcaggtcgaatttggattctcagtcgcattgtggctcacatgacatgaaataaaatgttgacatttatttgcttcttgtggcctctactaaatatataaaataatcaaaactgaaactttccattattctcagcaggagtgaaacatcttgactttggaaatttttcctagtgatttaactcaagtcggatatcggcagcaccacctgcaatagtgaccccctatggcctgcggcggggctgcttaacgctcacatgggtggtcaccaaggaagggctgctggacaggcagactcccagagcagttgctacttacaaatccagcttccagcagggagaccattaaagggctgcttccacctccagggcgggcagtgaagcctccagctgggagccgcgtgaaaatcagagccaatgggagctggcagcccatccaccaggagggtccagaagacagaggcagaggacgtgggatctggagcccaagggaggggtcccaggtgggttgaggctggagatggcccaggaagccctggtttggggtgagggtgggcgagactgagaggctgctcagacaggatgggtggttgaatggagtgcggatcatgagatcatcacagggccacagcatatcaggccatgggttccctgttaattcctctcccacctcgaggaccggagcttctgttaggcaggcgggggctctgccgcaggcccacattctctgctaattcccttctctcctaaaggtttcagatctgtctgtggtcttttgttttacttggaaacacatgtttaatatatcttataaaatacgtttaatataaaaatatagttcactttatagttcagttgctttgagcacatttagtaaaccaagatgtgcttatatgaacttttccctgaaaagtacctggatcccagagttctacatggattgaatacttatgtttcgattttaattccttagatggctaactcagcattatttaaattttaataaagagactggatacaatgtgagcgaatttctctctatattttgtgaatctctatcagagcaaaataaaactgtttctgttttgcaatgaatagtttctagccatggaattgctggtcgaggcaagaaagtatgaatcttatttttgtggatctagccaagaaaaagaacgtaaactttgaaaagtatgtcatttgccattcacagtctaatgagaaactcagagaggctagaaactctcaataaaaattctgatatcagcatttaagatccagcaagatagggtatacgggcatttaagggattcacaatccacagtttactggcactttaaatgctgtgaatcttgtactggcaatcacaatcttgattttattaccgagggggacccctcgtgaggaatatgtcggtgcagtgtgcaggttaaactgtgagctgctccagcctctctcccgccggctgacggaaaggtggtcaaattaccttcgcaaatctgaagggtgcttggctccagcaaattggccatttagtcaaaaagtgtctgaaaatgacgtagtcgttggaagtgtttgggaataagcgatgagttggccaaacgcagtgtgttttctgtaggcaagcacctgtggcagctggcagggatgggcaggcctgcagagatggcttcctgggggcgcagcgtggtcaggcttgagggtggtgacagtgcccccaggagaaggcgagactggccagaactgggacgggcatgatgagtggccgtgtttcaaatattgtccatttttaacttttgaaaatgccaaaagcaagtatgctgccttgtggaatctgtgcaagcagttctttccaggctgaccttgaatagcctgacagcagagcgaggagtgaaatgagcacgcctcaggctgtggtccactcgtgcgggaagacatggacctgctactgctccctgccctctgtctccccaggaaaggagcattctggctcagagattctcaaactgggtcttccaagaccgcacaggtgctgtgtcaggtcagagatgcctctgtaacaacgccaagacctcgcgtgtccaagagtgatgctgggggaggctgctctagctggacctagatccaggccaggccccagacctctgcagctgtccacctactcctcaccaccacgcgtttgcaggtggtggacggtgttttatttaagaatgtccttgttggccggacgcggtggctcacgcctgtaatcccagcactttgggaggccgaggtgggtggatcacaaggtcaggagttcgagaccagcctggccaacatagtgaaaccctatctcttctaaaaatacaaaaaattagccaggcatggtggtaggcacctgtaatctcagctacttgggaggctgaggcaggagaatggcttgaacccgggaggcagagatcacagtgagccgagatggcgccactgcactccagcctgggtgacagagcgagactccgtctcaaaaaataaataaataaataaaaaagaatgtccttgttgaagcaataaacgctaattgtactacaaactgaccctggagcacctctctttttagtagacacggggatgaagtgaagtgtgcgtaaagcacttctgccatggaccaaagcagggatgttttccggaggaagggtttgcgtgtgactcagggtgacgggagtggccacttttttcctggaataccattttcaccattgaaagtatcactgaccagccaaccatatttacccacacttgggtttttggcagaaattttcaaggaaaatagctgacagtatttgttgctagtactgaatgatgaaatctgagtttcaagtgaaaatcataattttgagaaacttgcacctactgccgtgagcttaacagcatttcaatgtttaaacaacgttttgctgataccagtgtggcattaactagtgtgaatttcggtagtgtgctgtggctgaaatgcctaacgtagatttgcatacctcagtgaaccagtattttctaaatgatggataatgttataaaattatgcctgggtaaaaatccaaaatgcaggctaggtgaatggattttaatggaaccgtgcagacagttgattcggaaggcttcagggtccacatggaaactgtggtttgggagctgccccttgttgagagttctgttcaggtatcaaaggagagtatccacagtggcccaaggtagattttcttcctgcacgtcagccagagccctgtatggaaacagactgaaggcagaagcagctgcgagagtccacctgccttctgttaagccagctgtggaagacagtctcaaaaatgtaaaccagtgcaactttaattaatcctttttttttttggaaaaatggttatttttcatgaaaatgttatatgtgataacatgaaatcagttcataactattttgaaatgaaatatttttaaatgttctcagctttcatttcaaacacagtatcaatagaaataacttgcatgaggaaaaaaatagctctttagagtcctcatgatgcttaagggtgagactgaaaagtcagacacccaccgccccagacaaacaccatggtggcctcggggatgctgcgaggtcagagaacctgcactctgcttccttcttgtgtagggtgagggagaagccccaagccgtttcttctcagggctcaggtgtctctcatcagtgtagggagggtcttcgggcatcctatgccctgctcattccctcgatgttatccggacaggagatttcagctcctgcgcagtgggcgctgttgggattcccaggcctccaagtcatgacggtgggtgaaatggagctggtatttgagaaggctcggaagcctccccttagaaaggtgggtcctgatcagcagtttgggatgcccctgtgtttcctgcatttgggatgggcggtcctccctcctgcctccccagctctcttgagcacagtgtggccggcatctggtcaggacttcagagtggccagccccgtgttgccgacgaatctgagagggagcccctggcttcttatttttctttgaactacgtcaacggaattgcttcggatccttagccattttaaaaaacacagtcatatcacgtccccttctgacattctcttaagctttagcaaataacagaaatttcagtctcactgtgccttgttcagaggtgacaacaacaatgggtggctgaggcgtaagtctcaatcatccaggctccttaaagcagctttcgggcatgtgtggggaaagtacgccacagacacccagggctgtgcttccaaagaggttttcaagaggttgagtattgacacctttccttacaaggtagtggggaggcctggaggccaggcagtgaggcgaacagtgctcagtgaatccacgctccaggtgaggggaggcaaatgtcggcagagaaggtgggagcagaggaggagttccttatgcagaggtctctgggcaggcagaggaaatgagcctcgactttgctctgccctgggaagggaagcttgtgatccacattatatcagtgtggggttttatgagctggactgagatggttgatctaaagtcacagttggcaagtccctgtttatgcgaggccggcaaagaattcacctctgagtgatctgtgggggcagccctgtgttggtgcctgaggcctctgcctttctgtggaggtctggctgatgcatgaggctagaaacagccattcatttggaagagggcgttgcaatgactcagcctctgggcttaagctttccttttgcataagaagtctgaggggtcctcagatgttttatcttcctttacaaagttgtgttgtcaacaccaaggaaacagtcttgattctgaacaaggaggtagcctgggtactgaaggtgaaaagagctcagatcagaagtttcttggaaagagatttaaagatttttaaaaaatcagattactaaggcatattaaaatatgttcagtcttacactgtgttctttgaaaccttgaattactctagcaaaaggctcagagggtactgctatgagaagctggatcttggacatctctttcaaatgcctcggtacctttcaaagggctttggatggaatgaagggacaccattgggtctcacagctttctcctgcctaacataccacagcagtgtatgaaattgttcccatcagctccagcgcgtgaaagacaatacgaacagtaacacccccaaagaaacagtggggctggagacagcagaatccttggagggttctctggctgaagaaatctctctcctaccacagatactgtccccagagaaggtgcacctctaccaccaatgccctccatcctcagttgacaaggattcaaaaagtttgttggtgacgctgacatgtaatattcccctgcgagttacacacatccaggtgaccttcggaccagcattgccggcacacccgtcacgccatcaacctgccaggctggagaagaccgctcagagcttttccttgactggggagaggggagccggagcagcgccccacgtctcacggttcacccctgccgtctctcggggccttccttcaggctttccctgtatcctcagatcttcgccagggtcctgtgatccagtgttagttcattccatgtgtcatatatgaatgatgtcatttgaatcatttcaagtccttttgtaggaaaactaaggcagaaaggccagcaccacaaagaggcatccagaattctcctcggcacaggagggtgcagccatggtgcctttgaggagacggacacgcttagttccccctgccatcagtgggcatctcgatgttaaccagatcttagaaattgctctgctcaggttggactcataagtgtactcttagatgcattcttccatgtttttggaatttcctagagaaaacgtcttctttgttcatgcccgtgacacacgttcctccctgtggtgacctggcgtccatcctgagctttcgtggtgtccacccatgaaaacaaaggtgtctgatcccccgtgccacagacatactcttaaccagaatctcccaacctggggtccgtggtggtcttcgggggggtctgacactacccagggtcagatgaaaagtgttgactggatgcgtttatgtgggcgctgcgatactcttcttggggcggggcccagagggttcctgaaattctcaaaagtgtctgtgtccctccttgtgagtaggagtcactgtttcagatgctcagctttccaggtgatttttcaaatccctggcacaggctttcaaggtgacttaagattgtctaatcctcctgcaggtagaaatgagagtcatctggctgatggtcacgagccgtcggggagttcctcctgtcttgcactcaagcagaggagtaaggagacccctttagaatgtacttctaattgttgaaaagcacctaacaagttttctatgggggagattatacagggactgggtagggacaatcacgtaagacatacctgtttatagaaagagctggatatagaattataggtgggttcagctgcacaaagaagagtcagactacggaggcttgaaggagctgtgaatacactgggcatctgacatcattgcttacttccccctgccccgccctgcccctccctgccccagggtatcggtagcatgtgtcctaattaaattttgacattatgtgagttttagcatggtattttctgcattgggctatctgtataatgtcatggagtggtgacataaataatgctagacttttccaatttatctaccatcccagccccctccccaactcagtcatatgtggaaagtcagtttctttttccatttattatagttgttaactaaagattaaaattttacatttcattgcactgttcataaattgtttataaatacagtgaaatctaagcaaaccaagatgatcttggaaagaagtgttctgtatggaatttatctgttcagacccaacatgcacacccttccttcgggatgtatcaccaagatgaaggcgggcagatctcatgggcatgagcttgtgtgcaccgaggaagttcctgcaagcagtcctgctgcacctgggcgggggacaccctgtggagaaccacggtgcttgagtggaaggagtctgtgtctgtttttcagaatgccttcttgccttcacaactaatatgcaacaaaaataataggattgcacctgcttttgatgcctcaagatatgcagaaatacatttccctcacttgagcatgtctctggatatactaggacagctaggtcgtgcttgcgtttcaggccacggccctgctcaggagtcaggttcagcttcttgcattgagtcttatccgccacagcccaactttaacagtggatgatagccaggaaagagagggaagcatttttggagctggttgtggttttaatgaggcatatacagacactgctttagtggatgtaggagtgaggggggtggggtgtagtggttgaggaaggggcttagtgggctggggtgaaggtctctgctggagatctaggagttttccctaaatcctcatctgatcttcctctcctgtagattgttaggataaatgagcaagaagattctgcgcaacaaactgataccttgctttcttttgtgagcagcagagctggggcgtggagagggtacgtccagtgttggatgtcaggaagttcacgtcccagggtatctagtacatctgagctctaagcctgcaaaggaaccttctttacaaattgcaccattgttatggttggcattctggttaaaagttcatctggatctcaacctcgcgtgaaattgcagagctacgactggaaaactcggcatcagttgagaacctttggggacttctcagacattacagttagaattgagcaaaacatgctgagttccattcactcacattttggtgagtgggttaaaataacagtttagtttcgtcatttttattacctacttttcagacagatccagaaaaataaaaaaacaaaaaaaaagacaagcatcattaccatgtttaggaaatctttgagaagaaatatgtatgaaatttggcatactggctagccattcccttacccccttatttttgattatccaaaagctcaaggtgactttgctcttcccctctgtgactggggttagcaaacaacagccatgggctagatcttgtccaccagctgtttttgcatgatcaggacgctgagtgtggttttttcattttttaaagggttgtaggaaataaagagactattgagtagagacctcacaggccttggaaagtgtgacatacttcctatctccttctctacagaagtggctgctgactcctgctctttggggtcgaaacacaaagactgaataatgatgtggtatttttgtatttaaaaaatggcatagggcatttttagggaggttgtggcattgacgtattctgtgttgcttcagagagatgtcgttcggtgggtagaggctgcgcagtggcccactgtgattggcatggtggtggctctcggcccctgggcctgctctgcagtcaggtccaccatgtggaagtgctctgagactcggtgcacgtattcaatgtttagtgtgtgccagccacgttctaggcaccgtggatgcggccagcaaggaagatgaggaccctgttctcatgcccagcctcagggtgggtgcatggagcatccctggtcgagtgtgtgctcaggattcctttagtatgtcatgaatctgtcgtgtttctcagagcagacttaggagccaggctccctgagattgaaccctgcgtgggccacttctttgctgtggaaccgtgggcaagtctcttgttctttctggcggcttccatctgtataaggggatgatagtgccaatctcttagcgtaggtgacagattccgaagtaaagggcttgtcaagtaggcctggggtgggcctggcacatcctgggggtgctgcctgagggtcagatgtcatcttggtggcccacactcccctgcagtggtgctgctggttcaggaagttaaagtggaaaactgtgctccggaataaacacaattgggagaacccaaaaccacacgcaagaaagcaaaatgtgctgcccgattactaagcatggagttaaactctatttggtgtttttgttctgaattgttagggagtaagaatatttatggttggaatccttggccaatcctaaattttcttctaactagtagataattaagtgtctgcttctagaggatgtagatgtgcttgtcttgtatattacaaagtagagacgacttgcccacaccccctcctgggctcacactccatgcggatggcgtcagtagcttctgagcctcttcaggtgctgaacacatgccctgagctgcttgttttgacagggacatcatttttaaagagtcctttattaccccagtttactcacctcttgttgtctccagcccttcccttttttatgttcttctctcccttttcccttagcaattgctaataccctagttggtactgataaaagaaaaacttaagctgaattgaatttaaaggagtttaattgagcaacgaacaattcgcaaatcgagcagcctcccaaagccagagtaggctcagatggacagaaaaaggaaagtgacagagacgaggcacagaaacagccagattggttacagcgtttgccttatttgaacatggtttgaacagtcagctatattggattggccaaaactcagtgattggcacaagagtaggctacggtctgtttatacctccacttgttatagttcatgaggtacagaaaaaccttgaggccacattcaaaacatggaaggaggcagctttaggctaagcttgattcaacaggttgctctcgtcactaggaagtagtcatgtacaaatgcaaatgtgcttgaagtttcaacctagtttttagaatgtgggatcctgatgggtattcctctcatcttgctgcttcttgtcttgcgcatttatcatcccttcgaggcagtggtttcagatcttaatcctttttcctagtcacctaatattctaagatgtggctatacaaagcatttccaaccattgtccttcccccctcaaaaattatggtaataagcgtccttcccaccccacagataatactgcagtcagtgcagacatatgcttgtacatgctttcacacacgattcactgaggccggcaagtctgtgggagggagttctataactgaatgtttacacagggtgtgcatatctttctctttgaataggttgtttctatactgtttgtcatgaaaactcagaccattcccattttaccatcctttcttcaccagggagatagagtgacagagcaacttaattgttgcccatctgatgcggatcaagtgtcatattaactgtgcatatccctgcaacgtttgcacactaatgtacattggtctttctagatgcctgttgttacctataggtaagtaggtaggtaggtaggtaggtaggtaggtagatgtctgctagcaatttgacgggtcatttctttttgaaggataatgaacaaatttgaaacctgtggcacagcctgggacctaagtctgtgtggtgcagggagtctaacttctgtctaagtcagtagtatctccagggatacagccttacatccactgctggctgcggcttctctgagcgacccatctctgcgtccgcccatccatggctgccatctcgcacaaaattattttcctgggatggtcccttgagttagttcgtggttaggggtagctctcaccttagtccctacaaacccacctgaatttcctttgtctccgagccacatgggaaggagactgtggaaaataaaccaagagattctctagtaggtagagctagaggcaacaggttaaaatcacatctttataggagaatgtttggggaatgcattcagcagtcacccattctcattaatagacccagaaaacaattaaaaaatacacattgtgatttggactgggcagacatgccgactgtggagccatttcttaagagagggaggttggcaggtagctggtgagcctatttctttgctcattgagctagcaagagcaacacccattactttcattggattacttgtttgaaaattaaattaatcaagtgaggtaaacatccgtattgcctcttagcacccccataggctgcccgcaaaatggcctgcgtgggtatcctaagagcaggaattggctatgacctgccgaggtggccaactcagatgtggccagttttccatacaagtatgaagttcctgaattaatgggaaacctggctgcattgtctgatggcttactggcaagcagtaattagaaaacatttttcatagtggaacctcaggtttagctatccagagaaattggatatttcaaaatactcctagttggttagtgaaacattagtattaatgacaaattaatattaatatcaatatcagagttgagtatgtagcctttgggaagagaagggaaagattttaaggaccagatttaagtagcctccatatgcctttccttcttggtggcatttttcatctgaaagcattttttttttttttagctcaaaaacttagatgtgaaaaattcaacgcattgggaagaggcgtcaacatttgaaccgcaaatgattaaacctttatgactaaagtaataggtttggcttcagtcttcccagtggagtagcaagcagaggtccttttcagtttgcaaacagtagtatacaaacttggtccatatcaaatactgtttctcttccagggcttgtgtgtgcactgggaacagcaacaaaagttgaacagcaactgggtggggtttctttatgtcttctgtttaatcagagtttcctgatggtttggccacttcattctcctttggcttaaggggttctaagccatggggcagaccttgggtggctcactgctcttggaaggagggtgtccagccttcctggcagtgtggagatgagtaagggaaacactgcaggggcttctggcttcctggatcctgcccctcacctggggactttgtctaagtcctcatcctagcaccacctcgagatcgattcaggcctccccagcagtggcagaaatccaaccatgggagctagtgggttccattactgtggagtagggaagaagacatatgtcccttctaagtcactttaatttggtccaaaataaataaccaaagtccttggggagaccgtcagggaagtatcttcccacatcacacttggtctttgcaagaagtgctggtgggcgtgcagggcttcttgacacttcgcagcaacgtaaggatgtggtagtagagtgcttggtgttccagtggccactgcaatacaaatagagtgagttttgtcgccgtggtacattacagccatggaaattccccgtagttcattggtccgtgaccaacaaaaatccccctagactaacaattaatcaggctctgctgagcctttgactggcgacagttgcagatgtcacatcatgcgaaaagttaaatctcagctttccccaagaaggaaaaaaagtttatttttacagtttatggaactagttttccttttgatcaaatgacctggtctttaggggagaaatattttcatttttatgttagcaagtgtgatacagaatcatatacatttaaaatcttcatttttattgctttttttttaaagtacaaaattttaatagtaatagtgatttcaagaaaatgttgtgagtgtcactttactagtcaggcatgttgaaaaggaacgcgcttcctgaaatctccaagcgaggttggcatttgagacctctgggtacgtgagcttaaaattaatataagtacctgagcctagagcccaggaggtttagaaagactcagagatgcgcttaaagataattggtgtgctcctcttgtgagagcggattcaccaaaatgaagttaaaatttgtttgggaagttgcttgtactgtgccttgtgaacttacaaatctgtgtcacaatccaaagggttgagagccacacaaagcaaaacagatgggccgtgtgtcgtaggatttcctgctgtcctttcggcttcaggtaactaggacttgtgaagcacaagatacatgggaggcaaatctgaaaaggaatggtgagtgcgccccacgtgcctgggtaatacctgagtgctcccggcattacctgggggctgccaccctccctccccctccttcctttccagctcaacattgaggtgaactttttaccatgatcgatgtagctttctggtgtctacacagatttctggatggcctcagaaatgtcacatactgcttcgggaatgtctgcaagtatatttcatacattttacctggcaattaaaaaaaagtcatctttaagatattagcatgtggataccgaggttccacacaaagcaaacaaagaggtcattcttagcagctaattttaaatcttcaggcaactatacgaacctatgtcacagtctctcccaaaatttattataatgcccttgttataaatttagaatatttttgcaaactcatataaacaagtaattgatgcgactaaaattcttgtcacatatttattgcactatcagctaaaatttttaagtgacaagaaccaaaataatcgttaatttttatagggcaaggatctggctttttgtctgacacaaagctgtataaaaaactgcttctgattttatgcacattgtttttagttaatgattttcagctgtttgttgtttctctgatagcatgaaaatgtaccatatgctcagcccaaagacagatgattagcaagtgagattccgggcagctgtctgactgagcgcgttgggttgatagcattctgctatcataattagcttaagctttgggttaattaactttctacctggatatgcataataatagcaaactgcaaaaagcaagaagctttcagtacatcaacaacattgctgtcttttttatttggtatttcaagagcatattagaatttcaagagtgattaatcctgggaatattgtcatctactgtagattttatttgcaagccagataatactgaaacaattggaatctattatagagcagaaatagcattttaaaattgtaattaaagtttctaaaagcaattgctaatttcaaatgcctttgttggcaagaatattaggcacactgcttcttgtatgggcagcttgtcgggcacaaaaaataccagcacttacactgtgaagaataaaactttcttttatttaagggctgtattgaaaataatcagttatttttatgtaatttgaaagtaagattactctgtagtttgcagaggtgctgttcagactcctagattgaagatattaaccctgtgccctcttgcaggttctcacctttgttacctcctgagcagtggagggctggaggcctgggtaggagtgcctggtgccctcttagaagatttgatgtgtgcgtgtgtctgcgggtgccagaggtcagatttttcaaaagtcagtgctatacatttgtagcttgatatttgttttctaccccaagcagtttctaaatcaatttactgatggtatgaaatggggagagggagggctttgtctccatcctcctccttgtttgcatgatttaccaaagcactctctacgacgctcatcatctgaaggggctgccggggcctttggagagcacaagctagtgaagtggatggtggatttggagtaaaaattgtagtttacatttcccaaagcaccagagagcctagcacttaattctgaaataagtcatgcctgttgttacactcagaaaaatattttatcttctgaaaaaaaaattctttacatatgcagtggatggtgaagatttggtggcggtgaatttgccctggctccagaggactttacttacagaatcagcagtcgtgaaaacgtgctttctcagatgtgtgacttgtggtcagtctgtgggctcaggagcacccatttggtcaatccatgcaagttttatggggctgtcagaagccatttttcaaaattggcttcatctgaggacacgtggaggagccactctcttggtgtgggtagtgaaaggagtggctccctgtggctctgtcttgggagttgggggctgcagtggttcactgggaggagggggtgcccctgcaggccccacctgcaccccacctcgccgccccaccccctccccccggctttcaggctgtgacctcaaggccttttatcattttcacaatgatgtctccaacagacctttaccccagtctcaaaaaagatactgccagagcctgcctttgctttttgtttagtctgcttcgggctgcgtcaataaagatagcagaggggtcaagagaaaagaagtgaacggaatcacagttttggtgttgaacccttaaatgggggccccactgtctctgctgtgtagcaggcacaggattatctgtctgccttctgagatttcttttaatgttttaccaaattaaacatgaacaatttcaggatgcaaaaacttgactgcatcttgttgtttcttaaataagagcactttaagaaggcaatatatggagattcttttgtgggaaagatgtttcaaatgggttattactggccattgaaagaaagaaaaagaggaaatgcatcgaggcctcattttttggcctgcacatttgattattttattttaaatgccatttcaaacatagtgtaaactaatgatattattttttaaaaaacttactctactatttgcggtccttgatctttaatttcttttaatgtcaaaattatttatttggccagttccattccagatgtgactgttgagggcacattaatttctattctgttttcatgggcccctgtccccatctgtacatcatttctgacttccgtgtgctccctagggagttcacttattcatattgtaggtttcatttgctgtgtaaacagaataaacagacaatgcaaaaatccccacaataccagaaaataattcttttcaacaacatagtggatcatatttaaaaaaaaacatggaaaatgcaatacatgtgaagcccattttttccactttattgtcctcccgaggaaaggcttgtgttaccagtgcatttcccttgaatttgataagttcatttttattaaaaatccatcccaaacagcattttacgataattctcaaacacgtgttgtggacatttctttgttttgcgtattagcttggtcttgcgggttaattcggaatgtgttactcaactggtatgtgcttgcgtggccaaaaacacccgttgtgctgtgtgtgtgtgaaaagcaacattcaagaacggtgattttttttttttgacatttacaaataaagagggacatgagttatttatgctccaatgttgctgcaaagtccttatctccatttggcactaaacaaggatttgttgtgggatttgtgagggctgcgcagtgcctctgtgctaagcacccaaaactctaggggactggcactaatttcctctctctcgtaaaacaacgtagtattcataacaactcaagaggcttgacataagtaatgatggcatgtgcaggcgaagattaccacccaacagtgtaatcaaggtgctaggtactaatgcaagttaaattgagacaataatgccgaaacttgcattgtgggattaggagggcacttgaaatgctgacgtgagcacatcctgcctgcctgcctgtctggcgctccgttcctgtttatacttaatgacctcaaaatttgtatgtcgttaacaccgtgtactgaagtgggagagaacacggtttgggagggagaagactccctgtcttcgttgacttttgtctcttttggtaattggtggcttttcctgccgtattagggagcaaagcgtgcagcggggaggcccctgaggtctctgtaaacatgctgtgggcaccgagggcctccgcacccggcgctaggcagtaatttacatactttgaatgaaaagtcatttgtgcctgcaaaattgttattgctggaagaaatttaaatactagtcatatggaaatttgaaataaagtcatattaaattttgatgctcagatcaatattgtggagccccggtaattaaagtgggtttgtttatttggctccttataaataaaaagggcttaatacagactaattacacagaatctttcgtctacggtgggataataatggcagcaatttaaagtgatattaaatgagaattaataaaggaatattgagtcactttgactgtattaagctgtgaaatgattcctcatctcaatttaactttctgtcttgagcataatgtttgataagcaatgcatttttgtaggaataatctataacagtatttgactgcaatatttaataacaactagacttgtgactttatgttgtttttaaatgggctgggaaagcccgttttttctctgcaaatttataggacaacttagagggttcttgccctatggtagcttcacaagagttctgagttggcaccctccggtttgggaggtaggtggagatggctttgacttttgttcaacttacaagggagtaacttcttggaagtgcagtccgggccagcagaaatggtcatagtaggccatggtggaaggagaatcagaaccacgcgtaaatcctcagaaggaagagggcagtcatttttttttttttctcttggaggaatatcccgggaagaattacctggaagaaatcagagtggttttggaagatggattgtcggataacattttaacttaagggctgaagttcctttctacctaagtaccattgaagaagtatgttcctgatcttaaacatttttaatagcagtctaggccaattgactctgtgaccattaagtaattttcaagtggactggctgctgccagggtgtttgtgttttgctttgttttgtttgcagagtaacttgtgtgtaatttctttccactgtgccgcacagcatgtcatgtccacgttagcatttctgcccttttaaagggtcctgctgaaggtcaggacctcacactgaacaccctttttatatatattacaaattgctggaattgttcattaatttctgtctttgaaatgccatgtcaaccctctaaaggaattcgcagtgccagtttcccttggacagctgctcaccatggtccagtgcgaatttctgatgaaattacaggtgcagggaaatgcagaattagaaatatatctgatgttgcaatacttgtgaagctatagctttgttgatgacaggacaattccatttttgacagtttaatttactgttgccagtggacaagagcaagaggaggacgtggggttagccacctgccccctcgtaccgtgtttcacatgcgaggttgccaaatcatgactccctcaacctgtcgggctcaaatgagaaggttttcagctgggaaaatggaatatatcagtgcatgtaatattgcctgacctcataaaacaaaagggaaaattgcagattctgacagccattatgaatcttgtatcagcatccaaaacgacttggagccagggtatagtacatgtttataatagaaaaaaaacggggttgccacgttgacttgcaatatggagcaaaaaatgacttgtcataattcgttctcagatgttaaagaggctgttgaatttactagtatatacacagaagaatgcgtagcccggagcagagtgtggaaatagtccctacacagaggggtctgctgaagttagtcatcgagttagattagaatggaaggcaggaggggaggaactccgggtttgcgccgcagctgcgtcggtggggccagatttctcattacaagatgtactgaacctttccactttcacccactgtaaatctataagtaatcaggcttctaaaataaagcaaacaaccttgttttgagattatgagaatcatttgaattgaatgtattctgttggaaaactggtgtattgaggcatggctttttatcttacgcttaaaaagttttatttatattaaaataaggcataatctctctgcgtataattatacgctcttcgatttagtttttctatttaatagtctattccttcaccttcttgcccatttctttatgttattccttaaaaaataatttctaagtacaataattgtctcagctgcttttggtgatttctttgggaggggagatgtggagtgacagtccaggaactttctgcccaggggcaggaggcccagcgcgtgctccccagctgaggccccgtccgccttggccactccctttcatctcccgggctgaatgcggagtgtggtgacttttattttttcctttgctattggtttagaatgagatgtagcagttgatttaagtgaagtaaagcatgcttacgcagtacactgtgtccctgtcggggcctgctctctcatgtcacctgccggcggtggcatggagacaaagccttctctcctctcttactgctgctgggcctctcctgggcaggtccgggctcagtggcttgaacaggtgatgcagggaggggcagtgcctgtggccacagtgatggcacaggtggacatgatcctgagagtccagtgggggctgtagcacaggaaaggaggttgtctacagcctttctcaccacacctttccctcctcagtggaatctctggccccatctggagtccctggaggctggatggtagaactggaatcgttggcccgatctggagcccctggaggctgggtggtagaagtggagtctctggccccatccggatgatggaggtggaatctctggccccatccggatgatagaggtggaatctctggccccatctggagcccctggaggctggatggtagaagtgaaatctctggccccatctggagtccctggaggctggatggtggaggtttgctggggtaaccctaggcggtaggtgttgccacccaaggtgaagaggaactcacagcagcgctggcttagcagctctgtggggcataacccacttctttgcaaactctggtgctgggagatgatgaaatgagcacctggtacattaggtttgggacttaaagctgatacttccattcgggagcaggatgagtaagacctggtgcttctttgctcagagctctctgaggtgggaggctggaagcgcttccctgaacactgtaggaagtgttgcaggagagcggaagagcaggaggaggaatggtgcagaggaggaggagcagtgcggagatttcacctggggggacaccaccacgggaggcaggcggcaatggtggaggcgttggctgagcagggcctttagaaaaaggcccgggagcttggcagcagaaaggagggtggaagtgcagaagcatcgagatgcccagtgacgtctgtgcagtttggattttgctgttgaaaagcaaaggagatgaatagaaagctttaggcagacactgagagtttttgctttggaggtattttgatatatggtaaactattgtttggattattttggagtatgctttggtctattattaaatatcccagtcaaagatagcagatattcaatatttgagttaggatttttcaaatacttagaatatttgaaaatatttttatcattagaatttattgattttttgagacactatcatattctaacaattgcaccttattctttggcggtatcactgtcattgtattaatggcaaaggcttcaaaatagcctgtcaggcccatgtcatctgcaagtcaaccctcaaccctttctctctaaactcctctcctccagtttgccaaaccactgtgctccagccatgctgccctccttgctgttctggaacttgccaagtatgccccaccccagggccttggcatgtgcctggaacacttgagcccccaccctgcacatggctggccccttgttttcttcagctctccgtccatatgcaatagcgattcctcatgcccctcatagcacttctggactttttccttgctctattttttaccaactaaaacaggggttggccaaccatggctctcaggctggccacctgttttgcaaatacaattttattggaacacacttataaagacttgatttcttatggctgttttccctatgatggcagagttgaatagttgcaataaagtctgacctgcaaatctaaaatgtgtgtaatatctggctcattaggcaaaagtttgcaaagccctcatctaggatatagtgcattcatttgcctctgtccctgactggaatgcaccctcccttaagacagagcctatctctgtttggcccactgctgtatccctagagcctacaacagtgtctagcacaaagtatgttctcgtgagatacttgaatgaataaatgaacaaaagtgaaagttccagccaacaggatgatgggcagtagttaactatgcctctaattctggcttaaactttggtatttcagcctttatgtatgttctattttgcagtttttatggtgcacaggatgaaagaacacatcaactcctagggagtagaggaggcctggaaatagactcagatgcagaattgtgtgcaggtggctgttggggagtgtattcattcattctcacactgctattagcatctgagactgggtaatttatgaaagaaagaggtttaattaactcagagttatctgggctggacagacttctgcttctggagaggcctcaggaaacttacaatcatggccgaaagcaaagggggaagcaaacacatcctcatggatggagcaggaagaagagagagagtgaagggggaggtgccacacactttcaaacaaccagatctcttgagaactcactcactatcatgagaatagcaagggggaaatctgcccctgtgatccagtcacctcctaccaggacccttctccaagactgaagatcacaagtcaacatgcagtttgggtgtggacacagagccaaaccatatcagggagtattcccaggatacactctgtaaggaagtgcatactgcaggatcgggcaagggagaagcaggggcttgcattatgacctagttgcagttgaggtctcatcctgtcctgcagggaactctggagagagaatgacctgtagagtcatcccaaattgaggccgggggcctaagtcttggctcccgggtgcgctctgggggggccataaccttggatgagatgcttctccctcgagagcagcggtgaagtatgcacctgcctctgagctcctagagctggggtgtgatgcactggtcctgaaacaaggcctgggcaagtacccagaatttcagttgtcaatggaaagagtcaaactctgtaaaatacttatagggatttattctgagccaaatatgagtgaccatggccagtgacacagccctcaggagatcctgagaacatgtgcctaaggtggtcggggtgcagcttggttttatacatttagggagacatgagacatcaatcaaatacattaagaaatacattggtttggtccagaaaggcgggacaccttgaagtccaggggacttccagcttataggtagatttaaaaatctcctggttgataattggttgagtttctctaaagacctgagatcaatagaaaggaatgtctgggttaagataaaggattgtggagatgcaagttcttatttgtggaggaagccttcaggtagcaggcttcagagagaataacttgtaaaatgtttcttatcagacttcaagtctgtgtggatgttagtgccggagaggtatagcgaagcatatccaacccccacttcccgtcatgcctgaaacagtctctcaggttacattttgaaagagccctggctgcggaggaagtccatttgatggttggggttagaattttatatttggtttacaaagtcttgaattaaaatattttatcattacctagttttatacccgggaatgttagttgttgcacgtgaggacatgaagtgagttaatgcagggcttgggccgtccagtgtcttctttccccacagccttgctggcagtgaccccatataaataggaacaattaccggaagaaactgtgctcctcctaaagcctagctagtgacttccacctttgaaccataggcgaggcagcacttaaccagggcactgtttgataggatgttacaggtggttccagagaaaaacgaaacatgtcatcttgttaagggaggtcttcgtttcggcatctctgtaaaatatttaaagaggtatttttatttctttaaacaggctctgcctcttccgtccccctcgcccaatgtggactctgcccgtccttcctgagcagtgagactctgtccccatgtgcttctggtcacagctgcggtgacatcctgtaacattgtttggtccttgcttaaatcagttactcaccatgttatagccgagttcagacccactacacagacctcctaaggtgctggcctgtctaaaacattatttccattattcattcctgttcactctgggatagggaagccatgctccaagctgtattggaatatcaggtccagggtaattagccagggcctaaagggtctgttttggaaaattcaagtacaagtagaatcttctttagtatcttggatccaccagggaagagatggtctctgaggcctgctatgcagaataaaaccaagagagtcactgtgaaggaatccaagagatgcaagtgctctttgctgtccagtgattaaaatgaaagcaaagacgggaagcgtccttgatccacattttgcctgtgatttgaatatcacatgcttggtccgggcacttaggtgggcttcagtgatttgggccggaaggaaatggtgcccctttcctcgagtttctagattgttttgtcacagacaggggaagccctcatctgacttgccctgtaggaccctagtctgtcgggaggtctctgtccccacccctccctggagtctggggtgtagttgggctgaccctcaaaatatgctgtgtcatcaaaggttcatcatctatctggtctgttttttaacgcaacttgataaaataccagtgttttaataaaaaggtctaaaacatttaccatttaaatgagcctcccttcctgggatgcacacaggagtcttggcgggaggctggtggcgcaggctgatgggtcctgtccctctgtgccttgggcgcctctgcccagcgtcacgcagtgtcatgagacccctcagtgcaagcgcaggtctgcctgaggtcccccctcccacctgcaacctggatgccttttgtgcctatggaacacaactgaaagggccggtcagtgccatggcttggctaattcatggtggacatgcattttggtttttaaaattatggtaaaatatacataaaatttcccaccttcaccatttttaagagtccagctcagcagctgtcagtgcattcacaccgtcgtgcagccatcaccaccacccatcctcagagcccctcatcttcccacagggaaactccatccccattgagcacagactcccccttccccagccctggcacccacccttctactgtctctatgagtctgactacatcacataagtggtacagccattgtcttttgtgactggcttatttcatggagtatcatgtcctcaaggtccatccgtgttgtagcacgtgtcaaaaggtccttccttcctcaggctggatatgggctctttaaaagcctattttcttagagcaaaacccgtttcccccacacctgatcgtcacaagccgtctaagacacgtggtctagggtttgctagtgatcgtctgtgggctttccgagcctgcgctggttttgctgccacaacctgaggtccgcggacgtccctgtgctcgctatgacttctttgtgtgagactgtcagagtgtgttcctggccctgacacgtgctcggcggctggtttttctccttcagatcagcggccttggacagctttcgcttctttggcagccgtttcaagctgctccgtcttgtcattttagagttcaatatctgctgctctgaaggaagaaacggggatgggctggaccattgcacttggtctcttgacctcgatgttgcccatgagcagtgaaggatgacttttgacgagccatgtcagatgtgacaggcaatctagttggcttgagtggaaatgtgctgtacaagtttgaagccttggttgggggcatttttctggtgttcaatgcatttaaattgacaccagacttcagtatgttgttcatttcaggcccagcactgtaggctcccatctttaaaatgtgtgggtgccgagcgctccctcgtcagcttttgcaaagcattttgcatattcccagtactgtatttacattcctggctcacattggtttttgttttttgtttttcctatcttaaagcttatttttgaagtgaatttttaatgctttcagttgagtagggatttgtggaattttgaggggtggggaggtgcagtggagaaaagggggaaaatggttgtttcttggctctcagcataagctacattttccatcatatggagtgagatgcctatattgggcagctgtgattttaagtgaaagtcatttccagttgtttctaatgtctagaaattaggtttgttttgattttaattgtcaaaggaagggactgtgggtgaggaagagcccttgccgccgcctcccctgacgtgcccctgcttgggcagacgcctccctggtgaggtgtgggctgcgctggacagcacccaggaccacggcctcgttcttttccttctcactgtgttttcctcttgggtaggggtgagggtggttattttactcagatctctgagccttaaagtggatcttctgcagatcatctccagagtcatctgacggcgccgggcagaagtctgtatgttgggagctgtccccagctcctctccttaggacttctgaatctgcttcaaccaagcatattcctgcctcatccggaacattcctcaccctctgccccagtgcaggcggtgtccacatctcagggatgcagcgtggtggaatttttaaggttttggttggcgtggatgagagcatctctgctgaggctgccgtgcgggtgtgggctgggtgcatctgtgtctctgggcaccatataccaagtggcactcatccctgtgagaacatggcctgggcattagaggataggatccttagtgtgagggaggcctcaaccataaagggactgaggggagagacaggaagggtccaggtataagaagagctgcccacggcagggggtgtggcagtgggaccaggatgaatgggtctcagtaatgtggctccttccccaagctggggagcaagggaggcttctgctgttgggtgttgaagaggaatctttggtttgcagatgggggtggggtgggtctttgcccatcctctgatcgtatgtgtagaagtttgcaacatgaagggcagactgtggtggagttctttggcagttaggaaagcaagccagggcacagacgtgttctctgaaaggcagggtgtgggcaccacagggtcagccctgcaaacaagagcactgagcagagggagcggcgattggattggagaacggaggctcccacctggctcacatactcctacatacatgccacacgcatgccacggtgcttaggaatcttgaaagctgcaggctcaggggagctgcgatgctcatcgtgaagatgcagagccggagaggccgcccaggcaggaaggccagtgctggtcgcctccaggtggtctcaggatcccagagcaggaggcagccatgtggtgctgaaggggaagcgagggcatagaagctgtgccctggagctggaatggtagacagggctttcttagtgccagggcctgcaaattcccaacaagggctcactggaatcctcctcccgccatcctcccaggccccccattggccggccaggcccctggattacctctctggtgccctgtcctcctccatgctctcctctaagggccctcactggcacctttgccctccttaaccaggtaacactaaaccaggagacatctagaatcctgtttgagacatcttcgagagtcaccttgttaactagacagaagtggatctctacaggttagagcctggggaacctctgttttctttgtgatattctctagtgagtgttccaggaaagaacatgccccactgtctcctttctacttgcagatagcggtgaggtgggagaggggcctgggagtgtgctcttcattctccacctcctcccccgaggaggtggtcatggtcactcgcttgacgagcccagactctgagcttctgcccctttattgagcaaattcataaagtcaaccatgctcttttattatgtaacttgttttttagattcaggggtacatgtgcatgtttgttgtataggtaacttgcctatcacaggggttttgtgtgtggattatttcttcatccacatgataagcacatgataagcatagtacccaataggtaggtcttcaatcctcaccctcctcccaccctcaagtaggcaccgttgtctgctgttcccttctttgtggccatgtgtactcagtggttagcacccacctctaagtgagaacacatccatgttgctgcaaaggacaacatggatgcaaatgatctcattcttttattatggctgcatagtattctgtggtgtatatttaccacatgttctttatccagtctcctattgatgggcctttaggtttagtccatgtctttactattatgaatagtgctgcagtgaatatacgcgtgcatgtatctttatggtagaaccgtttatattcctttgggtgtgtgcccaataataggattgtggattgaacagtaattgtgttttaagttctttgagaagtcaccaaactgctttccacagtggctgaactaatttacattcccaccaagagcgtataagcattccgttttctctacagcctcaccggcatctgttattttttgactttttaataaaaaccattctgactagtgtgagatggtgtctcactgtggttttgatttgcatttctctaatgattagtgatgttgagcatttttttcatatgcttgttggccatatgtatgtcttcttttgaaaagtgtttgttcatgtcctttgcccactttttttttacagagttgattgttttttgcttgttaatttgtttaagttctttatggtttctgggtattagacctttgggggatgcatagtctgcaaagtgtgcttcttatgcaagcacccagccttccggcactgggacgggccacatgggaggagccaaaggatgggagagtttaccccctccagcccatgaacttgctgtgaggacccctcctgccatataccctcctgggtgtgaagaggcctcctgtgtgggctgcaccactgtctccgggattcttggcctggaggcatctctgaaatttctcagaatgcccaatttgcaccagagatagagccaggccccttgggatggaaaaggaaaagaaactagatttactttttaaagtttctagaacttctttggtatccctagaaaactttttttaaaaaggattttctttttaagttggatttctatccattatttacctgagacataatttcagctgatcaaagtttagagtgctggcaagtgccaagccttacgatagatgttgtaccttttgacaaatgaccatgtatgcacagctctgtttctggactctgttctatccatttttctgcttgtcctcatgccaacatggccccgacttcattgctgtggctctgtagtaagtcttggtgtcttgtagaagttctccaaatttcgttgttttttccacaattgttttggctcttcttagtcctttgcatttccatgtagaataagtggattaattagtatagaaaaacctgtgattttcattcaactgcattcaatctatagatctatttgcagagatatttcacagttttgagtcttgatctttgattgtggcgtatagctccatatttgttttctttgatacatctcaacatggttttgtaattttttggtatacaaatcttttaaatatattccacataaatttatccataagtttttcatgtgtttttgttttgtcctttaaaaatgctatatttttagtttcaattcccagtatttctttgctaatgatgagaattacaggagctttctgtaaatttgtctagtatgctgtgagtttgctgaacaaatttattctagttctagttgcccaaggattctttagtatcttccatgtacgtgaatatcttgtttgagaatgaagacagttttgtttcttcctttatactatgtatgctgttagtttctttttcttactttattgtactggctagggtctccatactgcattcaacaggagttggggaagtaaacatcctctgttcctaatcttaggggtgaagcactcagtattttactgttaaatataaatacacattcttgtaaattcccattgaagttctattcttgtaggctgagagttttattacggaagggtgtgtcattttgtcaggtgcctttttgcatctgttgtaatgtttatgtggtttctgtcttttattctgatcatatggagaaatgcagtaattgattttctaatgctcaacaaaccttgcttgtctttgataagtgccacttgctttgagaaatgcatgcatacatctctctgtatatatatgtgtataattccagcattatttctatatacatagaaataataaatatacaaataatgctggttatatttgctaatattttacgaattacgggatactggtctgcagttttcacattttgtcttttttaggctttattatcggggtaatgctggcttcataaaatgaactgatgtattctctcttgtactgctttttaaaattgtttaggattggtattttttttatttaagtgtttaaaaacatctgggcctggaattttctttgtgggaaggttattacttaatttaaaaaatatatgcaatactattaagattttgaatttcttcatgactcagttttggttatctgtctttcaaagagtttgttttatctaagtggttgagtttattggcattaattgttcgtaatcttctcttatccagttatccctctcaggtctctagggcacgccatgatgatgctattccactgcccttttttccattcctggaatggtacttcccaccttctaaatcagtcttgttacaggtttattcattttctcagttctgtattttattgatttttatttttttgttattttgtgtattttactctctttctactttctaagatagaagcagtgggtcccactgaagaaaagcagatagcaggcactaaatttccctgtagggttaactatgtcagcctgacagaccccaggctgtgtgtctttggaggacagagacattggaggccgttcatgatcctttctaagattggtcattgataggaaactttgtttgttaagtaatataagtattcaaaactagacattaacttctaagcagtgcttaagcagcattctacatgttttgatagggattgttttttaatatcactctgttaaatatttatgtactgtaattattgtaaatggtgattacactgttccatgtgcatttgcgagaatataccctgccattgtgtgcagtcttctataaatgtacgttgggtcaggttgttttggcgtgttgtgcaggtcttccctatcttctgactttgtctccctgttcaatcagtcgagaaaggagtgtcgaagtctgcaactcgaattatggatttgtctcttttcccctttggttctgtcaactcttgccttgtgccttctgtacatttgctagtaggtgcctaatcacatgagatcatgacgtcctcctgatgtgctggctccttaacagtatgaaatgtactctttatctccagccatttttcttactctgaagttactttgatattaatattgctagctttcttgtgatttgcctatgcatgtgttatactcttttccatccttttgcttttgatctatttctttatatttatagtgtgtttcttggaaccaggatatagtgatccagtatgcaagtctgtactttttatttgaaatgttttagttaatgtactcatcaataggtatgggtttagtctgccgttttgctgattttttcatttgtactttttattcttcattcctgttttcctaattccctgccttcttttggattgaatccttttttgatttcattttataattactattgcgttattagtgctacctttttttaagtagtttgtttagtacagtactttttgttagaaattccagaaatgatggaatgcgctgtatccacactgtccagtatggcaggcactggccacctgtagctgttgagcacttgacatgtgactcgggcaactgaaggaactgggtatgcaattacgtttaattttaaataatttaaatataaatagccacttggggatacctgctaccacactgggcagggtgactgtagggtttctaatattattgttaacttctcatgatctacattgaaaatggtgttctgtgacgtcacatgcaatgcaagaccttcaccacagtgaacttccatttgccccttgaagtcccatgtacacggccattgatcttacttctacatgttatagactctcaaatacatggttgtgactttttcctttaaacagtcatttgtcgagaaataatcatttagaattgaaattgaaagtgagaaagtactcttttcacgtacgcattttgatgttctaaatatgttgaaagggcgcaggggggtttaatgcccttcatcagatctgtgctaccttgtggacagtaattggaaaggatggggaacagggacgcacgagtgggtagatgaatgcgaggctgttgaaatggttccatggtgagcagtgcatggttgcttggaacaggaaggagcggaggtgttaagaagtggttgaatttgggatctctttggaagtatgatgctccagctgttatcagcagagctgtaagtgaaatgtactttgattgtttgttgaacatccttgccacctttcctatcgaatttgcttttcaaaaatagtgtggacattaaaaagccatccccatgtgcctaatttcaattagaaaatgttgaatcactgtgaatttggtgagtcatcctgcatgtaagtagagctatccatctaactcttagaatttgttaactattaagagaggaagacagaaggtaatatagagatgactatttatgagtcattttatttattcattatccatctaaagagtagcaattgattgtatcacagaacggtgtttgttttacatcttttgattaggagcagtggtttatggcatagacttgcttaatttcctcctgtttcttcctctggagtggataactgtttcacaacagaaggcgataaaagatttctggtttattcattaattttgctttgagacggaatacctgatctcaaggataagatgctgattggtatgacctgaatcgaatgattagcagtatgttgcccttactctgatctccccacagtgtgagagattttctcatcttcgcatcagtttttagccatgttttggtgtttaagcagagatacgattccactttgaaagctctggaagtaattctcagatcacatatattcatctcaaatttgaaatctggagtgtttgtcttgaaattaaattgtggtattgtaagctgtcagtggcatgatctgtgctggaacctgatgcggtctagtttacacggtattgaatcatgtaagtatctcatctttcctctttgaattcagtatgacttcacataggtgaggttagcttttaagtgtacacagaggtatggttaactatcagcagacttcagttatcaattgctgatctcagaaagctaatttatctttagtgtccaataacattacatggctttctttctttgttttatgttttgtgtatatgtgcttaactgtttaaataagttctggattgcatccaaataaggtttgatatgctctcattaagaatatgatattgtgaataaatgtaatcctgactttcaataaatggcctgtaaaaaaaaaaagaaagtatttagagttagtgagttgaggggcttcgtcacatggctaaaggagatttgagtagcccctggaatgttgagtgactctgacttgtggaatgcatggagccccgtttcgttggctggcaggatctacgtgggccgagcatacagccctagatgaatgacttatgtctctgaattctgttcctaatctctgctgctcaatctgtggccacctgcagaggagccagccggatggcatcgtccttaccgagctctctggttgtcagatccttcactactccttagtggctgattactctgcgtagtgtagggtgctgtagggtgcataactgattagtgccttgcagatataagcaaagtttacaatgaagcccttgcgcttaggagcatacagtctagttatgaagagaagacacaaaacacccagtcacatcactgtgaacagacaagtttgccaggagtctgttcagacctggtgctccctgagccgcgctgagcagcagttcagcggggataccaagttggggaagatgccaagtggtaggaaggaggctggggctctggtctgcacatgccagctgatggagtttggagttggggggatatggccagttcccaatgcactggaccagccaccatccagaattaggaagtagatcagcccgtgcctggcatgcattgctttcttttcagtttctaacatatatataacctttttaagtatatatatatgtatgtatatatataactttagttatagagtctcgctgttttgcccaggatggagtacagtggtgcaatcatagcttgctgtagcctcaagtgatccctcccacctcagcctcccaagtagctgggactacatacgtgcaccaccacgcctggctaatttttttgaaaggacaagtcttgctatgttgcccagactagtcaccaactcctggtctcaagcagtcttcctgccttggcctccaaaggagttaggattacaggcataagccactgtgcccagcctaatctatataacctttcaaacaggtatctccatttgtatactaggggagaatgtagaccccacaccctcttcctcaagaaacaacttgaacgcatgccattctgccatctcagccaaggcgattgcctgtgcccttcccaagggcttggagacaccctctccctgctagccccgtgcaggggtcttcccatgtgtaccctgcagcaccgtccacctgtctgagttcgatggggcctccaggccccctgccttggtgaggcaacacgctcagcgcctgcgcgaatcttcttgcccatcagttccttttccttttatccaggatttcacacactgggacattttgtgccaacaattattaatcagttttaagattgactgggtttgtggactgtgcccagggtttgtgcacctcactcacggcagatttcctggcagccctggggatggtcctgctcccccggggacagtttccatctcatggtgtagctttgggagtggggcccactgaagaaaagcagatagcaggcactgaagttcctgcagcctgttggaccccgggccgtgtgtctttggaggacagagacattggcctacagtaaaataaagtcagatgagaaagggtggggaggctttcctgctgtaaagggattatgtattcatactcgaaatagggatacattaggggaatagattgtaatctctacatccccaatccatgaaaacaaaacagaaatggagggccaagaaacctacacagggaagacacgaaatagcaaacatacctgatttatccaagggaaggcagaggagggaaacgaaaggatgaataacaggtgaggcaagcaggacataactcgtaggatggtcagcatgcccagtgcggcggcgaggacttcggaagtcagtggacccagtggagactcagatgaaaatcagagatggtctcactgtgggaacatggtgtgcaaccatagactaaggcggcacaccttaaacatagcctaagagatgcaccgtgcagggcaggcacccacatgaagcggctatgtaaacgtgacaaagtagatattaagaaaagtaggaaggaacagtaaaaataagatcagatatcagcaaagcagaaaatggtattacagagatgttaacaaaggcagaaattatgtccttggaaagagtcgtaaaaattttcaaaattcccagccaaacctgatgaagaaaaatgaaatgacaaataatataaatgaaaaggaaagatcactacagaatctacaaatattcaaagataatgaggatgttatttaaaactttatgttgacaaatttgacagtttagatacaatgagctaagtttttgtcagagcttaacaatttaatctaaagaaatcaaaaattgaaaattaaaaatcttccctcaaagaaaaatctaggcccatacagcttcactgttcagttttatcaaatagttaaggaagaagtaattccaatcttatattagccctttcaaggaatagcagaagagagaataattcctagcttgtttcataagaccaacacaaccatgacaccaagatgccaagatgtgtcaaggatgtttgagaaatggtaaccacagaccaatgtctctcatgaacccaaattttaaaatcctaataaaatattagaatgtcaattttacaatatagaaaaatatgtatatttccagtggggtttattccattcaaaaatcaatcggtgtaattctccacattcacagaggaaaagaaaagaactttatgatgataatgatcatagtaaccaaaaaaagcatttgacaaatttcaacatccattcacgatgaaaatgcactgcaaagtaagaatataaaggaaattctcttacatgacagcgtgtatacgagtgtgcacacgtgtgtgtgcgtgtgtgtgcatgcatgtatgtgtgtgtacacgtgtgcacctgtggttttctctccatgtttcttccagtactgatcagggttgcttgttttcaggagttttcaagtgctctaccttcaagttttccccagctaaatctttcccatttctttctctaaatccctttttgatatttgcagttcttttcaacttaccaccaatattttagtcttgattagaatcttcccagaaaagacaagttttccttctgattcccacatgtcccttcagctcgtgatggcgcagaatatgtttgcttgccagttaggggaacctgaggctgccttcctgggcagagtggcgatttgtactgggccaacggggcagccactgttacttatggacaggtggactaggctctttttcatcctgaggaactgctccgcgcttgggaagagccactggagtttatcagcctgcgtgtaagcatgtgggaagggggatcaggaacatttagtagaatagtccgtgctccaggtgatcagtccccacccacccgcatgcctctccttctccatcccacccgcattttgggtcattgggggattaatttattcgtgtctcgtaagcactggcagaacaccacccgtgtgaacagcattggtgaagcctggggagttctttttgagacttccttgagcttccggcagcacgtgtgagtttcgggggtgattggaatgtttctccctggagggaggcctgatgccctggagctggctccagcccgagccccgcggcatgttctgcctgctgccgcctacctgcagggagacgcctgagctgggaaggttctgagggttggcagggtgctctgctgtgctctttgggaggatccccttggctgttctgcatgcccagggccgtgctctccgtggaaatctatgttggagacgacaggctccggttccagctacaccagcctgacttccactggacagtgccattttctgcctctgataacaccgtggtgaagcgccttacgtaaagcaacagattttttgttttaagatgcactataattactcttttcagaaccaataatattaacccagtgaagtcaaaactgaattgttttataaactgactatggagctggtgtaaggagatgcagggaaggcttctcatctgagtcggtagcagagtacatagtgcaagaagcgtgggcaggctcccagcgcacccagagatcaaggagagtgatgggtgctgcccgcctctgaggggacggaggcagctgccacccgccgtgtccctcacgctggctttcagaaggcttcacgcaagtgggctcacaggcaagaagaaaagctgtgggccgtgtgtctcccttggctatggctcagttttaatgtaattagaagctcaacttgaaagtgagatatcaaaggaagccttcagttgctgaagatgggtgtgctgggggatgagggcgtgggttgaaaagtatccagttactgtttttctcacgtggatcagtctaacatatgtgactctggtaattgaagatggtgacaggctaaactaagctgggattccccagggagagactaggatttctggaaccagtctaacaaaaacagaaacttgaaggagaaaacagaatatgcctccctctcttccctgcttccctcctctactcaaaaaaaagaaagaaagaaaaaagcagcttttgcaatgaagaattcagtttttcgcccccgagtgtatgatggtagtgactttggtgttcctggtgcagacctgtatttttttgtgatgtcttcatctggcccctcgccctccactcttcatgatgaatatgagacctgtgcactgagggtcctcaccaacacttccttcctcacagccgtatgatttcatccggaagcggcctctaaaaataaacaccctcatgttagcctttttccaccatgcttcatatttggctcttgtataaatatctgccacgtttccactgggaattattgctgttatatattttatagacactcgactgtcatctaagtggcttattttattcccatagctagaagaaaaatacaaaaataattttgtaatgtgagtgtgattgtgggccaggagttatgttctgagaaggagctgagagtaaattatattcctgctttattgtgttgatattgtcttccctgttgtgtcctgagttagcctttgttgttccaagttattaaccagaggtggcttgataatgacgccactttggaagcgtctggctggtgtttaaaactctagctggtgataaatatattttagtcctattaatgaagaattgtaacattttagtcctattaatgaagaattttaacatccatgcagatgagcggcatcctaaaagcagcttcagatgctttggggtgttttctaccgaagatgcttttgtagaaataccgccttccttttcattttttacactggtctgttcatcaaaaaccataacttcatggaacttgcttctgtggaatgaactaaatgtaaattatttttccaaaagctttatgagtttatcatacatgttttggaaaaagtggaaaaacactaggaagaagttccagtgagcaaatgtttcccgacatgtttcacgttttgctctggtttgaagcagggcgttttgtggaaggtagggctggtggatcgctcggtcgctgggcagtgctggtcactgcctttctttggttgagctggtcttgagtcctggtacctgtgtctgccctggcattgaccccgtggtgctttctgtgcatctccgtgctcacctttctggaacacagcccctgaacagaatcatttggcaaaacatcccagtacaaaaaccagtgggttttacatggggaaagaactcaatgagtccacagttcgtgtcgatgaaggaggcactgcgtgttgggctcaaacgcatctgtaactgtgggtgccaagagacaagtagagctcagactgctgggagcgttggctggaataaagctggccctcacggggctgttaaaatacttgaacttgaattcaaagtcagatttaagctgacttcacccctcttcccttgcttctgaagattctggtttttcacgagacagaaaaaagggtggaaccaggagcttatccccttccttccttccttgcaagcagcagcaacagccattgaaactcaaagacagcaagagctctcttcccgcccactcccagcgccactcccgggggaacccatgtgggaagggctcttcctgacacctctcctgcagcacacagcacacgtcagccttgccctgcatgcagccttcccagctggagcaggtcccaccagcgccctgccaggcggcaatggtctacaccgccattttaccttccccaggtctgtggcattaggtcttcccttgtgagtggctcgtattcttttcaagatactgtaaataatttggcatcatatggaccacttgatgcttctatatgaaacatgccttataaacccttagtactgcatgatttcagattacggaaatatctgcatgagtattggctgcgatatctctgtactagaaatttcagtgctacctctacacaaacagacacactggggatgtgctgtgtgtattgtatgagtgtatcatagaatatttcattgtccgtggtagtacatttcacatcataggctgtctgtggctacttttaaaccttagacatttgaattttccctcaagctttattctggtgaagcgtgggatggggtcttagctcactttggaaggatggaacagttaagcagcgtacctggtgactggcactgtgtgtgagtgatgccacctcggcaccttcgcgttgatcatctttaggatctttaggatcactgagaattaatcattctttgcatgcataaacctgtgtaagggttgctccacgtttctgccattgctcacagataaaacacattcatgatctcagcttaatcccaagaggatgtttccccatccatcaaaaccacagtgcaggttttcactgatgggacatagggaaggtatggcaagctgggtggaggtgtgtttcctggacttttccggaataacccaacccatccctcctagtgagcacagaattacccagaaagttgaaaaggaaaacacagtttattggaacaaatatgcaaagtgatttgttcttttcacagagaaggtaaatagcatgtcagccgccaaggccctcacacacacggatctgcccgtggagtgatgaacttgtaaaagaacgtcaggtggaagcggtgagagggcctggacagttgttctgcagctgtgttctttgtctggttaatcgcgtgcgtctccagtctgtggctggccagccgcgtccacctgcgtgctccgggcacccaaggtgcttggttaatatgcagctctctcaacatctcccccttaggagcaacaggtacccggtgctggtgttgtccgtccagatgaaagggcctggccactctgattgcacttctctttgatctccctgtagaaggtcggcttgtctgcctagagattcctctgaagggcaatttaaaagttggatttgagcaacatcaagtgaaatgtcttcccatctcacgccgtgaggagctctttggtgtggctcatggctggatgtgaggaaagatattaacccttcctttgaaacaaactgtctcacaggctgaacttgccagctacctttctcctctgcttttagaaaagaaaatattttctttctcataatgctcttggcccttgaagataaactcattgcagtgtttaaaatttgtcctgagaccctattgcctttactttgttagtgtgtgtgagactgaaggcctgtggatgggtgagatgcttcgaactgatagaaaaagaaaacagaaggaagatttttgtgggcagagccgagacgccgtctctcaaggtgttgtgatcagtaaaagaatccatttttaatggtgaactggcaaaggctgctaaataccaattactgagtaaagtgccatgagaaggtaaagccactttttgtgaattatttcattgcactaacgtgctcctactgaaaaacatggccaggctgcttccgatacagttcacttaaagaaaaatggctcacgttaaaaatagttgctttattttgtaaatgttttagaaaagtgcattgctgtccagaaatctagatgtacacttgttttgtgtttaatgaaaaagggaaggaaaaatatctcgaaatcccaaatctcatcggtatcaataggatcataaaagtaaaggcaggaaaaggaatttgctgctcgtgtttcccatccatgtttccaggttatgtattttgtttctcaacttttatttatgttaatgaaaccagtctgctttttttttttgttatttttgatgactaagatcccatttattaggaatttgtaactcagctgtgacaacgtagcctgagatttacacagtccccgttaagggtagaaaatagagggagggcttagctctctgttttcatagctgtgttaaagagccaaatagtaatttgttgaccgaatgtattatctgtcctgccatatgttgttcaaatgatgagacagaagaatgaaggactcttacaatgtaaacttctggaaatcatactgtttcagggttgtttacattaataacaatgatggcttacatgtatgtatggttttataattttttgagattataaaaggtatacatggtcagtgttgaaaataaagtataaagaaattaaaaatttggacggtgtggtggctcacgccggtaatcccaacactttggtaggccaaggtgggcagatcgcttgagtgcaggagttcaggaccagcctgggcaacaaggcaaaaccccgtctccaccaaaaatacaaaaaattagctgggtgagatggtgtgcacctgtggtcccagctgctcaggaggctgaggtaggaaaatctcttgagcctgggagttggaggctgcaatgagctgagatcacagcactgtaccccagcctggatgacagagtgagaccctgtctcaatttaataaataaataaaataaaaaatgtatatttctattgcataattaactattatttatgttttatcagtccttctaatttctttttttcttaggagacaggggctccctatgttgcccaggttggtcttgaactcctgggctgtagcagtcctcccaccttggcctcctgaagtgctgggattgcaggcgtaagccaccgcgcccagctttctagtttgtttttatgcctacagcgtacaaatgttactaaagtttggattgcgtcacactgcatgtgttgtagtgggatatgcctttttatgcaccagcgtatgcattgtgccacatccttagacatgacttttattggatatgcagtagcctggcttacggatgtttcataatttatttaacaccctgtgattggttatttagcttactttcatttttaactgtaccaaattgtgctgtcatgccatcctggaagtggattgcatgtgggcgccttgtacttgatagagcactttcttaaactgtatctcagtcattagcacaagtgctccatgaggcagtgaggccactgagtagtgatccgggtcacaagggaagaactggggcccagcgagactgaagcgggtattttcacgtgagacttcgccagtacggggcaaaagcacacggtagaggattttgaaatcaccctgattgaagaccaagctggtttttgtcccaacaatagtgattccttcatttatcccacaaatatttaaatgctgcgtacgtgtcaggcactgtccttggttctggtgaatagagcagaccctgcctgctgctccgggggatgtcggcccgattctttggtaactctggaaggcttgtgcacctgctggagtttgggggagagagggagggttgtggacccagtcacataccacagtgggttcaaagtctcatctttattctgggagtgactgggtgtctttaaaagtcaagttcggaagattctcatttaatgatatttgattccatgtctcatgcagaggaatacttagatacgacggaatgagttaagtaaagggtaaagtattacttaaatatatcatctgaaaataactgcttcatatctcttgtatcttaaaatattttctggacaaaaattttatgtaaattaaaacaaaatgctgtttttcatcattgtattaggaaaaaatgtaaatacaaaatatttggtgttttgaaggatgggccggaaatggggatgtttttgtatgatgctgctgataacagtaagttgctatcagtcttgtgaccatatacatacagacataaaaatgttaaaacccttctcagtactcccactttgaaaaagtatactctagaaaaatatctaaattatagaaaaaacgttataccttgcagcttctcttatcatggtggaaaggaaaccaacctagacgtccaacactagtgagatcgtttagataatactgacacatgctctcaccaaaccgagtcagcatctaatgcctatgagactgcgtagtcagggataaatgcttccgttaagtgaaaaagcagagtgctaaagagcaggcacattagagttacaactgtgccatgtgagaaaaagcttgaagtgaatactctcaaatgatgataatggctgttttagggatgaagatcaaggaatttcctgttttttcttgtctgtatttcaaattttttatagtatagttatattactttttaaaactagcgacttcattttataaaatgacttttacttatttttaaaatttaagcaatacaggaaagcaaaagaaataacaattacctcccatctcacagcccccagataagtagtgctgatacttggtgagcctccttgtaaaagtcactctttgcttgcataaacatgtggttatatgcataaaagacagtaacataaacacagataaaacgacaaatattttcaaatgacaatagttttgtttaatacaaggttcttaaatattgtctgtaaagaaccagatagtaaatatattagtctctgtctcagttattctgccgttttgtgacagcaatcatagacaaaatgtaaatgaattaatgcagccgtgttccaataaagttttattgctcttcattctgtttagatccatttccacctggcatcattttcttcttcctgacagtttccttcaccctttctcattgcactggtctactgcaggtgacttcttacagttttttagtgcccaaaatgtctttattgcttcttgattgttgaaaggtattttcactgggtgtagaattctagattgacagggtttttttcctcccaatactttacagattttgctacactgccctcttgcatgcattgtttccattaagaattctgctgtcatcctcatctttttgtgcctctgtgtgacatgattttttcctctggtaggttgtaaggccccttatcaattttttgaacaattttattgtgatgcatcttggtgcagttcttcatgtgtcttttacttggtttcactgtccatcttgtatctgtgcatttgcagtttgcatcaaattggaaaatattttggctatttcttcaaatatatttttttccttttcctttcagaaactccaactacagatatgtacgatttcctgaagtttttcaaaacctcactgataatccttccttcctttcttccttccttttgatttcctttctctgtcctcattttgtgtagtttctataggaatatattcaagttcactaattttttcttttgcagtgtctaatctattattttcatttgatgtatttttccattgtaggtttttttagtttttaattctgaaagttctctttggatcttttttttactatattctataattctaattaactttttgaatgtctggaatacagttacattaactttttgcatcctcgtctgctaatcttaacatctgagttagttttaggtccatttcaattgactggtgtatttcttcgtaatggatcatattttcctgcttctttgtgtgcctggtaatctttgattgcatgtccagtattgtgaattttaccttgttgagttctggttatttctgcattctgatagatttccttgagctttgttctgggatacagtcacagttaaattacttgggaatagtttgactcttttgggtcttgcttttaagattcgttaggtagaaccagagcagtgtactgaggccagcccccttttcagctcgccccggatggtctgtgaataggaggcattccagtgtggctgtcaggaaaagtcatgctcccagccctgcaagagcagcggttaccaccctgtcatcctcacagatagctcttttcctgcctgggggagcttcctgacatggcggtgcccatcagtactctgatgaatatgtgagggtgacctgttgcagatctcaggattcctctttctgagatgtgtctctgtccctccagttctgtcctgcaaactctgcctgtcctggtttccgggctcacagctccatcccctcagtttgggagctggccaggcccttcctgtgtgcccctccgggtgcccggaactctcagggcagtcgcagccttttcttccttggttttctgtcactcatctgtctctgtactttgctctccagtttcttgaaaagtgtgttctatttaatttattttttctttttggttctttttggtgagagggtcaatcttgtctcttacttattttatcttgcctggaaacagaagtgctggggtgttttttaaaaaataattgtaagatacataatttaaagctgtgctattatagtatttacatgaagttttaaaaagaaatttgcttcccctaaactttctgatcatcgatagcactttttgaggcagggagccactagtggtcacctatgtctgttagcaatagacagacatgtctgttacttccaaaggactctcacagtgtaaactgaggaccctcttacaagctggtacgggaagaccaggcctgcatctgtcagagatgagaataagacagattctcctaatcaagctgcaaggagctcctgctgtaatcactccagaatatatatcaagagtggatgtgtgttctctatggcaaaaaacaggcactggaaaatttacatatttttagtttaaaatatgcatgctcttggccaatatgtttgaactgaaaaaagatagaatgtggttttctgagttatcttctttttcttttttctcaagttagttaagatttataaggtgcttactcagaaattcatggatgaagtacaacgttcaccttcacaacactttgctctggttacaaatttttgtggtgtagaaacccccaaagtgcctcgtattttctcacccgagtccagccggagatactgaccttggtctagatcgtcacctctgaaccattcctgaagaagtgggtagacaccccctcaggactgctgtaagagtggaacacattcacgtataaccagcacagaggttagtattcagtaagcactcaataaatgttggctctgaagagattcttctcatttgcatcattgaaaaggggtctttgcaatgatgcttatagcccagtttggggtgaatcatacctctaagcaactgtcattgaaagaaggccttaatgctgatagtcattgtttcagttttactttttatttctttgtcttggctctctggctaggcctttaatacagttttgaatagaagtcgtgataatgggcattcttgtcttgttactaaatttagaggaaaagctttcagcattccactgttgatttcctgtgaactctatagattgttttgtggatacccattttcccccagaatgaaagatctttttgaaattatattattctttctttaatgaggccattttcatatttgcatttatgagaaaatgtttaaaaaagtatgtgaacataaattatataatcttttgagtcaatcagaattatacaattgaaaaatagtctacaattaatgatattcaagtatctttagattttaaactcattaaatgaacattgaaagttctgttttctaattatagagccgagtttaaattgacaagagcagccacactcgagttgtctaagtcagaggctttataaacctgttggattttccaagggttgcttctcttgaataaaggtgtttttgtttctcacatattttacattttcaatgacctgtttaggcagaagcaccttttgtcactaattagtgtggtgtgacaagtaacataatgcgtatctgaaaagctccactgggtgtaagtggagttcacacctcttaatgagtgccttcaagagtgtttttgtcattcccagggagaactagtgccccttgaatagaaaactgctgtaaatggaaaaaggatgtgtcttaggagcctggtgtaagtgcagatgggcccaccctgtcctctgactttagggccttcctcaaagccaaggccctcttgtgcgatggggctcttctccttcttagaattcctacatccagagtaatggagacgacttgggatcatgcttcaggatatatgtaggtgctcaacacaggctggtttctgtttttaatttctggcagaatgaaccacttgaaaatgaattttcattacgattttaggagggctgagagtagatgaggtaagagatctgcctagggggcaggatcgaaggaggctgtcactctcagatttgtgcaagtgacttgtgttccccaaattcacatgttggagccctagccctcagtacgtcggagcgtgactgtatttggagatggggcctttaagcaggtacttaaagttaaattggggttgttagaataggccctaattcagcctgactagtgtccttataagaagaggagattagggcacagatataccataggcttctgtgcacagagatgaccatgtgaagtggcagcaaggggtggccgtccgcaagccaagaagagaggcgtcagagaaaatcaactctgccaacaccttgaacctagacttgcagcatccagagctgtgagaaaataaatgtctgttctttaaaccacccggtctatggtattttgttatggcagcctgagcaaattcattcagcaagtgccagccttgcactcgcgggagagtgagtgcctcctgcagtgctcagtctggtctcaggctgaaattctaggtagatgcacattttcccagttggcaggtgctggctcatgctgaaggggaacatatgctcaggattcctgctttatgtacttcaaaaggagacatgtgacatgtttcacttaacttcatctaaatttcctagacacaccaatctgtaacggtttagaactcaacccggtggttatacagctttcctgaagtggagaggtgggctacttatcttgtatgagtcccatgagaactaaagaacaatggttcaaaaaacagatggatgtctcccatcttacattccctccaggaagaagtagttgaagaaataatggatataaatttccttgaattaagaacacatgaaagacttaagaataagaagtccaagagaggaccaaagaggcaaaaaaaaaaaaaaaagaaaaaaaaaagaaaaataactgacgtctatctagaagagcacagtgaaatttaagaatagagagaaaaatctaaaacattagcaagaacaaacaacacatataaagaaccagtggtcatattggcttcagatttgtcaacagcaatattgaatgtaagaagagaatggaggcatgttttcagcgtattaaaggaaaataacttagaacagagttttatatgcagctaaaactttaaaatatgagggcttggcaaaactattctcacaaggcctcaaaagttacaccttaacaattataataaatgtaaatgaactaaactcaccagtaagaaaaagactgaaaaatggaataaaatataaaatccaaatatacgccactcaaaggttatccaaagtataaggactttcaaactttgagggtaaatggatggaaagaagcatgtcaggaaaatacccaaagaaaactggcatagctataatgatatgtaaaatagattctaagactaacagccttgttagagatagaaaaggtgaatacacaataacaaaacaagtaaaatagattaacagagtaaaacataaatgacaaaaataatttgtattcttgaaaatatatagccatggaagtatacattttaagttagaaaatgaacagaataaaccttttaaaaagcagaagaaaagatcattggaaattagtggaaaaaatacaaagatcttaaaaaaccatgaattgtttgtttaagagaaaaaaatagattaaaggtaagatatctgaaatggctatattagcattagatgatgtatattctacaaaaaaagttactagggttaaagagagatgttacatagcgataaagtattcagttcaccaaaaagacctaacagtcttaaatggctatgtacctgacaacagaattccaaaatacatgaagcaaaaacggaaaggagaaatagataagtccacaattataaatggagatttcaccatttcttactgatcaacagatcctaaaatcagtaaggatatagacaatttgaacagcattatctactaacttgatgtaattaacatttctggaatacacttaacaaaggccaagatgtggaaaatccagaatatttgaaagttcttagtaacccatcattcaaagaagtcacagggaaacttagaaaatgttttgaattaaatgaacatgaaagcacaacctatcaaaagctgtgggttgcggctaaaagtgtgctttgagggaaatttataacattaagtttttataatagcaaaaggtctcaaaacaatgatctaagctgctgctttaagaaaacagaaaagtaagagcaagtcaaacccaagacaaacagaaggaaggagataataaagataaaaacaaagatgaataaacatggaaaacagaaaaacagtggaaaatatcaatgagtcaaagaactggttctttggaaaaatattaattaaactgataaatcggtggctagactgaccaaaaaaaaaaaaaaagagagtgaagtcatatattaacaatgttatgatgagaggggccattgctacaaaacatactgacactgaaaaaaaaagtgcatagcaggacagtttcgctacccatatgtttgactgcttagataaatgaataactttttttttttttttttggagacagagtctagctctttctcccagcctggagttcagaggcacgatcttggctcactgcatccttctcctcccgggttcaagtgattcttctgcctcagcctcctgagtagctgggactacaggtgagcaccaccatgcccacctaatttttgtatttttagtagagacaggattttaccatattggccaggctggtctcaaactcctggcctcatcatccacccacctcggcctcccaaaatgctgagattataggcgtgagccactgtgcccagcctgaataacttttttgaaaggcacagactaccaagctcattcaagaagaaatagtcttaaatctatcataataattgaatttataatttaagcctttccataatgaaaatttcagacgtagttgtcttcattggggaattctacaaaacatttatggaagaaataatgtctgttctagaaaattcttccagaaaatacacgaggaaatactttccaactctttttatgatggcagcattaccttgataccacaaccaaataaagggattagaagaaaaatacagaccaatattcctaatgtacataaaatgcaaaagtcctcaggaatattaccaacttgaaaccaggaaatatataaaggatgatggaacatgaccaacttgagtttatcttatgaatgtaagactgttcagtatttcacaattaatcagtttaccatatcaataggaaaaatgaagataaacctgtgttaatctcgaagaaatttcctgatttgataaaaaggaatctatcaaatacttattgctgacataattcctaatgataaaagattgaatgttttcctcctaaaatcagaaataagacaaagatgtctgtccactcttcctacagctattcagtggaaggtcctagccagtccagtacatcaagggaaaaaatgattttggaaaagtaagaaataaaactttatttatagaaggcatgattgtctatacagaaaattcccaaaaacctacaaaactacgcaacatacaaaaaccaattgcctttctatatactagcaatgaatattggatactaaaattttaaatatagttccatttataatagatgaaaatgtgcagtagttcatgtccaatgatatttgcaggatatatatactgaaaactacaaaaccttaaataaaataacatttaaagaaatggagagatatactgtgttcttagattggaagactcaatattctccccaaactgatggatttaacatgattccagtcaaaatcacagcaggtcttttcctagaaactgataagccattctgaaatctatgtggaaatttacagttgtacaagttttccaaaattatttttgacaacccatcactagagaatgttaaagtaactgatcatataattccttcaagaatggtcattaaattctggatttcacagtttcttttagttcgtatttcacaagatagaagctttacatttttcagattaaggtagttttcacctttgtgcatgctacatcttggggaaaatactgagacaaaatgactcattggaattatttttgattttttgatactcggctgacaattatagtctgtgttatgacagttatagcctgtgtcatacgtactcagaattaactaacatagtcttcctcctaacttccctgcatattggaacattagaattcttttggttggttgaagaaacatcctagaattttaaaatattttgtatctaatgtaatgctgaaaacatgaaatccacataatgtatgcggcatagctaatattagaagcatgttcaaggagcagcctctggggttaatagagtttaatttgcaagacaaatgaaagcttattttctcctaggctctctgctcataattctagtagggccacttttgaagaatagtaccttcaacagacacagagaacccttgttggacagcaacagaacttgctcacagtgagacccgacatcccctccgctcagtgggcatttcctacagtgcagagttgtgcgttgaaaagtgcctcttcactccctacatgaggttcctcacacaaccccgcacctgggcgggcgggcgggcgtagggggcataaatggcttatccctatgaacttcatcattatgaaatgtaaaaatggacagtcccattgccccagaaacagtgggggagcttctaagtaaatccaggtttatctgcatttgggaatattctgcattttttgaaaatgatgttcccaggaatctttataaccaaggagaatccttactgtaaacattccacctgaatttttccaaaaaaaaaatagatcattaagaacaatagacaaaggaatatgcttttaaaaatagtgattatctctgaaggtgggattgtggctaatttttaactaccctggtgtgaccttatgtgaccctgtgtgagtcaacatgtctggcctcaggggtgtgtgtggagggggcaccctttgccattgcattacacaagtctttgaactgactgtccttcttactaaatgctattagcatctcttagtcactgtggcagccaaaaatgcttccacgttttctaagcattccacaggtgtatgttcctggcctgattcaggatagaccagtaactcctgaaagtaatcaaaggggccgggtattgtggctcacgtctgtagtcacagctacttgggaggctgaggcgggaagaccacctgagccccgaagttcaagactgcagtgagccgcgatcccaccaaggcattccagcctgggctgcagaataagaacctgtctcttaagaaaaaaaaaagaaaaaaaggtaataaaagagcaccaggaagcataggtgatgcacctcccatgtagagaaggctgggcgagcgaatgtgtagtggtttctgcggctccattgttagtgatgacttacggatggaaaagggagttttgtagctgagtgaaaactgttagaaaaccaaatgccgctgtcatgtttttgtctcgtgcgcttccccttcaccttcatccttgggcccatgctgtggccaactgaggagtaccctgaggttaagcgtcccccatggcaggtgaggctgtggggtgggaggagggctgggagatagcagattagagatctacaagagaatagaaagtttgattcaaggagaaaaactggagtaagcagtttggagaagtcagatgtttaaaacatgaaaagaaatgtaactttgagttgcagtggttttgagtttcctgatcttgatgtgccagtaactccctgggggctgacaaatccagggggaaggttcaaaggcagagagcctgtttgagctgggccagggcacagaggcttgctcagaagacgtggacggcagcagagcctgggcttgagagtcgagctccaccttcttcaggctctttccagcggggcgggacaaggacccacacatgctaagcgagcagggaccctcaagcctgtgactgttcgtgccagtgaaaagggcaccagtgcactgatttcttccgttcacccagaaacaacgatttcttcaatgttcacagtagtctgttaaccacctcttcgtggtgcatctttgagcctgtgtttacagcagtcctctctttggtcttaacaacccaacgtgaattttgtggcatgctacaaattgaggcatcaaagctatgctttttacattgacttttgagaaattcgacagagttctgaaacccaaatcttgacctttcatggatatgatggtaacctggcttgaggttttttttcatctctttcccaaactacctgttctttccatcggcattttaagtagcttgagcacttggtttcactcttcaatactttgatgatgcgaatatctgcagatgcctactgtatgcccagcccagcctctctacagagagaccttcccagccagccccggtctaacccatcatgctgttgagtgttcttcctagcagacatcattatattactcatgcattcattttagggggttatggtctattccattgctcccctctcccagagcagtgctttaggggagccaggtctgtcttactcccggtacacccagcacctgtaactctctagcaaatcctagatgcttggtgagtgagtgagtacattgaagtacattgagtacagtgaggccacacaatttaaaaagtgacaatggcagtacactgcggcatgtgctggaaaatgaagtccagggtgctgggtggcctcatggcagggaggctcccctaggctggcgtcggggccaggcagcctgaggatgtgaaattcaagaggacacagcaagaggctggaaggaaactagttggggacaggggtgagaggactcgattgaaggggtcccactgcaaagggccccatgagcccatccagagtgcttgggttccccccctgaggcctggtgagagcccgtggaagggccgagcctggggagctcacaccgaggcctcaattcctgcttccctttcagacacgcattcatccttaactctttatcagaagggaaataaaacctcccagatagcttggttgtgaggattaaattaggaaaaaaaataaagctatagctgttattggccttgcccggtgctcctggaccgtggttagtggatggagcctttcctcatcctccagcttcttgcctgtgtttgtagggctcacgacagcttgtaattatttcatttgtgtgggtcttactttttgcacatctcttcactgcgtggcaggtcctgtggaggcagagcttgggtctgttttgtccactttgttcccagtccaggcagaaggatgggcagggagtggacgtccagataatgaacctgaagtgagtgaatgaatgcactaagctcaagtcagggttttctttacatagaaattctcccacgctcctttttgcttttagtcttgaggatcaacagtgttcatgtactaaatcaagcctgaaagccctttttttttttttttttttgagatggagtcttgctctgtcacccatgctggagtgcagtagcatgatcttggctcactgcaacctccgcctcctgggttcaagcgattctgctgcctcagcctcctgagcagctgggtttataggcgcccaccaccatgcctagctgatttttgtatttttttggtagagatgaggttttaccatgttaatcaggctggtctcgaactcctgacctcaggtgatccacccacctcagcctcccaaagtgctgggattacaggcatgaaccactgtacctggccaaaagcccacgtttggcagggtggctggcagccttggggcctcatccacggtgaggttgtgtttggcctctctttgcaggttgatggctggaagggggaagggttctgtggtcaggcctgtgcttcatggagatgtctgaccgttgggactgtacctttcatcctttggatgagatgctctgccttgaggcagaagcatggaaagccggtggatttgtgcgtgtcggtggttttccactgggtctccaatccggactcagcattgtgggaccaccagtggctccccctgccacttcttgtggacacgttctttctccttagagcatctgttccaggccagcggcggtgttactttccagcctggggatgactttatggcgtgatgtctaatctccagtgggcaagtggtgaaggtactctagcatccatccagtggccagtcggccgagggcctgtctgctcatggggaagtgtcctctgatggcagcccagtgtcttgctaaccagcagaccactgcagaaggcaacgctggcctcctagaggtgtggcttgtttgcatctctatgtttgtgaccaagtcgtttccttccttggtctcagaatctgcttggcacttactaatagcatttgttcaacatgcatgatcccggtatgtgaagtacagatatgacatttataagccagacactgcgtttgactaatgttggcaaagtcacactaagagcctcccagtgttcagatggcggaagggaaggcagataggagtccagtccccaggactctgaggccccaccttgtgccttggtagaagtgaagacagatcgcctggggaagttggaagaagtagccgagacatttctcctggctcagagcagagggggatttacgttggcctatgaaggaagagtaagtatgtagaaccttcacttgtagagagctgagactttactgtcacccttgttttagggagcctacatggcacctaagactcaaatttacatttttaactaactgaagccaaataaaagaccttttatcccaactgggtacactctaaagtctcgacatgattatgcctgtgatcctgcacaaatcgtctcaaagatcttggaaaattggttagtgtcggggcacggtggcagttagtactggggcattggaagcaccagagcttaccttagctagacgtttccatcccgtggcagcttaacacgtggcatcctcactggtcttacagcattatggggaatgcaaaataaggacttgtctccttccagaagcctgctgcccatcagaaatatatatatatatatatatatatatatatatatattttcagggaatggtagagaacagtggagaagtagatgcttgtcaggcgtcttgtctgctgggccaaggtgaatcaggaggtgagagcggcggctttcctcttgtttgggcagcgggtgaaggacaggcgtggcaggctgtatggtgagtgtgggcatggccgcccctccgtcctctttcccctctggcccgtctcgcatctgaacacctgggagtctgtgattagacctgagaagaggaaatgaggggcagttcccttccattttcctcccagccgctcagtccaggtgtgtgtcagtttgcacgcctccctctggaagtccgtgtctctgcgaggctcctcagccccggtagcccccacgccaagtcccatttactcagggtttctgctggtgacggctctaataggcacttcacctgctctgcggaggcgcctgcggaatggtggtcgctctcattagctctgctcacccgcccagcgttacaggcagctggggagggattcaggggctgctgtgttcagcagtaatcagagcccttctgtgcacattcgacgctcaagtgtgtagtttaccacgggagatcaagaaatacgttaaatgcataaaattaaaggcagcggcctgcaggatccccaggtggcgtgtgctgggaattggatgcacttggctgtgtgtgtcacttaggaaatgcgctagggggtcagcagctttcccatcgaagcgttggttagtttgtgaaaagtaaaattccaaatatttgaaataataaggggccagatacgtttggagcttgagaagaactatttcaccagccaagagatcctaaacattttttggcttaatagaaaataatagcctattttgaacaataatctttgtaaatccaagaagaaaaaacagttcatctccctttatagggtctgatttgtgtctgttcaatttaaatagcggcaacagaaatacaagtgtctttgggtgattttgttctgctcttaccaacagatgacaatcacgtcttatggtttttgatttgacagaacggttcatttcatcagctttctagcagcccatttgattcaatttccctctgcagtgttttactgaaaatgacaaaaatgttcttttacataaagcctgcgagtctgtgaaggaacataaatgtgctgtgctgtttacatactaacttaattgtaatttaaatgcccttttcattccataaatatagccataggcttttcatttccttcaagccttcagctcacagagcagtttatatgtaaactggagtcagttgcttcataaagtgaatttctggaggaaataatatagtatatatcaaaatctagataggtaatgggaaattgattgtgacaatacaatattagaaacacatctccataatattttatttattacactttccaccttttgctgtcaagggaaaatatttcatcttgcaccgcgaactccagtctgtagagattttgacctcaatattctcacacaaatgaatatagtgtgtaaggtagcacaattttccctgtgtaaaatcatgcataaaaaacaattcatttaaagcatctaaatgtttccaaattactgcaggtaatttttacagcttaattcctccgagacaccattttaaatgaacccataattcaattttcagactttgcatttcaaatttttatgttgaaagtaatttcctttcttgcttaagttgtgctcagaaccagattcataaaatgtgtatgatgtatgtctgtagaatcagtgactgttagaagcttaataacaaatatgcaaggaagaaattaaatgatttttctcttcagtagttcagtttaacattgatttctaaaagaaatgattctgactttgccgctaagtttctttctttcactttttttcttttcttttttcttcttgcagtgttccaggggataaaactgtccttgtatctgtattttgaatgatttggaatcttttatctttgcatattcctttagaccagaaaagaagttgaataatgttcagactggctcccatgttaaggtagcacttagagattctctgaatatcatccctgaagctatggcttcctaaagacttttgacctcttaaattagtgaagagtggacaccaccgcttaagccctgctaagaccagttaaaagcatctgtggtctgggcggagggagctttgagtacaatggaaaatggcaccaccgtgttcatgcttgcgagctttccatcctgatggctctcctctgccttttcctgtggctgtgggatttttcaaaacccttttccatgtctgcccttcaatagaacactccaagtatccagttttattaatgtccagaagcgtaaatcacagccccctgttttgtcattccagtcattttagtcactaaaggattacttcaagtgactgaactcggctgttatctgtttgagtttttgcagccaggtcatctcaggggactgggaacaagctttctgcccccttaactatgtcgagtggatggctttagctggaccactttttgtgattgatgtacattctgtgtcgctgtatcttcccgcgacgtggtaatgcaaacttagaaaaaaaaataagatggaaatggtgctgcaagtttttaaaatcaagggttgggcagtgcagggggagctattgtttaaaaaataaaagttgggaggaagatataatggattttgtcagtggtattagggcgatgaggcattcttgagttcagcaaatattggcagataattctgctttatggaaactattaaatgtaattggtcacatcagagacacaattggcatctgtactttgaagctgaatctcctcaggttgagagagagaaagagagattaagacggactcttcagagaccatggactacagggcccaaagttataaatctggaagatgtaaataaaggaatattttaggctaacgttgctccaagaagcagtatttgcctgtaagaaatgtaataatagaggtgccaatacaagatagcaaaagttacccaggaaagatgttaagtgacatgctgtcttcatttttaaacaggacaaattatttaattgggaattttgccgacactgttgaagcaattatcatatttaaactgtttatcttctccacattctgcctgtattttttttcttctttgcattaatctttttcctctttagcatctagagagggtccctttctcgtggagatcggcattgtagaccttaaaaggtctcacttgagaaatatttttgatattattgaataattattaattcatgcaagaaacaaaaggaagggcactcaccggctcgtggccagagcagactctcattctttacttctgagtgtttgggggcttctagcgaataatccctggatgacgggtcctagtggttttgagaccaccagtgggtagcctcgccctgggaggggcttgagcagccttgaggtgcttttgtgctttgcacgttcgtaattgtgaacctcaacgcaaagcaggtgttgttgtaaatctggtgtctctgtggaagcaatgccagtcctctaattcatcttcgccaagctagaggacgcgagcacatgtgcaggtctgtgacctaaagcccttgctggccagggtgctattcttacctttgggcttccagaaagagccagctcctggtggagtgaaggtcctacctccagatgcctccgaaggtgccggtacgtgattggaataggaatgcgcatgaacggagaaaaccctcaccattgcgtccttttgttctttttgcgaggaagagatccatgggttggctcttactgaacatgaaatgttggaagtggaacactgcagtgttaccagtgagctgtgtaatcgccacctctgacagggatcctgctcgaggagcacgtctttccttggtgtggccgtctccaagtactttgggtggtggtaaatttacccttctcggtcacacactgtgaagatgtgagtttcccaatttcagcatttggagccatgtccttggtgagggcaggaggaatttgtcaccctttctcgatgtgcctgggactagggcagagacggttagtctcaggagagccaggtgtgccagctgcccctgcctgccatggctcccgcattgtggccaggactttttctggcagtggtactgcccgagggccgcagtcctggtcacattccacttggggacagagtgtgcaaggggctgatctgaagatccggctggaacctgggagccacaggatcctggggaccctctttggctgtaccccgtacctctgtatttgctcccacatgctgtctgatttctctggatggcctggatgcctctgttcccagcatctcctcggcatgctccctgcagcccttggcctgtgtccagtgggccccgacccggaggctcctgccccgtagctcaggtcccgtcttggcctcagccttcccttaggtgctcgtttctccagtacctgcagcaccggcgcttttagattgcattctttatgcattaattagtaatgtggtggtcccaggtgactaataagctaaagaaagaactagtgtgagtgaatttctttaaaggtcatttggctctaggaaaaccttttttttaagaaaaaaaaaagcattttatagaaatgttcaatggcaaagtgaaatgtaaagtattacatgttttttactatagcgaacaaattgcccctttttattccgtttatgtcttcatctgctacatttagccagatatatttgtctacctaattttctgcaaactggaagacataatcccccaatgtgaaaacaccaagagttacatgatgataattataactcatgaggggaaaagtgtcgcctatagaatccataccggtcgtttgcctgagagaacgtgctcatcctggccctgttggattgtctccacagatgtttttcatttcgtatttggtttgattaaagacaaaattcacccatcaaaaggaagaacggccctgcagagtgtgagttcttcattcgagagcatgtgctagttaaaaagaaagaaaaaagatatcttaatccaatttctgagctgcactgatcccaaattgaactgaatttccattaataactcaacctaaaaatcctttaggtgttctctgggggctggaaacagaggccggtggcgtggtgtgatgttcagcgttggccaggatcacttgcttcacccaggtgttgggcctgcacactgagtgcccgagaggaaaggttccgggaaagctgctgtcggaagccggggtttgtgggatcgtgtgtaggagtagatgtggaggggcttgtgtgaatgggggagttatgaaaccaggactgaagacaacagaaaggccccctgggagacaggtccctggcttgccctgtgcttccccgccactcggggggccggccatgcggagaacactctcctctcccagccaggcttcagaactggggggctcggcctccttcctctggccccagcagcccccgagcggagacgctggagttccagtagagtggagggaaaagtgtctttgacagcgaggtgagctgcctgcctgcacggtgggtcccctgggtgactcaggcccccttcctggaaggcaaagggaggggcacgtttctgaccctcctgagggaacggaggagactggagagggaacattctagtatgtgcgtgcgcccatgcgaaggctttcaaaggcctgagagcagacttcagagctgatcacaaagttgaaggtgggaggaggggagcaagaaagcatcggcactcagagtccccaggcatgggcacctgacacggtgctgtcccccgcagtggctgctgctgttggtgtgcctactgtgtgggggcttctgtgggagaggaccctgtcctccgcacgtcagctgccggagagtcagctggtgccagatggccggccggcctgcctgcctctgggaggcctcagtgcctgttggattccctgccatgcagggcgcacccacggggtgacgtgtgggaccctcccaagcgtgcccgtgcacccatgcagctgtggccgcagtctccactgttttgaatatttgttgtgttcctcctggtaggatgcatgatgttttgggactgtgctggcagctctgtcttccagttccttcccaagcagtgtgggctgagggtgccagcagaatgcccgccccaggacacgatccagtggctctcgggatccctccagggttggctgagaatatatcagtggcactgatcttgtcccagaatgcttggtcgtccggtcggctgtgacaaaagagaaacatggtccgggttatacacagcctttccttgtctttatttctagacaccctttatttcaagactctactccactggacttcatgtccggttattaataagcagttctcgttctgtcatcgagcctgctctggagttaactgtcaaataatctgaactaaaaagttaaatcatataggctttgaaaattagcatccctaagtctctgtccttttgtatttgaaaacattgatcattttccaccccctcaggatggccagtatcctctggatttattgctaacagtaactgctcagtttcacacccatcctgaaaccatttgaggtgatcctgtaattgccatgtgtgtgtattactaatcaaggctgctccctctacaaaacactgagtggcccccaggccgaggtgctgcagagatggcccgtgtgggaggggtaacgcctgcaaacccgaccctgatcaccaatggagtggcctcacgtggcctccctgatggtggcccttgactgtggtcagcactggactggcccaccctatgagatgtctcaggcagcttgcaagattacatcatgtgatggccaatgcttctgctaaacaagaggcagggagccgaatggacaggcctcaggaagcacagcgtggtggccgtcacagccttctgggaaggctatttctgcatcactgaggccccacagcccagggtgtttaggatgaagggcacagatttccagatgtgaagagtgtcaggtgggctaggggcaggagaagcatgaggaggaccctgtgctggggatgagaggagagcggccctgcagtcaaggggccaggtggagccacctttggggatgcggggagaacttggtggccctcagagacccctgcttggagaccccacctcccccttgacaagactgcggcctgtgctgggcacagctggcccagagcgagggccacaccctactactgcaccctccacgcctgtctgtccttgcccacctcggtggctgcctcgccgacccccgccttgcagctggagtagctgtgctgataaagatgcaggtgggaagctggatggtgaggtagcccatctgtggtttgggatccgagaagacggcaagacctcagcttcatgagaagagagacctgaagatccatgctggggaagggcgaggatggaaaggggtgcagggcgtggagcaggtgcccaggtcgggtacagagacaggcctgggacctggaggacctgcacgcggggtcgggcacctgccacactctcccatgtctttgaagcctcttgtggtagaagagaaggtgctcatattttaccttctgtgccttagtatgtagtttggtattgtgttaagtggacagaaatcacatacccctgctcactctgagcctgcatcctttgaccgtcactgtgaacctcagatcgagacaccagcctcagcgggggctgagatagggcattccccattcccactggctgcttggagggctgtgagggacctgctgcctggagcacagggcctgtatgggtgggtaagtccctggagagacaggaggaggcaggggtgtgcaagcctcttgaggtatgaggaaggtggccggggtctcgggaagcttgtctggccctggcaggcaggacaagggccccctcctgcccatacctctaccttaggccccttgtcatgacacgtgatacctgagggtggggggctgtatgggcatttggaatgtgacggcacaagccacagtgggtcacttgtttctacaaatgcctgagaagaaaactattcttctaactcagagaagtgggatttcccactgaaaatcagtggaaatcacttataatggtctttgcaaattccttgcatctaaggaagtgcctgtggagcagcagtgggaggaaaccattcaggctcgatggagagggtgaccgctgcaccctcatccctggtgtcagcacactaccgaggtgctcctggtttaaggacgtttgtgcacccacccggaggtatgcatggaaagaaagcactgcagccattccccagccagtgtaggggtgggacacagtcccgtgggggccccgcggagggcctgggcagatgcagggctgcgcactgccgtggtttcctgtgtgtctgccaggagtgaagacctgagcagcctcactggcctggtgtggaggggccgcctccgagcatgcggagaagtggtttgcatggctggaagtcaatgtttatctgtctttagactcagttgaagacacatttctttcacacattaccatttttaaaacccattaaggtctgattttccaaggcgctgaccctgacgcttctagagggcctcatcccggaagctggtggggagagcaggaaaatcttccccgttgagttttaaacgtccagacctttgttgtctccttgtgacccttgcaggagagctctcgtggcttctgtgcatgttcgtgtgtgactcgcccggctgagggactggcataaacaaacagggatgagtttgtaaaacactttgtaatcccttgaaaaggagaaaaatataaatgaaaatcactgtttaacagtgaaggcaggaagggagctgttcctcagtatagctgtgggttgtcgttacgtgagcaggagggaatttcactttggatggatttggattttctcttcatgctcatgctctctaaatcttgcaaaagcacatggtaaacacacagcgcatgtgtttctggaggaaacgcacagtgtccatatagagcaggcactgattttgcactgaaagaacgtggatgagaagttccacgtgtttaaataaactggcaacagcggtcccagatagcttagccgggcagcagtcagaggtgccctggcctggggactgagctaaggtctcagaagggtcagctagccaagctcttcaccggacaacccctgaattaaccagacacatcacagatgcagactgttgattccagggaacccaggtgaaaggccaaggagaggtgaggtagttggtgcggtgcccctcctggagtcccttcaggactatggcactacagttctatgtaagctgtcacccaggactcatcttcagtggagtctggactgcagtcgggaggtgacaaacatccatggcatgagggcagcaagagcccctctcttgggaaccagttgtggccactatctgcccagtgaacatgggcttcagccccgagcatgggagggctcctggttgggcatctccctgggagttccttggtactgcctcctgcagggtgaggaggggtggggcctacttccaggcctctggaagcagcatcggcatgtcctttctggtgtgaactccaaatatctgagatggtctcagttaatttagaaagtttattttgccaagattaaggacatgcgcctgtgacccagcctcaggaggtcctgatgacacgtgccccaggtggtcggggcaccgcttggttttatagattttagagagacatgatacatcaattaatatatgtaagaagtacattggttctgtccagaaaggcagggacaactcgaagcagggaaggggcttccaggtcacaggtaggtgagagtcaagtggttgcaccgagtttctgataagcctctccaaaggaggcaatcagagatgtctttctctctgtgagcagagggatgactgaatacaacgggaggcaggttggccctgagcagtttccagcttgactttcccctttagattagtaatttgggggccccaaggttctcctttcatgctgggaggagggtttttccacacgtctcagacccaactctcgggcttcttaacccaaaagaacttccacgcagaaggcagcgaaaatagtgcacttcattttctaagacatctaaagctgccacaatgactgtgagttaggtgagctctatgaattaggctagggatttgcaaccacttagcaagttctaagtaactgtaaaagatcccatagactgcaaattgtgtttcatttggggacagataccctgtcttggggatttaagtgtgtttacctgcccagagttgacacagacgactgtcccttagcttcctttcctcatgctggttttaagtgcttcgaatcgggattttcctacccatctgatgcattccattgaaaattcaggaatacacatgtatgtgactgtttattggcaagtaattgtgaaataggccagaaatctaccagcttcctttaattaatgtaacaaatacttagcaaggacctcctgcattctagggattgtgggggtgggggggggagcaacaaacaaaacagataaaccctgccctgaggcgccccttgtcttgtctgggggtggaggtggggcaggcgtgagacagaagaaacaggtaaaatacagttcaaagtcaggtgctggtcagtgtcttggagaattctaaagcagggaggagggatggggtgagttttaaatgtggtgactgctgaagaaatggcctctgacagcctggaggaggagctggagctgggggggggacaggctggccagctcctccaacacacacacacacacacacacacacacacacgcacacacacacacacacacaccccctctcccccaaggacccacaaggactgcggcctcttagcgtgtgtggagtcatcacactgacccttagcagtgtggcctgacttcatgaggcccccgttgtcatggagatgctgggaatgggaggatttgccaccctccagtgaggagcccccatcccatgagtgcaaagcctgaaccggcccttccctaattggcacctctatcctattttctttggctgaggaaattctcgtaaatgtatatttaatgtggtgttgagattggtagttctcccccatcccccaaagatcatcaaatctctgggggtctttcaaaacctaaaggtgatctccctggtcctattatgctgttttgtttttgcttcttttctttttcttgaaagacctaattgtggagttttttcccccttctatgaatcccaagtaaggaactaaaatggaagacgggcttctggctcccgctgcagcagatgggataattctacaggtgattgccctggaggtctgcaagggagggagagcggcaccattagactaacacagctctattattgactaatgacgaacagcgtcgccttgccttgccaccttaaaacagacacagggatttgctactctatttgttttataaaatatgcattgagagcaacaccaaaatgctgaatgacaggtgaccctcagagcacgcctggtatgcactgcgttagcttgccagtatttcttagagacttatttgattctaattcagtaggatttttaaccccaacattttgaaatcttgctttgaaagtccatgttattcccattaacgtcagtgagtttttcacatatctaaatatctaatatcatgctttgagaattgaagcccagcctgctctttaaaagcaagggagctcaccacatcctggagttctgcagtgatttgacatgtcctggaagaaattatcttcgcaagaaagtaagtttagttgattgaaatgaaattaacaccacatttctgtgtcataatgtattaacctgattggctagctggattccagcctgtttacaaacatcctgaagcctagatggccccttcctcagtgtccttaactgctgttctcgcccttagctcgcgtgcccaaccctaaggctgaaaacgccccctgtaggctactgtaagctgtagcattcaaggcctcccaggtgtcgctgtaatttcttgtatacattttagctccatctgtggcataggtaccattcaatgttatcttaatacactagctttggattttgtggctgcaacaataacaaaaaaaaatccttggttctgatgacttcatgttgtttcagaagatactcaaggccgggtgcagtggctcacacctgtaatcccaacactttgggaggccgaggcaggtggattacctaaggtcaggagttcgagaccagcctggccaacacagtgaaaccccatctctactaaaaatacaaaacttacctgggcatggtggtgcacacccgtagtctcagctactcgggaggctgaggcaggagaattgcttgaacctgggaggcggaggttgcagtgagccaagatcgcaccactgcgctccagcctgggtggcagagcgagactccctgtgtggaaaaaaaaaaaaaagatactcagatgtagctgtctctgcctgggttgttttctaaatgcgtttggctggagatagaacagatcctgcctctatccacggcgtaagggagttagcttcatggcaagctctctggagaacacaggccattgtacctgctcatgagaacagaagtgaaagtcacacagcatgcatattagttccgaggctactggcattattatttaatgatgagttagtgcaaattgaggggtgaggaagtagcatgtacaaaggccctgaagatgaatgactgtgtgaaattttgaagagcagtttagcccgaaaatattccatgagtagctgccaggagagcttttctggaacagtattaaactttagaaaaagtgttctgacatttatagactgacacgaaaacagaagtaaaagtctaaattgaaccaaagtcctccttaaagattgcctttgaaattgagtaatggcggatgcccagcacctgatgtttgggcacgggcgacaggacgtagggtggtcatccgaatatccctgccccactccccagctctctatggcattagtagatgctggaagatgaggccgtgttttctctttcatcacccgtgcagtgaaggatttgcgtggtctttggtgcttttcttctaaataatgaacaattatttcttgcgacattttggttttttactgccaattccaacagccatttgtcttttcagagctaagtttataacttcctcctttctctcctgtcacttttaccccattctgatttttcatctccctgccaattgtggtttcgtttctgagcactcatttattaatccttctttttcatttcccagaacacgtgctggtgtaaatctttttgcagttaaagtattacattaacctttttgatagcatggggtggtatctcggcggatgggcgagtgctgttcgcctgtggtctgtctcaggggttctagttggaaggcgtcctgcagccatttcttcagaggctaaggtgtgggggagcaccttggggaagaagaaaacatagtttctgcccttacaaagctgataccccatcaaacttgagattaaaacagacaaaaaacccaagaacctacagagcactgcagagaggccttgggaccctctgacagagtcagtggggagtcggctgggaagggcagcttttctgtcccagcagccttgcttcctcttcagcatgctgagggacatggagccctccaccattatctgaattgattccatctttctctcctgcctctgctgtgggtttccataatgtgaaattaatgcatgtgcttaggttgcggggggccaacccctcagaaatatgcaaagacttcaagggagaccttttcttttcacaaagaggaagatcccccacccccaacacacacacacacacacacacacgcacacacatgcacagtttgcatagccggagtagggagtatctctttctggggaatgttcgtatgtcactgttgattttacattgtttttcctttctttgacttgaaaatttttaaagtaacacaaatttattattttaaaaacttcaactctggaagtacagccgtaaaatcctctttccagaagcaatcagtcttagtcctttggaatgcaaccttataaatctgtttctgttgtaaatatacttccctgttcttacctgcctttacctggagagtacatagtatattcttttgtgagtaggactttaacttcctaatatatcataggctttccgcagctggttctgtattatggattactgtaatttattaacttttcccactttgagtggaaatttagtttatttccaactttttttttttgcttttatggtgttatgaacatttgtgtatgtctgtatttctgtgctgtgtgcaagtatttctgtgggatagacgtctaggagaggaattgtttggccgaagggcatacacatttaaatgttcacggatgcagcccagacccccctcataaggctgtaccaactcatactctcagcagtaataaagacgcgtccatttctcacacctctgcagaggatttctaaaatggctttttatttttcaaaaagcttacatttgacaactattgatgttgtgcaactttctgtgtttattagccaattatatttttttctcctttgatttacttatacatattctttgcttttttcgattgtttcttttagtaactctgcagtatggctactagtcctttgtctaacaagttatacatattttattctagtctcttttcttagcagtttagtggtgtcttttagtcacgctggagttttaaagttttccgcaatttaatctgacgatcaatttactggagtttccagttttgagtcctgctttgaagcgccactgtaagatttcgaaaaaggactatcttgacttacggttttgttttaatatttttaatttactggtaatttgctttcgtgtgacctgagaatgatctgacataaggtttttctacatagatggttttgctacaccctttccataggcttcactgtcatctaccctcatcactgaaatgtccccttcatcttattctgacctttcctgtgtgtgggtctagatacaggctctgttctgtccattgctattcctgggccagctcttccctgatagtaatgtggctctgcagacagttccacgtgtagaggatgtgtcctttttcattcttgtttgtaaataagaatgggggtggggacacgggaggcagaatcataaacaaatagcctgacagaacagggataataaaaatttaaagaaaaagggggttaggggaagtagagtaagatcatgccctactgtataggtcataggtaggaatcaaaggaaactatttcaagctcacagaccaggaagtggaagattaggcaaggaaaaaaaggaattaaaatagggtgaccagtcatcccagctcgcctgtgactgaggggcctcccaggacacggaactttccgttttaacactgggaaaatcctgggtaaactgctgggacaagttggtcaccctagattacagacgctataaaagatatacacacaaaggtaccactagaataaaaacactttacaaaatattaacctaaaagaaaaagcaaagaagactaaagagacacagtaaccctcactgcaattccagcatcagccaacaggacaaagcggaagctgtgtcaggaactgtcagggggcttagctgcttctggaaatgaaatttcacgttggcttggtaaggcagcccgtagctcagcacatgtgagcagcacatgtgaaacacagtgattcacaagggaagggcaaagggatgggcggtgattaatcaggcaaatgaaaccatagggaagcaggggttgccatcttgggattagaccaagcagaaatcaggctaaaaaggcattataagagacagatgagaacaccttaaaatgctaaaagtcacactcataatgaagataaaacccatgtaacacagaaaccacctgtataaagcagaacctacagcatacgcaaagagaaataaatagcaacacggaaattgtcagagatgttaacacactattctcagtacaagacaggtcaagtggccacaagtaaggaatgatacaggagacccaaacaacctatcccgtcacagatacgtattgaaatgcattcgctgagtagaaaatacgtctgtttctcaacatacatggaatatttacaaaagcttatcaaaaattaggttatgaagaaaagtttcataaaagaattgttacaatcaacattctctgatcacagtgcaataaaactataaattgttaacaaaaacaaggcccatccacctagagacttaaaacctattcttgaatgaaagtgtaaatataaaccaacgtaatagaatgtctgtaaaataataactctgtgtatcaaaggcatagttaatgcagtgattagagaattcatgactgtagacacctatatcagtaaaaatgagggaagaaaaataaatggaattaataccaaactcagaaaactatgaaaaattaaaagggaagccaaaaaagtataggaaaggaaataatagaagcagaaaataacgaagtagagaaggaaaaagcatttatttaatcagtaaatcaaattctaggtcctttgaaaaaaatttaaacagacaaatcattagttattttattcaaggaaaaaaatggggaaacacaaatatataaaatgagaatgacaacagggaaataagtattgatacagaagtttttaaaaagcacaagagactaatttgcaaataaatatgaaaacatttttgaagtgcataattaggaaaaatccagttttagcaaaattaaccccagtagagatagaaagcttaaataaaccaatttacatggaagaaacagagaacattttcaaagaactacctcacaaaatgggtctgagcccagttgctttcacaggggaattctagtaaatcttttgtgtagatgattctaatgatacataaattgtttaaaagcataagaaatgaagggaaacgtcccatattttttatgcagcaagtacaaattgaaacctaaacctggtaaagatagtatattgtaaggaaaataaaaactaatataatatggaaatattgatgcagaaatcccaatgaatattagtgaatagattccgacacctcattagtagtataatatacctcaacaaatataacctttctatgcccaggaatgcaagggtagtttggtattaggaaatctgttcattgcattgcagatgaataatataatcatgcaaaaaggaaggaaaaaagtaccaatgcaagtaacttaaacactgtactctgatgacatgtactcaattgtagggggaaaactacaaatattcttcttaataactttgtttttcatagtgatgtggaattatttcatgtgtatgtggattgagaaaatgactaagtgtgttgatgtttgggagaaccccctgtgaagaagagggacacttacatggagtaggcatcaaggaagaagttggtgcagttgacttggaatcagcatcatctatatggactcattatttctcaaacatgcacatatgtacacacttcttccagctctagctagaactaaaaaggcctagaggcagtaataccccagtcacaaagaacacacctagttcccagtcttattttcaaaataccatgcaccactgaaaaggatcttgtgcagcttggagaaatggctgattccaggatgggggcagcaaagacacaaaaggagcctagaacaagaagaatgataagcaggatgagaaggaagaatacaaaatgagcccagaattagcagggggaagagaagccaatttttaaaatgggcaaaacattggaacaggcacttcaccaaagaatgcatataaatggaagataagcatatgaaaatatgctcaacatcttcacccttagcaaatgaaaactaaaaccacaaggagattccactacatgcttattagaatggctaaagtgaactgacagtgccaagtgctgatgaagatgcagagcagccagagtccattgcgggggaaaatgctgaattacagccaccagggtgacagtcaggcaggtttaaaaaatagagttgaacatacacttaccatatggcacagaaatctgacttaaatgtttactcaagtgaacaaaaacagatacctactcacccacccatccactccttcagtcacccacccactccatcactctctctctcttcacccactcacccacccccccacctacccactcacccacctactcactcccccacccaccccccaactcacttacccccacacccgctcacccacccatcctctcccctctcccaactctctctctcccaactctctctctctctctaactcagaaaagtggctttactcagagtctccccaagccttaaacagccattccctcacttggagaactgagtaagtagataagctgtagttcatccctaccatgcagttcagatcagccctgagaaaggagcagacaattgatacatacaacatcatgaatgactctcaaggcattatgcatttgatagtggaagaagccagacactgagatgacattactccacttacaggactgactgtgggaggcaaaaccactgggacagcaaatcagtggtagcgagggatgggattgagggggaaagaggtttcctataaaggaccacaggaagtgcttaggatgatggaactctggcttgatcttagtgatggtcatgtgactgtaggtgtttgtcaaaacttacagaactaaacaccaacaagggtgagttttacttcatgtaaaaaatgttaatgtcatgaaagacaaaggctgtaaaactgttccagcttgagggagactgaagagacatggcgactgaatacaacgtgtgcctgtactccagggaaagtgtattgtgggagagacttaattgggacaattgatgaaattggctatggattatatgttagataaaagcactgtgttgatgtagaatttcctcagtttgacaactgtactgtattatggttacctaagagaatattcttaggaaataagatgtgtgatatacccaaagtaactctcaaatggttcacacaaacaaataataatgtttgtgtggggagggagggggagagaaagaaaaaacagtggcaagatggtaaaaacaggtgaatctaggtaaagaatatactggtgttctctgtattcttgtaacttttctgcaagtttaacgttatttgaaacaaattttaactatttcagtgttctagatcatatatctttttccatgcttttagaatgcatttgtcaactttcacgttttaaaaatccagttacagttttgattcagggtgcattcactatgtagattaatttgggatcacaatgaatttctgttaattttgagaaaatttatatttctgatattttcctatctaggaatatgctgttttttcacttattcagcacttcttttatgtctttccataaaattttatactatgagtcatagaactcatattttttgctaagtttagccatatatattttttaatgtttgttttataaatgagctcttttcacctcattgaaattactaatttattatttctgacatacagaaaagctgttgacttttgtacttggccattctgctaaattctcttattagttctaacatcaatttattctctttaactttctctaataatacctggaaataatgataattttgtttattccttcctaatatttttatctgttatttctttgtcttgtcatgcattgaccagaacctagacaacaatgctgagagtagtgatactgttgatggggtgtgcctacccaacagttgtagaagtttttgtttctaatgtttgctgcttatgaaacataagatggtaattaacaggtgattgctggaagttcttggcttggttcccacacctgaaaagcatttgtgatttactgaaaaccagtgcatgttgaaggcttcccagccttacataattgagattcactttgactgtcatattgccaaaaatggactcaaaccctgaagttgtatccataccatcttgagaatcagttgtttgaagcgtcacccattgtttctaaccatttttgttataaagataatacacacagagagaagcgcctgcagtgaatctttgtgtaaccatcatgcagatcaggagacaaaccatggcggcccctcagaactctgccacgtgtttcttcccatcttttcctgctgctgctcccagaagtaaccctattccgacttttctgggttttcttggtaatcaatttctggtttttctttatagagttgttgcctaagtatgcacccttcaacacgatactgttgttttgcttgtactttttgttaactgtacatataataaattatgttatatatttctttattgcaggctcctttaatccagtgttatgtttgggagacgcacccatacaactgcatgtcaccgtagcttgttcatttccagtgtcgtgtagtgtcccttcatgtgaatttatcacagtttattagtatcttccactctgatggacatttggtagttggaattttcattactaatgatgcccctgcctgtggtcattcctgcctgcctcttgatgcacacaggcacgcatttctgctgggtatgtcctagttccagactcactggttatacggtatggatgtaattattgttagttttccagtgtgattaaacatcagattagcgcccattagcaatgtctgaggctgcctgttgctccactcgggtgcccgtttggtattaggagcttcttcagccattcttgtgtttgtgttcatgtatctcattgtggttttaattttcatttctataatgactaatgtggttgaatatgtttttgtatgattatttgccatttgtatttgctctttttaaagtatttgtacaggactttcacccattctcttattgtgttgccttatataggaattatttctatgttctagatatggatcctttgctggccatatatgttgaaagtatctccactctttggcttgcctttcattattttaattgtgtcttgctgaacagaaggttttaatgtcaaggtagtttttagtcaatcccctcatttatgattggtgcattttgtcaggtttaagaagtcttttctctcccataagaacgtgaagaaaacatattctcctatgttttatagaccataggttggcaaacttttttctgtaaaggactaaatagtaaacattttaagctttgtggaccacagatagtctctgctacatattcatcttaaaaaaaaaaaaagaataacctttagaagtataaaaaccattcttagatgctgggccagagtgggccaggctgtactttgcctgttcctgttctagaagtcacagttatttgctctcacctttacagttatgatttcagttgcagttggttttgttttttgttgtttgggtttacagcatgagacatgggacatctctaaatggatatttattcatgttgagaagtccatttattccccatgtctatgcagtgacccctttgtcacaagtgaaatgagtctgtttctcagttgtctattccattttattgtcctatttgcttattctcccaccataccgcactactttaattattgtagctttataacaaattttcaaatctaatagagaaagtacttcatttgttctttttacaactgtcttggttattcttggttaagacatttccattagtatataaatgaatcagtttgtcacatttcagtttcagagtaatttttaaaagaactttttctttttgaaatgtagagaaggtttttagaaaatctttttcttcttgaaattgtagagaaacatctctacaattttgagtcatcaaatctgtaaacatattatagtcctccatttgttgaggttgtcttaatctttcccaatcatgacttaaagcctttccctacagaagtcttgcatacattttgttggatttattattaggtagatgaatatttaaatatatataatctattgtaagtgttatgcatttattaattggcagtgcttccttaagtgtttgttggagcatgctgctgaaagcatcttggcttatacatttccatagaagatttaaaattataggacactaggtttcctgatatttttgtttttttaaaaatcaacttattttgttttactgcaatttttttttgttaagagacagagtctcactatgttgcccagactggcttcaaattcctggactcaaacaattctcccacctcagcctcctaaaaagctggaactatggatgcacaccactgtgcccacctctaatttcctttttttcctgatctttctggctggttgcttaccaattttactcacctttttaatgaccccacttctggttttactgctttttcttatttttttgtttgttttctgtttcatcagtttcctatatgagatcaacccacagacatacaattttatttgagcatttgtattgcttagaaagcatttataaaattttattaaattcttctcgacatttttctttcagcatggcattacactgcagattaataatttccaattaaaggttgggtggaagctcttcaattgcacagttaaaaagactttgaaatatggagatttctttttgtacttgccttgggatccacaaaaaacaaaacactaccagaacagtaatttgtgctcagaaattatatccactgtaaatttctgtgggaatagaaatctggagaagtaaatgaacagctgatgtttcttatgattcagttgttacttttcatcacaataactttactgaattttaagcatataattactgttttgccttgtaactttaggttgaatttatttttaaaaaatataaagtccgatttacaaagctatttaatgtttgataacaatagttgaaggaaattcttttgattcagaaaaattttaatatcaaacctgaaccataaaaattgcagtaaaacgttactacctctgctaagtcattgaagtgctttgtgatacagtatgtcaggatatccagcttcagtttctgactaaatttcatagaaatgattgtcattaggtccgtgagcatcaatgaagtacaccattgattacactctttaaataatgtgcaatagattcagattcacatattttatgcagagtacctgctagtaggtaatatagtaaccataggccttaacattttcataagtttttcagtttagccaactaatccttttttgcttcacacaatttcacaaccaccacttataacacatcttagcagattccacttcaggttgtaccgaagtagtactttctcatttttctgaaaatcttttctttggatttaaaaattttttctttgaaaatattcttgccatggccatagtttgccagctgttaatctagctttcaaaataagaaaccacaaagaagagaaaattgaaacatagacctagtagaagaaaggcaataatgaaaagcataaattaatgtaatggaaataaaaaaaatttttgagaaaatcaaagaaaccaatagcttatttcagttttgaagacatcaataaaaatgataaaactcaaactgagaaagagattacaaattacccaaattgatgtggtaagaggaaataagtacagatcctacagacattaaaagattatgaaggacatattataaacagttatgccagtaaatgtgacaacagacaaaatggacagaatcattgaaagacacaaactatcaaagctctctcaggaattcgtaacttagttgctgtggtgcctgtatgactgtacatgtcagtactcattgaactgtatgtatgaaaagatttaatttttctgtatgtgaaaattatctcaatttacttgactttaaaatattgtttaatgctgtcagtcatttgagctacacgtagatttaccatttttattcttttcatcctttctgtgtctgtagccttctttatgtgataatcctccttctgcctgaagaataccttttcagcagcagcaagctgaagccagccagctccgagagccagttctttaatttacgagaattttatgagctggctgtcaaacacacccattagtaaaaatcgaattacataaatttacagttaaatacattatgtttggaaagagaacacacattcaaaactgattccttccaattattgtactaattgtgctgttatccataccttggaggccatttttatgatgctgtgatactccacatttagtgctgtcaccttggtagcttgaagtcagtcctggtaggaatatttacacagcagaaattagcaaatgctactaattagaagtttatttgattatctagaccagaggttggtaaactatggcctggggctggggctggacatctttttttttttggtaaataagtatttgtcaacacagccacactcatttgtttatgtcttgtctgtggctgctttcatagctcagtagcagtcaagtgggagcaactgagacttccggcccacaaaacacaatatatttactatctggccctttgagaaaatgtttgccaaccaaaatctagatttcaaaatgtgatggagaagatgttagtaaggtgcattcattttcagatgtcttgtgtgtaactgttacattttgaatagctccagaaatttagcccctcttccagtggttaaaagtatcatctcattcaacaaagaaatcgctcacgtcattgccgaacacgtgaagttctgacataacatcttcatcacctctgtctcgtcactttgcagcattcatgtagaactgtgtgttcaccagttgcaacctcagattggctatggacatgagtttggcaaatatcaacaaagtcatgctataagaatcagctggctatacagaatttacaacaaagagtattgtgtattgaattatttgtaaattgtatacttcacatcctttatatcagtagagtttattctttaagaaatgcacatctacatgaatacttgttttggaatgccagctaaacatttatcagtacaccattgcctttatttcatttcacagggaattgctggcaagttctggtttcagtttcttttttagaaaatgtcttaattgtatctgtatttttatatcatttgttataggggtctaggtttccagttattttattcagaatccagagatactgtgactttttcttcaggcttccatcattcttcttgagaagtcagctcttctttcaagtaatgtcttttctctaaattgagatctgactaggtgtggacaccttttatttatcttgctttgagatcacagggattcctgaatctatagctcaatgtctttcaacagtttcagaatgttctcatctcttacttcttcagaggttatttttgctccattcccttgaatttccttctttgaacccatttacgcatcggtacacttccctgtatcttctaaatctcttgttctccgttatttcccattattttatatccgtggggtccattgtgttgatttcttctgatcgctctaacagttcattagttttctttgctactgtgcctaatttggttttaaacccattcatagaatacattatttcaatgatttctcaattctagtattttcatttttttaaatagttggtgattctttcctgaatttgagatcttagcttttttcctgcttgaaggtagtaaagcatagttattttacattccaacacctggaatccctgtgatctattttttgtctttatttctgccatttttgttcatattgtcttatctcctcatgggtctagttgttttttattttgtgccatattagtacattggagaaacagtgtgtagaaatgacgtattgcccgggaggatgttttcttcctctagcagtgcttggggcaccggcagtgtgggatcagctcattctaaccctagggattaatacgatcagagcagggctgtggctcttttgaggtttgctctagtgacagctcacttttactcctacaaggtggccattcagattcttcccccaagttgagggtgctcaaaggaccctgcaagacactgtctgttgccccagggcagtcacctcgcaggaatggtgcttcatcccagggtaggggcagctcctgtgctgctgtttcctcctgtacgctggcccaaaattgtcgctgtctgctcttagaatatgacccactcctttcataaagctgagttcaaatcccacatcccaatttaaaaaaaaaaatcatgttataagcaacactaacaacaaatccacttttctgtcagccctgcccacctccccatcttcctttctgagacatgcagcatttctctgcaacaagcaaaattttgtatgtgcaaacacaccctcccaccccaaactttattttagtctctgtgtcttggttaaggtgtcttcctcgcagtgcctgccaccttgcggtcgagcccagctggcaaatgaagctgagctccagttctgcctgatgcaccaccccatgccttggtcttctgctggaggctgggggaggtgagcactggccaaggaccagccctctggttctgtccacatcggcttgatgcccattcaggggttgcaagttctcctggtctggatctattagttgaagaaattgccacctcgtaatttcaaattagtgggaattaaaaatttaatgggatgtatgtattttttggatcatatgaaactatgttttatgtggtatttaatgtgagtttaaatatgcttactaaatatgacttttgttaatatctcagttgatgctcgtgcgaaaaaagtctgcctttctacctttctttcctacctttctgccaaacccagtccttttactaatattttaaagtattgatttgaagcagcagtgtggttgcttctgtctgggtttgaacaagtaactgaattttaattcctgagacctcttacatatagcaattgtcttggctgttgtaggaaggcagcaccctcattcctctgatttagctctctttgattctacaggaagttgttgccactgtctctttttattaaactaaatgccagaattctttcatgtcatcataagatgttaatgcatattgctttggggaccaaagtcatacaattagaaaccactcaaatgcttttttattctaattctgaggttaccaattccttaaaattagtaaattttcactgattttgcaagccagttgtaaaaaaaaaaaatagtataaactcctcactgacggtagtttggaagctgcattgtttggatgtgatgtttcagtgccacacacgttagcggtgggaactggaagccagtcacgaatcggctatctgcttcagggatctggctttgcactcctgcccctgcccctgaagtggctctagggacagctgtggtttgagtggactcttgctccttcctgacctcttaatggccacatggacccccttgcttatctttgagagcagggccttgatggaaatgcaaatgtgtttctctttggtaacccagataccaaaaccaagtgcagtcctggaaggtgaaaagagtttccaaaggaaaaataaaagacacatttctaggaagcatgggaaaaccttggtggctttgtcctctggtgacagcagcctgggggaggtggagtagctgggatgcccccagctttcgcctcccctgggctctatcctgcatgttcttggtccatagccctctgtgggccatatctttccagcatcagtacctgttggggtccgtgctaggaacacagcagtgagagatgaagatgtggcctccctgaccgcctggagtccacagtgcaggggaggagggtgactttcaacaactaatgaacaaagcgtggctcagtcgtagctgagagaggcactgcccaggagaagtatgaggcatcgtgggagcatttatcagagtcagaggaggcttctttgagaggtagcttttaaatgagatctgaaccacgtggaacaagtaagagctcacgagtgcctgtgaagaaggaccccaccttgcacttgggggacccgaggaggacctgtgtgcttgccgtgcaaagcagcaggacagaggacccagctgagggccaggcgggagcaagggcccagcacactgggaggtttgagagggtgtcaggaggccatttggatggagaagccacgggcaaccagaggagtttcgtctcgagtcctcaccctggctgtagtgtggtgagcacattggatttggagaggttaggcagatgcaggcaggccagttactggaccatcatggtggtctaggcagggaatgactgggtttagactagtagaaggatgacagcagtgacgtctgtaagtggacagattgccggaagagttaggagtgaaaacgaggactttgtgattaaatagggccaaagaggaggataaggcaggcgtgggcccgtgttgctggcatgtgtgactagcaggaggggagtccccatcagaaggggaaacagagcaggaagccaggagtggcgggaacaacgcttcaaccttgggcctgctcttgttgaggtccagggaaccagtgggtcggatccgtgagcatgcaggcatggagctcagagaagcagcatgtgtcagagatatggcctgagagccacacacccactgctgctgctgtgatctccttgggtgagagcatcagggagaagagagaaagacccagtaggtggtgtcgccaagggagcaggccgtggtgacagaggctggtggaaccatcgggaaaaagggtgccagagcccatttccctgtggcagccaccaccccctcctcacaacacccaccaggtcccttttccttaaatcaaaacctggtggatttcaggggcaggcgctgctcagttgtggcctctgcaaggtcccggccatgtgtcaccattgagtagctgctacctggcactgcgccgggctctcatgagcacatgtgagtgagggagggaaggggctccattggctgagcagggtgcaccctacctctcctgtaactcccaggagtggccgtcccacacccagatggggagtcggggtgaagccaccatcctgtgcgtgaatcaatggaaggcaaggctggactcacccccgcctttccccagggcattgggccggatgttactgagcctccttcacttcctcttccctgtggccgccccccgaccttcatttccttggtaatgggacactttggccgctgtcatggttggccaggctcggtgtgggcggcacccaccagttccttctgtgaacatacaggttgatggcaacagcgctggggccatggggatgactgcggggagaagggctcatggcagagcaagcgcagtggaccctctccctctggccagtgttcttctgtgaagaggtgcatctctgcgtctctgcggcgtactctgcgagggtccctgtggaagtggctgagatcagcaagacgacgtgtttgcaggggttgggccacaccaggctctgcacgtgacatggagcctgcagctggaagaacagtctgtttaataaaaaataaccatttgataattataatcacttttaaattgataaatggattcttttaaataaaagaaaccattaagaatgattgttctgcagaaaaagcacatgaggaaatgaaattttctatctcattgggaatttcttggtaaatatgcaagcagatacatacattacatttagattttagaagtaaaatgacctcatatactttacttttttagcacagagaattctgtatagcataaagcagtaaatcacagatactgggcattatgagtgtatttttcttttggaaaaaaaaacattgaaaaagcagagttattaattggagtcctcaaggtccttatttcagtaaatctgaaatggtgaccatcttacccatagctaagttgggatgccaaagccatttccaccatcagcgtgctagtagtaaccatccaggggcaaagcggctgattctgcagcctgggcatgtggtatgtgggtgtctctgatgggccaagggaaatgacaggcccttgtgctgaagactgataggagttgatttacatgaaacacatgtgttttttttttaaagacaattttaatgcacatattttcattttcagctttatagtgttttatgtcttttgcctttgtgatttaaattgtcttatattatttataagcattttctattatttataattatttttaatgattttatgtaataccattttatttctagcttgacctgagttggcctatgctaacacatttaagctttcctaattcccaaggttaccataaatcagcaggtccctaacttctgtattcatctctgccctgtagagaatagccaacctcaggttttcgcagccatgcctcatctctctgtttctctaaagggaagccatagcaggtgcctgggtaatgtccagatctgaaaaatcccatgtaacctggagttgagggcctgtctttcacccagtctgtttgtaagcagtgcctctgcccccaccatgtccccacctgacaggccagctcaacacctgcctgcctcctcgtccctgctctaacactagtcagggcgcacagcccagcgaagtgctctgtctgctgggaggaggtactggctgtgatcggactgccccccacaaagccctgagcaggtgaagggtgtgggccagccgggggcgaaggaacaggtcaccgaggccactgccagcaccaccaagaatcaggccaggttccgggggcatctctgtccccaccagcagcactgcccttcagctttttgatgaggccggttgttggccataagaggagcggtgataagtttagattgttttggtgtctgtaggtcattactggaattacaccagccagccatgaggtcataaagttaccttgacagattgtgaatgccgagtccacagtaactctggagggctgcctggcatcgtccttcatcattgtccagaaacgctcctctcgggaaggctgggcgtaaaactgaaaagaggaggctcaaggaaagaacgcctcggtggctccatgcaggaaacattatttctgatttcaagctggagagagaaaggactttggggcccctgttttggaggcctggagtgatgagtactgtgtctccaagctcagaatgaagccaccagtggtggctgcctttgtttctgcactttcagttcctgcaggtgcaggagcttgccagggctgctgtcagggacacttttccaggccccgctgccctggctgggtttccttctctgagcaggaacaagtgcccgatgctgttgctggtgcagattggagggctgccagggctgggtgactccctgccgcattttgccaagcttgtgtagctgcttctgcctcttggaggggctgtgttagaaagcatgcatcacctccagttacctcaggcagcaggaaagacttttaacctactaaacaagcgtcttccctgggaaaatacatcctttggttgagactgtaggagacacactgtaagttatttatcttgaaccctaaactgcatgtaaaaaatgtaaccaaaccctcagtgcctggggcgaaatccactccctaatgttttaatgacacaggatccactatgctacgtgtgcaccgggtgtagacttggtccagtgcatgtggtgctaagccataagggactgttaggaagagccgggcatggtggctcatgcctgtggtcccagcactttgggaggccgaggtgggtagatcacttgaagtcgggagttcgagaccagtcccggccaacatggcaaaaccctgtctctactaaaaatacaaaaactcgccgagcgtggtggtgcacacctgtaatcccagctactcgggaggctgaggtgggaggatcgcttgaacccaggaggcagaggttgcagtgagccaagatcatgccattgctctccagcctggatgacagactgagactccatctcaaaaaaaaaaaaaagaatcgtgatattcttgataggaagtaaatgttagtcataggattacaagattttattctaagctcttacaagcaagcagttcagattaatgtgttttcttagaaaacttgatttgattaaatttcatactttttatctattccccaaaatttatgcggtccttgtgtgcttgagggttctaggaacaaagtgattggggaaacaccggtcccctctgctgtgggaccctgcgggcttccagaactggcgtgaggtccgagtcgctgtgggaccctgcgggcttccacaactggcatgaggtctgagtcccggtgtttcacaatattacttgaccaaagagcgtttttttcacaaacacatgaggcagcccatgtgactccagggacccgcaaagcacagcttgagaaatgttggtatgtttcaatggaaatgtatgtaattaagaatattagtacaatatttattaaaagtttctgtcttgaatgaagtaataggatatcctttaggaagcctgatgtcgggacgtgctgtggggtatttttatgttaggtgttaacattcagcaaacaaatccaggctctacttttatcctttaatgaaagattttattttttattcagcattggtgcattgaggacttacagccatcttatcttacctcgatgccattgaaacaaaaaaattagtcatagaaaacaaacctaatgccttcctttgcaagttccagtcagaagtgtcgcatataccagacaacacatcatttttatagttatagagagaactcctatgtacttcatgggaatacaaaaatgtcacaaaattaaaaggaatttttccaaaattactgtgactgaacagatcattccacgctccgttataccattctgatcctaatcccatagtttaagtgtagaggctggaaaatgtcttcgatttagaaaggaaagacaggcgagtgctgtacaatggtgcaattcagtggccaacgagcccagcagtcgcagaccccatacattcctctcgttcatatcctatcgatttgtgacagcgatcacatgctattgtagtacaaggaagaggtttttttaaccgactgtatgacttgtagacttttctgtgaattttcattaaggttggtgaattgtacaagctgaggaaagccaagacaagctagttaaaatctcctggcacacaggtcagcctgagttcagattttatttcgcgggcatgattttggggatcccgtgctagattgtagttgtgttgtaataaagccccctttccagcgctgcagtgggttgtggaaattgttgagaggagaaaccaccttctcctaggcatctgtatttggttacccgccagcactgagacatgcaggcatggaaaggcagactcaggaaggttcaggaattctaccgactttggagcatgctctcccccggatctgaaacactggcccccgtcttatccacccaccactccttaagacatccaggcgtggaagggaagattcaggaaggttcaggaattctaccgactttggagcatgctctcccctggatctgaaacactggcccccgccttctccgcctcccgctcctttaaccagtcgtcaggtatttcctcaggtacccgctctgggaagccttccctgaccctcctttgcccccgtggggacgtggctgctgcttcccccgtgtgcctgtggccccttgtgcccagcgccatcgccactccgtgagggtagatgtgggtgccggccgtgtctgatgcctccccacaggggccttgggcacgctgtgtggacgctgcctgtgcgtgcttcctgagcgaccccatcagtaaagcgtcgccaccatgcaatgctgctggcagtccttgtactgagacaatgtggtagctgccatcctgaatttccctctgaaactgctcccaccaccagtgctgcctgtgctgtggccctgctttgtgtcctgtggcctaacactggagcgccggctgctacctgtctgtctcctgtgctggacaggaagcaccatgcaggcggcgttgtcgtccgatggtctccacctgtggccgtagcaccgggtgcgctgtggactgggacacttccatgtcactccacacgtgtgccccgctgtggcactgtaaatattcatttgagctggtaaggaaaatgacattttaaatgccatgatgatatatagtgtatttctcatgtgaatcacgttttccttagtatggctcagcagcacgccatgtttccgtcccatagagaccatgcttcctgtggggacgcccatggtcctggctacctctgctgaaagacggccaaggtgactcttcagctataagagagatcactcatcctggaaacttgtcagagcaggagaattccagaaggatcaatatttttaaaaaattctgttcctaaacttttgctctgcaaaaggtcttgtaaaaagagaacagagacaagtcagcccaggagaaaataccattgacctttgaacaacacagacttgaactctgtgggtccacttacatgtggatttttttcaaccaaatgtggatggaaatatagtgttcacaggatatgaaaaccgtgtatatggagggccagcttttcatatacacagaatctacagggctgattgtaggacttgtgtaggtgcagatttttgtatccatgaaatcctggaggcactcaccagcatataccgaggaacaactgtatttgcaaatcccatatctgacagaggagttgtattcagaacatgaaaccaactctctaaactcaaaaataagaaaataaacattccagctagaaattggacaaacaatctgaacagagacttcatccaagaggagatacgtaggaccataagcacaggaaacaatgtttattgttagccaacagagaaatgcaaatcagagcctcagtgaggttccacgcagagaccacacactcctacagccactcggagaccacgtggccacttcccagaaagttaagcatctgtttccacaggaaccggaagttgtacttctgctcttgtatcctaaagaaaggaaaacttatgtccacacaaaaactgtacacaagtgtccatgtcaactttatttgtagtgacccccaaattggaagcaattcagatgtccttccaaagatgaaagaaaaagcaaactgtggtctatccatacaatggaatacttatgaaaacagaataaaaagcagccaactattgatacacggtacaatttggatggatctaaagggcattaggtggagtaaaggaagctaatcctaaaagataggattttttttgtatgtaacactcttgaaatgacaagcagtgatggggaagagataagggttaacagagactggggacagatgacttcgtaggtgtagcctgacaggtgtctttgtgatgagacagttcagtatcctgtctggggttttgtgcatgtaaatctaaacacattataaaatttcattttaaaacataatttttaaaagtccattaaaaataaaaatacataagaatttaaaatgtttgtaaaaactggtgacatcaaataagataggtagtttagttagatgtattgtatcaatgccagcttcctggttttggtaacgcatgattatgtagaaagttaagctgaatgaaggtgcctgggaactgtcactaatatttttcttgtgaatcttcaatttcaaactataaagtttaaaaaaatttgtgccttttacataccagttttttgttgtttttgagacggagtttcactctgtcactcaggctggagtgcagtggcgcagtcttggctcattgcaaacttcatctcccgggttcaagcgattctcctgcctcagcctcccaagtagctgggattataggcgcacgccaccatgtccggctaattttcatatttttggtacagatggggtttcaccatgttggccaggctggcctcaaactcctgacctcaagtgatccaccagcctcggcctccctaagtgccgggattacaggcgtgagccaccacgcccagcccatacccatttttaaaaagagaaaatggacaagagagcagggaatggcgttggctttgctgctgtgagtcttggaaaacccatttccagtgcaagtgcctgcgtaggagtacgggggcagcattcttgtaatgaaagtgagccctaaagccaaaaggtgatattccccctgaaatttaggaaagaaaggaaactcttaggctggaaaaatgtggctgaacttgatactgttcatttgatggttctttgattagcctcattacctagtatttgaacaacataaaaaattggttaagaatagccaaagagaaaatgcccgggtgagtgctaggcgtccatacacatggcagcttttaacaacgtgcagccatgaaatatggaaaacttcctgacgttgatcacagttgaaacttcatactttcttaattcagcctcttattgacagtaatatattttaactcaagaatgtgttcattcagtgtatattgacttggcttgttgaaatgttcacagtacatgtgaacactgggtttcctgtcatgatgacttaagacaggaggacagcagtgagtgattcctgccagtcaaggaactttccctggaaccccacttgaatggtaataatctgctcctataattgctgtggaaaaggaaagccctctggagattttacatctaatcatttatttataaatctgtagatggcagtctgcagaagatgtgtcaggggtcaactttgtgctcaaaacagttgcctgatgtttacatttcacagtgtatttttttaacagtacctccagcccccatcatcacaaaaggaccctggcttgctggtagctgctccccactcatcccacagcccagacacttcattacagatgcctcggcagaggctggtcccctctgtatttgctgaaatatgcatgtttttccatctcattaattcagtctacatacaattaatttttgcctattaataaaccccttggtgttagcgacagctatctaaaccacttcacctagtgtggaatgagcaagtgtacttgcaaatttccatccctggtctgcattttttagtgttgtatttgtgggttggagagtttgggtgcataaatcaagcattgtgaagaaatataactgccgaagactctgggttcagactggctgatgggaagtttgaaatacgaattagttccacattaattggggatagagggagatgcaggggggccatcccagcacgtggtagtcagggagggtctctggctatgggaaaatttgtcagccttgtatgtgcgtgagaccaactttctttttccacaaatacaaatcctctccaaattggacacttctcaaaagatatcttttctgtgtgttttcaaatctcataatttcttaaacatctaataaagtctgtgaatacacgtaagtgattgtgtatgtggtaactacaccagccaacagcattgaaaggaaaaaggaagaaaacacaaaaatcagaatggagccttgaagttgagatgagcaccacctagctcatttagagacatccacaggaaaggaggttccccaagacttttgttatgctccaaagccctgagacagatccatgtcacaaggacacctttctcatggttcaacatcaccagccaggaggaaatgcagaattctgtataaatgttaggaattcttagatttctcacctggatttgtaaaaattgcagttcatggcgagagacatccgggagatccaaatgccatcctcctagaacttgctggaggaaccagattctttctaagcgatttgcatcttgatgtgatgctacagttctatgacaggcccgagtagctgatgaaattctacgtgggaaaagcttttgagtgcctgtcctggtaaacctgtgacagtggcatcacataaaggtttccagaatgttctgtgaggagattgagccaatgtcgttggtcagcttaattggaagcaggtgattgaaagtcagataaacatgcaagatttgctgatttttaaatatgccatatgtgtcaaatgtatgaattgtgatgatggacaagaacactttcgcagctttaatgggagcatgtaatgacttgaacaagactgcttagttttggttactgatgatcaagtacagaatcttgctggtgtctccaaaacttcctgcctggcctgggcagctgtcctggctccctctggccagttctctgccaggcagccagtgtgaatctggaaggggctagtcctgtcttcccctccctgtctagtgcctttaacgtctccgctgagcctgccacctcctggcctcctcgaccctccacctccccgagccgtggaggtgagtcctagaccttcttctgtgggctcctctccccggggccctttcggctcagccccacttctcttattcacccacttgtgttctctgtagctaaatgatacataacaggaactcgttaagtagcttgtgcagtgaatgagttaatcctaggtgttttcagaacagtgaatttcaggttcctgactccgctttgagctcattcaaagaaagtcatgtaaataagacctaatcattgcaagaagtctaatgaagaaaccattcattatctctggagatgggcaggtacacctcacagaaagtgaagtctgttgctgatgaatagtctgcatgcccacatcttcctctgggtttctaagtaattgaataagaaacgtttctatttatattcttatttatgtgcaactgtatttaattattccctagttttgaggattggccaataaaccttttcttcccttttgccattgattattcttaagtttaagacaatgcccagtggcagatgtgcttaaccgccatccttcatctagttcatgtgactttttaatgtcaattataaagaaaattactcctttggcttcagaagtttatttaaatctcttctgagaaaattggcagctcttcggagttaatgtccagagcagcagaaacagaaactggagggcacagactggtggatatgtgaacagaagcactttttttaaacaaagttaaaaaaaaaatgttatgctattgctaataaattgagtcaggggaaagaaaaaaaaaagagatccctaaatcagcttccaagctgccattaagatgggcaagtaagataattccacataaataagaccagaggccttgtctctgtttttatttatgtatttattttattatttttttgagacagagtctcgctttgttgcccaggctggagtacagtggtgtgatctcctctcactgcaacctctgcctcccgggttcaagggattcccctaccttagcctcccaagtagctaggattacaggcgcccaccaccacatccgactaatttttgtatttttggtagaaatggggttttctgctgctctcaaactcctgacctcaagtgatccacccacctgggcctcccaaagtgctgggattatagacatgtgccaccgtgcccggcctgccagggctgtttttaaatgaggatttctccatttaaggaggtcacctgtcctggacggtatttcctaaatgcctggcataggtgacatcatgcgaacaagtgatggttcagaatacagaagtcatgagtttgaaggctgtgatagaggaaggccgggagagaagtgagaacagaacgtgcttgccctgggcctgcagctgttgccagcatcttctgtcagctgatctgggcagggcgtgggggttcttctcaggcctacctcctaagaacaaaaacatgactgaccacgagcctgtcctcaggatgcagcctccatccttggtgggcacagctgagagaggaagttctgagctgctttggggtagggctctgttgcactcaccctcccatctccttagtcgctgcaaccctgtgtcacaaatagtaggttctcagcaagtgtgctgaaccaaggggtaagaacaacgtttttatttttttatttaatttatttttattttttgtttttacatttattttttaatccatttggaatttttctttttgagatatatataatagggatgaacttttatttcatttttctagacaggtgtacagttaccttaggtacatatattgaattgttatgtctcaccaatgcaccacaacgtagcagtctctcatagcccgacgtatcacccaaagttctttgtctcacgaccaagaaagttaaggagcgccgacgccaagggtatcactggactgaaaatttaataagcaaaagaagaaagctctctggtgcacaggggggacccagaagagggttgctgtttttacagttgaatgcaaaggcttttataggaaactgatgagagctgggcatcttatttgcatacggtgcaaatctgtggtagctccaccccgtcctcctagtgcacacgtaggcccttagcttgagttactccatattgctttgtttcccttactgtgcatgtgtcaggggacaaaatttttcattgtgggcatgtctgggaaactcacatgtgtagccctttttttttttttttatactttaagttctagggtacatgtgcacaacgtgcaggtttgttacgtatgtatacatgtgccatgttggtgtgctgcacccattaactcatcacttacattaggtatatctcctaatgctatccctcccccagccccccaccccacaacaggccctggtgtgtgatgttccccttcctgtgtccaagtgttctcattgttcagttcccacctatgagtgagaacacatggtgtttggttttctgtccttgcaatagtttgctgagaatgatggtttccagcttcatccatgtccctataaaagacatgaactcatcattttttatggctgcatagtattccatggtgtatatgtgccacattttcttaatccagtctatcatggatggacatttggcttggtctttgctattgtgaatagtgccacagtaaacatacgtgtgcatgtgcctttatagcagcatgatttataatccttggggtatatgtccagtaatgggttggctgggccaaatggtatttctagttctagatccttgaggaatcgccacactgacttccacaatggttgaactagtttacagtcccaccaacagtattaaagtgttcctatttctccacatcctctccagcacctgttgtttcctggctttttaatgatcgccattctaactggtgtgagatggtatctcattgtggttttgatttgcatttctctgatggccagtgatggtgagcattttttcatgtgtctgttggctgcgtaaatgtcttcttttgagaagtctctgttcatatccttcacccactttttgatggtgttgtttgatttttttcttgtaaatgtgtttaaattctttgtagatcctggatattagccctttgtcagatgggtagattgcaaaaattttctcccattctgtaggtcgcctgttccctctgatggtagtttattttgatgtgcagaagctctttagtttaaagacttcatgtctaaaacaccaaaagcaatggcaacaaaagccaaaattgacaaatggtatctaattaaactaaagaacaacgtttttattctgtatcatcaaggagggaacccagcacgcctctatccttttaagagacacggcaagcatcagacctgagggacatcatcatttccttgcagctcagaatgcacttaagtgtcatgtagtgggttttctgtttatgggtttgttttttttttagaaaatgtgttcttttctatcttttgtttgtttttgagacagggtctcgctgtgtcacccaggctggatggagtacagtggcaagatctcagctcactgcaacctcagcctcctgggtagctgagactacaggtgtgcaccaccacgcccagctaatttttgtattttttgtagagatggggtttagccactttgcccaggtttgtctcaaattcctggactcaagttgtccacctgccccagcctccaaagtgctgggattacaggtgtgtgccactgcgcccagcccaaccctgtcctttgtttcttacaatattcaacagtcagtcacttctagctttcactttgtcccataaaaatatttcattgaaaattgcaagccatggcagtttgcagtgtttctaagctgaggagttcagctccacacccaacagagctccagcttctggtttgattcttagagataggagtgacttttttcaatcatgtacatcataattaggaggaaggcattcagtcttgaacatggggacaaaaaagtgctggagatagtagcttgagagttgcaaatatttattttgattctgactttaattcttaaaaatgtttgtcaagaagacagtggtgtgatggagcaggtccttcggttaccacaagcacacaccctttctctgtagtcttatagcttgttttcttggtcgattgtgccagctcttataaaaatattatgctcccaggcaaagggccatttctgttggaattgttgagaagattcttggcttaactcttgatccaactctgatcagcttggccaagactagacttgacaagtttgctctgaattgcctcatgctgctgtgtggggtttcaaatcattggcttcccagtgctttctgggctagaccaacaaaacaatgcctgggaaaagagagatgataggccgtgataaaactaaaactgcgtaatactggaattaactgagttggccatgtagatggcaagatattaaaattgagtccttgtgtgccaaagtcgtaaactcattcagataggccctaggtctgtgaatgtttgttgttgaatcctaggctctgggtggaaccgaaagctgaaaaacatgaaattccccctctgtcctttggatcttattcagacagtcatttcctagctatttcaagttttgatcaaaacagacacgcagtagaagcccagtctaaaacatcggtagtttatatcacatatttacttccatgtgtcttaagtggttaagttgtagaattatgtcttttagagaatggatgaagaagtctaggagtacaataggcaagagaatatagcaaagtagttatattttgtcaattttaaagtaaattctgaatcattttaagtatattcagtaacacccgtttgcccccaccttccttcctttgaggttttcacttattcactcattaataattcatcagtctttgctgtttgtggcatgagtatgtacaaaaggcactgcggcgtccattgctgtgagtaatatagagatgtccaaaggtgtggctttacctgtggaaaccacaggaccatacccagagcatttggaggtgccatatgctgcttaagggtggcacatggaggggaggctgggctgcacgcatgctggtcctgaggtgaccctctggccgcaggagagctggaaaggtgccagccgtgggtgccatgcacttgtctgaggccaggatggggagaccacattccaggtacagggataagaggaggaaagtcccaggagtgggaaggcctgggggaaaaggggagaaggtcagggggaggcaagttggccagatcggctggagcttgggattcagccaggacagagcctgagccccaggccagactgcagggctgtgcccagcactggatgcagagtttggatctgattctgagtatgtggtgatgactcggggaggcttgtgagcaggatggtgacaaccaggcaggattttaggaaggtttgtctggttttggcaggttctctggatgtgactggagtgtgaagaggccagtttagaggctctggaggttgttcagaagtggcaacaaaagggaatggaaataagagatgttgcaaagcagaaaccaactgacatggagtgcgggagaacttgaaggcagcagtgggaactgggagctgttcccggcgtggggagaaggctgacgttgatgttgcctaaggagttagaggtgatgaccaggttccaggtggctgatctggataggcagctgcatggggcaggagccccagtgtggcacagctgtgtctgtcccctgccggtcctcagaaagtgacacctaacactgtcccagtccacacagagccttgtccagtagtcagggtgaggtgagtggaagcaagaagaggagctggcaacaggacttgggagaggcggagagcacagcaggcagctgggcccagacgtcagccccaggcagtgtcctgaagcagcgtgtgcacctgggcagtgcaggcatcgcgagtaagaagagggtgttagctcggataactggggctcctgagcagccttcaagaggacaggttccttggggctgtgggtttcaaataacatcatggaggagggagcagagaggcttgaaaataaacggcggtggccggggggagcacaaagaagccaggcctggcagtggcacaggtgtcaggggtttcatgaaggaggggcccgggagtgtgcctgccacatggacactggagcgaaggtgcaccctgaggcagcccacagtgaggaattcaaacgcagcttcctgggctggatcctgcagggcctgagttctctgttccaggggcatcttcatctgaggatttggggtgtccgtgccctctcctggttgaaagtgttagaagccacgttggagaggccaccactcaggtgctaaagttaaagctctagagtttggtgcctgccacttagctgcatggccttgggagttattcactcctctgcactttggttttctcgttaatcaaactggaatccagatactcacctcctaccttgttatgggaactagacgtgggcggtgcacgtgggggcaccgagcacagtgcccagcacccagtgggtgctcaggggatggcagctgccatgatttttgggactgaatgctttgataccacccaaatatatggtctgaggtggttgtaaatagaattagcagaggagatgatacagactcagagttgaattagggtttgaagaagggcttaggtctggagcgttacaggtgggaggaccagcagagagtggtcaggaatcaggaatgacaggacacacctggggagcctgagcggcggcttccaggcagggaagaaaagctcggggcagtatgagtccagaccaggggcctatcaggcgccttctatgcagggtcaggtggtaaagaattatctcagccttagtgggctagaagatctctgtcatagctattcagctccgttgctttctgagtaaacaaatgggcgtggctgtgttccaatgaaactttatttacaaaaacagatggtgggccagtttggtatgtggaggcatgttgactatggacaccttgaaaatcccatgtggcaacagatatgagccaagtggtgacgtggaatgccccatcgttgagggatggggacgcaagggcagcgaggaggtcctgtgggtccgggtgtggcgtgggcccagcgtggccatggcatctggggcctcagctgcagggttgcagtggaaggaaggggaaagaagctcagagtgcattctgagggtcaaactggcctgtaagtgacaaactgaggtcacttcacatgtacatggagggagacaggctgtctttggagcagtgtccatgcaagcctgcctggagggagctgccaccctcagctgcagccccagacctcgcggttgctctcatccgtcgttcccagtgtgggcagtgacgcagcaccacggtaagttctgtagagtggacgccactcgctggcaaagcccagcagggcaaggaataagtgtcactcagtctttatccagaaaaatccaccaatgtacttttagtgcagtattaacacatggtagaaaatggaattgcctagaggattttaatctctgatggattattcttgtacctgtacctgtctgatggtcgtgtaagtccatgttaacaaacctgggaccacaggaaaggagaactgatgcgaatacaaacaggtggaggatttccaggcgtcagtggggtctgggagacttttccaagaagtgttttcattgcagttaacatttttaaagatgaatatctcactattataaaggtcaatgccacttctgtaatattaatttgcaattgaaaggtattttcttttaagaagtcccctttttcaagtttctcaaactggaattttcttgagcatctaagaatcctttcctttcaaaagatccccaagttaccccggtctaagctaagaagggttcagcgttggccggaagcataactctagctctccaaggccttgggctgcggcagggtttgcatgtccaggcagtaggtggaggcttctcttggtcagtgtgtctgctcagggggaggcctggctggggaagcgggtagcagtttgggaccagagcttaaaagagaaggagagaccggtgcggtggctcaggcctataatcccagcactttgggaggatggggcaggtagatcacaaggtcgggagttcgagaccagactgaccaacatggtgaaaccccatctttactaaagatacaaaaattagcagggtgtggtggcgcacgcctataataccagctactcaggaggctgaggcaggagaatcacttgaacccgagaggtggaggttgcagtgagccgacatcatgccgctgcactgcagcgtgggcgacagagtgagattccatctaaaaagaaaaaaaaaaaaagtgagactttgaaagtgatgacagtttccacagttcccatgggcaggtggctcagaatgaggtggcctgaggcccacagtctgtccttggggactgggtggcccccacgtccaggcagcagggagaggacgtgctggctgccaagatggggtgggagaagcccagggcatcaagtgccacggaaataaagctggttgccttagttgaatggcgcctttgagttcccagaagctcttctcagcgggaggctccctgtctttcacctctgctcttctgaggtaccagttgaagggtttggggggtgaaatcaaggcatagggctcctggcaacactacccctggctccggggtttgcatgccggggcttcttccttgtcctggctgtcagagaacacctggaaataaatgctgcattgttttgctggaaaatcctgacaccacctcctgccttcccctgggagggctgagacctggcctaggcatggagcttacggtccacagacctgcctgcctgcagcatgacagcctcccagagggctgtattgatttttgaagaggaggaaaaaggcatacaaaattggacttgccagccttctttgagtagaaattggtgcttcctaaagggaatcttaattggctagcttcgaagctaaaatgttttctcccccttcccttctcagaactctccagcccccctgtttgttcttgtgagacttttccaagccccagttacttttctttcctgctttggaacataattggattcttcgctgggtagagttttgcttggaagacctgagggtgtagctgaaccaagtttgagcaccctggaaggaagacagaagatgccgggagaccagccagctcaaaggagaaagggagggggacagcatctgaactctggcctccagcatgatttcatcctttaaactgaaaaccctgagtttcagtgccagcgacgacacttgttgaaaaagtacaaatgttttctgcttcttgtaatctacttcttgcaaatattagtactctggaaaaaagatttattttaataatgtgagtttcagatttttttctgtagttaacgttgttttattactctatatccttgccagaaagcgtgttttaagagtttcaattcaaaattaaatatgacctcagtgttttaaaatacaattatattaactgtccatttaatagttgctgaggatttttttggccactgatggatagtcaagatacttgtctgagattaaatgcagtattctcaactctgctaaccagctaacttgttccagctgcagcaatcaacaggaaaaacaagggctttctatgaagtgagctggagaaagttgttcccggataaaattgcagtactattctataagctgtgcttttcttttaaaaactccactgtgtttcataatagggaactatctattatttatttagaactgtacaaaccaatttacaagacaggtaatttagtgacagaattatttattaatgagcccaagtatacaagttaatgggaccgagccccgtggaggtcaatcctcatataatccatgccttttggaaagaaaagtattgtcttcagaacatttagttatgattgttaaatttaaattacgatatattctcttgctaagacaaaaaataattttttctgaattgcatgatgacagagttagtctgtaagctgtgtggagatgaattgtgtcaattaggggtaggtacatcttagccctgttggtaccaaaagtattatttctcattgcatgggctcacaggagaaagcaagcctgttctttaatagagacgacaaatcagaaaccgctgcctgcctgggagatggaacagtcgtgcaggcgaggagctcagagggcgggcgtggcttcccaagctctggcacagcctgcaggccttatcaggtgctctgcttctggggtactcggcactttgctcttccggtggatgggggaggggcgggctgttccatgtgacagcatgtgggcttgtcatgattcggggtgaccactggcttccatttcccaggagtggctttgtcctcgcggtcttacggtatgtttccagtagatgagaaggcatgcctacagacagggcctgctggtgtctgctgtgtgtcatggggggaggcaaggttttcctcactgggacctcttcactccccctttattaatgaccccctggctcctccccagaggcccagaagcctagaggagaaatgagggtacagcatagatgccttagtgtaacgagtggggctgctggaactcaacagactatttacagttacagcatgaaggtggtgcttgaaggatttgctgcttcgtttcatttttctcatttcatctcatcatgaagtcgattgcattatatcagggggtggggaatggaacagacacagaggagaacccaccaagttctgtgtcttcaaacctgcagcatttccaggttccgactgcagagtcctatcaaagtaagcaaaattggaagtgatgcccatttcctgggctttcacaaactttgttattctgcagtctaccacaaaatctgaaaaggcagagaaatgtagctttcactgtttagaaaatctttgtgagtttttcttccccctagggaatggttttcagcacattattcattggaaaaatgaaatctgaaatgtaggtgtattttcagtgcacgtgctccggaggagcctcagcacccttgtgtcttgtctacccattcgctcagtgggcagggattgagcactgggaatgtgctgggtcggagccgagggctggaggcagagttgggaccagccccaggatggtgcctggctgtttgtcccagggctcactggaacagccctcctgggcagcccttggttggacttctttacgcagcccagtccacacctcacctgtgcattcgtcaagccattgagtgcagtgttgtggcctgaatcactccaggccttgctttggagggttgacagtaggggacacggcaggccgggggcattctgggacccaggtctcctgcctatgtggaatactgatgtgtgttgtgtggacaggtcactgatgtgtttaaatgtaaatctgaccttcctttaagagcaattgggcagcagtctgggagcttgagactgtatgatgtggacacctagtatctctttctggaagcttctagtgtataatagaaagtaggttggttactcattcccattgtctttgaataatggggcagtgggcctggattgttgtcctgtggattggggaagagatcatagagatcatagaagtaaccttagagtaaaagaaagtaaatcaaaatgctattctatgtagaatatatgccatcaagggcagagcatgtgggcgtgtggacttgtcatgatgaggagtgaccactggcttccatttcaaagaggagagctggagtgcttctattccacggagatgccccagactaaggtctttggagtcaggctttcattccattcctgggtctgtcccttatgcgtttggtaagttgttattacataacctccggacctcagtttcctgttttagaaatagagataatggtacctcccccaagggtctttgggaggaataaatagaacagcttataatggaatgcctggcacatgttaggcactcagtaaatagcagctgtgcagtgttgtgcgagagcttacatcgagctgttttcccagagtgcattgatcctcaaccgtgttcatgtacccctgcccaaggtgccatattgtgtaatggagatgtgacgtcgaggcgccatgttgcctggaacttctggagtcagccaccttgcctgtggctgaccttggctgtgttcctgagagagtgaggatgtgaaattgcatgacacaaagtcggtcatcttgtgcccgtctcatctactctcactggtggttcagttcttctctgcccctaaattcttacatcccagagcaggttcttggttgagacacaggtgcttgcctcaggtttccttggaaaactccagtggcaccaagcggtcagtagcctgtagcggccacttgcactgttgtccccttttgtggacgtggacgttgactctccatgtctggtctgtgcaggaaagagtgagtcctctctttctcactccagagcctgcaggggtacccaccctcagccgggcagggcaagccaggacagaggctttgagggcatctgaggaggaaactgcaaggtgtgcagtttggcccagcagagagagaccagaatgcagagggtactcagggcaggcggttgctactctgggctgtgtgcgtcatagcgtttgcatgacagacaccagcggttgaccagatgccccatttgaagcccatgtccaggcatgcagtgttgatctctgtgtatagatcgacgtggcttcttctctagggctggggaagagaactgtttaataatgcacagttgcctagcctcaaagatcctttgagaaatagctactctgtgcaagttttcaacaatttgtttagactaatggaatgactctttaaaagtttatatctttacagatatacaagcactttatttctaagcaactaatttaagctgggaaagaagaacgtgccctcatgtgtgtgtaaaacgttagaaagcagctctgttcactgccgtggtggtggaaggcatgtgcaacacagacataaggctatttgaactctttatttgccacatttacaatattaataatagcgtttctagaagttgtcacatcaagtaaaagatcttcattccaggctgtctttaggggccaaattgagactggatgcatgcatttaataaattgtagtctcacgtagtcatttttgtaaataattagtttcagtgaaagaataagttagcatattgtatgcatctaatgttgcaaatgtacatacagcaaactttgctattaatcaacagtcaggcaccgcaagtggggtctcatacataatgaattgtgcttaagcctcatgggcttcttgatagaaaaataaaagaaaacacaagtgcagtaagcttttgaataaaatttaactagattgctctgcatcctgtaattgttttggaatctttagggacctgatcattcatctatagttttggggtgtttttatcttcatctgtcaaatagtagagacttttaatgatatgttaaaatgttgataaaatacaattttccttttaatgatttgaacatttggaggggggaggtaaataggctttttaaggctttctgatctgccaagtatactatttgggttgtcttttaaaaatattttcattatttcctgtatttttaagaatcaattatttttaaaaagaaaaatatatatagtccttatggggaagagttgaaaatttacataaagtgttctctgtatttttggtgggtgttttaaaatactatggtaaatacctttgcagttttgtttaggatctgacattaatttgagccccagatattgagggcatagcgtgccggttaaaaatcggtatccagttttagcaagatacctacgaccacccagaaagtaacttggaacctaacttaattttaaatggcctctttctcctcttcacattattgacattagtacatgaacccgttggtggcctataataggatcataaacataggattcattttgggatggggttgaaggcataaaagcaaggagtgagatttatgtccacctttattatgaaccacacagtaaaagtgcagtaaagatctgctgacttgacagccagagctcctcacagccctcctgcaagcactcatggaacccgtccttctccaggaagacctcctgtttacttctgcgctaggaatgggctgtgctcatcacttacttccctgtcttatatgatgtccttttgtacagaatgcatctttaaaataggccctacaactaaacacataacagtcaatcagtagactcacctgtgataagtgggaggccctcttgtaccagaaagttttaaaaaaaaaatacattactcatacctgtcattgtttgttacgtaaacttaagcatatttttgatgttttgtgcgtgtttattcacttcttcctttcatagttgaacacatcttgttcttgaggttgcgttggaaatcagtagggtggcgcatgaatcactgagaacagcccacggtgtgtggtcagtgccatcgtcatcatcgtcatcagcaacggcagctcaagaccagcaaggccgcggttgtgtctgtcatgagcccgttggcatgccgtttgttttttatctttgccacagttgcactgttgagatccatgtttcctattactaacatcagcacttttaattttccgtttctactcagtttcctaaaagaactatagaatattcaaataattgcatgcgctttgtcaaacgtacatggtcatagtgcccaaacagttgctggccaccacgcagagccacggagcagtcactgccatgttccttcgcagcctcctcggggcctccatgaaacatcggggccaatggaaggcggaagtgctgtttctgatgttgacctgtgtgtttgaccctcaccttcccttcctgcgcagtcggctgtcaactccagaggaagggacagccctgagtcagtattctcaccactaaccgcatgcatttcagatcctcagtaaatgattgaatgaaattaagccactgcatttgtctgaaatacagagtcaaaaggttttattcagcctcctgtttaaaataaaatgatctttattaagagcaggtagcatagtttatttcttttcttcagtcttacccctgaaagaaaacatctgagctttagcaggaagttataattaaatgcaggacaaatccatcaaacacaagacactctgctagagatctctaaatgggacataattgtgcatttaccagtgatatttagcaagagtctccatgcagcgtggataatctttggctgaaggcatgttccttcctacatgagccccggagtctgctgctctgcccttcagtcccgaagcctctcctggccctccacaccaggttctggaagccagaggaggtggggtgctcactagctgggtttggaaaatgttgctcatcacctgagcatctgaagtgctgtgtgtggcgaggccactaaaagcttttcagatccccaccagtttccgtgcaacctccttcacagcctcatggaagccttgcgtccaagctcggcaccttgccagattccagaggaactcagaggagcacctgtctttggaacgaactctttccttgggtgaccctccagggtggtcaggtagcattcccagaccataagatgaaaacgtcgtccatggagagagagaggaggtgttcgggtcacaggagaggcagagggtacacagcactccccatctggagtgtcccacggtcagcccgatggtgcctcagatgtgagtaacttatgaaggactcttggccgattttcttaaatcaaacaggattcaagccaagtacatcgtgtgttaatgtctctggggagtagaattcattcagaaatggacatttagtgattctctactgccagtggaatcttaaggcacccaaaaatctgaatacccaaatctcccagctggctggtcaagttttagaatgttgagcactctaaactgggaagagcctggtagccgtggtaccaggaacactcactcttcctgcttgctgctttcctcatgctgagctgggctgagatcaagactcctggggcacttgcttcctctaccctttgtctgtggccaggtgggattcccacacagtcaaaggaagcccgtgtccaacaggggccatttcccttaaatttctctcatcacccccagctctgctgtgcctcaggtgggccgctgccactcttccttcacgttcttgataatatcagtgtcttgaaaggaagcttcttgcaggtagggaggacgcttttccctggaatagctgctgtgctcatatgagtttgtgctggaacattctaaccacctttctgtgccctggtttgggttgaagggaaggcgatttaaatcaaaataaatctgcaaggcagttcatcactgggacattgtttttccaagccggggaaggcgaatgggttagggcagcttcccacagacggcaactccgggagaatatcaccggggccttccagtctgccgcagccccgggagcttctacccagggcaggtcagtgttgtccggtttgattttaaggaacccctggcattgccaacagttgtgtttttcttaaagaaatccttgagccaggtccacatggctctagctttgctgtgttaaggtgcccgacgccctgttgtcacatgtacacacgcccagcaaagctgggctgcttcacccaccagccaccatcctctcgtgccaagtcaaagaaagtgaaagccaccagtgtcatgatatttgcctcgggattattctgtgggtgacacgtgatgtcctaggagaggcctaggggaggtgcgactctgatgggctctgagtgtttccccaccaatgctgggagagggtcttgtctcctgctgggttcaagggatgggataggaaggggctgaggtgccaggcaaaagtcttgtctcctgcagggtttgagggatgggacaggaaggggctgaggtaccaggtgagggtcttgtctcctgcactggctcctgctggcatcatgagctggcatccgtggcagcccccggagctgcaggatttgggcttccgagcaaaggtgctcccccggcaaggatggggcggaccacagggccggcatttcagtggtgggtgagttgcagggcccctggggaagactgggacgtggcatttccatgagcgtgggctacggagcccgtaattgttagtgtttcagggtttgccagtggggaagcttgaggaactcccccgtgataagcgccgccgtgagagaggccatcaccccagctcttcttccagggccgagcgcggcagggaaggaggagagggcagggcaggagaataaatttcattttactgtagaaatggaaatttgtgtcatggctttaaaaatctggttttatgtgtgtgtttaatgccattcattttaaatgtagtatcataaatcattgcttcagaatcaaagctgtttaattacatttcacccatgaatagttatctaatgccaatagagaaagagttaaaaaggagaactacagagtaaatcagaggttgagatcttcagcacaagcataaaaaatcaatttaagatgaattttactactataaaaattcttcaaatatccctttaagagtgggaactgctaggaaagccagctcacatttcaattccctcagcagcatgagagaaggacgcccgcgtgggcagaggcttggtgtgcaccccgttttgctcaggggtgatgaaggaatcctaactctggagtctgagcagttgctgggggcacagaacctcccagctctcgtggtagaatgccccctctcccacagtgtaccctcgcttccctgagaaaccccatctgcggggtgtgatggccagccagaccccgctagtcctgaagactaaccctgaccttgaggtgcatgcctcgccaaccaatcccacatcccagtcttacccggggaccgtacaactcacccaccactgaaacggcagcccctgtgctccactccatcctcgccgggggggcacctttgcttcggagcccaaatcctgcagccccaggtgccaccacggacgccagctcatgacaccagcagaggtagtgcaggagacaagaccctcacccagcgcctcagccccttcctgtcccatccctcgaaccctgaaggagatgtcagctgagctcttgctgcaggaggtgccaggcccaggtggcttgatcaggggttttgtttcctcagttgaaggtcggggcacatgggccccatcacgcttgctcttcctgtctgggcagtggtggttgacagcagccagctctgcatcactcaggagggagccggggctaaccctcactgcacagggcttccacccctctgttcggccgccttccccagggatcaggacagcaaagtacattacatatttctccatcgttcttcttagatagcatcagtacactgtttattcggttagcaaagagcagagcaagaattgaatgactgaaggtgtgtctctgaaattgaataatatttaagccaagcagaagttctcctttccgtggccagacctcactaacggggaaggaaattgggcagtgaaaagacagcactcccatgccctaaggaaactctgagagaggccacttcgttgcctgctcggcaggcccattctctgcctgcagagtgagcccggcttcccccagggcctctttgtgacgggaccgacaagggtttccaggcagtggcttgggctgtggagacctcagcctgtgtattaagggtactgggctgaatgagggcactgtctgcgtgagttcccttgggcagggatctgggtaaggcggcagtttggagaagaccggggcatgttctgtctggccgcagtgtccacggggtcagcgtaatttagccggctctgctgggcttggttcacaggtccgactgctggtcacagttatccgtggctgtcggtcatcctagtgagcttccttctttttcccttcattctctggctccttccttaaaaccgtcaggatttgtgtgcttggaaacctctgaccaccctcctgctccaccgtgaaaaacagtgtatgggggcccctatgtgcatctcacccaaaaaggtccatttttagaaagacccgaggatctcggcagagacttttacacccacaaaatgctccagcccagagacccagcctccagcacaggacagcgtgtgagactggcccgaggtcttccgtcgccgcccctgctgtcggatgacatgcacatttctgcacctgcaggacctcaaagcgaagtaaccctggacacacccttcactgggtctctttcccccacatctcccccaacaatggaaggcaagcaccgctccacacgaaaataacaacacgggtgcagttctgtgcctctccttagcttctccctgccgccccgtgggcttggtcatggtgtcaccacgcactgtagatgtcgcagacgcaggcccatggccgtgtgtgcccctgggcatgtctgctgtcttctggggaaatggaaacgccaccataggcatttactcaggcagaagctccagaactttagatcccagctttgccgtttttaattgtctcttgttaaaatgtgagtatcccagatggaatgcaaaagaggttcgtgctgctgaggccctggtttcttttctgaatggatgtgccagggtatttccgcccacagtacactttaagccaaagtaatttgtatcatctttaacacaaacccaaaacacgaaaggctgtgtttgtttaactagacgtgtaagctatagttatctttatttccgctttaactgcataagagaggaaacctttttaactataaggaaggtgttcggcttccttttatctcttgcctcattatgtacttttgactttattcagatttgtacaagcttggtttttacctcacaggaaaagcgagaactaatcgctccagagatcatctgagctctttgtgtgaaggtgttttaagaagttgtgactacatcttcttttctaaaacagcctccaattctgtgatacaaagtgaaatgccagttgtttgcagctccggggctgtggtcctcctggacaccagcggtagcaacaggccccatccacacagggctggggagacaggtccccttctgcacggggcccaggagacaggccctcattcatacaaggccagggagaccagcagaatcagcacggggccagggcaacagccccatccacacagggccgggcagacaggctgaatccgcacagagctggggttggagctgagagtcatccctgaccccagcttcatggtcctccagctcttccctgcaccattgccatgttcttactgctgcagccctgcgtcagggcagctgcggtgccttctgcctcttgccaggggcccccagcccccaccagtcacactgtgggccgcactcataggacaaagtgcccttcccgccctgacacgcacagtccttgcccacctttctgtgagtctcagtccccgaggcctccactctgcgtctacgttcacactgtctgtcctacgtccgggatggctctgttgcctcctctccatggactggccgtgcataccttgtgtggacagagttgggacggtgctcccggctgcatcggccgcctgtgctgggccacatgtccaggcaagtgaagccttcactgggaccctcccagagcagcatgggtgtgtcgaggagaaacattctgtagatctcagcgcacgccccccaaggcagcccaggaaggaagggtgaagggcccgcgggagctgtgcgtccacagcatccacagtgcagtgacgtttcccaccttttcacagaagcctgaggagcagcactgtctgcagaaggaaactagaaaacttccgtgctccaagcctgggaagtcccggggaagcatgccgtttgtctggggcctcgagaggcagggaaggaaggaagggagtcacctgaagaaatcggacccagggccagggcttcccacgggggtccacagcacttgaaatcacaacgggatgtgtcatgcactccacagccccaggtggcagcgggagacctccccttcagggccatgtcctcagtccgtggaacacagccccagaaaatccacccctgctggagatggggaatcctttccatgagggcccaccaggtcgaagccacagatgaatgaacaccccaaacagaagcagccacaaaacagtctgaagcgactcccagaggtacaggttcaaactgcaggaaatcaaagggaggagagtgtccagaaagaaccaagagggccgcgcagtagctcacacctttaatcccagcagtttggggggcccacgcgggcggatcacctgaggtcaggagttcgagaccagcctggccaacgtgatgaagccaacatggagaaaccccatctctactaaagatacaaaaagttagctggccgtggtggcagtcgcctgtaatcccagctactagggaagatgaggcagaagaatcacttgaacccgggatatggaggttgcagtgagccaagatcgagccattgtactccagccacggcaacaagagcaaaactccgtctcaaaacaaacaaacaaacaccaggaaggtttgagaaagaaccaagtagacacaggcacacgaggcacagggctgcccccgagaggacagactcaccgatgaaggaaacacagagtaggccctctggagcgtgggaatcaggggactgcaggtaaaccctgaggaatcccctgaacacagcacacggccatggaggaggcagaacgcgtggatgtggccttgcgttgttggactcggggtggggtgggccgtgtggtgcagtctaatgactgtgtcgatatttctgggaactgttttcaatagtgagtgcttgatgatttaggtgcagccgtgccatctgtaagtcttacaaagggacactgtcacttgggttgccttgcgctgtgatgcagactctcagaacacacgtcctgggaggcctgaaggtggagagtggttgcggggcctcggtgcgtccttgcctcaccagtccccctttctgctgcacagctagttgagacgtgtgtgcccatgaagcagccacaggtgtttgcccgtttagatgcagtaggtgtttgcttttccgatgtgtggaggcagggcccagaggtttactaagcccctgttctcacttttgcagtgccgtggaggtcccagcccccgctgcggttctcggaggtccggagcccctgatgcagtgcacagcctggctgaatgcctatttccaccagcccgaggctatcgaagagttccccgtgccggctcttcaccatcccgttttccagcaaggtcggtaactaagccatctgcggtgtttcctttggggagcttgacttattaacgatcgctgacatcacagttcattttattgagtataccaacttggtatttttacatcagctaaacagaggcagcgtttggccgagctggagggacgggggttcgccgcctccacccactccaacacttgtgttagttttggcacagggttgcataattcttggcaaaggcaataaaaatgaagcatgcagatcgactcttgactctcgctggctgaaaggtttaaataggaacacatctgaatggcagtaaatttttcaataagcttattgtgaacttcaactatctgcttgccaacagcacagaaaacgagacttgtgcgtggacatttagctatttccatacactctgttggtgacacttacatcatagcaggtagcagcattggagcttctcaaataattttacatttaatttctcaaacgtaccagagttagacatattctttcttaagagatgacttgagaacttacctgtatgtagcctgcttaaggcttgtgataatctaaaacatttcccagacatttcttttaaagcttgtgtttggctctgctcaatacagaaattaattacagcaactaaaatcattccagacacatgccagaaatttattttgcatagtgagtttttcataatcatttttgtgtataaatgaacatatattcatatatgatgtatatatggagttgtacacttatatatccttaaagggaaaaattaccttgagattttagatgtggtgaatttaaagcaattttgaatttcagatcagatttgctgggtaagcttaacagtattctaattgctgcggtgcttctcagcacaaaacaaacttgaaaatggagagaacttttcaagggaagcaggtaaagaaacccctgaaggttgggctaatacctgagttcactaaccaagtcagacaggcgaacatatgaagtcatgagcacgttttgtgcataatgaactgaagctgtgcagctataatgaaccaggcaccttgctgtcctctgaatcatacagaactgtctccagaagggttcagtggggatctctaggatgggcagataggaagctagagtgggtgggcctttacatggaaccacaaacgtccaagaaacctctcatcatctctgcccaccaatgggctgctgccaggacaaaggcactaccaaagcctcctgggctgccgccagctgggggccacctctccccagcgccacaagccagtgagccaattagacggtgtgggggaccttgctcactgtgcacctgatgggccgggcacagggcaggatgttgctgaatggcccaaggaagtcagagattggttttgtttattaaagttggggcttggggatcttagagtggtgaactcttctctatacgatctctttttgggggttcgcctgccaggaggagcaaggctgaagagctgtccagaggcttttcttctccttaagcctgtgaaatatgtgagctgaaatgtaaggtctcaggacagaaaagttctcttacaaaaccagggcaggaggtatctgcataatcatatggaggctgggagaatgagcctgcaaacccctgaagtttacctaaggtttgttgggcaacttcatgaaaaacataggggcaaaagttccatgaaaatcgttagttttctccaagtcatatggtggccctggccatggagctagaccctgctggcctggtctcaccagggtccagagagtggtgtgctctcaggcaggccaggaagaaccggaggaggaggcctccgcagctgctgacaggagctccagggcaggagtggccagcaaggaaggtggcaccggaaataatcagacactctccaaaccacccctgcaagcactgaacccccgctgagccttttccccctcacttctgcccatggcagtgtttgctgctcctagagccgaggacaggcgggcccctggggcttctcagtcaagtccctagtgcttaagcagagttgggattggccacacctacccctgcctccctggctttcagcccacgccaggccaggctgcttcctgggctggcaggtcatgataggtcttggtgaccaggaagacctcagagtagccgccaggatactggtaaaggctgtctggctcccccgtggccctgcccctcttggaaagccctacagtgcgggtggatacctctagctgggacgaggtccactccagccaagttttgggatggtagtgcgacagccgctcacatccttctctcttggtgttctagaactctgaggctggctgcagacccagggtgctgagctcagggccttctctcgagggtaggggctggagtcccctgggccaggcctgcctgcggatggttagtggttgctgtgggggctgggattccccaccacagcatgtgtaagccaggtttttaacatttagctcaatcgtttactcctgggcaggggccaggtgtatggattttactgtttgaagaaggggaggtggatggtggatggttgctaacagggagttaattggttctcccagatgtggatacgcccctctctgtctggcatgagtttggtttgctctctgtccaggttgttatcttgtaacatcagtgaaatcaacagtgagggggcaggtcttctagaggaaaagtcttttgacatctcagagccgcctggaagctgtggagtaacagaaatcaacctgctttgcagactgagaggagcgggtccattgtaacatggaatgaacatttccttgaccaattcctttttctgcacattttaatttctgtatatgtttaacatacttttgcatatcatttttcaccatagtctcacttctgagattgagaccaggtttatctatttcaacctggtttgtctatgtcaacatttttaaaaatgtgattgtatttgagctcatccttgagttccagcacattgaccatttctttctgaaggcctggctggtaaaacttctgactgcgcagtaccaagccctcatcccttcctcaggcctgtcctgctgctgaaagaccctctctcctgcacacggcctcttcgcggtaccacctcaccttccaggattcctctctggaacgaacatgctgtttgtgatttgctttttaaggctaaccacaaaaatatgcattacgttgaaccatatgaaattgctattttttaggttaaaacttatcaaataccagaaatttcagatggttcaacttcttatcttggggaatttccaaagacaggttagtagctaggtagctgttgaagtatttctgccaagggacagtgaagctgcctttcccgaccgggtgtccggaggtccccggggctgcctcattgtgaggttgggacaggtgggatttcccagtgggagggcgctgaggctctggaaggaagcctcattgttctgctgaagggattaagaggaaagctgagctgtccagtgaagcatattctaatttctcgttcaagtgttgttttagtcaggtcatttcctaaaataaaattagtcaaagttttcttggtttggggttttttggcttttttggtttgctattctggtttttttaaagtgtcaacaaaatccattttctagctactgtgtgaccgagggctagcatcttgtcgtacaacgtagctttttaaggaggtaattttttcccataagcctctcgcaagggtcagctttgtatttatttctaattcatttttcctcaagaaatacttatttaatgaagccattatttttgaaatacatttttacttttttcttttataatgaaatatcatttaaactttgaacactccctgatttcttagtgtttatttatgaaaatgtttagcttctttatataatgtgccttctggagaagctgtaggggtcagcagccaatgcagctacaagaaatcctttctaccttagtttgccaaaagcagctttttacaatgagttcaagaaaagcagacctacggaaagcgaggatggactttcagatacagaacccatctgggcacgtcctcaggtccctgagccctcccacccatggaaaccctgccagcaggtatggctgaccccaggctgctgagggaggtcctgccaaggcaggaccaggccttggggctgcccacgcgagactgtggggagcctagctgggaccccagccttctcacagttgaaggtgttcaacggacgagttctgagttttctttgtaaagtgactgcaatgttcccttttaaatgaaatatttaacactttaataattccttcgtcacagctattggcttacagctatgaaatccagttgcatgacagcagtaaaatctcccttttttaacacctgctggtagaagtaagtttttgtaacttctattatagagcctcagaaaggattcatatttttgtatttttgtgtctccatcgaattcctcatttcaaaagcgcctctaacaaaagccctgccccagagttaagggaaagggccttcagggtgaattcgttaaggttcccaccgtgtcctggaagatgggccctctttgctggtgcttctagtgaggactgcttgggtcctggaaggggcatgtcccgggagaggatgacgagggaggagaggagaagagagtggcgtcattacttgggtcctcaccggagccagccctttaagattagaaatccttcttgaagagccaagcaaaggctcatccagccccctacaaccccatcctgctgcctactcacatccaggaaagagcccacccctgatgggtgcccaagtagatggcctcccctggaaagaggcatattagccctcctcacccgagggtcctagggcccgtttgggtgttcttaaaatgtgccttataagtcgtgatccagcctgagtttttctacagagacactgcagccaagaggggatgtttttcttgtagcttccacatagatcacggcagcacgcaggctttgtcctttcagcactttgtaccgatattttccctgaacttaagaaaaaaattaccaattgaaagagaagagaatagctaaaataggagatgcatttgccaccacgtgtgggtggccaccgctgttccccttgattttaaacgagggctcataaatattgttgaccttgctgagatattacctggtggagctggaaggtttgtaaaccttcttccgatgcccgtttattgattagaacaagctaacaacactgcacttaagtggaaaaaacagctggtaaaaatgtaattctttcagccttagggctgctgtgctccttttctggagagcaaatgtggaaatcaagatctgtggccttctggaaccttcaccaggaaaggtgaaaagaagaagaacccatccacagctgagagtggatggcaggcccgcgggtttccaggtggccagtaggattgtccgatgtctggaatgagtaccggggccgccaccaggaacacttgtcatttctaccatggagaggaaagcccagtgcatttctgtggttcagaaacttgacacaaagagaaaagctggaatgtttaaaagcaaaaatagggcagagatcagtgaaagtgcaggatgtgtgtgaaacaagggtagagtgagcactggtggggatggaggtggtgaggggtcttctgagctggggacgtttacttacaccagccctgcctcccaagaacccatcccctgtgggtccagaagaccagatccccgccaatgtccttccctttcagagctgtctggaggagcatgccactagttcccagggtctcatctgccggcacacggcctgactttcatgggaagtccccattgatgctgttcccttcccagtgagtgggctcccgtcacccgtcctggctcatttgaatacctgcatcacctccagcccctcagcagaacaagaatgtcagataatccagaatgctgttgagagctgctccaggttgggggctcgcagccccagcatccaaaagcctggtttcagcagggcatgcccgcagagcccctaggcgccccgagctctcctggtttgcccgggctttgcctgcacgggctggccccgtggactgcctggccaggccagcccagtaacagcgaagcacaccactctcagctcctgagcttggctgaccagctatactctggcatattggtgaatttcatgggccaaagaacctgaggttcagattgtgtcttagttcattgtttcatatttgaatatgcagtttcctacctagcaattgtcatgagtactttcttgctgtttatactatgaacaacatcttgggctaggagagagtttttaaagtttcaacaatgattcattcaagcactttcctttttcaagttactcatatctcagttcattcaatggggttgggggatttatatcagaatcctctagacatttcatttataatattctacctataaatttttatacttcttacccctcctcaagatacactaaaaccttagcatgggcacacgcacacacataccctgtttctgagaattattgttctaaaggaatttatcaaaatggatgtagctcctatgaatgcttttgctgtgtgctttaccctctactaagcctaacattcctaatttaatagctatttttgtttgagacttaaaaactgtgcgcattgaaggaatgttttgccgttgaggaaatgccagcccctctcctaggaaaggggtgctcggctcctggtccactggcagtggctggaacagaaccacagcctgctgaatcccaggaaattcatgatgtccctgtgcagagccctctgactaatcagcgatcccacaatgcctgtagcagaagcatagttaggtgagagttttatcctgaatgtaagaggtggccaggtccttagttccctgaggttccgtgagtcgggggtaaaggaagcagccctcacacagagtaatttaccaagcctgagagggaaccaagaggactgtttgagagtcagccacttccaaaccttggtggacataacgagggtctctactacaataagcaggacttgtaatatgtaaaattattatgagtgctgcttttatgggaaaatattcacattaaaatataatttaactctggtgaagtaattaaacagtaaatcagtgatggcttctattaaaaattaagtcatcgtaattatgtgaatgcctttagaaggattttccgcagtgtcctggcgttggccttgagtggacttctcaaaaagtagaagtaaccaggtttctgcctgtgaggaaatgtaaattgcatcattgcttcctttaataaattttcattttaaatgggctttgaaaaataggaattttctctctgttttaaagtaaaaaacacacttttcacttaaatatgtttctaaatttctatttccactgtagtcattagctggacatgtgccgctccaaaagagaatgttaaccttcgtctcttttgtcgtcataaatgcacattcatgttttacaggtaatgttcgtgcatttgaaataattccagcaataataagtagaattatctccactacctgtgtttatagagaaaatgatgttttaataacgtgtgcatagaattggactatgttatcaatacgttaaatgtgtaaatattagtataaaattaatagtgataatgctgaaaaactattgcaggagctgaaagtgtaagaactatgacttaatgtaaatgctttcacacatacggtttttgcctgcaatccttatgttcaggctgactcggaatataagattcatgagtctctgtccctctttatatgttgtttcatgtgtcagaatggaaaaagcaaatatttacgtagagggaactcctccctcctgttggaggtacgcggcggtcagtgtagcttctgaggccgcgtggagatgggaacatcctcaagacagagcagacttcctggaggctcagccggaacgtctccagctctgtagcacgttttaattccatacaagaagttactcccaaagaagtaaattgaagaacgaaatcgaggaaaagaaagtccttttttgaaagctcttaaacacttgactccgtttagttcggatcaggccttctctgcccttccaaagattcaggttaggtattggtaacgcccaggaagcacccactctggcgagcccaccctctccgccagtaaatatatacagtgtagctgttactatgacaacgacttttttttcttgagtactgtttttaattgttgcacaaacacatattgtgtaagaaaggggaattgtccatagtcttccacgtgtggatgtgtgtgcccacactgtctgctttctttaaaaatgcacattcctttctggattgggctccgcgatcccccgcctgccaagcaacctgattttctcttcagcctttcctcacttagatggttttagtaagacctagcaaccgagctcaagagacacgtcaggacttactgcttgcccaagacatatacttttcatagaaaattcgcgtctcttcctcttttcagaataaaatatgcaagaaccaacagaaatggcacattcccctgcttttccccaagaattgggcctttgatgttcaagagcagctgatattaaaggctatccctagaaggctgtagaaactgtacctatttatgacaaatgtaaaacagcacaaatctagctgaatgtgatggtatcattagtttgtgaatcgcatccttgaaaataactgtgaaggagccaaatcggtttaaaagaagataacaaaatggtttaagctacttaggttgaatgccaattatattttaatattcaactgagcatattttactaagaaaaaaggccgcattgacgcatgcataactcattggcagcgtcggccagctgtgccgctccactctccgaatcactttgtgcattttagtagcatggtaatttagtagaggactacctgagtgatggcattttcaatgagcaggtaatctacagagaatttttatatggttatgagttctgtgcttcagcccggcaacacaaaaatacatcaagaccaattacggtatcaactttcagtgtgatacccttgccacgcaagtgcatgtatttctgccccaggcatttcaaattgcatctaatttgaaatctttggggttttaattaaatttcagaatatatggaattcttcattagtacctgctctgaatagcagatcatccttctcccagtctctcgttaaagaagtaggctgtggtaaatagcgtgttcagtagctgatcatttgtgggacctgggtattggaacagaaatagtgaaatgcaaaataatatcaaaaagattattagtccagggagagtctcttgatttgtattttaatggaattttacatttctcttaatgatttgcaaattgtcctctgattataagatgcattaagcttttcattttaatggcaaagacacagccattagcagaatttttttttctgtcttctttttagagtgcttccctgcagcagataaatattgaaaccattaacaccttttgatgtatggtacagtctgcatcttagacccacacatggctggccggctgtggtccctccgtgccgcacacctggccggggaccctgactcttctctgaggacagtgagcagcagtaatgcctgtttccttttctggaaaacaggattctttttgaaaatttcatcagaaggtggtgtttatttgtattaaagcaatgcatttaaatattattcatggcccaatgtgtatttaaaaagctggtcttaccagtgttagggttgacggtgcccacagctcctgccttgctctggtctgcggggctggccttggtgattttggaaatggaatctggccttgcccccaggatgtttctctgtcaacccatgtgctgtgagagacacacagagctctttctgtgttagccagctgaccacagcacgaccccaacgtggggacacttgactttggtttggcctctgagataatgtcttggttttaaggccaggacttctaatgccctagaagatgaatatgatttacacgaccagagctacaaggcaaagctcatctcttctgcttcatctgctgaatgtgcacagggagctttaggcttcgacctggcatgcagtgacagtctgtgaaggcagtggcgcttcgggctaggtgtctccttgtgtcggagacctgtggaatccagcagctccgtctgatcgtatagttaggaaaaccaaggggactagagaatggcactgctgagtgcgggcagtggtggctgccccccacccccaccctgggcaagtgaggtcaggcctggccctgcttgccctccatttcgaagggcaattcttcactccaggcttgcacagctgacccgagagtgagtgtctctgagcagctgtggctctcagtcacttaccccctcaccttctcacttctcttcatgggtcttccaggatctgagggatgaagccagacacacctcctgcccttcctttgtcctctcctggtgagtgtcaccttcccgggctgtcaagagctggaccatgtgcccactcaggtgtgtcaccttcctgggctgtctagagccagtctgcatgcctgctaaggcgtgtcaccttccgctcaggtgtgtcacctttctgagatgtctagagccagtccacgtgcctgctcaggcacatcaccttcctaggctgtctagaggcagtctgtatgcttgctcaggcatgtcaccttctgctcaggcatgtcaccttcccgggatgtctagagctagttcgtttgcccgctcaggtgcatcaccttccgctcaggtgtgtcccctttctgagatgtctagagccggtccatgtgcccgctcaggtatgtcaccttcctgagatgtctagagccggtccgtctgcctgctcaggcgtgtcaccgtcccaggctgtccagagccgatctgtgtgcccattcagctgtgtcaccttctgctcaggcatgtcaccttcccgaggtgcccagagctggtctgtgtgcccgctcaggcgtgtcaccttctgctcaggcatgtcaccttcccgggctgtctagagctggtccgtgtgtccactcaggtacgtcaccttcccaggctgtctagagccagtccgtgtgcctgctcagatatactgtcaccatgtgggccctactcttgtgtcagggccattagctggcacatgctgtgtggttgcctggtgcgcgctggggcaacctcgggaaacactcttagcctttgtattgatctgtgcaggctgccaaaacaaagtgatgccaactggggtcttatacaacagaaatctttctcagctctggagcctggaagtccgagaccgaggtgcggcagggtgtcagctactcagaccaaggtgctgaggctgtcctgcttgccctgcagatggccgtctccttgctgcgtcctcactaggcctttcctctgggcgtgcatcgctcgggtctctatatcataatctccccttcttagaaggacaccagtcagatgggattagggctacctgaacaaccgaatgagaacttcttcacctcttaaagaccccatctgctgatacagttgaaatgccgagggtcagggctgcaacatacgaattttggcagaacatagtttagcccataacaccctttccgagcctctgattatctgtctgtaaagtggggacagtagtaacaatgtgtaaaatgtcatgagggtaaaatgaggccaccaaacagtcagcaaaagaaatacctgcttatttcacagatagtcttttctccaaaatcccagtggtagttagcaagtcaggacagctgactccacctggtcctttggaactcagggaagattgggccgttattaggaagtgctgctctttgcagccaacagaacttcccaaggacgcccgccctccgcccttgcttgctatgtgtacgagttacaggaagtgtggctggtatagccccgcagctgttcagaaggagtgttttggtttgtcatctccacatgaaatgaatggagccaattcatactgtaactgagaaaagaacatttttcaaccattatttcttctccctactcactgttaagctctaggccacaataaatggctgcctgctgggactcctgcactctgggatgacacgttcaaagcgtgtgcccatgtaggctgctgcaagagggtaagcatgattggagtggggtcactggggtctggggagccagcctcggcccctcctggctcagcacagccctcgcggccttgggggcccacagggtcactctcccccaaccctcccacagcaccgggctgtctgctctgtgcttcactctgcactagctggttcctgagtaccaggaggcattctctgatatgctatggatacagttatggacaaaatggactcttaggaaggcagcaagtaaggggaatggaggggcaaagagcacacagctaaagattgcctgactcaactgtggtagtcactggtgcactgcaggttggcatttgcaccctgctagcatgtgctcctgaaactggggccggagagctttcttctctgtctgagcactcagagcagtgcctgccaatgctgtgacaatgaacgaatgaataagcaaaatgtcaacccattttcagagttttgtttaatgtccctggacctggatctctcttgagagtgagcattgaatgggccttccctgcccctactgagagctcagggcatggaccccaaacgcttgggtctctcctcttccctcttctgttgtaaatttaaatgtcagggggaaaaaaaaaaaagcaagaaaaatatgtaaataaatacatttgcaatcatatgttatcggatgagaagggtagcggtttcaagagttacattcagagtaatcgttgagcacattgatggcaagttgatagtttcgttattatgaaatatttactttggacaaaggagtattcaaaactgacttacgaggtataaataataaaggacaaagtcatatatatgccacccaggtgatgtaataatttgttttcttcccttctgtcagtagacatttgggttctgaagtttttgcctttaaaactaatgatgttacagatattctaggttgtgtgccctagtgctccagctggctggaattcatgggcggagttcgcgagaagagggaactatacagagaaagaattccagaggtctgcatggtatcccattgagtctgttgcagattacaaagtcatacatgcatttgtaaaccacatgaaaccagacaactattggggaactataagttgaacaaatttcagataagtgaacctcactagaactagaaaatatgtggacaagtatgaaaattttcttctattattttatttaaaagatgattaactgttcatgataaagttaataaagatgtattttgtagtttataatacacgtagaaggaaaacatatgacaacaatagcatagaagatgagactggggaaatggaaatacattgttctaagtttcttactttatgaacaagtataatatttaagggcagactttgataaattatgaatgcatattaaaaatcctagaataccagtaaaaataaccagaatctatagctcatgggccaacagaaaagataaaatagaatgctaattcttttattagaattagcatattagaatgctaaaatgtaaaagaagatagggtaaagggggaacaaagaacagatgggaaaaataacaagttggcagacttaaacccaatcatattaataattacattaaatgtaaatgttttaagattcaaataaaaagacatagattagtagactggtttaaaaagccagagcctgttatatattttctactagacaaaaataatgtaaaatgatgacagagtcctatgtaaagatggaaggaaaaaaaaaggaatacattgacagaaagatataagtaaaattgtatttattttcagatcacataattatttacatagaatatcttgaataatgttgaaaataactattaaaaccaataagtgaatttgagaagtttgaggatacaattttaacataaaatgtattctatttttatataatgtaattaaaaagtaaattataaaacagttgctttatgtatttaacattagcattattaaagattattatttaaagatatgcaaggcctctctactaaacagcataaaaacatgactgaaagaaattaaagaagacctaagtaaatggatctttattagttattggaagaggcggtgttacggagaggtcacatctacacaaattgccctctgcattcagttcagtcacacttttaaattatttcaaaatgcaaagagcctagaatatttaaaacaatcttgaaaaagaagaatgaatttgtaggacttacattacctggtttcaagacttcctacaaatctgtggtaatcaagacactgcagtaaggatcaaaacttagaacagtgcaacagagagagagaccagtgttttttcagttcttgtatctttgagaaagacacaaagtagatcaatgaggaaagtaaagtcttgttggccaggcatggtggcttacgcctgtaaccccagcactttgtgaggccatggcaggcggatcacttgaggccaggagttcaagaccagccttgcaaacatagcaagaccctgtctctactaaaaacacaaaaaacagccaagcatggtggtgcacacctgtaatcccagctactcgggaggctaaggcatatgaatcacttgaacccaggagacagaggttgcagtgagctgagatcatgccactgcattccagtttgggtgacagaggaagactctatcacaaaaaaaaaaaaaaaaaaaaaaaaaagtcttgtcaactaatggtgctgagcaactggatatccatttttttttccattccattttcagatcactttaatggttagaaatttgttccataacttatttatttccataggtttttggggaacagatggtatttggttacatgagtaagttctttagtggtggtttgtgagattttgtgcacccattacacgagcagtatacactgaacgtgatatgtagtctttcatccctcacccacttcccaaccattccccctgagtccccaaagtctattgtgtcattcttatgtctttacctcctcatagcttagctcccgtggataaccattttcagataaatattattcaccatgaccttgacctcacaccatacacaaaaattaatctgaactatatcatatacctaaaggagaagctgaaactctaaagctcttagaagaaaacatgagtatttttctgatttgggtaggcacacatttcttataacaccaaaataaaaaacaatgaaagaaattattaataaattaaactttattaaaagacttcattaagtaaatgaggaacaggccacagaatgagagaaatttttacaaaacacatatctgacaaaggacttctaagaagggtatatgaagactctgataactccataaaaggaccaacaacccagtaaataactggacaaaatatctcacattttcatcgcaaagacacataatacacagattggcccctgagctcatgagaaagtgctcggcatcatcagtcattagggaagtacaggttaaaaccacagtgaaagacatctgcatatatcccagggcagctcagatcagacaccaccaagtgtcgcagagactgccgcagcctcgcctctcgtatacattggtgggtgttaaaatgttgtaacctctttgcaaaaggtctagcagctgcttataaaactaagtgttctcctaccccgctacccaacaattccactctagggcatttatccaggagaaattaaaacctacgtccacaaaaacgtattcaagagtgttcacagcagctttgcttgctttatttataattgctgcaattgggaattgcttgtatgtccatctgtaggaaagtggataaattacctgagggatatccatgtagagcctgttcctatctgtgaacttagcattgaaaaggaataatccacagacacacacagcctcgtggatgagtctcggtaacgtcatgctgagcttaaggagccggacacagcaagagcctgcctctgattatatttattgaagctctgcagttgccaaaaacaatctggatagggaaaagttagaagaggaactgcttctggggttgtgcaggcagtgagaaactgggaaggggcatgagggaatgttctagaccatgacggccatggtctatatcttaacaggttaggtcacataggtatctatctgtgtttgtcagaattcatcaaatgatgttgaagatggtacatttcactgtgtgtgtaaattccaccttaaaggaaaaaagaaccataaatggacattgaactcttaatggtatatgtgctgaaggacttggagagagtacactgatgtctgcagcttattttgaaatgcagcaaaaataataataaaatggatatggggtggagagatggatagatatatgataaaaacaaatacaggctaaaatgtcaattatatcatctgaggtataaagctattcattgtaaaactcttccaactctatgtggctggggtttttcataatatgttggaggaaaatagtaaatattatggatttttattccttgaaagcaaatttgggggaaagatcatgaaaactgtggcctccttatcccagatggtgaagatacaacctagtatggcctcagcgagatactgagtgcactctcagtttgcacctggagggcagggtgagtctgggaggtctgtgaattgtcagtggacctcccggtcctctccagagccctgcaggatcgggtggatacactgacctgatggacaggaagaggaagcctctgggccagacctttggacactgttgccttactcttcttctctccagccaagcgagtggccttgggaggtgagtgtggtgtcgccttgcagccttgcactcagctttgcagccgtccctgtccagccagcttccacgcaagtggaagacacacagaatccacagcccaggcagctgctctcacctgtgtgtggagcacagggtgcccatcctcagagaccctgcccagcccctcgctgccatcccctctgctagaccaggcatgtgggtcagcgctgccctgtctggcccgaagttccatgtcagtagccgtggatcaaatgatgaaggcagagttatctaattacggagtgttttctctaatatttccacagcctgctgctgtcatggaacatggagattcattacttagaatgtcaaattaatagcgttcctggacctgaaacatcattgtgtcaacttctccaccttttccaggtggtggtttgagtttgtgcacatggcatgcctattgccccagcacggccacagctttccaaagtgccgcccagggctggggtctgcccacttcctcggaggtctgtccatgctctgggcaggctacagcctgcaggatgcagatgcccagattggagcagcaccctgtgccctcaagaggagcacagctcacacatccacgtaactcttgtccttagcagtagtgaggggcttctgcaggcagaggagtcggctccacggtcctccatgtaaactaccgggatcaggagcctagggttcaattctgctgtcacgtgtctgcactgtagcctgttctgccttctcaaccagccccttctagctcctggggcagtttctctttagctgaaacttcccttcatcttccaccaataccatgttgcgttacagtttccctcttctcacagaacgagccttgggagaggagtgtgttctgtcacacagcctggccatggctcaggtccacaaggtcagctccagactctcagtgcaatgagggaccatgagtagcttctgcttgctgagtgctttccaagtggcggggcctctgccaagtgctttgtgatcctcatatccaagtggaggaaactcaactttagacagtgactgagctccaacagctgatccttggcacagatgagacttgaacctgggtccttctgactccagaatgcaagctcataggaaggggtaaatttactgggaagatctctgctggccaggtccttgatggcacagggccacgtgcaggtggagtccaggcgagacttgtccttgggaacacgagctggttttgaagctactgtagtcctgggttgcccgcccatgggtgttgtgaggacgctctccagcatcactgctgcccacgtgccctgaggggtcttaggttccaccccaggtcacattcagtgttttgtctgattcttcaccagaagggagcagcctcacgcagactgagcaggaacagtggcattggtgttttccacagatcttttggaagaatttgaacttctgatcatgtatatatgacactttttaaagttttaagtgatgcatggaaacttgatattgtaaatttaaatatcagtcattttcagttttgtctctttgctgctcaaaatgaaaaatcttctcactcttcccctactccataatatggtcatggagttttgacctaattaaaagcatcagaattaagttgctaagtttgaatgggaatgtagtggtgtttaaggggacttaggagaccctgtcctcatgtcctttctgtcactataggttttgttactgtttaaagtccatctgcccagcttttagataattaattctaattttgagaacttgggagatgttgcaaaaactgttggagctgattttaagattggtgtaatatacctggtattactagagtcagtcagtgaagtcatagatgaagttgtgacatttggcccagggttccctgctgaattctgaaataccatgatgctatcaagagaagagccatgggttagccagtctccatgtgacacccagtgagcttcactgctggtactcccactcttgttccttctcggatggagtcaggtctggccccaagctacagcaggatatggaggaagtgatggtgtgcgacttccgaggctaggtcataagaggccttgcagctcccagtgtcctcagtcacctgctgtgagggcagccagtaccatgtcagaggacatacaggcagccccaggagaggcccatgtggtgaggagccagggaagtcagccctgttggaaatagatcctccagccccagtcgagccttcggatgagtgcagctatgcagaagaccccaagtgacaactgctgagcccgacccttctgaattcaaggccatgaaagaaaggtcatttgtgttgtttggggccacgaagttggggattatctgttacctgtctgtagtgactggcacaagatgtgaggcactccccagtagttacttattcatcacacttcctttcatagctggtccttgtcctttcctctggtgtaaagtacagactgtgaagacccgccctctgttccttccagctgtttttggctgtctcttgtgtacaaatgctgtaggagatgcaaaggtgactcgcagcatcccccaagaatgcctgggcttggtgctgccagaaaggtatatgaggagccccgggtaagccagcactgcaggcagcaaggtagccttcagctgtgtgggctggggagaacttcatggaggaggtagcatttgcaccagactttgaggtagatgggatttgaacacatggagtaaggggaaacaacatagactgaggctgggcctgtgtgtgaaacagcaagcaatcccttctggctggagcaggggagggtgtgaggaggggctgccagcctccctccaggccaagaaggccatcaggtctcactgggggacagtgaggagctactcaaggcatgatgggagccaggctggacttgaacaggactcattggactgtccaggtgctgggtgagagagggaggaggggacatggagccagcaccaggggacaagggggacctgaagcagctgtgaccgtggatggcagggaaaagaagaagaagggattcattttggcatagagttgggaattgcagcagtcacttgagaatgacagagatgggaaggttagggattagggtcagtggcatggacgtgagcgatgaacccatacaagtgggtgagaaaaaggctgaagaaggtgaggcagcatagggagtgggtgacgccagtgatggctgatgtggtgtgaccagaggaaggggccaagggggcggaccccgcagggtccataatggtggtgattgccttgggggagttcaggggtcgcagaagaggacctgattatgccatcctcacttgtaaattctgcttggtctcctgacgctatcagggtcagacccagccctctcatggcccgctgtgtggcatgtgctgctccctggctcttgcccatgcccctcctcctggccaagccacactccacctgcatcagccataggccctcccgccactgcccgcctgcaggtctcagcaccagcgttgcctccccagaagcctccctgaccatggtccctgttgtgtgccccaccaccccctgttctctgtccccctggtattggttcgtctgcttgtggtaactgctgaatgccagccccaatgcccccgcctcccatcgccatcagcgtcaccagcatcacaaaggtcagcacgaggtagctgctcacagaatatttattaagaataagaaattaataaagggactaattggtaaatcttaacatgcccacactgggtcttttccccatgtcacgtgagcctgaacttggaacatccatatttccagaagacatcaggctctttctctagtgaccttagaaatccccgcattgaagggagatggccctggcatggggcccctgccactgggtggggaggggtggggaccagactgtgccagggaccccaaggagttggagggtgcagagcttcttgacctgagtggacagggagaccctctgagctcatcctctgtaacaggatgagcatggactcttcaggggacaaacttcgtgcctcgtgtgaaaaacgaaagggccccacgggctgtgtctgatggtgttacccactgcacagggaaggcacctttgcaccccagtcccagccaggagagcagcaggtcgcaatgtcttgctagcctggcccctctgccctcaatgactttgcaagcaccttggcctccctgtcccactcccctgccggcacctgcgtgtccctgtcctgccgagctgccagcctcacctgcgtgcctctcgtcctcatttgaataggtgagcaaccaaagtcagctgtgccgttggagccggattccatcactcaaaatccaggcacagctccttttgaattcctcagctgccccgaggcaggggctcaatgttgatactgagattaatccccaaagagcttctcatttctctgcagagaaattaaagcttgccagtttccttttgcccgtccttctgacagctctgtcagtaatgatatgcctgccgcgtggcataatccgtgtcccgtggtaaagaataattcattaagaaatttagggcccagctcctttccgttgggttggtcttcaaaagttaactaatggcggcagcagcacgatgatcaatggaaaattattgaacagagctcagggctgcttcagaccagctcaaggagccacctgggtggagagcagtcagacccacccacccccttagatttgtcagcattccctgaaacacagtcagacggtgttgatatgaggtgtctgctgggcgtggacagtggggtggatggggtactgccctagtttgggaagcagcttatttttagccttgtagaagcagcgtgaagtgtctactggtaaagccagcacgacttctcctcccttctgaacaccagcaagaagcttctagatgtttctgatgaacaaataggagttcctgtactggctgagaggggcagcctacatacttaggttctttggggaggtcagtgcgtttttagcaaccattggcgcattgagcatgaaatggcgtggagctgaaactcactaccaactgcagtgaaaccaacaaatggaagacgtgaactgatgctggccctaatgactctgggcaagacgagggacattattgttttgcatgcattgataatgtgtcatctggaatcagattttctactttcatgttgttcgataacaaggttgtgccctgtgagtctgggattgtgtgaggcgagcgtgcgtattcattctactgcagaggaggctggggaggaatcagagcatcctgtgtctgcaaggtctggcgtgtttctaagggaaggcagagaaagccagtgctccaaagacagcagagcagacgcgaggtttgcaggcatgaggatgacaaatgaaattcgcagaattcctcagacttgatttccctcccttctataattaacctcagggataccttgactgcgctgaggtccatgtgcttgagcacttgctgtcctgcttgccctgccctcctctgatttttttttgcacagcatgattctatttctgctattgttcagaaaccattagcacctattcagaagtcagttattcagctttgagctgaatgacaattatttgaatggtaaagggtgttaatgtataattattcacattcataccaggacagtcacagtttaatcatttctctgtaggcttccttaagtttgtgcttaaagtcttaggcataattcttttgttaaataagtttaggaggctctaagtattgggaaagtgagtataaatacgcctctgggggagcttcaaggatgtggtgcctcacctccaggagcgagcctcctaggtgaaactgtcactaggcgccccacacttcagccaggaggaaggtccatttccgagggctggtagcataatctggcctccaggtgagctctgaggtcgtgttctggcgtgcccaggactagatggagcctaccggggcattcctatgtgtgacacagagccctgccaggcccggtcgggctcagagtgggcttaaattaacccttcagaccctcgattcctctggacccctctttaagatgattgacgaccccaaagagcttttgatgataagggctatattgtgcacatttgccatattggaaattaaacctaagacttttttttttttttttttttttttgcgacggagtctcgctctgttgcccaagcttgagtgcagtgacacgatctcggcttactgcaacatctgcctcctgggttcaagagattcttctgcctcagcttcatacaccctgcatatgccggctgcctcctcaagcagtacagctgggattacaggcacccgccaccacacccggctgattttagtgtttttagtagagttgcggtttcaccattttggccaggctggtcttgaactcctgatcttgtgatccacctgcctcggcctcccaaagtgctgggattacaggcctgagccaccacgccctgccctgagactttttaaatgtattaacttatttaaaaataacaacagtaaacctatggcaggatatcataggtaatatgcttctggaaatgagttttccaagacagacacttgaggagagtggcactgttgtccatttttgcagaatggaatgccttgatgcctgcctcagtggaagacagctgggttctcagatctgcctctgcgtttaatccgttgtgttgtcacatcacgtagcccccagaaaactcttttgtcacctgtaagagaatgagaatctaaaaggcaaataacatcctagtattgctatggaaatgattttgacctcacaaaccccctaaaggggtctcagtgacccctgatgatccctagaccacattttgagaatctctgttctaaaaagtccatttcttttactctaaaatattactcacattgcctgatatgttgtgggctcctccttttttaaattttttttattatactttaagttctagggtacatgtacacaatgtgcaggtttgttacgtaggtatacatgtgctatgttggtgtgctgcacccatctattcgtcatttatattaggtatttctcctaatgctatccctcccccaaccccccaccccccgacaggccccagtgtgtgatgttccctgccctgtgtccatgtgttctcattgttcagttcccacctgtgagtgagaacatgcggtgtttggttttctgtccttgtgatagtttgcttagaatgatggtttccaacttcatccatgtccctgcaaaggacatgaactcatccttttttatggctgcatggtattccatagtgtacacatgccacattttctttttttttggcattttttttaatttattattattatactttaagttttagggtgcatgtgcataatgtgcaggttagttacatatgtatacatgtgccatgcttgtgcactgcacccactaactcgtcatctagcattaggtatatctcccaatgctatccctcccccgtccccccaccccacaacagtccccagaatgtgatgttcgccttcctgtgtccatgtgttctcattgttcagttcccacctatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtaaataatgccgcaataaacatacgtgtgcacgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagacggtatctcattgtggtttggatttgcatttctctgatggccagtgatggtgagcattttttcatgtgttttttggctgcataaatgtctacttttgagaagtgtctgttcatgtccttcgcccacttttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgtcttagacatgaagtccttgcccatgcctatgtcctgaatggtaatgcctaggttttcttctaggttttttatggttttaggtctaacgtttaagtctttaatccatcttgaattgatttttgtataaggtgtaaggaagggatccagtttcaactttctacatatggctagccagttttcccagcaccatttattaaatagggaatactttccccattgcttgtttttgtcaggtttgtcaaagatcagatagttgtagatatgcggcgttatttctgaggactctgttctgttccattggtctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatacgaactttaaagtagttttttccaattctgtgaagaaagtcattggtagcttgatggggatggcactgaatctgtaaattaccttgggcagtatggccattttcacgatattgattcttcctacccatgagcatggaatgttcttccatttgtttgtatcctcttttatttcattgagcagtggtttgtagttctccttgaagaggtccttcacatcccttgtaagttggattcctaggtattttattctctttgaagtgattgtgaatgggagttcactcatgatttggctctctgtttgtctgttattggtgtataagaatgcttgtgatttttgtacattgattttgtatcctgagactttgctgaagttgcttttcagcttaaggagattttgggctgagacagtggggtcttctggatatacaatcatgtcatctgcaaacagggacaattttacttcctcttttcctaattgaataccctttatttccttctcctgcctgattgccctggccagaacttccaacactatgttgaataggagtggtgagagagggtatccctgtcttgtgccagttttcaaagggaatgcttccagtttttgcccattcagtatgatattggctgtgggtttgtcatagatagcacttattattttgagatacgtcccatcaatacctaatttattgagagtttttagcatgaagggttgttgaattttgtcaaaggccttttctgcatctattgagataatcatgtagtttttgtctttggttctgtttatatgctggattacatttattgatttgcatatattgaaccagccttgcatcccagggatgaagcccacttgatcatggtggatcagctttttgatgtgctgctggattcggtttgccagtattttattgaggatttttgcatcaatgttaattaaggatattggtctaaaattctcttttttggttgtgtctctgcccagctttggtatcaggatgatgctggcctcataaaatgagttagggaggattccctccttttctattgattggaatagtttcagaagcaatggtaccagttcctccttgtacctctggtagaattcggctgtgaatccatctggtcctggactctttttgttgataagctattgattattgccacaatttcagctcctgttattggtctattcagagattcaacttcttcctggtttagtcttgggagagtgtatgtgtcaaggaatttatccatttcttctagattttctagtttatttgtgtagaggtgtttgtagtattctctgatggtagtttgtatttctgtgggattggtgatgatatcccctttatcattttttattgcgtctatttgattcttctctctctttttctttattagtcttgctagcggtctatcaattttgttgatcctttcaaaaagccaactcctggattcgttaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcattatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtcctcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttacgaatctgggtgctcctgtattgggtgcatatatatttaggatagttagctcttcttgttgaattgatccctttaccattaagtaatggccttctttgtctcttttgatctttgttggtttaaagtgtgttttatcagagactaggattgcaacccctgcctttttttgttttccatttgcttggtagatcttcctccatccttttattttgagcctgtgtgtgtctctgcccgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagttttttcctagtcttgatggtctacattttggcatgattttgcagcggctggtaccggttgttcctttccatgtttagtgcttccttcaggagctcttttagggcaggcctggtggtgacaaaatctctcagcatttgcttgtctgtaaagtattttatttctccttcacttaagaagcttagtttggctggatatgaaattctgggttgaaaattcttttctttaagaatgttgaatattggcccccattctcttctggcttgtagagtttctgccaagagatctgctgttagtctgatgggcttccctttgagggtaacccgacctttctctctggctgcccttaacatttttccttcatttcaactttggtgaatctgacaattatgtgtcttggagttgctcttctcgaggagtatctttgtggcattctctgtatttcctgaatctgaatgttggcctgccttgctagattggggaagttctcctggataatatcctgcagagtgttttccaacttggttccattctccctgtcactttcaggtacaccaatcagacatagatttggtattttcacatagtcccatatttcttggaggctgtgcgcgtttctttttattcttttttctctaaacttctcgcttcatttcattcatttcatcttccatcgctgataccctttcttccagttgattgcatcggctcctgaggcttctgcattcttcacgtagttctcgagccttggttttcagctccatcagctcctttaagcacttctctgtattggttactctagttatacattcttctaaatttttttcaaagttttcaacttctttgcctttggtttgaatgtcctcccgtagctcggagtaatttgatcgtctgaagccttcttctctcaactcgtcaaagtcattctccatccagctttgttccgttgctggtgaggaactgcgttcctttggaggaggagaggcgctctgctttttagagtttccagtttttctgctctgttttttccccatctttgtggttttatctacctttggtctttgatgatggtgatgtacagatgggtttttggtgtggatgtcctttctgtttgttagttttccttctaacatacaggaccctcagctgcaggtctgttggagtacccggccgtgtgaggtgtcagtctggccctgctggggggtgcctcccagttaggctgcttgagggtcaggggtcagggacccacttgaggaggcagtctgcccgttctcagatctgtagctgcgtgctgggagaaccactgctctcttcaaagctgtcagacagggacatttaagtctgcagaggttactgctgtctttttgttggtctgtgccctgcccccagaggtggagcctacagaggcaggcaggcctccttgagctgtggtgggctccacccagttcgagcttcccggctgcgttgttaacctaagcaagcctgggcaatggcgggtgcccctccccaagcctcgctgccaccttgcagtttgatctcagactgctgtgctagcaatcagcgagactccgtgggcataggaccctccaagccaggtgcgggatataatctcctggtgcgccgttttttaagcccgtcggaaaagggcagtattcaggtgggagtgacccgattttccaggtgccgtctgtcaccaatttctttgactaggaaagggaactccctgaccccttgcgcttccggagtgaggcaatgcctcgccctgctttggctcgcgcacggtgcacgcacccactgacctgcgcccactgtctggcactccctagtgagatgaatccggtacctcagatggaaatgcagaaatcacccatcttctgcgtcgctcacactgggagctgtagaccagagctgttcctattcggccatcttggctcctccccatgtgccacattttcttaatccacatcattgatgggcatttgggttggttccaagtctttgctattgtgaatagtgccgcagtaaacatacatgtgcatgtgtctttatagtagcatgattcacagctgaattctaccagaggtacaaagaagagctggtaccattccttctgaaactattccaatgaatagaaaaagagggaatcctcactaactcattttatgaggccagcatcatcctaataccaaaggctggcagagacacaacaaaaaaagagaattttaggccaatatccctgatgaacattgatgtgaaaatcttcaataaaatgctggcaaaccgaatccagcagcacatcaaaaagtttatccaccaccatcaagtcggcttcatccctgggatccaaggctggttcaacatacacaaatcaataaacatgttccatcacgtaaacagaaccaaagacaaaaaccatatgattatctcaatagatgcagaaaaggccttcaacaaaattcagcagcgcttcatgctaaaaactctcagtaaactaggtattgacggaacgtatctcaaataataagagctatttatgacaaacccacagccaatatcatactgaatgggcaaaactggaaacattcactttgaaaatcggcacaagacaaggatgcagtctctcaccactcctgttcaacatactgctggaagttctggctagggcaatcaggcaagagaaagaaataaagggtattcaattaggaaaagaggaagtcagttgtctctgtttgcagatgacatgattctatatttagaaaaccccattgtctcagcccaaaatctcctcttttttattttcgaaaaaattacagcagagttcactcttcttggtgtgcagcaggaggtgcacgtgctgtgcttgtccatcagtgtctgctttgtgcatctctgttgacctgcctctaacactgggacgagcatcagccaaatcagaaccaggtcagagcccctacgccctggtcagatcagaaccaggtcagaactcccctacaccacagtcagatcagaaccaggtcagaacccctataccaagcttgtccaatcctcagcctgcgagccacctgcagcccaggatagctttgaatgtggcccaacataaattcataaactttcttaacacattatgagtttttttatgattttttttaactcctcagctatcattagtgttagttattttatatgtggcctaagacaattcttccagtatggctcagggaagccaaaagattagacacccctgccctacaccttggtcagatcagatccaggtcagaggccctacatcctgtccccacagtggacaggttggaaatgtaaggtcgtgtggccactgggggcccaggatgggctctgcctcagaggcacttccttccacctggcctgttttaatcaacagtcattaaagggaaatctaaagatgtttaaaacgttgtgtattttctcgttagcagagccaagaatcagtctgcagggagcaaagagcttgagtgtggagttagaagtcggggtccgggaaagggtgcttgtttctgaggctaacatgcatcaggtgctccaagtgggctctcattgaccccaggatgccatcagcccccttgccctgcctggagtatatcacatgggccctgggtgcctgggcctgtggagccacagctgctgaggtccggtgtttttaaagcctgagagaggccatctgggggtagcactacaggagatgggaagaggcccccaggaaaccagggagagcaagaaggtcttctaaggactcatgtcctcttaccaactaccatgtagttaagaatgccttacgaagggggacgggagagtcaagggatagaaaatcagtccttaaaatctgcactgtcctttccacatacaaagcacctttcacacaggtgagctcatttaccctcagatggcacttactgttgtgggaacctcattttaccaggaggaaacggaggggcgacaggacagcgttctaggaagtagctcagctgtggacattttgtggtgagctctcagggacagcagcaggcatgggatgcctgcagagaggctttcaggagagcgctggccccacctgcaggcccccagggcgaccttggataggctgccgtctgggcctgggagacttctcacctgcagagtggatgatgggggaccttgaggactgaacaggagaaagcacactgaaccgagcctggtacctagtaagcactcagtaagtcttggcacttactgtgataattgcattttaagcccagctaccaaaatttccagacctacgttaccatcttcaaatgagtgcccctacccgtttccctaacgttgctcaaacttgcattttctgaggagcgtctgttggatgcctttggcccttgcaccacgtacagctttccacgcttattggctggccactgggtaccaaggaccatggcgggcactctggaatgctctgttttggcaaactttcttccccaagaacagatttgacttttgaaaagtggtctgaaagtcagcctccccagccctggtcacagcagaaatagttttggacccaggtgagttgagtccacaaaataacaggccgtgtctacttgagctgaagccttatcagttggcccagtaggtcccatctgaagaagccctgtatttttgaaaaatgttaactctccctaaaaggttacattgaacggcaacacccgggaggctgctgttggccttgccagcaagctgaacctgcagttgagtggccacgcgtgtggtgcgaggcgtgcagcccatccctgagggctcccctgcatgggaaaggaggctgggaggttcgccaggactgcatgtggccctcgcaccaagaacctgacccatggtggaggtggtgagtgctgtgtggtcggccttgatgtttatacgagagtctctgaggtgtagacatcagtgtctccattttggggagagggaggcggttttcttcccagcttaccattaccactgtgttcgaggagggactgatatttcgagtggggtcaccatcacactcacaccaccaaggctgctttccaccactcagctttctcatgcatcccgtttcccagaggtggccagtgcctgggccctgagtcggttgagactcatccagagcagagctgcagaagctgggctggctccagacagagatgacccaaagcctgtgtcagcatttgggtgcctgggcccaccgtccaggcctgagagagcatcagtgaggctcggagcccccatcagccaggtcaggccgtggctctgagcctagtgctcctttctaaatgggagttgcaacgccagctttgcaaagtggttgtcagggctcactgaggggctctggggagactttgggggaaggataatgattggggaagtagaaattggctcccaaaatgctagagcaggacttaagggactgatggccaggcacctgcccagtgtggcatcctcccatcgttggctcgagcgctgagctgcacctctgtgtcaggacttgctctcagtgttctgtctggggaggtcatgtgcctactgggtggggcaggtccttgtgtgggaggagccagaaactcccttttttcttaaaagttattgggccagaggtcatgaattcacccttagcctatgatctccagtaactctaccatccgcaggaaaatgacttcacaccatgcgtagggctggaaggagcactgggatggagtcccacctcggtgcgcgacccggggcgttcagcagtgccccaggaccgcagcagcccatgctcagagccaggtcctcagggccggggcattcagcagtgccccactaccatagcagcccatgctcagagccaggtcatcagggccagggcattcagcagtgccccacggctgcagcggcccatgctcagagccaggtcctcagggctggggcgttcagcagtgccccactaccacagcagcccatgctcagagccaggtcatcagggccggggcattcagcagtgccccacggctgcagcggcccatgctcagagccaggtcctcagggctggggcgttcagcagtgccccactaccatagcagcccatgctcagagccaggtcatcagggccggggcattcagcagtgcctcacaactgcaacggcccatgctcagagccaggttctcagggccggggcgttcagcagtgccgcacgactgcagtggcccatgctcagagccaggtcttcagggccggggcattcagcactgccccaccaccgcagctgcccatgctcagagccaggtcatcagggccggaagatggcaacttgatgcttagccttcaaagaggtggtaaacgataaaaaaacggagccatgcctggattcaagagcctctgaaatcctaccacctaatcactgtcttccctaatttccccttggccgctatgtgggtggtatatggtgggctgttgggtggagcggggcgggtcgttactgatctatctggaatacccgctttatctctacccagcaaactgctacccatccaagacccaggcccacctgtcacttccactctggcacctcgttcgccatcacctcactcaggagggttccactggtgcttgccggcgaacgccaccattttttgcagcatatctcatagcttgttggaaacccacgttgagttggggctttgttcatccacaggtgctgtcacgcatccgttttcaggagacagagatgtcctctgtggccctccgttggccgaccctgttgggtgcagcagctgtcagtggacagaggtgcatcagtgcgttggttggtggcatcgtggcctcaccggcccacagttctgacagaggtgtctgtgtttcaccaactcagtctgtccctgcccattgtccgcacactcattccctccatgccccagtctggcaccctcaagtgcaagtgcgtgcatttaattcacgtagtgtgttggttgggtgcactcctggacctttggggagactgtcttcttccatgttagctgcttccttcttccctgtggggtcatagaggtcacagctgacatgctgaaacaaatgccattgttttcacttaaaccacattgtattccatagccgctgtgtcatatgcgtatatataatagtgtgtaaggcgtatggaaagaagagattgtgtccagactggctacagatggtcatcctaatggcggaagcagccaggccagttgggcttgactctggagctttggagggccatcctcagtgtatttgtttttatttgtggaggccccgcagcgctcatgctggccatgcctggctgggatgggatgacctggtgaggacagaggaggacagcctctgcttccatgatgaataaaacagcatctggctgggtaggaggaaagcctgtgcttgttcagcctcaagtacgtgtttgaaagcttgccccaaagacattccaaaaaccaggcagtggtggtgtcctgtccttctagaggccaggttgtccaggcccaggggagtcttgcttaggggtcagtgagcgctgggactcagtctggctcctggcaagcccagagaaccccactgctgagtctctacacaaggcattggacggggctgctgtgggtgtgcgccaggccacctccatgcctgggcagctgtgcacaagctggctatgagctccatggcatacagagcacgtccaaactaacctggtagcccagtcccatggaaagtgtgtgacatcgtgtccctgccttcggagtgagcaagccacaagccagatgtcaggggctgttccttctgcaggtcacccactggctggccaagcaccgtgaagctgggcgcacctcctccagggaccatactaaagcagctagcagcaccttccccctgctgtgaaccccatgcctgacctgagcctgagccctcacaggcctggcaaaggctgcctgcagaggcctgggccacacaggccctatggctttcctgcgtgccacggagagccagccagtggggctgcaggcacctcctcccgctcactctcagtgtgcgcctccacagggaccacagaccacaggagctcctggcccgccacatcgccagccgtgtgcgcaaggtttatcaggttcctcttggccaggttgaagtagatgccgggtggggatctgtaggccctggttgtgtttacagaagatgctgcccttcactgtcttccagcctcccaggaaaggatggtccccaggctccatgctgacaccacccaccttgcttcacccagtaggcgcttactgtatgtctactctaggtcatccacagtgctgagtgttgggatagagccccgggaggtaggtgcctggtcctccgtgagtctggtggaggagccctccgtggtgacagccttctgtgagagcatggcaggtggtggggcctcgtagagggaaagattttgcagaaaatgtgacctagattcccttttaaataggaaatactggtccctagtgtcttgaactttggggagaaaactccctttgattaaagagaaggtaacttggaaatgtgttttccctcatctttttgttaatttattttttaaattaacatgtagtgaaattggctttttgtggggtatacagtcccgtgaatgttaacgcgtgtgtgtgtttctgtaaccacccccaaaatcagggtgcagaggagttccaccacctggacacccccacgccgccccctggcagccacggcctctccccacccccattccagctctcagcaactgcgacgtgttctccaacaccgtggctttgtgtttttgagaatgtcttataaatggaatcagacagtatttaacctttggagcctggcttttttcactcaggttaatgcctttgagattcatccaagttgttgcatgtatctacagcttattcatttttcttgctgagtgtacgctaccgtgtgggtatatctccattgatctgttttttattttggccattctaatagatatgtaatgatatctcattgttttcatttgcgtttccccgatggccagttatgttgaacatcttcttttgtggttattgacccctccttatatcctctttggggaagtgtcaattcaagtcttttgccttttttttaagttaggtggtttgttgagtttcagtttggaactgttgagtttggaaaaatctttatatattctggataggataggactcttgttggatttcttatttccaaatattttctcctagctagtagtagctagtcttttattctcttaacactgactttcagccgggtgcggaagctcatgcctgtaatcccagcactttgggaggccaagggggcggatcatgaggtcaggagatcgactgcatcctggctgacacagtgaaaccctgtctctactaaaaaaatacaaaaaaaattagccaggcgtggtggcaggcgcctgtagtcccagctactcaggaggctgaagcaggagaatggcgtgaacccgggaggcagagcttgcagtgagccgagatcgcaccactttgctccagcctaggggacagagcgagactctgtctcaaaaaaaaaaaaaaaaacaaacaaaaaaaaacacctgactttcatagaccaaactttttcacaaacaagttttttttccctttttaatgaagttcaatttatctctctcttttttttatcatgatttgaaggacatatctaacaactgtttgcctaaccccaggtcatgaagatttgtcatatagtttctttttttttttagtttaatgttttacatttaaatctatgatatattttgagttaatttgtttaagtaagtcatgagatttacatcacgtttcactatttgcctatggatatccaattttccagcacctctttttgaaaataatatgctttcttcattgaaatccctttgcacctttgtcaataaacatttggtcgtgcttcagtaggtctattttggaaatctctcttctattctgttaactccatccagtaactccatcaatactccaacaagctgggtatttatccctttgcaaatacataattattattatgtatagtaagtcttgaaacctgtcagtgtgatttctctaaccttttttgtctcttgtaaaatatgttggctagtctcaatcctttgccctttcatctaaattttagagtcaacatgtctatctgcaataaattcttctagggttttttaattggaatgataataaacctataggtcagtttgttagaattcaaattttatgatattgagatttccatgaacatgatatgtctcctcagttattcagacattcttgtgattactttttcagcattttgtaatttccaacaaacagagcctatatacaaattgttagatttacatctaagtattttatttggttggagccattatcagtggtatatagaaaggtgattgatttttatttagtaaccttgtatctagtgactttgctaaactcacttattagttctaagacttttctattatttcctgggtattttcccatagacaattatgttgtctgcaaatagggagagtttgtttcttcttttctaaaacaattgtcttctatttcctcatcttgctttttttgcacagttaggtatgatgttaactgtgggttttttgcagatacagttgtcagattgaggatgttaccttctgttcttaggttgctgagagcttttatcatgaataggtgttaaattgtattaaatattttttctgactggatatagattatgtgtttttctaggatattaatatgatagctattgttcgtttttaatagcctttgtttttagaatagtttcggatttacagaaaaattgaaaaatcagtagggttctctgatactgcacacctattttcccaaattataccattgattcttattatgatgacatttacacttgacatcttacattagtacggtacatgtgttatgattcatgaaccattgttggtaccttaatattaactaaagtcctatgatcttgaagttttcttagtttttacctactgcccttcttccattccaggatcctgccttggatactgcattcctagctcctttggcccctcttggctgtgacaggtccttagttttagatggcctagacagtgttaaggagtactgattaactattttgtagaatgttcctcttttggaatgttttatgcttttctcatgatttgactggagttacagtgtgtgaggagaaaaaccacataggtaagctgtcattttcctgagatcgtatcaaggagtcatgctgtcagtgtcatttatcattgttgatgtcaactttgattacctggctgggtagtggtgtttgtcaggtgactctatgataaagttaccttcccccatctcccctgcgtactgcactcgtcccgaagaagttgctgtacctaacacacttaggaatggggagttacgctccttgaagacagagtatctacataagttactgggaatgcttctgcatgggagagttcttctccctcacctatttctgtattcagtcatttttttatgttagtatggactcagggatattgatattttgggttgtcttccaatactactttattttgttgctgagattatcccagttttggccatttgggagattgtgcagtttgctcctgtgtccctttgtcgtactctcctcatcgtggtttgactggaatgtttgtctttgttcttttgcttcatttcattttggagtgtgtcctgactttctgatactgcaagattctcaaggctcatcttgtgtatttcctgtcccagtcctagggaggaaaaggccagttcttgaaggagtcttgtgtcttttattataaaatgcatgagaaaccatggactgggcactaggtttgctccttgctatgggggtggtgttgtttctaagtcttctcagttgacagaccacagaagtagctttctgtatactaacccacggacagataaatattgtaaacatttctgtatgcaattatctgtgtctatattaagctaaacattagttcctattgatatctgcaactctaatccattaccacatggattcttctagcctcctctccttacttatctgtaaaatcccactcacaatgagaaacctggctcacactttctgccatccatttacttaattattcaagcccagtatacatatagaatagtatcagagagtttaacacctgtgctcatgggaaacaactttatcaactagagttcagtatttatgtacagttccttttgcctttagtcttacagactccactcactttcaagttacttttggagaaatcagctcccctcccccattcagtgaggacgttttataagtttataatacagtcagattctcttgtcacagtctgtgtttcttcccaggatcccctgatctcctaaatattttgttgttgttaatttacatacattgcttagattcactctttgtgctgtaagcttctatggcctttgatagatgtatgatatcatgttttcaccattacagtaacatgcagaataattttacaccctaaaaatccccctgtgctccacctattcagtcccccgctccttctgaaagtgccccggcaaccacttatcttttttctgtctatatagttttgcttcttccagaatgtcatctagttgggatcatacagtatgtagccttttcggctggcttcctttgcttagcaatatacatttagttttctccgtgtcttctgcatagctcatttttttcactgaataatattccattgtatggatgtaccatagttgtttatccgttcacctatcgaacaacattttggtcacttacaacttttggcagtgttaataaagctgctataaacattcacaggcaggtttttgtgaggatgtcagttttcaaatcagtagagtaaatacctaggtgtgcaattgccagatcacatggtaaggctctgtctttgaaagaaattgcaaaacagtcttccaaagtggctttaccattttgcattcccatcagcaatgattaagcatcctttttgctccacatccttgccagcagtttttggtactgtcactgtttggatttttagccattctaaaagccattgtaatcatattcattattttagtgtgcagctcctaaagacaaattatgttaaatatctttccttgtgcttatttgtcacctatatatattctttggtgaagtgtctgttaagacttgcccattttttaattgggttgtttgacttttttcttgttgaattttaagagtctttttataatatattttagatgcaagtcttttttcagatatgtgtcttacatatatcttctcctagtctgcctctcgttttcagagtctcagcatcttttgtagtaaagaagtttttaattttaataaactccagcttattcatttttttctttcatgaatcatgttgtatctaaaaactcttctcccaacctaaggttgcttagattttctcctgtgttatattctgaaagtttatgattttcccttttagatttaggtccatgatccattttgagttcatttttgagaaaggtataaagtctgtatctggattcacttctttttcgtgtgatgtctaattgttccagggccatttgtttaaaagactatgctttctccattgaattgctttttgcttttttttgtcaaagatctttgtcaaagtctaaatttggcccttgtatttatgggttccacatccatgtattcaaccaactgcagataaaaaatgttcaacaacaaggaaagaatggttgcatctttactgaaagcgtacagactttttctccttgtcattatcctctcaacaatacagtataacagctatttacatagcatttacattattctagatatcctaagtaatctagaaatgatttaaagtctacaggaggatgtgcaagggttatatgcaaatactatgccattttatatcaggaacttaagcatccatggattttggtattctagaagggtcctggaaccaatacccaatggataccaaggaatgactgtatatctgtgtgtgcctgtttcattgacctttgtgtctgttcttttaccaatgccaccctgtcttgattactgtagtttcataatgtagatttattttcaaatattgaatcagccttgctttcctgggacaaaccccacttaattttgatgtcttgttctttttatatattgctggatttgatttgccaatattttgttgaggatttttaccctgtgttcataagagatactgaactgtactcttttggtttctgactttttctggttttgatggtggagtaatgctggtctcataaaacactttagaaaatgttcctttctctggaaaaaattatgtcaaatcaatcttatttttaaaacattttatagaattcactggtaaaaccatcttggccctagaggtttctttttcagaagattgtaagctatgaattcaacttctttaataattataggagtattcagtttcatcttggataagtttggtagtttgtagtttttgatgcattggtctattcgcagttgttggattttagtacacagttatttgtaggaataccttattatctctttaatatctgtgggatctgtggcaatatcttctcttttattcctgatattgattatttgtttcttcttttctgtcagtcttttagagatttataaattttattgatcatttcatggaactcatttttaatttcttggattttactcttatcatttgtctgttttcaattttgttgattttcgcctttgcctttattatttcctttctggttgttttgagtttatttttctcttctttttctggtttcttaagttggaagtttagattattgagacctttcttttttaatatagacacttaatactataaattttcctctaaatattgttttagctttgtcccataaattttaatatgctttattttcagtttcattctgttcagtatactcttttaattttccttcagactttctctttgacctattgattatttagaagtgatatgtttactgttcaaatgtttggagaattttctattatggtttttgtcgatttctagtctaattccattatgatcagaggatgtaacttatatgattgcagtcattttgcatgtgttaaggtttatggcccagaagaatatggcatatctttgtcaatgttttatgcacacttgaaaagagtatagattctactgttattgggtggagtgttctgtaaatatccattaaatccaatcggttgataatattttttatttgtgtatctttgctgattttctgtcacctagttctattgattattgagaaagaggtgtttaggtctccacatataattctagatttgtctaattttccttgaattttttcatgagttttgaaatctgttgtaagacacatatacatttagaattgatgatttctttttgtgaattgaccctctcactatgtaatattcctttttaccctctgggaattttatttgttcttaagtctgctttgtcttttattaatttttttttacatttgtgtttgcatggtatatctttttctatccgtttacttttaacctacctacaggtatcatttgaagtgaattctttatgacggcattttcttgtgcatgtttttaaaaatctattgtgacagtctctatcttttccttggcatggttagatcatttacatttaatgtaattattaatgtttcaatttaggtctaacattttattgtttgtgccctctttttttcctttttcttccttcttttgggctatttttaacttgttttagtgttttgttttatttgttgtggtttttactatatctcttcatatagtttttctagtgactgttttagggattataatactttctttcacagtctaattagaatcactgttttacctttttaagtggaatatagaaatcttatgactatatagatccttttagctctcccattatgttataatatcatgcattatgtttacataaattgaaaatctcatttcatatgtcataatttttgcttttggctaataaacatatcttgaaaaacttgaggaaaatagcctgtaatagttttccatatacttacatttttcttactctgcctgcattcctgatgttccaagcttctttagagtaagtatatggataactataaccatcatttcccttttttctaaagaatttcctttagccattctaaagatcagatctactggcactgaattaccttagattttcctttttatcagcaaatgtctctaactctaacttcattcctgaaggattcttaaacatcggatatagaatcctgagttgtcaggtttttttctttctttcagcacttcaaaagtgctgttttacttcctctggactcagtagtttctgatgagaattccacattcaaatgactgttgccttgtacataatgcattgtttgtttctagtggctttcaagactttctctgaagctttcagcagtttgatcatgatttatctgggaatggatttctttgaatgtgtcctgtttgcagttttttgggcatcttaaatctacagttgtgtatcttttgccaaatttgacaaaattttagctatcgtttatttgaattttttcccgtactacactttttttcctctttttctgtaactccagtgacataaatagatctgttgaccttgtctcacgtgttctctttttgtctattttaaatacttttttttctgttgtttggatgattttttgttaacttggcttcagttttattgactcttttctcggcatctccattctactattgatcctatgcagtacagtttttaattttggttattgtatttttcaacactaaattttctactttattattcttgatagcttctatttgtgttttttcatttgtttcaagagtgtcttcccttgcagcatttttataacagatctcttaaactttttgtcagatgatttcaacttttgggtcatctcagccttggcatgagttgattttttccctggtgagtttatttttctgattatttgcatgcttggtaattttggattgtatcctggtcattttgaatattatgagactctgggttttatataaatcctacagataatgttgatatttttgttttaggaggtagtcaacctggttggatttagttagttcataagttctgaccagccttcaatatttgttcaattttcaaacccttttccgtcctcttaacatcagttcttttgtgcaccactcaccagccagtttgggaactggcagtgccgaattcttacagcagttctcaaagtctgtggtttagggtcagatacacatgtgcataggcggggaagtagacagctcacccgaacaggtgagtccagaaatctatcaacagctttttggtttgcttccatgaactccttttcctccacaatctttttggcactttttagttctcagggctccctcctcagtcccctggacagacagctggggcttttccccactccgctaaactcttcctattactaaacctcaatctgggtccaagcattaggaagacagaggtaaagagcaaagacatttcgcccacctcttagggggagcacacctcttcccatcagaaagggaccatctccccctcactggtttgggctcctgcggcccctgttgtcccccacaccacaggattgcttagggaggagctgacgttcaagggctcagagataacaccaaaaagggatgattcctcactcgccctgaacatagttgtctcagcccattttctgctgctataacaacactgccatctaggtaattgataaagaataggaatttattgggctcacagctctggaggctgagaagtccaagagcatgacgccggcatctgctgagggccaccccgtggtggaaggcattccatggcgaggaagcatgccagacaggagaaaaggggccagagtccctcagtaaccaattccagcagtaacagcattcatccattcctgagggaggggccctcatgacctaatcacatcttaacactgtcacagtggcagttgtttccaacacaggaacacattgaaaccttagcagcaggtgatgcttttccttcctcaaagtggattagagccgagcccctagggggctccccagctgtgccaggctttgcctccagggctcaggctgtagtaagttcgggctgaggacaacagagggataacccaggaagcccattcatcttttccatggtacttgaaattcttatcttctttccaaggctgccaactactactgactcttctcagccctcacgtagctgctctgtgccttctgcccaggttttataaagacattcagtagaagaaacaagtatagagtgcttgcttcattttacctggaaccagaatccccctttccctccatttgtgtttcaggttagtttattctggctgcttttgatggccagggagcattaggtcaaatagctgtgacttgtgccagggacaccagctcctggggattccccttccaggccagtggctgctgcacagggatgtcctgcaggagctgaggacctgctctttcttgctctctgttgctctttgttggccatggccacagcacagctactgagatgctctgcaagcatgacccggcaggtagcacctgtgtgtatgggcctgagtatgcccctgctagctgcagcctggctaaggaaaagtcccaaagcctgggctgctgaaggatgccccttccccccaggaagccacacggaccttgacaggtcaccacccatggagctgtgatggttgagggaaaggagactcctcctcaagaacttggaagcacaatggcctgcctcccaggaaagagagcctcagtgcttgtcggagccctgatctcagagagggccagctgcctggccagctctgctgttgcctgtgctctgagcctggccgtgtgcagtggacgcacaggtgtgtttgctgaggtggctcgtagcagattatcaccgaggagagatggacacccaggataaggaagtgatgagtctgagcacagcggtggcagagccaggctggtcccggtctgtgtcctcctgccgtgctctggtgtgtgttgtcttccttattggagctgggtttggctgagttggtccaggttcaggtgtcaggcctgctcagagccttgagctccactccatggcgtggcatgaaaacacctcgcataaaaacccagtgtctgtgacacaaaacgatttctcccgtgaccagcatgagaaaagggcatccagacccttggcggaggatgcacaatgcaggcagagggtttagaaaacagtcttctctgggtgaggcagttatggtgcacacatttaaatagctgcccaagccgaaatgaaaatagccatgtccttcagatgcagagactccaagatgcaggtcctctcccttgaccccagccacagaagcccagcccaaggtacccagcaccacaggacaggcaggaggaagggcgagtgtgggaaggagacaagggaagtggaggggtaagagaggaacatccagaatgtggcgttcggaggccgcgtcacagagccccaaggtctcggggctgccctctggggaggcccatggtgaaagagagaaggctgctggggttttttttgttttgttttttgttttttgagacggagtctcgctctgtcgcccaggctggagcgcagtggcacaatctcagatcactgcaacctctgcctcccgggttcaagtgattcttctgcctcaccctcccgagtagctgggactgcagacgagcaccaccacgcctggctaatttttttatttttagtagagatggggtttcaccatattggctaggatggtcttgaactcctgacctcgtgatccgcccgcctcggcctcccaaagtgctgggattacaggcgtgagccaccgcgcctggaccagaaggctgctgttttaatggttgcccctttgggccacctgaagtgattgttccagctgctgaggactgatgtggtcacctcaacctcaagaacttctattttccacatgagttaatgtctatgagtggatttcactccattatagaatatgatgcttaacagcaaggattgcccttcttcaagaacgggtgtcattcagccatgtgattctgcacaggctagggttcgaagcactgtgctctttgagagctgcttcaactaattactgcattcgttcgctgcagggtgaaacagagttttcagatacatttgtaaaatcaggtgcctgattgctaaatactacattgtttgagctatacttcctcatatgttgcctggtacggaccagttaagaaatggtttcccatgagaaactgacaatgaagctgaacatgtttgataaactctgtgctcatctatggacatataattgttttattatacgatacttttacacttggaaagaaaggtgctccgtaatttggcagcaatttgtcagagcagcactcaaggctggcgctcagatgaggcccttggaaccatgccattgtttctcggaactgctctgtgctccggttaggtttgcacacacctccctcgtttcattcctacaagtttagtaaagttccaggccgttctcccagaacacctaacggaaagcacagaaaacaaaaccaccaactctgtgttcgccgaggaaggcaggaaattggcctctgcttcttgcggtattgacgtgctgctttcattgtttcttttccaagacagctgtccccgaaatctctttacctccaagtcaacagcaggctaccttgctttgctttgcttttttttaaagttaggcataacaacaacagcaaccatgataatgattaacagtttgatttcaaaacgttttctgaagaaatgacagtaaacagtgcatttgcccagggaaatccaccaccccgccagccatcagccggtaatacaactgcatgtgctaatgaacccaaagctgttaatgtggtttcttcagttaaattgattcatgaattttgaagagaacattatctaatgaattttctttgaatagaaagcaattaaaaggacaaatcagtctgattaaccccaaagtcaccctcctgccacaaatggtgtacagtttgaaattatatcataaaaaactagagcacatttgctatctttttgccctctactaatccatgtaaattaatgaacaacaaagttaatttctttgatgacccttttctagtatcacctggattatgctgatgtttaatttgcttaatgttataataaagactaaacagatttttttcccagtgaagtgattatcgttcccttcagttaagaagtgatttttattatttaacacacatgtaagggtgtgtttcctttaagaaccaaatcacactttgccagcttggcaccaagtgtaattagtgttcttgtggacacactcagaacatcgttcctgcccgcggaagccttccctttgttgctgctattcagaaactcctgcccctggaggggctggagcccctgcgatggaggacatggctctgtctccagtgctcctgagctgcatgtcccccttggaaagacaataggtactgattcagacaggccttcttcgcgtgccccagtttctctcccaccgacaccactcccaggtaacagttctgaaacctggaggcagagggagagaatgttctcctgcagtcacctcctcattcctgcagcaggatgcggcacaaatgcagttggatgtggttagtcaattaaaatgggaatcaagtcattttatttttgcagccctattcactaaagatgcctgtaaccaaggtcaccgccagcccctgcgtactgtggtgcttggcactccgagcagtagctgggggaatcctgcacgcggctggaggtggacagccggcataatatcgcagcctggcctgtggctgcttttgccttctttgtcccagttgaagttggaaattaaccagcagtacaaaagatttccaagcaggcgggcaggcagggacttctgtgtgtattaattgagccatgagctcacttacacacgcccagtcgctagaagagtggcacacgcaaccccacgcggaacacgggaagatggaaagaaattgcaaacctgtggtgccagctccaaggatgccttccaaggggccagcctgcatggtggcctgccacatgcttgcgtctcctcgcctggtgacatggtggcagcagtgcatggaggccgtgttttaattgagtataatacctctatttgtgtagatgcgtttcctgttttgggactagtggctatttatatcagagctgctgaagccgtttgtccaaataacattatcctgcattcttcctttcagagtcgttcaccagacaggtgttatggaagctgctgaaggttgtgaaattcggagaagtgatttcttaccagcaattagcagccctggcaggcaaccccaaagccgcgcgagcagtgggaggagcaatgagaggcaatcctgtgagttctcatggcgcaagcatggctgtgggtggcgggtgcgtgcaggtggcagggtgtcatctgatcccacgtgtttcctcggaaggcaggctgtgctgctggggtgggcagaggggcgatatctgtgatggggaccattatgccagatgcctccagaagaggcaaggaggctaccccagcactacactcctggaagctcccccctaccgggagcacatctccactgcatgagctcctggttgtcacagtgagcaggagaggagggagcctggaggagtggcaagcgggcagagggtgccccacctgctcactcaggaggtggacgtgttgggtgcctgttttatggcccacactcttctaggtgcccagagtacagcagctaacagacagaaaggtctacctgcgaggtgcctgcatcctagcaggatggccaagcaagggtgcacatccaaccccatctctctgtgggctgcactccccctgaggcccagggctccctgggtcccaagagctaaagcaccacacgtgagcacacgaggcaggaggccttgcagcatgggacaagggacctagaccacacgcacctcgtgtctcaccagggatggcgccctccccagagcccttctgtgtcctcgtccttcccatgcgtctgcagtcagatttcactaaactccaggctcccaggctatgcagcctcaggccatgctccccagaggacaaggcccaaccgggacacagcatgggtggggcagcgtggcctgtggtgcctgggggccacgtgggtgccgttgctctcccatctcacagcacccaggcctggcagctgggccgcgggccatctggcatctggcatgaggtggtaagtcacagcatgccatgtgcgcccggccaaggccacacgtgcctgtgtgtgtgggggcagaaagggtgccccgtctgcgtggcccattgggagaacccacacaacctcaagaatgcccctggaatattcacccagtgatggtgtgtggtcacgttggcagtgtcttctcccgaaagctctgtgaaagtttctagcatgatggaagcataccatctgatcagggagcacaaatatgatcactccatcatgggatgggaaattactaaatcagatagacctcactttttgaaaaattgctgtggctttactgtctatttccaaaactacttatatccctgctcacaggggagaggccggcgtgttcataccacagcctgctgctcctgctgcccgctgcagcagcctgggggcagagcctccgtttctaggagatgacagttacgtaggcttttgcacaaaactgcattgttagtccttaaaaagcaactctggtaggtttgtagtggattgcattgtcgtaatgtacaccctaatctaggcgagctttctaccctattaaaatatcccaaatatcccaggagtgagataccacagggacagccaccatccccacctcctccatctcttcctgtcctcagttttggtgacagtggctggtgggcgcaattgacccttccttttgcacctgttgcacattaattgcaatgtcttcagctacattgtcataaaacatctgcaccacgcagtagggatctgatttttacggcgcgttgggggatatttccgaatcaaatttctgaggatggtttttgacatttcccaataaaacttaacctacatgcccctctggaaggctgctgtcttctccccggttgtgagtcaattttgaggtgttcaacctgatgaaaaggcagctcagatgctgttgtgttgtggctccgtgtagggcccatgagaactgtggatgcgaatggggttttgggggtgctcttcctgcatcagtgcagtgactgtttcaggcagtgtctactctttgtgccccccgaggagagtaagtccttgtcttctccccactgaggtggattctgctccctccgtgcacacacatgaagatgggagtggccccgtcagcgggcgccgactgctcgctcccttgtgtgtgcagctccccttttgctgtaaggacaagctccactaactgacatgtgcagcgtggcagcaccctcccccaccagcctttggtgatgccagcagtttctcactctgcagtggagatgccgtcgctggttagcaatcctgcttgtggcgatattcggagacatttattgttctgcaaaccagcgtgactctcttctcctgctattaatctctatgagtgtctctgttccagtatggcctcagtcactgaaatgtataaagtagtatcacatgggatgtaaaaccctaatgtctgtaaagtccacacatcggcaccctgtcccatggcaaagccaagactggaggtgagcacagcatcaggcaggagggttctacaggcaccaagtctcgcccttctcggcgtccacatgcctcctgtgccgagggcagccaggcggtggtggcttctcgtggcctttctgtgggctccaccgtgtgcagtgaccttcagcctgaggagggggctgcagcaggacctgtggctacggtacccacagacgcctcaaattatagcacagatatgccagagatattcctgcaagaagccttcagctacgtagtttactatggttcaggttgacagcctcccaagttcccattagaaacctcattagaatgggctaggaggatgaaaaggtgacccagggacttgctagaggaagggcgctggccagcagtgagccattgctgctgtcagtgtcctcaggaatgtttccctttggcgctgacagcagtgtcccagccggaaggctgcgcacatccactccagcccagacggtgcgtcgctgagactcgctcattgaaaacatcccttatattcaggatgaatagagtgattgtgcatttaagggaggagagtgaaaaatggacttggaatgttagaaaacatcgtaaagctcattgtgcattaattccttaggtggcttgcaataaacaggagcacgtgctggttcatattactgcatttgctgtcggcatgagtttctcttccccaaccggagtaagggatggcttttgccatgcggagctttcctctatcctaggagcttgatttctccagaatcctccaggaaggactcaccagccggtgtaaggtggttggtcagcattcctggaaggctgtctccccaactcagcgggagaggatggtcagtttcccagtatattgagtagaaaactcctcacgacccaccccctccacaaagcacccttcctcttcatcctcagacagaatttgctaaatgcagttcaaaggcaatcgatacattgcacagagagtctccccacctttttctgaacaaatgcattcctgaggagttagtttattcacggattgccatgagcgttaatgaccccccgaggcttgttctgcccgtcacccggatggctgctgataaagacttagcatcatgttctaagtgtcaaggttgtcagtggagctgaaccatttgaccagaagaaaaaaacgcacagggagctattgattacagcttctcggtgtcacttgttcaccaggatttaggtattgatgaggctgcgagtgaaaacaagctctttcccttgtgggctgctgcccagaagaacaaaggcgaagttggaaaaaatattcagccggtaccagaatcagagggattccatcattgactgaaaggccccttcatgttatttttgttggaaacaaatctatgggtttggaagttttatagcgtttgagaaaggggctgcataagtgatggattcacgtattggatgaattagatttcacagcatgaagatttcaatgcagctgtgatattatgagcttcttggttattgataaaaattacattttatgcagcacatgctttaaaggagagggcatagagggtacagatcctttgaaaatgtccttagggccccaataaatttcagcaggtttcattatcttaatagtctgaaacctgccaccaaaattcacacaaacagaagcagcgttccctatttctaacggtaaaaatagtgcctatttggtaagtcacctcttccccatcacagcatgctaaggtgaggaccggtcacagctgtcggggtcattgttattccgtgccatctgtcctggcctctgcattgatgtacaggaagagggagagggagacatgtttattttactcatttttataatttcatagctcattgagagggagagaagaaaaaccaaagctctgctgtgaaatctgctattaggtaggaaaattgaattggtgcctaaatgtttataaaactagattgaattaaatgcctacctctttatcagtcaaaaacgtgaattgtgtattatctaataatgccctcacagcaattattaatgggactgttgtatttgataaaaatcatcaatcagggtaaatattccatcctggagatttcctgtgactccttctggaagactgggattctcagctgttccagaacttggcagttactacacctcactctagtaaactcaatgttaaaaacagtcagccctccgccacctgcatgttcccatgtcatagtcgtcagaagcctcttagactgcgtcattggtgcacgttaccaaactcatcgtcaaattaggatgagctgtgtgatgtgccggaagccagagtcccaccttgcagccatgtcatctgctggcaccggctgtcaccccacaaggtcccacctcaacagtccacgtcaaggaggagaagtgtggtgcgtggagccatgcaggagagtggttagagccccttctttgccacttaacagctttatgaacttgggcacgagactccattcggccggaggctgagacaggcctggtggggccttgcggggtgatgggggccatagatggggtcgaagatgcagcagcatcaggcatgggcacacccgctcccaggggctttaagcaccttttccaaggggggctggggcttcccccacctccctcggggacgtgtgtagctgggccccacagagggccacacccaccaggtgaaatctgtggcaggtacatgtgtggcagtgacacaagctgcctgcaccaaaagcctcaggggatgcaaaagtagcagtcacctccccaggaagcagaggtgcccaagaaatagagcttggagatgctgggcacacgcccccagctgcttcctctaaaagctcacctgaccagtagctggttgctttgtccagttcactggctttggagggtggagcgtggggaagctgggcatgggcagaaatcatttctctgttgagctggggatacgctcagctggagagaaaaagaagagtggagtcggagtgatacccgggggtacccggagtgatacccggaggtagcctggacacgccccaaccttgggatcctgcagaaacagctgtttgttctcatcagggcaggatgctgggagcagggcagccatgtgtgagggcccagggagaggccccgggtctgcagcatccgtgtctgggccatctaggttgcggggatgaatgtgctgccctccagctcaggaggaagggaggaaggggggccaggcagtaagcgatcgttaggcatctcccatgtgccttctacgtgtcgtgccagctgagaaccttccagagcgagcttggtgcccttccccattcttctggagcctgccctggctcctgtggtcatgctcattggcagtttaccttcttcacggagcagccactgtgatgctttgcacgatgatgaggcatgtccccccacacgtcccccgagatgtcctggccccttagtggctgcccacccatacacctgctccccaggcgccaggagctacttagggatgaaggctgttgcctgggaggctctccagccaattctttctttagaaatctgtgcaagacttccccacatgctcctgggaagccattctggagcagatcttcacagtaactgcttgttgggaagcttaagcaaatggccctggagcccccagagcccccagagtcccctgcggtggccatgcaggctgtgtggccatccctgtctgcccaggcagagggggacaaccagagagatgcccatatgttactgccttgtctttcacctttctgagccagctgagaaatggatagcagacctcaagattttagctttattagggtaaaagcgagattgaaggcagggggtggggggccagtggcatggccatggtggcttcccagtaattcccacaagaattacattcgccatcactgtcccctctggctaagctctggcctccccagccaaggcaggggctgaccatctcagaagagatcagggcgccccgaaccctggggcaggcaggtcacctgcaggagccctaacagtgctaagctgggcatacccctctcttcctcccttgtcggtggtcagtgactcattctcccttgtgggtgtgagagtggaggaggccagcacctacatggaaaccagaggcaggggccacagcacctgcccccacccaccacaggtggctctcagagcttcagccagacagtggacccatggagctcctcctgtctacacagctcgggcaacgccaaaggaccaaagcagagtctccctgaggactgcactgaaggaggcgcccgcccctctggagggaacagggattcccttcccctggtgggactggccataaagaagcagttggtaggcaggatccggggcctgtgtatggctgcgtggttgtggtcctcactctggatcagcccctatcagcacagggcatcctgaggcaggggttggccaagtcctcctgtcaagggccagagagtaaatatgttaggcttggcaaagcagccacagccagtatggagaaaaaggcatggctgcgttccagtaaagcttcatttgcaaaagcaggtggtgggctgcgtgcgcccacagccacagttggccggccatgggctggagaggcccgtgcaggtacggtcttctctgatgcgtcctgtgatgcctgcgtggtacctggggagtgtttgagagcgtcacataccaccagaactcggaaacgtagttttcagttttgtaagcgaacgttgtatattactcaccggatgaaattaagttttctcctcccaaatcgtgggcctaaagcaattctctgaggatgccccacgtcacctcaggacactcgtccctcccccaacccgtgctgagacccccagggactcaagggcctcaggggaggggaagtccatgctgagacatagctgacacccacccatgccaacagcctgcccctggcacaggcccctgcttggtgggcacaggactcctgtcagtcagggccttggccttgaccccaaagacctcgttgtccagatccctgactgacagtggctgcccccctgtcttccaggtccccatcctcatcccgtgccacagagtggtctgcagcagcggagccgtgggcaactactccggaggactggccgtgaaggaatggcttctggcccatgaaggccaccggttggggaagccaggcttgggagggagctcaggtctggcaggggcctggctcaagggagcgggagctacctcgggctccccgcctgctggccgaaactgagtatgtgcagtaggatggatgtttgagcgacacacacgtgtaacactgcatcggatgcggggcgtggaggcaccgctgtattaaaggaagtggcagtgtcctgggaacaagcgtgtctgccctttctgtttccatattttacagcaggatgagttcagacgcccgcggtcctgcacacatttgtttccttctctaacgctgcccttgctctatttttcatgtccattaaaacaggccaagtgagtgtggaaggcctggctcatgttgggccacagcccaggatggggcagtctggcaccctcaggccacagacggctgccatagccgctgtccagggccagctaaggcccatcccaggccgtccacactagaaagctggccctgccccatccccaccatgcctcccttcctggctgtgtccatggctgtgatggcattctccactcagcagttcctagcatcccacacccaggtctcactgaaagaaaggggaacaggccatggcagtcagtgcttacagaggttttctagctttgtttcctacctgccaaaaaggctaatgcaagatgcatccacttatggtctgtatcaggtgaatagaaaataaccatttgccaagatttggaaagacagagagctctctggacacgggttcgatggagcttgcacctctctgagagctgaagtcaagtctcaccctctctccatactccctggcctagtgtgctctgggcagcaggtaggaagggacagggacctctcatctcaagggctgccccaaagggccctcagggaccatgggcctgttaggaccccagcaccccagtgtcgatcctggaagtcaaaggtcacgactgtggggggccagctcatgtcactgatggcagcaggcagggtttccagcatgggcggtgcgctgctgtctgatacttcattattgtgttgtcatcctagctgtataattaactatatccaaaagccggaagggaaacctgtagctctgcatatggagaaataaaacagagcatatgatgtatagagaaaatgaactgcacccagctgtgcactagagcgccatgttcttacccagcattccttgccacggtgtgaaccacagcagggaagctcgcatggttctacacgtcaccgaggcctggatgaaaatgtggcctcacgatgtgtatggttgggacccgccttctatttcattttatcttaacaccaacgaaagaaaaccgatttcagacgtttttcgctgatttatgatttattatatccctttctggcatcagccaaaatctcggtttttcctatgacatgaagtgatgtgactcttaccccgttgtcttaactcttggtatttttgaagcaggataagtcacacagcgggtcacgtagacacgtgctgttttgtgggacaggccctgggcctccttgctcctggcaggcctcaggtgccgcacgccgcgtcaccgtcaggactcgcaggctgtctggtcatttttgacgttgctgaaggtgagtgggaaaagctgggtgcactctgccccaaaggtggtgccctgtgtcccccacagatgatggccctccccagtgatggccggtcaccaggcacggctttcccctctgcatgaacagaacagaagcttctggctctccaaggcagcagcttggggcctggtggcccgggtgtgcgagccgcgagtgctttccaacagagggcaccagagccgtgcggtgtgctgtggagaccccagcaccacttcccctgctggaggatggatttgaaggagggtggctgggcggcaccccgatggctccctgtgctccctgagaccctacaggccgccctctgcagccacacctggaccggcaggcatgcacgctgcaggcaggctgcctccgctgtttgggtcccatgaacgatggaagcctcccagtgagatcttcaggtctctcatcaggcacaggctctgagggagggtcctggggccacatgactgcagccagcgagggccgagcccccagaatccaggtcagctcctggtggcaggggacctgcccgtcaaagccgtccaaggtgagccagcaaatccgtgtggcctgggagcacaggtgggcctgctcggaccatgcccttggtgcagtacaaaaccatgttctgcttcctctccgagggtttccgcggccctgtcagaacaggcttgatagatgcccggaggttccctctgacagccgcagcagcagggctcaaaccggcggggccgtgtaccgctccaaggacaagctctgccgaggccgacatgaaaagccagcacgcgggtcgcctagagccgctctgcctccaagctgcagcgccgttcgtgaaaatacagagggagagggaaggcacaaagaaatacaaaactattttccaaataaaaagaaatgtcgaaacaagaaagctgtgttcttcagccttggccctgggtccccctcaccctgtcgcatttcccagcactgtgatgctttgaaggccgacaccgagacccgccgtgcacgacagccacctcgcagccactcagaccggcggaccacgctcccctgtttccagagagatgagagagtcagaagtaatacttgtttttgcagaaccacacttgtggcaaaataagttgcctttggccacgcaggagactgagttttgtgaggggttgtccttctcccagtctctcttcccgctgggaacagaagtgtccagtaaacccacctgcattccacgtgtcctgtggccgcctccagtggtgagtctgtgaggccagagaagagaagctatgaccgtgcaaacatgcatgttatggtgttggctgatgcggaatcaggaagcttggaggagctcttgcatgaggaattgcagaacttaggggcatgaatttgcacttccagatgtgaaggttgcaggcaccgggcgttgcagaggaagtgggcaagctcaccttgtagagaacttacttggggtttgtaatttgtatacacttcttacccagcagaaacagcttactgaacacccctcgggtggctggatgatgtgctagcaactgaaaccatctctgcgacttaagcttctctggtgcgtcgcgccccacgtgcttctccagaatcccgtttggaggggccaagcaagtccaatatagataggtttatactgaagccatcagttttgtttcttacatcgtttgtaaacagcagtattatcctggaacttgtttcctacagaactgtaagataaggataaaatcccatccacctgaattgctgagaaacgtaagaggtggtgtgacccgctggagccctgtggagtggcggactctggggagtagctggtcagtgagattctcgcagcaatgtgaggcatcctcctcacagaaatgcatttacggatgttgctgtatcccctgacctggcctacaaggacagaacagccctgggggccacgtcccctcccggtctcatctgccgcttgctcaccttggctgtccatgcacccgtagctgtgaccatgggcggtggcgccagctcggacttcaccccgttggagcgggcaggatgtcacactgagctaatgtgagattgttcatgaagctacagatcttagtgctacttgggcttctcacagcacagaggaggattctgaagtgagagataaattggcttcatgtatgagcaagggggaaagtgttttattttactaggaagattttactgaaagaccaatcccgaaacggcccttgcttcggccacagctgctgggatgtcctcgggcctcccctgtttgtctgcatgtcttcttgttgccatcggggcagtggagtccccggaaacagtccaaggccctggggtgggggatttaaatttttggcttccctcagacctcagaccgtgtgggtttttttttctttctttctttcctgttcatgggcatttgattaaaagtttgtgtttaaaga

SEQ ID NO: 13 - DNA, 13559 bp, Homo Sapiens
cctggctaattttttgtatttttggtagagacagggtttcacgacgttggccaggctggtctcaaactcctgatctcaagtgatccgcctgcctctgtgtcccaaattgctgggattacaggcatgagccaccgcaccggccatgctttcagttttcaagaaagaagacaccattattgccaaagattttggtaatttgagagatacaatgtatgttttctccatgtggatactagatagtaaggatgtgttgaatttgaagtgtctatccagaagtattttgggtacttgtttaaggattgtaaaacaatgtttccatttctggatataataaatgtatttgttaatataataaatgaatagattagacccataaactatttgcagtgttgagtcatttcccacagttaaaatcaggatgaaaatatatagctgaatacttgctttgtttcttgtaactgatttctttagtacagaacctgctaaggccatcaaacctattgatcggaagtcagtccatcagatttgctctgggcaggtggtactgagtctaagcactggatgaagaagatagtagaaaacagtctggatgctggtgccactaatgttggtaagtttgggagagttttaagccacaagaaatgatcagtgaatgttgttgtagtcaagaaacatttgttattgaaataagactatcaagtgttgatgtagtaataagttattatttttaagttaaagttagcacctattatgtgcctagtacttagctaggtagtaataataataacgacagcttttcttgtgttcttatggtgtgccaggcaggtgttatgctaagaattgcacagaaatatttaatttgcagaatagctgggcgtggtgtctgacgcctgtaatcctagccctttgagaggctgaggtggggggattgcttgaagccaagagttcaagaccaacctggccaacatggggagacctcgtctctattaaaaaataaagcaggccgggtgtggtggctcacgcctgtaatcccagcactttgggaggccaaggcgggtggatacctgaggtcaggaattcgagaccagcctgtccaaaatggtgaaactctgtctctactaaaaatacaaaaattagccagacctggtggcagaagcctgtaatcccagctactggggaggctcaggaatgagaattgtttaaatttgggaggtggaggttgcagtgaaccgagattgtgccactgcacgccagcctggggacagagcaagactctgtctcaaaaaaataaaataaaataaaataaaataaatcctggagtagtggctcacatctgtaatcccagcactttgggaggctgaggggggctgatgctttgaggtcaggagttcaagaccagcctaaccaatgtggtaaaaccctgtctctactaaaaatacaaaaattagccagatgtgatggtgcatggttgtaatctcagctcctcagaaggctgagggaggagaattgcttaaacctgggaggtggaggttgcagtgagccaagatcgattgtgccactgcattccagcctgggtgacaagagcaaaagtccatctcaaaaaattaaaaaaaaaaaaaaaaaaaggaaagaaaaaaaagaaaatgacaaaattaaaaaaaaattattaatctgccaaataactttatgagatagaacttattacctccattttacagttgaggaaattaagggacagtaaatttcctttttttgagattataaagctaataaaatagaatctaggaagtctgattccagaaccagttctgtttttttttcttttttttttttttttgagatagagttttgctcttgttgccgaggctgcggtgcaatggcacgatctcaactcactgcaacctccacctcccaggttcaagcgattctcctgcctcagcctcacaagtagctgggattacaggcatgcaccaccacgcctggctaattttgtatttttagtagagatagagtttctctacgttggtcaggctggtctcgaactactgacctcaggtgatccgctcgctttggtctcccaaagtgctgggattacaggcatgaaccactgcgcccggcccccgttctccttactgggtatgttaaaattatttctttcaaaggaaaaggctggtcaaagtgcaacggtctttacaactaattgatcacaaccagttacagatttttttgttccttctccactccaactgcttcacttgactagtgtaaggaaaaaaaaaaaaaaagaggaaagaaagaaaatgctaaactatttaatctgggctagtaaatggccagaaagaactttataaaaatgaaatatacaaaatgacactagtatgtttaactaaaggtatagttacgacacttaaatttgcacgttataaataatatcaatataaaaactgatagcgtgggtccatttttaataaatatataaatattttaaactttctagatctaaagcttaaggactatggaatggatctcattgaagtttcaggcaatggatgtggggtagaagaagaaaacttcgaaggcttaagtaagttaactttctaatcctattataaaataattgggccacatgtcttagaattttgagtaacactgtcttgggaaacacaaaaacagttttttaaagccagttactagatatcatgtatatttgttgttatagcacttgagatatcttagtccttactttacagtctctttcagctctgaaacatcacacatctaagattcaagagtttgccgacctaactcgggttgaaacttttggctttcgggggaaagctctgagctcactttgtgcactgaggtgataaaatatttttatccattcacttgaccccttagaaaaacctctctgaaaattaattggaatcattattatttacaattttctatctcaatatctcagcttctagcttctgaattctgttttgtctcacagccaatctaagtcctagtacttctgaaatgtgagcaataaatgaatgaaatgaagcaaatagtattgtttaaaaaattggttacccttattaaaacagtaacttctcaatttgaacataacatatagataataaatgatagttaccattggttttcattatcaatttttagggaaacatttcaccaaagcactatttaattatagcacagatactaaatttttataaataattacatgcacacacacatatatacatatatatacatatatatacatatatatacatatatgtatacatatatatacatatatgtatacatatatatacatatatacatatatacatatatatacatatatacatatatatatacacacacacatatatatatatatatatatatttttttttttttagacagagtcgcactctgtcacccaggctggagtgcagtggcacagtctcagctcactgcagtctctgcctcccaggttcaagtgactttcgtgactcagcctcctgaagagctgggactatagcgtgcaccaccactcctggctaatttttgtatttttagtagagatggggttttgccatgttgcccaggctggtctggaactccaggcctcaagtgatctgccctccttggcctcccaaagtgctggaattacaggcacgagccaccgcaccctgccctacatatacattttaattataatatcttttggattctttaaaaaaatttttaaaaattttaaaaaattctttaaaaaaattcttttaaaaaattttgtttgaagagtaataacaaaacaaatctctatttgagaatcaataaatcttgagatcatttatggttttgcaattcaacctgaaaaatgaagtcagagcttttatcaaaacaaagcatgtttagtgctctctgtctcactgtcttttagatgccagaccttagattttgtgatgactcctcaaccgtttagatctcggttatctcagagggatcatcagctttttaagaaaattttgagagaaaagcaagtgaagaaaagagtagtcagtgcccaacatcacggatctctcactgaacacaccatgcctggtattctctcacagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaaggtacagtaaattaatcctggttttcaagagtattggttaatgcacacgagcaaaagatttactaaagatgtttattcttcagttgattctcttcccataatttattgagaaatgctttatttgcatttctcattaaagacttaacttcaggatgatttacttttttctttttatcacataatgtttattaggactgggaaacatagtgagactctgtctctatgaaaaattaaaaaaaaaattgactgggcatggtggcatgcacctgtagttccagctacttgggaggctgaagtgggaggatcacctgagcccaggaacttgagactgcagtgagctatgattgcgtcaccacacttcagactgtgagacagagtaagaccctgtctggaaaaatatatatacatatatatacattttttttattttttatttttatctttttttgagatggagtctcactttggcgccctggctgcagtgcagtggcgcgatctcagttcactgcaacctccacctgccaagttcaagcgattctcctgcttcagccttctgagtagctaccattacaggcgcgcgccaccacgcccggctaatttttgtattttcagtggagacggggttccaccatgttgtccaggctggccaggctggtctcgaattcctgccctcaggtgatccgcccacctcggcctctcaaagtgctgggattacaggcgtgagccaccatgcctgaccttatgtacttatatttttatgagaatatttctcttggttttctgataaatgagttactggcacccttatgaatttgaatgcaaatgaaacagctaaatgttatataattgtcgtgtttaaaaagcagattataaaactgtctgtattatatgattacagttttataaaaacaaaacaggcctaaatgtgtatagtataaagactgaagagtcagcacttccatgttctcagcggttatccttggatgtgagatctcatgcactttttgctctcttctttgtgcctttccattttgcatgcgtatttcttataatctaaaaagttacttaaacatatgcagctaaaaactttttttacttgtaaagcgtttggtgctaattttaacttttttttttagacggagtcttctcactctgtcgcccaggctggagtgcagtggtgtgatcttggctcactgcaacctccgcctcctgggttcaagtgattctcctacctcagcctcccaagtagctgggattataggtgtgtgtcaccacacccagctaatttttgtatttttagtagagatggggtttcaccatgttggccaggctggtcttgcacccctgacctcaagtgatctgcccacctcagcctcccaaagtgctggggttacaggcgtgagccaccacgcctggcttttttttttaaagcttttttgtaagtcagccagcaagaacacaggaggaagtactcaaatctcccttacacagctgggggctatgtcaggttttataagcatagggtaatgaggtgtgatttgattggatcttgcaataaagtaatgctgggaggtgtgatctgactggatcctgccatggggtgacaccaaaactcaatctgattggatcctggctcctgcctgggggtgtctggttcttaaatcggtccgagctcttcaggctgagctcttaggttccactccacggtggcacgcgtggttaacctgggcatgcacagggtacatgaccttcaacctgcaggtcgatggcaattggaaaacaactgacaacttcattacataaaagttgaactgattcgggtgcggtgactcacgcctgtaatcccagcactttgggaggccaaggcaggtggatcacctgaggtcgaggagttcaagaccagcctggccaaaatggtgaaaccccgtctctactaaaaatataaatattagccaggcgtggtggcgcacccttgtaatcccagctaccccagaggctgaggcagcagaatgcttgaacctaggacgtggaggttgcagtgagctgagatcgtgccattgcactccagcctgggtgacaagagtgaaactccatcaaaaaaaaaaaaagttgaactagatttggtctgatgcagttacagatttacaaaccgcgtcccaccctcctgccaacaccttccactcctcattcttgagggattagggatggaggtcatgcttctgtatcgacttcatgctgaccaggggcacttagtcccctaaagtgagaggaatgaaactcttgggcttctgagttcagatgagttctggggtcacccggagtagcttgaaaggctggtattgttgtaatacaagctgaaggtggaagtgttggatcctggaggacaaacagctcaccatccatttaaataaataggaccaaaaagtaacggaacagtggccacgaggggccccaacagaggaagaaaccaggtgaggtgtggtatagtggactcgactgccttctaaatctcagtggttgtccgggtgcggtggctcacacctgtaattccagcaaaagaagagccgaggcagggtgatcacgaggtcaggagttcaagaccagccgggcaaacatggtgaaaccccgtctctactgaaaatacaaaaattagccaggtgtggtggcgtgtgctgtagtcccagctactagggaggctgaggcaggagaattgcttgaacctgggaggcggaggttgcagtgagccgagattgtgccactgcactccagcctaggtaacagagcaggaccccatctcagtcaatcaatcaatctcagtggttgaactacccttgatatggttcagctctgtatccccaaccaaatctcatgtcaaattgcaattcccagtgttgagggagggacctggtgggagatgattggctcatggcggctgacgtcccccttgctggtctcgtgatagtgagtgagcgctcatgggatctggttgtttagaagcatgcagcacctcctgcttcactctctctgtctctcctgctccaccatggccagaaacgtgcctgcttccccttcgccttctgccgtgattgtcagcttcttgagggctccccagccatgcttcctgtacagcctgcaaaactgtgagtcaattaaacctcttttcttcataaattccccagtttccagtagttctttatagcagtgtgaaaacagactaatggacccttctggttgaaggaatgtagccattctgcttgtttaagtatttcctttctattcatctctatttcccgggaggtgtttatccaagtgcaataggagatattggtgactgcagagtcccctcagtgttctgctagtaaatagttgaaggttgatcagtgatctccagcattttcagtctggcatggaaaagcccccatgtaactggtaaaggtatcagtaagcaccaggaggtatctaaatccaccaggagccataggcatcatgttgatgtccatttaccagtcttccctggcaagattctctgaattgtactgccttggccaaaagaggtatgggaggggctgggcacagtggctcacgcctgtaatcccagcattttgggagaccaattcgggtagatcattagaggtcaggggttcaagaccatcctggccaacatggtgacattccatctctactaaaaatacaaaaagtcagcggggtttggtgttgggtgcctgtaatcccagctactcgggaggctgaggcaggataatcacttgaacctgggaggaggaggtggcagtgagctgagatctcgccattgcactccagcctgggcaacaagagcgaaacttcatctcaaaaaataaaaaaagaagtctgggtgtggtggctcgtgcctgtaatcccaggactttgggaggccaagatgggtggatcacgaggtcaggagttcaagaccagcctggcctagatggtgaaaccctgtctcgagtaaaaatacaaatattagctgggcatggtggcacacacctgtaatctcagctactcagaagtctgagacagaagaattgccaaaacccgggagggagaggttgcagtgagccgagatcgcgccactgcactctagcctgggcgacagagcaagactccgtctcgaaagaaagaaagagaaaggaaattccccagggaagtacctcggcttatttcatgaagaggtactgaaggaagcagaggcatgtggaggacttccccacctcgtgcagctatttgggccgtggcgtctgaaatttcttatttcagagtcacccctttgatgaccttggcagtggactgcagtcatctgtttaggcctctccatggcccgtgtcaatgccgatatttctgtctgttgcacatttgatttccttgttgttggcatttagaaggccccctgtttcccagatcacaccacgggcatggaccgcagagattgcatcttgtgagtctgtagaaacagtcaaggccttgtcctctcttaggtccagagctcaggtgaatacagattttcccagctgtctgtgctgaagtccctgtggggaggctcctggctggtttcctgtaggtagacagctacacgtcctgcccttcattggcttcttttcatgaagctcctgccatctacaaaacatgtctcccttcttgaatcacatctctgttattgaaactctagaagtcgaccgggcatggtggctatgcctataatcccagcattttgggatgccaaagcgggtggatcacctgaggtcaggagttcaagaccagcctggccaacatggcgaaatcccgtctctaatacaaatacaaaaattagccaagcatggtggccactgtactccagcctgggcgacagagcaagactccgtctcaaaaaaaaaaaaaaaaaaaaaaaaaaagagaaagaaagtatcatgcttttctgcattctgtgaattgttttagtgagttatcgaacttcagggcatggtgggaacctccaaatttgcagccagttggtgagaagtacatgtggtctgaggacacccaagcctgcaggtgtgtctaaagcgagggcagcctagtgggggctggtggccttaacctgtggcatttgaggtaacatcagggagttgacatcagaattgcatcacataggctgggcgcagtggctcacgcctgtaatcctagcactttgggaggccaaggcggagagatcacgaggtcaggagatcgagaccatcctggctaacacagtgaaaccccgtctctactaaaaatacaaaaaattagccaggcatggtggcgggcgcctgtagtcccagctactcgggaggctgaggcaggagaatggcgtgaacccaggaggcggagcttgcattgagccaagatcacgccaccgcactccagcctgggtgacagagcgagactccatcccccccccaaaaaaaaaaaagacaaaaaacagaattgtgtcacacaggccagatgcagtggctcatgcttataatcccagcaatttgaaaggcaaggtaagaggatcgcttgagcttgagcttgagcctgaggccgcagtgagctatgaccacaccactgcaccccagtctgggtgacagcgcaagaccccaattccaaaaagaaaaaagaaaaatcacaaagaatttcatggcagagtgcctgtctttcacagctttaactgctgcaggaactttctttttttttttttttttttttttgagagggcgtgaggagacacaatctctgctagtgattctcctgcctcagcctcccaaatagctgggattataggcatgcaccaccacgtctgcctaatttttgtatttttagtagagacagggtttcaccatgttggccaggctggtctcaaactcctgctgggatcatgggcgtgagccaccacgcccggccacctttagagttttcttaccacctggttttcctctctcaatatctttctctcatttcctgccttaaaactctagcttggcatctgggcgcagtagctcatgcctgttaatcccagcactttgggaggccgaggtgggtggatcacttgaagtcaggagttcgagaccagcctggccaacatggtgaaaccttgtctctactatttttacaaaagttggtcggacgtacagacgggtgcctgtagtcccagctgcttgggagactgaggcaggagaatttgtttgaacccagaggtgaaagttgcagggagccgaggttgtgccactgcactccagcctgggagacagagcaagactgtctccaaaacaaacaaacaaaaaaaccctgtagcttgagccttctcttctattgtttttctttaaaaaataaaaattaaaaatagatgtagatgctatgttgctgaggccggcctcaaactcctggcctcaggtgatcctcctgccaagacctccaaaactgcagggattgtaggtgtgagcactgcacccagccgtatgttttttttctacataaaaaacagcacaggattatcttccagagctaataaatatgttcaaataaccacaaccccattaaggaaaaatatcactgggcagcaaataatcaatccagaccaatatgatcacagttgctgtgaaggtgagaaaagttcatttttattatgtttccacaagagacgcactctattgttctcttgaaaacacacagctcatgtcctcctttagaacacacatcctctttaaagtaacatacaaagatgccaaaacaaggtaaaaaattacatctgaattctcacatttcaaacatatatgaaatatcaaataaaaatttatttttacaagaatttaggggaactactacatagctataaatgtaatatatatgttaactaagtatcacagataaaaaccatgctcccttcagcagcacgtgtaataatagatacaaagattgaaaggtaaaagatttaggatgaaaagaatcctctcttaaaaaggaaaacaaaattatatgtatgtgtatataatagttataacacccatcacacagctttatagaaacagcatctattcaaaaataccagtatttccaaaatatttaaaataatatttaaagtaataataatatttaaataaataaatatatttaataaatatttcaataaataaaataatacttaaataattctatacccatgtttttcaaaataaaccaataaattagatagtatgtattagacgtgttagtatatatatctgagacatgttaaaaatcacaactgaattctcacaattcagtcacaaacctaaacagcaaataaaaatttctatcaccagaattatgtttttttctggtggggaactaccaatagctataaatagaagagatttttatggaagtatcatagataaaaagagtgctcgcttcaggagcacatataataatacagaaacaaatttaaagataataaaatatttaggataaaaagaattgtctcttaaaaatgaaaagaaaattatctttatgtatatataacaactataactctcatcaaaaaactacaggaacagcatgttttcaaaagtacaacaatttccaaactatttgaaataaatctatgaataattcaatggccaacatttccaaacaaaccaataaaatgcagagtgtgcatgaagctatctgttacaatctgtggcactgatatttcacaaaagaattctgtgccaatctgagcccctgcattgtgccttcaaatgctcctggactgtggcaaccaagtctgtaagaaacaggacctccaggttccggcccagggaggttggaattcagcaatatagaaagggtggtggtgccgcaggaaagggtggaactggaaacactcctgttttcttacttttctccaaggactcctagaaggaccccacccccctccccccacccctgctcccaggaggacaacgtgatcactgtattcagctccatcaagaatggtccaggttcttctagatgatctgcacaaatggttcctctcctctttcctgttgtctgccattagcattggaataaagttcctgctgaaaatccacatctcccctgggtccggtgttctggaagtgagagagacaatgtcacacttgaaggaggcagctctctagacaggaaggttattcacgtcccatgtcaagtctagagttcagagcaattgagaaatgcaattttatctgctgcctttcattctataccctgcttctgaaccatcgtgttcaactgtgaaactcacactttggtgaccacaactccaaaactcacttaatacacccaaggtcagccccagtgatctgcttcatagcaaggactttgggtgggtctgcccagggagtagggcaccctcagagaatgtggctttggacttcatcatagctggggccttttgtgtcacttaagatctaaacttgtaaccatgctagatgtgtttctaatgtgacaacatcacgaaccacgagtccagaagcctaatccttaatcctacctcctcatgatgaagtctcatgctctgtgctcaccgtggttagctgcacaagatgtaaaccaaagcttcactgaaccctcgacccaaatcggtaactcaagtgcgtcaatcataatgaacctccccaaactcagtatttatgattatttttgaggcagggtctcactctgtcgcccagactggagtgcagtggcaggatcagggctccgtgcagccctgaccttccaggctccagcgatcctcccgcctcagcctcctgagtagttgggagtagagatgcgtcccacatcgcctggctaatttttgtatttttgtggagaggggatctcgccacgttgcccaggcttgaagccggatcaagcaattgggttcctcggatttccaaaatagaccccaatattctgcctttaccccggaggatgcagatgtaccttctctcaggccgatgacctcaggcctccacggtccctggagctctaggaaaggcgagcgcgatctcgcgcccacacccagtgctctgggtcataagcctggatctggaaaaacaaacgccctttgagaagacggggactcgccaggatacccctctctcccctcatccagcctccagcccacccgattcctccccacctcctccacctccccaggccccactcacctcctccaactcctcccgggaaacccaagccctgccgctcatggaacagaagaactggaaccgaagtttctggaacagg

SEQ ID NO: 14 - DNA, 31226 bp, Homo Sapiens
ccggggtcagaaaacaggttttccctctcggggacagcgcccaggggaccggcattagaacatcggctgatgtttcatctggtcagggaaccatccagcgcttagtacacctggcgctaatcggcggggattaatctcacaccccgcagctggcggaaagcagcgggaggaggcacctagccctggggttgagatcccagttcccgcgtgcgcaaaccacgcccctgtagattctcgctgctgcgtgttcgcgcgcgtcccggagtgcgcatgcgcagcggcgggggttgttccggctgcctttcactgaggggacccgccagtttctaactcagtggcgtttgccctgattcccggggcctggctttcagcgtagcaattctgccggcgaagaaggtgagcgcagtgctgtgtggcagcagagctccttaggacgaggagcagcgggacgaggaagggcagactggtgaaatcgcaaactgggcgtctgttccggcgccggacccctatttgcaaaggtgggtggcccgtccggagcgggaaaacattccggaagtggagggccgggccagcgtgattgacaagcgggaacccctgtgtggggacgggtaggcctaggaaggttgtgcctgcggtggaactgggcggtgcgcagaagtgggcattaacagcagccgcgtgtctgggtcttagatttggcccagctgtgttgagcttttcatggattatcttacgtagataagacactgcaacagtgagtgagcgcttgtaacccacctgtctcttacggaaactgagccccagcgatgctaactttagcaaggatacagctgggatcctaaacttggcaatcagagcccagagccgataaagttagctgcatgagtctagcttcccccagggcgggaatcgaggcggagcagggtacagtacggaggccaggaatgagtgcacttgaccagattgttgacggaagtgtcataaaaatggacttaaatgctgataagcagctgtttgggttccacacagggtgcgagctcaggatgcacgttggaggggacacagggccagagcaaggtgggaatgcgggtattatgggccaggccatcctccagctggtggagcaccgcagtactgcagtgtgtggccctggcttaacagcagtgcggaaaagcttttttcttggggctgtggtgctttccaggtgtgtgaagttaaaacattttagggccatacggtagatagtacctgccacatagttgtcttggtcagccccggctgccatgacaaaataccataaactgggtggcttagacacagaaatgtgttttctcacagtcccagaggcttgggatgtccaagatcaatgtggggaggacacaactgagcccacaacaatagtctgtactcagtaatgagtgataattggggactgaagaaaatgaacacgttaagaactaatatgttcctgaagtgctttcacaactctaacctcgttttatgagcgtgagctttgctgtcctggtgtgtgccttggcactgggaggtgatggttgtcctccacacagccaacctgaagagggctgaacaagtcactgcaaatgtttttaatagggcttagtgaatccgttatactcagatttatctaaacctctatgatttagcctgtgctgcttctggaataatgagatccataattaccactgatggggaagtgaaataatacttacgtttcttctgtattgtttagtgttgtcattctagagtttggtaaccaagtctgtcttttttatcccacttatcctggtgggaggaaaagtgaggagatagaaagtttcaggtggcttgggggtctggcagatgtggttcaaatcctgagttcaagcacttgctgagtgaccttgggcaagtcatataagtttactgagtctcagtttctttctctataaaatagagcttataaaaataccacacagggtttttgtggggttatctgaaaacggtttgaaaccattaaagaactggccatttaactaataggtattcaagtcatgggacctccgttacccagcctcggaagagaaaccttcacttacagccccgatgtctggctggctactcattcgttcatcagatttttgttgaatgcctatgaggtgtcgaagcacctagttctgagtcctggagccagagaagagcaagacagacaaggttcctctatttatggaacgtatattccagtgaggaagaataaataggttcagatggtgctaagagctatgaataaattaaatacagagtaatgtgattttttaaaagtgacttagagcaagctagggggtgaggagtgggggtggtgtttgaccactgtccagcggccagacagccggagaggcttctctgaggaggtgagccaaagcctggatattgaggaggactccttctccaggccaaggggagcagcaagtgcaaggcccgagctgagtagatgaggctgggagcctgaccagtctcaggctgaccagtgctctgtcttgagaggagctgctggtcagctttttgtcttgggattcagaacgaggagacatgaagactttttacttggcagtgggagctgaagctgaaaggtccaggggctgatgaggccacgtgtaagcgaaagtttgggataagcagaaaccgagtgcgctgagggagtgagattgtggctgtatccggcacctggctgagcaggagagtgaaccccgtgggtgtgtgtttgctggtgacgttcctggagctgtcttgaagtccgagctgccttgcagcttgtagtctgcctctgtttttggctttcccagatagtttcaattcttactctcagtttgtgaacctcccttcagtgaacctcccttcacttatgctggatatctcttgcaaccggatgagcttcactaaagcagagtcatttggacctggattcgaatccctggttttccactttttagctgtgactttgagcaattatttaatttctgtaagcatcagtatccagtagctgtatccttatagtgttgtacagattaaatgagataataaaagcaaaagaccactgtagagtgtttaacacataggaggtactcaaaaatttgttaggtacctttcttcccctttccttcatgtgttaaagctttttcagtacatacccctctctcaggattgaattgtaaatcatgttttttgattacccttcttgtaataattcctctacctctgtagtcatgtttttcttttttcattttttcttgtccccagaatgtctaacaaaacagccaaatatacctctgtgaagacagagggtaaaataatgctagttctgtgagttctctcttcttgtgcaaatccataaactgccaccaatctgtagtcattttaattgcccctaaaccgaagagcatcgtggcaactacctttcccctcgtaaatagagtgacactatcactagtcttattgaggccaaagttataaagatgggctctcgatctactaatattagtaaaatgggtttgggacttactaacatttgtgcttagaagagacagacctggcaaagagcttggagaagtgagttccaaagagagaggtgtgggaaccaggatggaagagtcaggcctccagatagcgtttacttctcctttcttccttgaatcactgtctcagagataattaggttcaggagaggagaaaaaaaaagatgacgtcaacgtggagcagagtttttcttagaccttagcctagcaaggaaagagaaatgcctggtctcagtactgggaagctgttccagccagagccccgtggctgtgaagagagctctcctgtctggaaccaaacagaaagctcataggtctagaggccagaaaagttagtaggtggtggctctgttcggtgctggaaatggaggccaggatgaactaagaagcaaactaaagatacttgtaagataaggacgtgtaggccgggtgcggtggctcacgcctgtaatcccagcacttcgggaggccaaggcgggcggatcacgaggtcaggagatcgagaccatcctggctaacacggtgaaaccccgtctctaccaaaaaaaaaaattagctgggcgtggtggcgggcacctgtagtcccagctactcgggaggctgaggcaggagaatggtgtgaacccgggaggcggagcgtgcagtgagccgagattgcgccactgcactccagcctgggcgacagagtgagactctgtctcgaaaaaaaaaaaaaaaaagatagggacgtgtatgttaacttgcgctatccaaacaacaagctgtgcttatggtcctctgcctgtgcgtcatgattttccaggacttcacaacgggataaagtgaagtagcttcggcttgtgaatgtgcattgcagagacgtgggagaagaaagctgcaaaagtcattataagcaacacccttgatcttaggggtgctggtctgtgagaagagagctctaagccttttgtagaggcattagaaaggtatcggagccacggtgaaatgcaggggagattgggtttaggggctttcctggtctgcattctgctacagccgttaaatgccgctagatggagtgcgtgattctggtatggcctcacgtggacctgctgcgaaggatggagagaacatggtctctgcttcccagaaaaaaggagaaatttggtaataagtgtggagactgctcttaaataatgctccagatttcaagccacttcttcctggaccatgagagagctccctaatgttgtatttatttttcctaggtccatggctaatgaaacacagaaggttggtgccatccattttccttttcccttcacaccctattccatccaggaagacttcatggcagagctgtaccgggttttggaggctggcaagattgggatatttgagagtccaactggcactgtgagtatgaacagtgagagatactgaaaaggacaacttaacagcagccgtactagcttttcctgtttgcctatccagagattttcatagtttgaagttgggcagagtagtctctgtttatctgagtaatagtcacttcctctattaaagtcttttttttttttttttgagacggagtctcgctgtgtcgcccaggccagagtgcagtgggacgatctcggctcactgcaagctccgcctcccgggttcacgccattctcctgcctcagcctcttgagttgctgggactacaggtgcccgccgccacgcccggctaattttttgtagttttaatagagacagggtttcaccgtgttagccaggatgatctcagtcttctgacctcgtgatccgcccgcttcggcctcccaaagtgctaggattacaggcatgagtcaccgtgcccggcctaaagtcttaaacatagctctgtggtctgagaaaaattaggctgaagtcattggtgcctacctattacggtagatgagacggctttcttaccaactcttttccctcccgttccccatccttcaaatataattctaagttttagtctctgctgagtgaaccagtgtgttatgattatgttttgaacataattttgtcttgaacaatatgtcttaatattctgttttttctagttaataattgcccttttaaagttagtttagtttttaatatacctatgccagttcctcccacatcatccagtggcctctcaatatgattttccatacagataactcctgtcttagtcggccaggactgccatagtaaaataccatagactgggtgacttaacaggaatttattttctcaccattctggaggctggaaagttgaagatccagattctggcagggttctggttctggggagggggtctcttcctggcttgcagatggctgcgttcttactgtggagcaagaaaagacgaggaggagaaaaacaaatctttggtgtctctttctcttttatgaggacaagggctgctcccttatggctgctccgttatgacctcctttacccttgaaggccagatctgtagtagagtcacatggcggggttaggatttcaacatatgtttgtttgttaagatgggcagtctcactatgtggcccaggctggtctcgaactcaagcgatcctcccctctcagcctcccaagtacctggtggctggcaagatccaagattactggtgcacaccaccatacacagcttcttttgttttgtttttgttctttaaaaacatttttttaacatgcattttggtggggatacaattcagtccacagcagtgaccaattccatttttaccttggagccctcctggaatcctccatcctttccctgtcatttgaattagttgctcctcagactgacttgacagatttcagcatgagtgttaatggggacagacggccgcacccacaccacatcagggtatacgtccgtttggaggctttcctcaaacgtctggcagccctggactgcctgtgtatgctgaagaacagggcacagaaaggctgagtctgcagggcactggctgtggctgccaggctgggctcctttgttgggggcctccagttgccagcacatctgtgggattttccctagagtcttcagtctctccagagcaggtgcctctgagccctggcccagcaggtacagacgctgaagcccaatagccggtcttccgggaggtggtctggggaaggggatccaggtggagagtccccctcagtgcctgctttcagcctggccctcctccccctccctcttgcctcctcaatctgccggttgcctccagggctctcctagctcagcttccacttagagcccacttcctgtcttctgcaaggagcaggagcagggattgcaacctgagaatctaattgttcttaaaaagaatttcaacccgtccctttgttttcagtggcctgctgtgttcctaccacttcctgagtctttctgagaatgagtgggggagatctctggggacacttgggcttgagtgtctctgccgaaatcacttccatgtctctgccttctttccctctctcctaaaacatattactccttccactttctttttgtgggtgtaagcctccatattactttggttaattttagtgtgctttggaacacagatgagtgcatgttcattctgccttgtttaattttagagacagggtgttgctctgttgcccagggccgagtgcagtgttaagatcatggtttactgcagcctcaaccttctggcaacaagtgatcttcccacgtcagcctcctgagcagctgggactacaggtgtgcaccatcacacctagctaattttttaatttgtagaaatgagatctcactatgctgctcaggccggtggtcttaaacccctaggctcaagcaatcctccctccttggcctcccatagtgctgagattacaggcatgagccactgtacctgacccctttcaccttgtttagcctgacaacccatcttctccctctcaggtctttccatctcagtcttctgcactccaggcttctgcgtcttcttcctctgctcagcctttaattgtcgatgtttctggttctatagcttcatcttcttgtgtgcagtctctgtgaatgtaccctgtggctttattacctttgacattcttctgtcttctaaatcatctcctgaatagagtgttttctcctgtcctgggtgtcccgcagcccatagaagcagccatgctgtgggacaccctgagtggggtttgtgttacctgttgtgcctaccatgcccttccccgccgtggatgcacaggtgccccaccttagctgccccagatgctgtttatccttgatagtcaccttttaagccttatacaggtctatcaagttgagtcaccattaccacttggtgtgtgctgtgccttgtgtaatactgcagttccgggagtcatccaacctggaatgcatgctttgcggggatctatgatgccctcgaattgtatgttacatgtgaacctgtgagcattttctaggggctctgcacctttgtgtcctcagctctgagccccatgcttgctgcaaccagcaggtgttcagagtgaatgaatttgcttatcttggcataaatcatgtaactgttgatgataccccaggaaggtgagcctttggttataaatccttttaacattttccagtctaaaagttttgtggtcttattacacgatgtagaaaacagtgggcctcagttattcttttgctgttgtgccggagtataccacggttgtttttgaaagataactttgaccatacccttaggaacttcctcagctcactttcaaatggagggcactggctttctaaccattgtgtctcccagcccagtgacagctgaagctgactgcttccgatatcacagacagcacagaagagccgccctccaggtgctgctgggaaatgctgcctggaactctttgccatttactttctatcaaaagctgagggaaatggtacatatggggctttcctaaaaatatgggatccatccatttgtcaacaatgtcattctatcctatcccagggcctttcaagattttgatgaaaactaatagatcccatattccagaataatgctattaataattttattattattacttaatgatagcaaaaagttagctaactccaaccgctcacttgttatttgccaggtaatcctctaatccagaggatttggccttttgtgtgtgttaatgtcctgcttgcaccagctctatgaggaaggtgccgctgttgtcatttccatttctgcactcgtggaaacaagcgtagtgaggccagcctgagccacagagctgcaggtgggggagacagctggaaccctggcacctggctgtggagtttgagactctgactcctgcgccgcgctgctgccccaaccgtagtcatacgaggtgtttcaccccgccctggatactctgagatcccctctgggttcagcaggctcagagagctgactgcctggagcagaaggcatggggtcctccagagactcccctgagctgagttcccctgtggacaccagggccgcctccttgtggcgctccctgaagggtcctctctggaagaactgtattggttccctggggctgctagaggaaagcttcacaaactggggcttaaacaacagaaactgacatcccacagcgctggaggctggagtccgagatcaaggtgtcagcatgcttggtcccttctgagggtcgtgagggaaagatctcttcaggcccctttccttggcttataggtggcgtgttctccttgggtatcatcacatcgcctgccttctgtgcatgtctgcatccacgtgtcccctttccaataaggatattagccctttaggctgggtcccgtcctagtagtctcatcttaactaattacatttgcgacagtcctatttccagatcaggccacattctgagatgctgggggttaggatttcaacacaggaatttggaggaatacaactcaatcaggcttatggaaaattctggtcttaagtcaagggtagtgttctccagtctgtatatggaggcgcacacctatggtcccagccacttgggaggctgaggccagagaactgtgtgagcccaggagttccataccagcctgggcaacatagcaagacctcctctcaaaaacagacagagtggtgtcttccagagtgattagtttgcttaaaaaaaaaaaaacaaaacaaaacacaaaccgtaagcactggcgctcatgactgatcatcctgtatccacgcacgagctgcacgaaggccgcgcggtcactctggctccctgttggcgagtacctgggatttcttgctcagcattttggggccttaattcttttaggggactttttgtctaatgtctccccttcttctaattatgtgcgatatttacatagaatctgataaactgcttcaaatttgttttcagaacagtgagctggataattaaagaagctttttcctgcttcttgggcccagtttccatttctttcttttttctgtttttcctggctattctagtgctaatttccttcctttcctttcctaggctggtcttagagcatcctctcctatgtacagccagaccttctttcaagcttttattaaaatggggaaaggtcatttgggaggctttgttgttttcctgtttctaaagatcatttttcttcctgcaggggaagtccttaagtcttatttgtggggccctctcttggctccgtgactttgaacagaagaagcgtgaagaagaggcacgactccttgaaactggaactggccccttacatgatgagaaagatgaatccctgtgtctgtcttcttcctgcgaaggggctgcaggcaccccgaggcctgctggagaaccggcctgggttactcagtttgtgcagaagaaagaagagagggacctggtggaccgactaaaggtgagacctggggtatccggaagtgggagtactggaggaaacagggcttcagcgattgttctggggcgattccgagactcaggcagtgcatgctcccctgccgttgccgtgcctctcagctcttccctcagctccttgggtctatggtgctgccgctgtgctgtcttttttgagctggaggtcagcaggccttctccacataaggaactgttggtgcccatttattactcacctgggaaaggacctgatcattgccattggcagcatggttcaatggctgcaaatggatctgatggagagcgtgtggctttgggaggagtgtgccgccttccgcagtgagcagcgaggctgggaccggcagggatgaggtcccgggaggggatgcggcagcccttgagtgctggccggggaaggagagatgcccccagtgaggaggcgccgggctgagtggcccagactccttaggagaggcctggttttgggcttccttggtgattttccttcatgtctgcctcctgtaggcggagcaggccaggaggaagcagcgagaagaacgcctgcagcagctgcagcacagggtgcagctcaagtatgcagccaagcgcctggtgagcctcatttcttggggggcaggattatgtccaggcagggttgctctgcttggaggctcatgggtgcgtggtcagggccttggtctcccctccgtgaccctcactggctatgtgctcccgtacagaagctgggctgtgagtggttgaggcgtggatcctaggagtcgacctctctccagccaggcagccaggcctatgtgaatggggcgtggtgtgctttgtctctggcatgtggggaggtgggtactggtgctgagacttcttcctccctcaccacctccactacccctgtccagaggcaggaagaagaagaaagagagaatctcctccgcctcagcagggagatgctagagacaggcccggaggctgagcggctggagcagctggagtctggggaggaggagctggtcctcgccgaatacgagagtgatgaggagaaaaaggtggcgagcaggtgagacagaggcggtagcactaccctgccccaggccaggggacacccttgaagacagctctttccctcatgccacagatgccatgaagcacctggcaagaggcatggtggcctctgccctctgctctaagccgggtccttcctagggtccatgagtgccagtggcagtgaggacagtcaccggcctggcctgtgtcctctcagctgtcctcacggcagctcaggcagggcaggaacatttgtgtctgcgccttatacacaaggaggctgcagccccacaaggagagactccttggctgaggccacaagcctcggcagtggagagctgggctagaactcagctggcctggctctagatctcaggctctgaggcagctgactgcactgggtaacctgtgaggtgccaaccatcaaggcgtccttagcctgagctttccttctcccataaagcctctgttggtccagactcaaggtttccacttgatgagccatgagctgctgggtgacttagccctgagcaggccacccaggccatttcgggcccacaggatccctggtcacagccctgttcccattcacactggaacctcaccaccatccctgagtgtctgctctgagtatggcactgtccagatgctgtggacatagaagggaagaagacatggaggggacagttaatagacatgaaaacaaatagcacctatgtgaagtcagcatgtttgcctacaaggaaaacaaaatggtgatgtggatggggtggggggctgcacctgatgatgagtcccgtgtgtcctgtgacatcctggccaccacatctgtcggagggtaactgcaagaccagagaccctccatggatattcctgaaggttcatccccggccttcacagtctgtctgcagggcgccttctgatgccacctccagccgccatccaccagacgccagcttccccgctgccctgaacttcctccagcgcaccaggccttcctctgtcctgtctgaggatttgctcatgcaacgtgctgtggccaaacaccctgccctcctcccttggcagatgtcttcctctcctttaaggcctggctcaggtgtcgtcttggtggcttcgggtgtcagctgctctgttttgctcatgcacctgcttgtgcttctgttgttgcctcctctccctggctgggctcgagctgcttcagggcaggaaccacgtctttatagtttgatgttcccagagctgacccagtgtttggcataggggtgtgctcaataaaatcgagttgacatgaatgagcagatgctgcctcgttgcagtctggtagtgtaattccaggctgcgcatgtgaacttcgacttctgcccctgcccagggcagagaccaccgtgttgctttatgcctcgctggtgagagggggtcataaacagtttgtgctccatgaacccttcctgcccgcctccgaggtcatgtttctgctccctctcttctcccttagagcccgtggggacaaggcagagaacttgagtggagatggaggtggtgaatattaaaggaacaaagtgctccttcaggtctgggcaagagccatggatcctgtaggtcagcttctggggcttcccatgccctcacgtttcaggagataacgtgagcctcggaggacctgagttctgaatagaaaatttttgctcttcatttcttcacacacccagcctctcagtgagctcctgctggctttgtccagcatgcgacataagattgaatccaagccttttaagatagagccgcctgctctttagtgaccatgaagccaagcctgtaataattactcttctgatagcccaagacaattgtattctgttttgttagaaaggaatttcgaggtgaacaaaaatgttttctttttatgtgatgttgccataggtagcgtgtgcctgtcagatggttttgtgttttctgaggagcatagactagtagagctagctcagcttcaggccatgggatgcagggctggcttccctgccaacgcctggcgctgatggattcttcccgcattgctgggaagggcagactgaggcactgacacaagaagagttgtagctggtcataagtgacagcatcctctgttcactcgattggtcagttgtagcttcatccaggagatggtcatggggttcctgctgcataccaagctctaggtgaggccacggggactcagcagaaacaaggccgacctgggtcctcccttgtggacatgacagtctggggagatagaccgagaggaagcgattttgaatgagatgggtgtgaagagcaggggccatgaatctgtgtcagagcagccaggcctaccagggaaggtcaaagaaggcttcctggaggaggtgatgtttctgctgctatctcagagttgactgggagctggtgaggggagacaacattccaggcacagaacatccgaaggcctgagatgatgaagagcaaatatccgccctggggcctcagaggggtccagcttgctggagggagggcagagaggagagcagcctgccatgagtcccgaggcttccgactcaagacttgggttgggggtgctgagcccctttctcctttttacatttccctacccacagacctgagcggccatgggaggttggggttggcatttgcctgggggagtttctgagcgagcagcacctgctaccttggtggaacccattgctgggaatggccagggctcagcaccagcgctcagcagatgctcagtgcgttttgctgagtttgctgagggaagactgttttctgttctctctcacacacacagagtggatgaggatgaggatgacctggaggaagaacacataactaaggtaacacaagtgtcctcagctggtgctgtgctgggggtataggctgggctgtgcacccctggggaggaggctggagtcacttggctacttctcaccctcctctccacaaaggaggagcttccagcacttggactccgttgcttcttgcacacaaccctggtcctaagttgctcccttggccagctgcagtggaccctggagtcctctcctggggtcagggcctggggagtcctctcctggggagacctttcctgggaacagggacctgaggagacctctcttgagtttggggcctggggagacatctcctgggttcggggcctggggagacctctcctgggggcagggccatgcttgccaccccagggcatcgaggaacagctgttctgggctgaaatctgggtgttttctgtccctgctgggtggtacgggtaggacagacatgagtcccctgccctttgggtctctcatggtgtgcttctccctttgtctgtgttcccatttgcatggagggctatgggttgtgtatggtctgacatttcccatttggtttcattgatttatgacttgttttctgtcggaagtaggtattttctttgtattttctttttttctcccttcactcttgccttagaggagtagagagagggtattctggtcagccttcctttttccctttggggatgtgtgtgacacactccctcccctcccaccaacaacccaccctccccaagtggggaccctttgccacgggagatggtcacccatgtccaaagattggccaaccccccaaaagcggttgattagaggctggatatgactcgtggaaggagctgcctttggggcattcccttgaacttctggagctgtgggtgacttgggaatccctgggtccctcgatagatgcctgacatgggacattgctgtcctgcctcggctttgtgcattgggagccactccctttccctcagcctctcaggccctggcgtgccttgatgttagagaatgctgtgggatgttttggttctctctttgaagcgcctttctttctctctgctagatttattactgtagtcggacacactcccagctggcccagtttgtgcatgaggtgaagaagagcccctttggcaaggatgttcggctggtctcccttggctcccggcaggtaaacagtagccagtatttccaccaggggccatcctgctcctttcgccacaactttgtcctgctcgtccaggccttgggagacgctgggtctgtgacaggctgaaccgtgtgaggagcagccccctccctgacctggccggcccagcactggaaggcaaaggagaggtggcggggcaggtccacgtgtgttggtaggatgtcatttagctggcaccatctttttgcctctttctttctcctttgctgcagaacctttgtgtaaatgaagacgtgaaaagcctaggttctgtgcagcttatcaacgaccgctgtgtggacatgcagagaagcaggcacggtagccactgggaccatggtgtagccgcaggtggtctggagagagtgaggcaggggtggcagtgactgaagaccattaagtgtctttcatagaaagaatggcagaggagaccccagttccttcctgagtcccctctccttgggaaaaagtgttcctactctctgggtcagtgtctggtccgaatccttggcttggagatgattttacgggctctttctggagaacagaagtaaaaccttacagtgttccgatgagaccacagtaggcagtacttgggagggtcttatagaccctaccccatggaagtgggtctcaacattacacaaccccctcttgggcccgtggacagttgctgtcctctctgttttctctctttgtgcctgtgccaccctcagagaagaagaaaggagctgaggaggagaagccaaagaggaggaggcaggagaagcaggcagcctgccccttctacaaccacgagcagatgggccttctccgggatgaggccctggcagaggtgaaggacatggagcagctgctggcccttgggaaggaggcccgggcctgtccctattacgggagccgccttgccatccctgcagcccaggtgagggccctgcagggccagaaagccgctcttgactctcactgtggtctaggccatgaggggggtcctcatcacactgtagtttgggggatgccccccaccgtggtcaggttgatggcaccttaacccattctctcctgatgtgtgagttggaggaggcgcgtgggatcccttggggtctccaggcagcagggccagttggcattactggggatggtatttaggagccaggaaagccggtgcattcctagtgaaaccacagggagaggggggatgccaggagctgagaagagtgtgctgcatacatctatttacaaatggctttccaagtgatgctcccaacttccatgcctatgatgtgatggaggatgtcagtgatagaaccattcagttttccagtttttcctttttgtaatatcagtactcttaactggaaagctttccctaacttacacctacctgcagcacgtgagaatactgtcttctctgcctcaacttctcttgatttttaaacagaaggaagaactgctaatgtagcagatcaaaagtagtatctcactgttatttggtgggtgcagtttcactatttccttgctacttctttaatttgagtgactttggaaacgggatatcactagtggaaaattctgtataatccagaaaaaaatgtaaggttttaaaagattcagggaactaagtaaccatttgcacagcagctaaatgctcaccagcatacctgctgagctgtgtgggcactggcagagaaactgaggaaagctgccaggccccatggtgtcccaggccttccctcccgtctgtttgcctttagagcaagattagtgctataggcatttatacacaaataccataatatggcccaaaatctttacaatttttgaatttttaaagtactttgaccatattttgcttttatgttaatagtattccagtgaaattctgtgcatggggacactggagcccagaaaagttaagtgactcatattttctcaccaagcgtgggtgatggagccattcagttttccgatattttattttttatatgagtattcctttaactggaaactttcctaacaacaaacacctaaagatgtgcagagttgcttttatttttgttaccccagctccacgccttaaccctcactttgaaataggatgtatcaaccctattttgcagatgaggaaagcaagagtcagagaggttagacaactcttccagagtcacacagctggggagtagcagctccaggagtagaagctggggccgcttcctggtgcaccgatggtctgcaggtgtttgtggaaactcgggggcctccggggcgaccttgaggacatggacaaggctaagcaggggttcccttcacccagccctgcccttggtttactcaggagtcagaccagccctagtttcctgtgtttcatgtattggcttttcatgtgaaactcgaggagagcttgtccgttgccacaagctgtttttcgaatgtctctacacagtccaggcaggaaatagaagcactcacatcaggagctcagtgtcaggcaggcaaggctcctgcaggggagccccgccctgctcaggtggcctcatctcccctcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccaggtgtgtgggcctcccctccccgggccagggcctgctgtgacgtaaagggacttggatggttcctccagacacctgggccaagagttcctccggaggtggggcttgatagagggtgcacgagtcaaggcggtgacctcatcggaggctgaccatggctttccagtgcatcgggggaccccgctatgacagagtgcctcatttccctgcacctcatctgcccccatgctcctgagtccctccagccctggatgccagcagccagttctgtaagccagggagatggcatgtgtgaggcagaagtcccctcaggattggattttgtcattactgaagttgtctggaggggactgaattgaggaatgctcaagatcagcgcaggctcctcctgctgccctatcatgcgccatgcatggcaccaggtgtctctggtcttcacgctgactctgccatgggtgtggtgttcctgttttacattggaaacttggagattcaaagatggtcaagctctgtcctgaggtcatgcagctcatgagtgtggagctggggtgtgcccactggtttctgactgtgaaaacccccacgacatcccaccagctctactgacctgtgcctgggctgaattgaggctgggatgtgatggtggccttgaaccatcactctttgtagactccaggtcttttcccaacccggtggaaacttagcagggagattccatacttgaggaattcagcctcttgctttttctctgacccacagtggacactggaggaaaacttcccttccttcccttttctcttagctcccaccagcctaagggctgtggaaacccgtaccttttgtctgcagccagccccctctcctccctttggtggcttcctgtgtgtccagggccagcatcttctaggtgaatctaagatgtcagtaccttagccctcagctgcttgctcagagcctggtttgtgttctttccccagctctgccaggcccattcccagctgctgcagtacgtggagcgatacgggtgagatgtgaccctctgaggtagtgggacagtcccttggtggccccctgcgtgggcctctgagaggcaggcagcactttggttcccacctctggcccgggctgtggcggggtggagctgcatgccattcatgtcctaggcacatcatggtgtgtgctgcacacagacctggaaggctggggactgaccgctggctctgaggcctggggccgtggccagcctgctctctgggaaaggatttgtagcttgtgacccagtttgagaggcaccgggcagcaaggcttccactggggtgggcggggcgagtcgccatcagggcaccaccacttaatgtccgttggcttcttctcaggaagcgtttgaaggccaagaacctgatgtacctgaagcagatcctgtatttgctggagaaattcgtggctgtgctagggggtgagagcctcgtccccctgctgaccccgggcctgcaaaactcgctgggctgctttttccttggatgcccatcaggacacctcagttctctgtgtttttaagaagggtcggccgggtgcggtggctcacgcctgtaatcccagcacttgggaggccgaggcaggtggttcacctgaggttaggagttttgagaccagcctggccaacatggtgaaatcccatctctactaaaaatacaaaaaaattagctgggagtgttgccgtggcctgtagtcccagctgctccagaggctgagacaagagaattgcttgctcaaacccgggaggcggaggttgcagtgagccgagattgtgccactgcagtccagtctgggcgacagagtgagaatcagtctcaaaaaaaaaaaaaaaaaaaaaaaagaagggtcttggtcattgatttagaaaattcttgttctttgtagcttagttgagttgtctgacttgagctttatttagacccatgggttctttgcccatgttctgaggactttttatttcaggccctgctctggggggatattaaggatacagcatcacatagacacacggtgtttccgtgataggcatagttctgtgggttgttcgaagcacttgcatatgcggttttgtgtgccctgtgagaacgcagtgctggtatttgaatccttgttgatagacgcataaactagagctcggagcaagggctgctcccagcacgggagcctgggatcttctgactccagctcccacgcctctttgcatgaccctgtcacgtccccttcttttatgatggggcacccccttggaaggcgtctgtggaagtggaagctgcagaaagcctgtgggagctcctggcgggagctggtctcgtgttgctgctctgagccaccagctctgctttgcctcaggctcaccagtggcctgggcagctcctctgtgctccggtgccctgcataccttggtctggctgctgtgtcccggcctcctggagaaggggtgaaaaacatgaacttacagggctttgggttccacgtgcaagcacgtgagtcagacatgggaggctcctggacccacctgccctctcagtgggtccgttgcatgctataaacagtgaaaagcaaaacaaagccatttaaatacagatgctcttcttacttgatgtgcagtgtggagggagagaagatagggaagggttgggggtcctgagaaccagcattgtgacctatttccattctcttttttagggaacattaagcaaaatcccaatacacagagtctgtcacagacaggtaagagagttgccctcagagggcccagagctgatctgagccacttccgagcttaaccctgggactgaaacctgaggcttagggtgaagctcccaaggcccttcatgtgtttgttctcagggacggagctgaagaccatcaacgactttctcttccagagccagatcgacaacatcaacctgttcaaggtagaggtttccacctttccacattccacatccaatttccttcctgtcaccacctgtgggtaaagtactatgttaagactgtagaaggaagaaaaagcaaaacagatgtgtaattacttaacccttaacgcaacatgcctgtgagacaaaagtcatcttcttttagagtgaaggccacagggatgagggatgggtgagaaagggacctttcttggtgccccatagaacagatagagactccaggtccttgctctctcactccgtcttctggcacagtctccctcaggcttatggacaggaataggacgttgatttgttctgtgcaacccctgtcacgtcttcccacttgggccttgggtctggttgcagcctcagacctctgctcactccaggtctgtgtacccagcgctccccagatgaaacacggccactgccgcctgaaccccaagctcgtaactcaaatcagcaacagtgactgcccccgggtacagggttctgcctctgttgtaggcggcatgccatgtgctgtgctctgagctaggatatccttttgccccagcaaggaaagcaaacaggcccgtggaggtgacttcaggagggtggcgagcacaggcttcccacaagtgagccaatagcaagtggcagagacagcgtccaaacctggctgcactgacttggggccccacattcttcccatcctgcctgccttttttttcttaaaaccagcttttcccctgaattacacatttgggtcactgtcactgccgccatccctgccagacaggctggatccaggtcatccttgatgcctttctccccttgtctcccacatgcctgtgacagccgccaggcctgacagcctgagacagtcctgccgtccctgcgcttctcccacagctgggacatgggtgcaggcactccttctctcgccttccctttgccctccttgctttccttctcccctcttcttcccatgggtctcgggtctcatcactcaccattgagggaatcctcatcgaaggacgtcgctctttttagaaaccggtttaaaggctccaaactcctcatctctgcatcccaagctaagatctggcaccaaaccacacacattggatgcaccgactgagtggcactgccccagcccctgagcaggtcccagccatcatctcctctgtggctttgctcatagaagttccttttttttttttaactctttgtcacctggaaggaaagccaaggggaactggattttactgagcactcttagacttgagagagacatttggaaagagggtctccaccctgaggaggacactgcgttgtgggcaggggcagtagaggagggggtggcctcggagaggagatgacaaggttggtggcaaggaggctccaggtgcctcagaaggtagcactgcgttgtgctgcctgggtggtagaagtggtgttttttgttttgtttttaagattatagcttgctcagtttgcactcatgcctacagctgggcttggtttttgcaggtgcagcgatactgtgagaagagcatgatcagcagaaaggtaactgctcccatcttgtggtcctgaacaagacccagctgtgccccaaccccctgcccttgccatgctttcctcccctgccctcagggaactccagagtccccttcgtctccactctccttggtgcagtgggccttgctggggtggtgggatgtgtgctgcaggtgtcttgggcctggcagagcctccgatccacccagcctctctctcatggctgtacctcgttcctctccactgctctctctcatcccacccagctctttggattcactgaacggtacggagcagtgttctcatcccgggagcagcccaaactggctgggtttcagcaattcctgcagagcctgcagcccaggacgactgaaggtgaggcaggagggtgggcaggcagagccggctgcacgcatgggcaaggacttctgttcctcatgtgtggacctgaccagagggaggcctcctccccgttctgctctgtgcagctcttgcagcccctgcagacgagagtcaggccagcaccctgcgaccagcttctccactgatgcacatccaaggcttcctggcagctctcactacggccaaccaggacggcagggtcatcctgagccgccaaggtaatcaggtggttcttggccaggttcagttcccaggaaggagccaagctgagcccgggagccgcagcgtgaaaggattctttccttccatcctgggaacttcctgggttaggaggaagcagtgcagtgggcactggcctgctgtgacctgggcaagcagtggaggtggatgggaggagatcgaagggctgggatgggggtcccgtgaccagggtaagcagtggaggtggacgggaggagatcgaggagctgggatgggggtcctctagggcaggggtcctagggaaacttctactgtggggtaggtgggctttggtttgggtcatgattttgtcatctatgagccttgtgatttggactattttctttctcaacttcagtttcttcatatgaaaatggagaggataggccgggcgcggtggctcacgcctataatcccagcactttgggaggctgagggggggcggatcgtgagttcaggagatcgagaccatcctggctaacacagtgaaaccccgtctctactaaaaatacaaaaaattagcagggtgtggtggtgggtgcctgtagtcccagctactcgggaggctgaggcaggaaaattgcttgaacccaggaggcggaggttgcagggagccgagattgagccactgcactccagcctgggcaacagatcgagactccatctcaaaaaaaaaaaaaaaaaaggatggagaggacagtgtggtccacctctgtgggctggttgtcctagagattaaatggtgtttaatttaaagagaaagcactagcacttgtgcctcagacctggactcacctgggggaccccctttgctgggacgacagaagtgtctgttgggcttgcactcacctcccaccgatctgtttttccaggcagcctcagtcagagcaccctgaagtttttgctcctgaatccagctgtgcactttgcccaagtggtgaaggaatgccgggcagtggtcattgcggggggtaccatgcagccggtaaggacacctttcccagcccctcgtgccccaggtgttgggatgagatgggggcttgggagagatgcattatcagtcctgttctctcctggggccccaagccagaaagggtcagctcgagcaggcccagtggtgtccgctgggtgacactgctattctctcactgctgtgccttttaggctgcaggagcagtggagactcctctgctgctccattctgtagccccaggatcacatgtctcccagagaaagctgttctgtggtttcaaactcaaggaaaaaaatcatgattccacttttaaaaggttcattttgatgtatatgaatataatagtctttgtaggcgtaatttttacttatgtgcatagctgttttaaaaacaaaagtacggctccctccatgtgctgtcactggaacttgctcttttcactcagcagccagagggtcataaaccctgtctccttgtcagcaagcatgcacgtatttcagtatcccagctgtgctggattccagttacacagatatatagcatttcatgtagctgcttctctcttgttaggtgtgcaagctatttgcagttttctgttttgagcatgactgtgataaatataaccgcatttctgcacagtggtgactcctacctagcgaagggcctcctggacaaaaagctgctgggaatcctgaagcagtgcttcccagccccagctgccttagcttttgatttttatatttttgtatggatagattcatagttttattcattcggcatattaaaagttgtttacagtaattattgtttctgacgttcacattgtgagagccccttcctgctagctcaggtcctccccgtggcccggtcagtctcgcctccagcacagcagaatgtcatgggatcaccatgggtgtcctttccccacactggattgattcatttctccaagctgctctggtttcttgtaatggggaatgacatttagaagtcaagctgtgggtgctagggtgtttgtcgtgctcctggggcgttttggtagacagatctaggaaatgttttcagaatgaatccatactggtatttctttctttctttctttttttttttttttttttttgagacacagtctcgctctgtctcccaggctggagcgcagtgacctgatcacggctctctgcaacctctgcctccggggttcaagcgattctcatgcctcaacctcctgagtagctgtgattacaggcatgtgccaccacacccagctaatttttgtattttagtagagatggggttttaccatgttggccaggctggtcttgaaatcaggtgatccgccagccttggcatcccaaagagctgggattacaggcatgagccaccacgcctggcccatattggtgtttctaagtaaaaatcaaaggatttgtttacttgaccttttattgtacctctttttctcttaagcctgaacatgtgtgctacattaacatacttatctgctctatcctataatatacttaaaagttttgaaatcatagtaccaatattacttctaacaatagatctgattgaaattgcctttcctctttgcctttagagtgtaacccactaaggatgcctggtcactaggctctaaagtcacgtggaaccaggcttctctccgtgtgcttctgttgtcagtttcatagataactaggctgtttttgtttcattttcttttcaattttagaatttgcttttttcttttctgacttgtagtttttaaatatgtaaatatttgtatggctcaaaagtcaaagcaatataaaaagatctattcaggaaagcctcactctcatccctttccagcccattccccacccccatagggaatccgttttactagcttatcctttcagtctttctttttcccctaaataagcaaaaacgtgtcttcatttttccctttcctgttttatttacacagaaggcatcttagtcagttgtctgaccatcgctcctctagtgggctgcgtggttctctgttggacagatgtagggagcttatccaaccagtaccctctggataggcaggcgcatgattacagggaaaggtccgggggcacatgctgtttggtatttgtgggctgtatcttctcactggactcctaaatatgggattcctgggttaaaaagtataaatatgtttaatttgttaactactgtgaaatttcatgagaattgtaccattctgtatcccaccagtactgtctaggaatgcctgtttctccagagtggttacttttggatttttgccagtctaacaggtgaaagcctggagattcttattcagtagtttgggctggggcctggccatgtgtatttttgaaaattttcgctggtgattttgctgcatggccagggttgataatgactgtgccagatttgctggatttcctttgctgttcctgcacatagtttaaacgagactgccagcactgggtatcagtcaccatttttctttttgttagtttgccatcagccttttctttgacctcttctttcagtttgtgtgtacttgctgtctcttagcccagacttctcgcttcctttctgctgggcctctgaggggtcatggggccgtgacgctgtggccttggtctacaggtgtctgacttccggcagcagctgctggcctgtgccggggtggaagctgagcgcgtggtggagttttcctgtggtgagaagctgtgcccagggtggggcaggctagaggtcaggttctggcccccgttttctgtgggtaatacctcatactgcgaccaggcacaggggcggaggagaccccggggtgggagcctcacccttcgtgcgctcgcccaggctctcctgctttgctccctgctgcctgctgcccagtgtgactggtgatggtgggcgggtgagcgctgtcagtcgctgttcctgtgctggatgatggggcagggaaatgccctctctgcagtgtcttgcagcacacctgcatctccagttttcggcccctccctggctcttaccaggtcacgtgatccctccagacaacatcctgcccctcgtcatctgcagcgggatctccaaccagccgctggaattcacgttccagaaaagagagctgcctcagatggtcagtcccagccagctcgccgcaccacagcctggcctcaggcagcaaagggttttctggggcaggggcgctctggcccaccctgagtgttttcagtgttggggaaattgcacagggacacccgcttagagccacacagaatgagcggcgtcgatctagatgcttatggaggaaggtctgagcttccccgcccctcacgccttaggctgcgaaatatgtattcataaaacctccaggcatcctctgaggacgcctcacacaggagaaagctgctagttccctttggctctcttgccctttggttatatctgcccctgccgggggtagggatgtggggcttgggggcatctcctgtggtgtgcctggggtgtgcagcccctgattgtcgttgtggtgcccatcaggaccctggacagaagaagggaggactcagtgccagggcaatagggaggccccctagggacgctagtgctgtgacatgtgtcagaaaggcgcagtcagcagcagcggctgggtgtgtttggtgggaggtggcacctaccaccccgtggttcccacccaggggagccaagtcctcttccttggctgtagtcctgccgagggtctctcctcagttttgagtctcaaggtgaagacgcggtttgtgggtggctgaggggttgctccatgggggctccctccctccctcctttccttccttagatggacgaggtgggtcgcattctctgtaacctgtgcggtgtggttcctggaggggtggtctgtttcttcccctcctacgagtacctgcgccaggtccatgcccactgggagaagggtggcctgctgggccgtctggctgccaggaagaaggtgagtggcctgtcggcagccttcccacttgtgaggacagtgccactgagtcctcctgggagctctcgtgctcatcgggtcaggacaggcttctggctcctcatccccaccgctcccagtccctgactacagaggatttcccccaaagtccctggctgtgaggttctccagtcccctggccagaaaacacaaggccacgagcagactcgagacctggcaccctgaacctgtctctgggaaatgtcctctgtctttctcagatattccaggaacctaagagcgcacaccaggtggagcaggtgctgctggcatattccaggtgcatccaggtgcgggcgtcatgctgggcttgggtctgagatcgtgtgggggtggcagctggaaacgttgtgggtgtcatccaagttttggctcagcaactcagcgtctgggtttctcctacaggcctgtggccaggagagaggccaggtgacaggggccctgctcctctctgtggttggaggaaagatgagtgaagggatcaacttctctgacaacctaggccggtaagtagtggttctgctcgtctcctgggccgtgatacatggccggccctcactcccagcagctgggcccctgcctgctctctgctgccattagagcccacagctgggctgcgactgctcagaccagccagctggagggaggggctcagcagctctgggtttggtcctgggagagcagttggattttaggctacccattgctgtatcaggacccagtcaattggcctagacgggatctctcagccgaacaagccctctccaggtggtaggtacagagtggagagaggctgagttttgatcacagtcggagaggctgagggaaggggtagaacggagcagctggtgacgtgggtgatgacccgggaggtcctgacgtccacctgctgggctcttgtctcccccgcccaggtgtgtggtgatggtgggcatgcccttccccaacatcaggtctgcagagctgcaggagaagatggcctacttggatcaaaccctcgtgagtgaccccagtgtcacagagggtgacaggagagtaggcagtgggtgggagtggcatcacccccagggctgatacagccaggccttccccgctgcgctggcgtctcctgccccctccggaagcttggatgcccctccacaccctcttgatcttccctgtgatgtcacctggacccctgctgctggcattggccacgaagcctcctggtctggctccaaagcctggcagggtcttttcccagggggagctgcaggcagggaacagtcctgatgggtcttccccttcactcccagcccagagcccccggccaggcacccccagggaaggctctggtggagaacctgtgcatgaaggccgtcaaccagtccataggtgagcctggctgcctccagctgggtggacagatgggggctggagaaagggagaacaggaaagaggggttgcctgccctgtttcctatataagtctgaggaaggggagggggtcgccgtgggaatgtgctgtaggggggaggcaggtgttgctcggagccccagcctctgttcctatgcaggcagggccatcaggcaccagaaggattttgccagcgtagtgctcctggaccagcgatatgcccggccccctgtcctggccaagctgccggcctggatccgagcccgtgtggaggtcaaagctacctttggccccgccattgctgctgtgcagaaggtcagtcctacctttttctttctgagagcctccccaccccgagatcacatttctcactgccttctgtctgcccagtttcaccgggagaagtcggcctcttcctgatgggcaaccacaccactgcctggcgccgtgcccttcctttgtcctgcccgctggagacagtgtttgtcgtgggcgtggtctgcggggatcctgttacaaaggtgaaacccaggaggagagtgtggagtccagagtgctgccaggacccaggcacaggcgttagctcccgtaggagaaaatgggggaatcctgaatgaacagtgggtcctggctgtccttggggcgttccagggcagctcccctcctggaatagaatctttctttccatcctgcatggctgagagccaggcttccttcctggtctccgcaggaggctgtggcagctgtggcatccactgtggcatctccgtcctgcccaccttcttaagaggcgagatggagcaggcccatctgcctctgccctttctagccaaggttatagctgccctggactgctcactctctggtctcaatttaaaatgatccatggccacagggctcctgcccaggggcttgtcaccttcccctcctccttcctgagtcactccttcagtagaaggccctgctccctatcctgtcccacagccctgcctggatttgtatccttggcttcgtgccagttcctccaagtctatggcacctccctccctctcaaccacttgagcaaactccaagacaccttctaccccaacaccagcaattatgccaagggccgttaggctctcaacatgactatagagaccccgtgtcatcacggagacctttgttcctgtgggaaaatatccctcccacctgcaacagctgcccctgctgactgcgcctgtcttctccctctgaccccagagaaaggggctgtggtcagctgggatcttctgccaccatcagggacaaacgggggcaggaggaaagtcactgatgcccagatgtttgcatcctgcacagctataggtccttaaataaaagtgtgctgttggtttctgctga

SEQ ID NO: 15 - DNA, 31768 bp, Homo Sapiens
tcggtttgaatcatctgcaactttattccagagcagaaataagtcattttctaacaataaatataaaaaaaataataaattaagattcgaaaaaaatgtccaacaaaacaaaatctttaacactgacagaatagaaacttatccaaaaggatgagagatggggccgactggggcatgggcaggacactcctgcagcaccggtccctgagtccccagctcacgaatgtttgacaccctctgtccccagccctggcggggccccctgccacacacacacattctctccacaaagtacaaaatatatatttaaaaacctcaacacaaccaagcatcttgcaaaggcccaggaaagcaagggtttggccagtcagggatgaggatggggcccgagggtctaaagaaggcactagagggacagggaccgctttgggtctcacccagtcaagttcacagtctgccctcttagtgtgaggaaatggggcttgaggtaccctgtttacttggcgctgggccaagccctccatctcctgagatggcctcatgtgggagaaggcggagggaaggtcggcttgggaatatcccatatgtctgtccgaaggctgtggcggggctcctgctccagggatgctgggacgtggcggtgcctgctaagtgctcagctgtgtgcgtctcgcagggaaagagggcccagcccagcatccctggtcatctcctcagttcaggccagggtgtcatccgagacccctcagcggaagttgcagggggaggaaagaactagaaataaataaagtccccagtggcccagcatggcacagcagggaggccactctgtttcttcaagtattcttggccgatggggctccaggccctgtcgaggctcagatggggatccccacagtgttcacctggtccttgagtcccagcaggctgtaggcgatgcgcttctggtggccgggcagccgcaccccaatcctcttgatgtcgctgtgggccgggagggagagagggagagttaggggctggagcaggggagggggccgggctgggtggggacaggactcggtgggcggctggggaggggagtggagggaggcagaggaggagggtggagagggtgccttggggacctgtagggcaagagagctctggttaggtaggcctgggagaaggagccacagcctagaagcttgccaaggtggcccaccatcaacaaagttaggaaaacgacagaagcctcaactctgtacgatgctttaaaaaaataaaaataaatcaaatcttctgaattatctgtgaggcaggtgctctttttcatccccattttgcagattagagaactgaggtcagagaggtaaagtgacttgcctgaagtcacacagctaggaggtggaagagctgggaatcaaaccagctatgaacaaatgccttccctcccctcacccctagtctgttcccagtgcccccagctcaggcctccttcccaggaactctctagggatgtcgctcaaagcctctctgcccaaggtctcttcccacctgctgcctcatttctccctcactccttccaagttcccactgctgatcatgaaggaaggacttgggaaatacttgaagggttaaactttgcgagtcttcatgggtgaggcttgcgggtcaccagatccagtgactaggaagatgtcttcccttggggaaacctcagtttcctcccgtgtaaaatgggagctactgtccatctggagggcgagagacctcaaaaccagcagccgagggggaaggcagcatcagtaccagatggacagatgtgcccaggagcccacagccctgctttcccacccccacagggtacacgctctcctggggcccccttccatgcccctccgtcccctcatgaaatcacttatgctcccaggaacctgtgaggagggcatttattactcactttgggagttttctcctccaccgtcctcacccactagcccaaacccatgaaaacacccaagtttttatgggccgacttttggctgtaaagggagctaattatatgatgcaagatcctagttgcagttctgcagacatgactttcccacaggctccgggagccccggcacaggcgcagagcagggaagggcagacccaggtgagttggggggactccaggacctcccgcagaggctggtgctcccacagcagcaggaaggccgagacatttgggacatttgggagaacttcctacgctacctgcacaggacgtttctaacctatacagttggaggtgctgaaaaagcagcagtttcccacacacttgaaggtctcaaattgtggtccctggaaaagcgctcagaccacggtgaaggagacaggacccccggcctgaccccagattcactcgatttgcagttccgcaggtggggcaaggagtctgcatttggttgaatcccagaagaaacctgacatccggtttaaaaaccagtgggttgtaagctccaggaggacaagtgctgagaccttgtcatctgggcccatcacccccacagcacctgctcccgcccccacccctgcccagggtccaggataggcctggcacatagtaggtccctaggaagtgtctgctgcatgaatgcatgagcgaatgaatgctttagcggaggttgggccgttgctgggccacctctggtccctcttgcaaatggtagtggttaatctcacaggatgggagcacagtttgctttggaggccctgcgtagaaaactccaaggccatatactcggtgagctcctactgtgttctggccctgggtgcagggagacgggagtaagaaatggctcctggagcctcacgtgtcagatcattcattcattcagcaagcattccttcagtgccaagcctatgccaagggcactggagaccctaagatctacagcctgtgccctcgacccccacacaggatgcaaatgctgtagtcccagctctagacagagcctggggttgggctatttttctggggtgcaacatccacgcctttcgtcagctgctcacaaaacatctgggaccactagtctagctagaaacccaactgactccaaaatagcacaaatggagaagagacagtggctgtgggaccccaggggaccaggcagctggtcccctgggagggagtcaagaaggcaggaggctgagaaggggaggaggtgggacactgaagcctaaatcctgatcccattgggaaaggcacgcattcccctgctaccagctccaagtctcccgttgggacccatggcgtgtgtagacccaggcttcaggttttaaaaagtcctttgagatccccatttatttggaaagaggcagaggggaaggaggaggcatgcaggccccagctctgagcaccagtggctggtgggaggagcgggtggtgggtggtggggggcgccgaatgacttcctgcctttatccaggccctttcacaacaacgcgcactgcagcgcacacacacacagcctccatccatccaagactgccccgtccctgctcgtgggaaaggaattggcgaggagcaccctgggctatttagggaagcttctaagaacatgtgtttcccataagcacttctccgtgccctcagctctggtccccagaagagaggctgtgttgtccttggtgggagcccctggaggagcaaagggtctggtggatgttcccaggaaaaaggagaaaaggagggggcatttgcacagtgctaggggaggaaagcaagggagtggaggaaaagaggagagcaatgaggatttagcacccactgtataccagtcgtgtcatctgcgctgcacccatgcaatcccatcaaacttgatcaaggtcacccgctaggaagtggcagatgcgggacttgaacccaggtatgtgtgcagagcccaagcctgtggccctgctgggctggcgggcagcaaaagacatcctgtgatccatctcccctccctacgtgtccccgcctcccctctggtcggctctgttcctgcctgcttcccatcaccgactgtcccctgagggaggctatggccttggccagcaggttgggagcccagctgagcaatttccaaaggccctagagaatgttcatgaacaggctcaaatcccagaacttctgtgacctagaaccatgggaggcccaggtcatcccctccatacggttcccaaaacctcccagcctcccggtctgttcccgccatgatctttgaccatgcacaagctgggttgttgaaactggccactatttttagaggcacaaaaggctaagaggatagggtctcccccttcctgggacaggaggaggtgtctgtgccaaggccatgccgggaaaagtctcaatgctggagttgggaaggggagaagagctgccaaggggcagcttgacaaaggggcaaacccagggccagcagagagtaagtggcacttctcaccaggtgggactgcaggctgagagccaaccaagtggagagaggtgcccggggtaggccaggggttctctctcctgggcagcagtcagggcatcttggagaagactgccccaaactggctgtgtgacctcaggcaagccggtaacatctcagcctgtttctctaccaatgacctctccgatccctgcgctctgggatcccgactgactgggcctggaatcctgctctccccctcatggctgtgggaccctgggcaggtcactgcacttctctgcatctgtttctcacctgcacctgtttctcacctgttaacaggactcaccccgctgggttctcattcaaagtgctcaagcagagacggcacatagccctcagtaaacagtagctactgttatgattacggttactattatttccccactctggtaaaggatgtaggaagaggagagagctgagagtgggcacccagagctgccagctgctggcggagttctgcccttctcttccaaggagcctcttcccagaagagaaagaacaaagagaggagcattgaggggcagggaagagggctggggggggcatggaggcagcctctggagtgggaggcgggaggcgaggggggacggaaaggggcctgacttactcgttggtcatctgcaccaccttctcgatggcagtgtagccggccgccatgaagtgctccgtatactgctgcatcttgatggactccagccactcggacaccgtgcggaagggcaccccctccgagccgctcgtgctggggagccggatagacacgctgcaacaggaagcactgcaggtgaggggctgcagcacccagtccaccctgggccctgcacctgctgctccctaacctggatgattgactcggctgccccgtgcctccgtctccttatctgggcaacagggaagcccagtcaagtagggttcaatgagacctcctggcacgttgggagcgctcagcatctgtaactactgctgcccctccactcctactaacaggaccaccaccaataactaccacatcataaaatgctacgagcagagattccagatcctgaggtcacaatcccagcctgaccacttccagccatgtaagatattcaatcgccctgtgtctcagtttcttcttctacaaaatgaggatcactggaggactcatctcgtaggttgtttaaatgaatgaaaacatattaagtgctcacgcagtgccctgcacacagacacataagctggttgcttctattaggatttcctgggccatcgtgtccagtctaagtcaagtccacacataacctcttagcccccagcaccccccctaccagcttcacctgggtggccactctaccgaagtggttcaagagtctgcagaaggaaaattgaggtcatcatgggcagagggcatagaactcaccgggggtcaaagtcagccagggtcttgagggagtcaggggcacgaatgagcttgtccaggatgctgacgatgtcagcgaacttggggcggcgggcacgctcctgctgccagcactgcatcatgagctggtagatggcggaggggcagtccatgggtgtggggagccggaagccatcattgatggctttcatcacctggcggggcacgaaggtcaggggcgctgttgcagaaagccactgaaaccctctgcagcctccagcctatggaggtgggcaggggaggggaggggaacaggaacatcccagaaacagacaggaagggcctttcttgagctgccacccaaccttcagagctgcccaaagggcaaatgcctaagggtctgtgtccagagttcactggaagggacttttttttttttgactgagacagggtctcagtctgtcacccaggctagagtgcagtggcgctatcacacctcacggcagcctcaacctcctgtgctcaggtgatcctcccacctccgcctcctgagtagctgagactacaggcacgtgccaacacacttggctaattttttaattttttgtagagatggggtttcgtcatgttgtccaggctggtctcgaactcctgagctcaagcgatactcctgcctcagcctcccaaagtgctaggattacaggcatgcgccattgctcccagctagaagggaccctgctccctcacagggcaccaggcagcagccacactgtgtaccctcagcccagcctccctcccatctctcttcccctccctctcatctggctgccttacagtgcccttggtcttggcagagatgtgacctcttctgagaagcctcccaggccaccaggctgagagaggcaccaagcacacagacacacacacacatgcatgcatgcacatgtgcacacatacggatgcacacacatgcatggacacacggatacacacgtacaccccactccttttttcatctctgcactctctgaatcagctcctggaacccagcacaaggcctggcacgcagtagatcctcaagaaatatttacggggctgggtgcggtggcttacccctgtaatcccagcactttgggaggctgaggcatgtggatcacctgaagcgaggagctagagaccagcctggccaacatagtgaaaccccgtctctactaaaaatacaaaaattagctgggtgtggtggcgcatgcctgtaatcccagctactcgggaggctgaggcaggagaattgcttgaacctgggaggtggaggttgcagtgaactgagatcatgccagtgaactccagcctgggcaacaagagcaaaactccgtctccaaaaaaaaaaaataaacatttatggagcaagcctaagaaggttcatctaaactgtcctctgcccagcccctgcagtttgagatgagtaaagggcttgagttcaggtccggacaggcctggggagggcaagggcacccacctcgtggttggacaactcccagtagggccgctcgccataggtcatcacctcccacatgacaatgccaaagctccacacgtcgctggcagaggtgaacttccggtaggaaatggcctccggggcggtccagcggatggggatcttgccgccctgcagggaacccaggcccagtcaccactgtgccctctggctggccccaggaccattgcagccaagccccacgacccctccctggactcctacaggtgttctgcctcctgaagcactgcccaggtgtgcaggtgagaggacaccatgcagggcgaaggccgcttctcccttgaggtccccttccccaacttacactggtggtgtaggtggcctcggggtcgtcctccagcacgcgggacaggccaaagtcagacaccttgcagaccaggttgctgttgacgaggatgttgcgggcagccaggtcacggtgcacatagttcatgttggccaggtacttcatgccagctgcgatgccccgcagcatgcccaccagctgcagcacgctgaactcgccatccttctcctgccggagcacaggcgctcagctgcaggccagccctgaacccgccaggccagccccgggctcaatggccaggcatccccgccccctacaacccacatccttacccgaaggaacttgtccagggccccattctccatgtactcagtgatgatcatcatgggcttgtctgtaggggggtgggcacaggtgagaggtaagtgggcccaggcatgtgggagaggtgggcacagatatgggggaaggtgggcacaggtgtaggagaggtgggcacaggtgtggggagaggtggaacaggtgtggggagggtgggtacaggtatggggagaggtgtggggaaagctgggcacaggcggaggagtgggcagaggtatggggagaggtgggttcaggtattggggaggagggcacaggtattgaggacaggtgggcacaggtgtagaggaggtgggtacaagtatggggagaggtgggcacgggtgtaaggaggtgggtacaggtatcggggagaggtgggcacaggtgtagaggaggtgggtacaagtatggggagaggtgggcacgggtgtaaggaggtgggtgcaggtatggggggaaggtgggcacaggtgtaaggaggtgggtacaggtatcggggagaggtgggcacaggtgtagaggaggtgggtacaagtatggggagaggtgggcacgggtgtaaggaggtgggtgcaggtatggggggaaggtgggcacaggtgttaggaggtgggtacaggtattggggagaagtgggcacagttgtagaggaggtgggtgcaggtgtggggggaaggtgggcacaggtataggggaggtgggcacagtcacagacagagcccctgctaagtggcccctctccacccagtgtgggcaggccccaagcctcacatttggagatgacgccctctaggcggatgatgttgtggtggctgaactggcccatgatgccggcctcgccgaggaagtccactcgctgcttctctgtgtagccggctttcagcgtcttgatggccaccggcacctccttcttccccgaggatgtcttcagcatgcccttgtacacctccccaaactctcctgtgggcagacagggtcaggggagtgccctggtcagccccggcatgagggctcccacactgtgtcaccaccgctgcctcctcagggccccttggcagggggccaacctcacctgctccgatcaccttctgccgagtgacacaggatggatggatctcggtagtgaacttcaacacagcctggttggggtcctcatatgtgtgggggtccacgtatgtcttcaggggcttcagttgttctggaaggagaaggggtggggtcacaggcagctcaggaggggccccatggggggtgctctggagtcagaggagaaggtcacgtgatcttcagagacttggaccaggctgtgggggacggacccctcagagctgcccacggaagcctgtggccccaccccagtgccctgggaacaccctggctgcccccacctcccccacagagctggggacggtgcgggcagggctgggcctggagcgggggctgcgtctcacctgacttggagaagtaaacgtcctccggggactggcgggcacgctggttcttcctcctgaaagagccccacggggaaccaaatgcagggaggtcagtgaggtctgctccggccagggaagcctcctggccctactttggtcctaggaggacctggggtgctcagaatgcggcccagtccccgcttttgctgcccaagctccactctcagggccgagggtgcggagaaggcgggtggaggaacagggaggaagtgagcgagccaggactccctctccaggatctaggccccagaatggccccttaagcagtcgtgacgaaggcattcccattagagctactcggggattcctgcctgcgtgtccagaggaagtgtggacacatcattaataacaacaagagcagaggtaatgacccccgtgtcccggccccgccgcgtgccaggcacttcgctacacactctaactcgtatatcctcgcaccatccggaggcagggattagactcgactagcatcctgtgggccccatcgttcagatgaggaaatggaggttcctgccccattttcccacccaagcccatgtggagccagggtatgggctctgacgaacctgcggtggataaagaagccaactcctgccagcaccagaagcaggaccacaccgacagccacgccgccaatcaccgccaagttgccagatccctccggggctggtggaagaaatcagctgatgacaagggagttcccccacaaattacagcaacacccgcgctgcacccaagacacctgggcccctactgtgtgctgggtgcttgcacttgggaaggctccagagggtacttagtcccatttcatagacggtcaagcggaggccttcccgaaggtctcacgggaggtattgcaggtatgtggggctcaaagctctggctttttctgagatgcggatttgaacttcctcacaccactgtcgtgaatccacatcccggctcctccacccctcagccttccatgcttccccctccccaggcttgggggcagtccccgaagggctgtcccaggccgccggtgaccgagaaaggggcatttctaagttatttgattcacttcctttcccaagatgtctcaattgcttggttctgggccctggcctggtccatgcccagggtcccccaactcacacagcgtctggaattcgtgcaccttgctgccggccccctggccctcctgcgtcagtgcctgcacctggaccaggtaggtggtgtctggggccaggtcgtccagggtcacggagaaaccctcggtgcggcgcacattgtagctgttggagtctccctgtgggtgggtggccggcggaggagcaggcagtgagggcagggcaggggcctcggctcagcccgctggagaccaccccaagctagcaaggtggcttgcctttgttagcaaacttgaggctcttcttacagaggaggaaactgaggctcggaattaagtgactcactcaaggtcagaaccactaaatgcatgagccaggactcaaactgagtgtgtggggtcccaaaattctgcccctgtcctcaccctgactgcctcttccaaggacgccatgtcttctctcgtacaaatctctgctgtgctgccttgggagatgtaaccccctggcagaccccaggcctcagtttccccatctgcagaagggtgcttcttcagatggctgggtggtttggtgatcatctatgtgaccagcctgtcccctgctgtcggcccagctagagccagccccgcccctctgggagttaccttcttgcggtaagtgacctcgtacttccacactcggctctgctgcggcggggggatgctccaggagacgctaagcgaggtggtgctgcggccctccagcctcaccttggggggctctgggcaggacaggcagtgggggaagtgggtaagaagctgcctacgagcaggcagggtttggggggacaagtggacgtggagccacatcctccacagcccagattctttcatttttttgagacaggatctcgctctctcacccaggctcgagtgcagtggcatgatctcggcccactacagctttgaactcctgtgctcaagtgatcctcctgcctcagcttcctgaatagctggggctacagacacatgctactgtacctggctaatttttgtattttttgtagagatggggtctccctatgttgcccatgctggtctcaaatgcctgagctcaagcaatcctcctgcctcaacctcccaaaatgctgggattatgggcgtggtcaccacgcccagctcccaggctctttagatcccaacctaggatcctaaactttcagctccagagcacagggccagagccccaggcctccaccctggccccatcacaggggctggcacatcagaggtgccccatatttacgagtgcataaataataataataataataataataataataaaaggccaggtgtggtggttcacccctgtaatcccagcactttgggaggccgaggcgggaggattgcctgaggttgggagttcgagaccagcctgaccaacatggagaaaccccgtctctactaaaaatacaaaattagctgggcatggtggcgcatgcctgtaatcccagctactcaggaggctgaggcaggagaatcacttgaatccgggatgcagaggttgcggtgagccaagattgtgccattgcactccagcctgggcaacaagagcaaaactccgtctcaaaaaaaaagaagaagaagaagacagaagaagaaagaagaagaaaagaagaaaagaagaagaaagaagaagaggaagaagaagaagaagaagaaaagaagaagaagaagaagaagaagaagaagaagaagaagaagaagaagaagaagaagaagaactaacttttgctgaatgctttctttttttttttttcttttgagacggagtttcgctcttgttgcccaggctggagtgcaatggtgcgatctcggctcaccgcaacctccacctcctgggttcaagcgattctcctgcctcagcctcctgagtagctgggattacaggcatgcgccaccacacccagctaattttttgtatttttagtagagatggggtttctccatgttggtcaggctggtctggaactctcgacctcaggtgatctgcccacctcagcctcccaaagtgctgggattacaggcatgagccaccgcgcccagtctcaattctcaattattatcccactttacaggggagaacattgaggcccagagaggttaagtaacctgcccacagtcacagagctcagaagcggctctggagcaggagtgtccaatctttcagcttctgtgggccataatggaagaatggtcttgggccacaaataaaatacagcaacactaacaacaggtgatgagctaaaaaaaaaaaaaattgcaggctgggcgcagtggctcacgcctgtgatctcagcactttgggaggccgaggcgggcggatcgcaaggtcaggagatcgagaccagcctggccgacatagtgaaaccctgtctctcctaaaaatacaaaaaattagctgtgtgtggtggcacgtgcctgtaatcccagctactccagaggctgaggcaggagaattgcttgaacccggaaggcagaggttgcagtgagccgagatcaagccactgcactccagcctgggcaacagagcgagactctgtctcaaaaaaaagggaaaaatattgcaaaaataatatcataatgttttaagataatttacgaatttgtgttgggccgcattcaatgtcggctggggccacatgtggcccacgggttggacaagcttgctctagacactgtgcctttaaccacttgctctgctgcctctctctaaacacacccgagccccagatggccgtcctccttaagccccacctgggcaggccccatagggcacagctgccacccctggacctcacctgtctggttgatgctgacactggcagtacggaagctgcggctggttaccaggcctgagacgccattgcgggcctccacggtgaaggtgtagttcatgtggggctccaggtcgctcactgtcacactggtgcgggtcagtccgtgaggaggctccgagtagcgcacactggcctcacacggcccgcattccccagactcgggccagcactgttcgcaggtgacgctgtagacaatgtcctcgcggcccccgctgtcctgagggggcgtccagcgcagctccaccttggcacccatgcccacggctgtgaggtagtgtggggcggaggggggtcctgcacagacaggaggagtcagtgctgtgctggacccaggcggacacgtcaccctcagtcacgccaccctgacccactgcaagactcacgtgtgcaaggcatcgacgctgggtcctgaggtgcccggaagaagccttcctcacactcgcaggaggtggcaccctcaggggatggcagcgtgtgctcagggcactccaagcaggggctctcagatgcctcaaacttaaaaaatccaggcgagcaggctggtggacacaggacagacagagcacaaggacatcagttcaatctgcttccaccccacgtgactgtctcattccctcaccagggacccctgccctgcaagcaggtcagtaaatctctatggacctgttttctcatcggcaaaatgtcttgtgatggaaaaatgcatggcaagggcctagcatgtaccgggcacccaggaagtgcttcacacacatgctgcaaacctttgcttcactccccactggctcctgcaagaagcaccacgcccctgagcctggcattcaaggccatacctcgcctttcagccaaccaagaatcccatcacagcctagctcagcacttgaccaagcacgctgcccaccggcctcatcccctttcctccatgcagactagcctgtccggtccccacctgggtagctgagagctgcccagggcaatgactgcctcttcttgaccatgtgtgtttgttgactgtcaccaccaccctgactcactggccagcctcatcagttcaggatgccatccctgcaggtgttacctccagcccaggacctgccctcctttccatccggggctgaccaggaagcaggaaaggccaagccccctggcattttctctggctctgcttccaggaccgagtcatatccgccactcacaaggacagccaggaagtgactcttcctcccccagtggccagtcctgtcctggcccagcaggctgggggctcaggcacctgactccgggggcttcttcctcccaccgccctatcctgtctcatcccgcccctgccctaagccccttcctggccctacaggcaggaagctgcccagacacagggctcacggtgcagggctgtccagggcttgggcagctgctgaagtggccagggtgggtagaggtcaccctagggagctcctccaacaaccctacaattataatccttcagattgttctgatgagagggtcctgagacacctccaacctcagcaccgtgttcaccacacacacaatgatcctctgctctgtgcctggcccacccccagtgctgggtatgcaccaagatgaaaacaaactcctgatctcagggagcagaagcacctgacaaggtctgcaagacagagggaggaaacaagctaacagctaagggggtggagaaggggaaacaaccttggccaggagtctgagaagtcacagaggggacattttggctggggttcagaggctgcataggagttcagcaggggaatgatagatgttgggagagggagttaggagtgagaaagtgcatgactaatacggaaggtatgagtgggtttgtgggcacaaatgtggggagcagcaagcaataaaacagttgagaaaggccttcaatgccaggccaagaagctgggactttatcctggaggcaatggaaagccgctggaggtctgatgtggagaagtcagacccctgccgtcaggaaaaatctgtgcctggaggcagcttttgtccaagaccctggggacaacctggcccctaatggcctaaggacaaccccctccagggaagcaatttcaagtgccctgacccaagcaaacctgctaactctcagggacagaatctggagcgaagactctcgtcatccagtcccctgtgtgagcagaggtgcagagggggaccaggagtcaggggaacaggactcaaaggacacccagctctgtaaggtgccagatagtgacctcctgctgatgactctgctctcagagccaggctgcatccctgtcccctcccaaccctggcccagggaccacacaaacagccgctctcacccccttggtccatcctgcttctgcagaccctcagcattggccctgcaagagctcaggcacatagggcagggaagggggcttgtcccaggtcatgcagcaggacagaggaggcccgggacccgactcctgctctgcacagagcctggagtcccaatgacagtacctactatgcgcagggctcgggctaagcactgtaccctcatttagtcctcgcaatagacctgctatatacaggcactattagcgctggttccactttggaggtgaggagagacaaaaaagcttgtccaaggtcaccaagctcccaagaaggaaaccagaactcaaacttaggatgcctgattttcagcctctctcctctcccactcctttttcattatttatttattttgtttttgagatggagtctcgctctgttgcccaggctggagtgaagtggtgggatctcagctcactgcaacctccgcctcctgggttcaagcaattctcctgcctcagcctcctgagtagctggaactacaggcaccggccatcaagcctggctaacttttgtatttttagtagagatgcagcctggtctcgaactcctggcctcaagtgatccacccgtctcggcctcccaaagtgctgggattacaggcgtgagccaccgcgtccggcctattttattttttagagacggggtgtgtctttgttgcccaggctggtctcttgacctcctggcctcaagtgatcctcccacctcgacttcccacaatgctgggattacaggcgtgagccacctcaccgggcctcctttcccacttctgttcttaggaacacttcaatttggagcaaagataaatcaacattctgaaacaagcctgaagagagaggagataaggcctgacccacttcaaaagccagaaactcctgacgaatttcagagcagctgtgggtctatgtgttgtggaggaggggagggtattccccaccacagatcttctcaaactgggcacttttgtgtctgtgagcagaaaagtgtagactccagcccaggggggttggttggggtggctgaagtggtctccttcaagccccgaatgtcttcaagtctcctattgtatttggaaacccatgagtatattgcatccctccccataacatatctgcatgatacaaaaatagctctctcctccaccagatctgtgagtaaaactgagactccagaaagctgggccatgtttatcctggggtcagttcccccaaatgccctgacttgtctgtggaggagacttcacctggctcagtgctggttcaggtggtccagggccagctgacttgggaagctcgggggcgttcccagcccaggctctcaggccaggcaggggccataaacccccacagcccaggctcggacccactggaggctttagccacctgcaaaccctcacaatgccccgactccccaccgtgtggctgcttctatgccaagaggaggaagtgggggaagagatgggctctttggccccagcgcccgggggtggcctgcctgcctgctgccgccaggaaagagggaatttggagagatttccgctgcggatgtgccagataatacagcagagaggcagcgtcaacagggcatgtgcctgcctgacgagatgtgcttcccctcctccaaccacaaagctaccaggggctgtctccagggccccgccagagtttccaagtgctcaggggtcccagagttcatgagtaggacaccagcaagcccctgtgttcttcctgactttatctagttggatttcctggcattctaggcgggcaagtggggacaggggtcacacacactcaaacacacccacatacaccagatacctactgttccttagccaaccagcaaactcctatgcatcctttaatacccagcttaagctcctctacacagccctcccagactgcccaattcctggccccccggcccccattagggcatctattaatcttatgtttaccaaatagaaatgggcacttcatacgtgtctggcacaatgctgggtgctaggatgcgatggtgagacagataaacactgtttcagctccaggggaattcaaaacttggcttttatgctccatttgaaattattcctgcatgtatcaggagcttccgtgagaccagcagctcctgaggagcaggaatggagaccaatttatctgtgtcccatggcccagcggtgctcagttaatgtttgctgaatggatggacagacagatggatggatggatagatgggtgagttggtgggtggatgggtagatgagtgtgtggatggatgggtgggtggatgaatggatggatgggtggaggggggtatgagtgggtggatgaatggacagatgaatggacaaatggatgggtgggttggtgggtggacaggtggatgagtggatggatggatgagggatggatgggtgggtgggtggagtggtggttggatggatggatgtatggatgggtggggaggatggacagatgaatggacaagtggatgggtgggttggtgggtggacaggtggatgagtggatggatggatgcgggatggataggtggatggctgggtggaggggtggatagatggatggatggggcggaggatggacagatgaatggacaagtggatgggtgggttggtgggtggacggatggatgagtagatggatggatgagggatggataggcaggagggtgggtgggtggagggatgaatggatggatggatggatggatggatggatgggtggataggtgggtggttgggtggaggggtgggcagatggatgggtggaggggggtatgagtggatggatggatggatagatgaatggacaagtggatgggtggtttggtgggttggcgggtagacgagtgaatggatggatgatggatggatggatggatggatggatggatgaatggatggatggatgtaggggtggatgggtggaggggtggatggatggatgagtggatgggtggacaggtggatggaagagtgagtgggagagagaatgggtggcaaacctaccatgtgcatgtgaaatatgcactccagggccagagaaatgagcagtgtttcagcgcccagagagacactgtggagaaggtccaccaggatgcctacctgccttacacaagagcctaactttggcacacctgtggcacacctgtggagagctgttctggccccggttgtctggcaggcctgggctactccgagcaggggaactggggcacagtggctgcacctccggctataccctggtttttccagttcctgatgcccgcccctcaggtggcagcatgaggtgactcagggacagacgcccttatcgtgacgcaagtccagcccccagtggagcccctcctcccaaggcacagccacctcccaggctggcaatggcaaggttgtgaggtcaagaggtcatggtggcaattcacctagggccagtcaccgcccaagccaggcccagcaggtgaccgcaggaaccaccttggcccagggatgtggagcttggactttgtctctgggccctgacagacggcaaatggcgacctatgggttactgacccagcaaatgagggagctgacaacctcaggccctggtggcttcttgctcccagcaggccctgtcgtctctgcagaaggggggctgcccccagggcctgacggctgccagcaccctgtccctttcacacacaccctagggagctatctgcaggcacattcctccaccattgataagcaccactccccacctcagcccccgcctaccgctcctgtcctgcctccagcctttcatcttctgtttgctttccctcgcctccttccttccgttctggggacccacttacctccaggagggagagagggagggagggagaagccggtgcccgcccagcggagatgccagcgcctagctttgcccccagtgtgagctgagggtggggcagacagggcacagaggtgagagccaccatggggggctgggggtgctgccaccgtggtcccacctctgtaggccagaagaaacatcacagaaataaggcctggtgggacttcccagcaggggacaaagcctgcgagccacagccagcagctcccagagtcttccacctgggggaccaactgtgatctgatgaaacaggaatcctgccagcagcccctgccatggcccgagaccaccctgtctaaagaccaccttaaccacagacataccctggccaggggactcctccctgtcagctatggactttaggccactggggctgtaagcagtgggacccctcctcaccacacttgtgtcacacagtcaacagcttccccggtgttcagactgagccccagtgggaaaccacaggagggaagctcggatcaccaggttgacagcgtccttcagggccacaggtccagcccactcattttacagatgggggtgggaccccaaggggacctgctaaggtcatacagcctgtgggtggaaggacacacaccaggggcaactgccttcctgtgccaggcccccgttcttttggtcactgttcactgcttcctctccggacctcagtttcctcatctgtaaaatggggatcaagtcctcatcctctctgggttgtgtgtgaagatggaagaaagccctgcttatgagatgtccagcatggtgcctggaatgcggtgtccctatgaactaggggatcatgaaactacagtagggaggggacctccccaaggggctgggccccttgagggagcaggagcctctcaggagggaatctccaactccccacaaccccagctctggcctcccagctgttcagctgagccactggccaaggctgctggccacctgctcacctgaccagcggtccccagggctgaggcgccagcaggggccccgccagctgctgaggccagcacaggaagcggagacatggagacaaagcagcccccgggggacagcggtcagcccgagcgactccactgtccccgcaggcagggccgggggcagggcgggggaaccaagggaagctggctcattcctgacatagttcatgggagcgctccgggcagcgtgcccacctgccgcacacagcacctgggaggtgcctcccttcctctgcccacttaactctttcctgagctctgggcttcctggggaaagaaccctgaggagaaacggacaaactgggaataacctagacaaggtgccaggtgacctcagggtgccccgcctcgctctgggtctggtttgtcaccagcaggagccccagtgaaagaatctgggtctccaggcctggggagggtccggcagggagggcagaccctgtgcctccctctggttctccctcaatgtacccagcagtgccctctccaggacccctgcctccaacagagcccccaagcccctgcaacagaccctgccatccccagggctggccagagagcctaccccagggccaggagctgagtcagggattccaaaggaactggtcacttcccgccccatttcctgacccatcctgcagcctgggcgccgctgcaccgcctggattcagatcctgatgcagccacatcctagctgtgtgacttcaggcaagcctctttagctctctgaacctcagtttcctggtctatcaaatgggattgatcacagtccctgccacgcagaaaggcggtgtggattccgctcgcatgtctgataaagcgcttgcttggctcagcgcctgcccctcggacgacacccgtctacggtagcgactgtcatcacttccagcagcagcatggccaggggctgctgagagaagtctagaggtataaagaggagccagccgggcgttcctggcatctcgcgcaccggcacccagccacactgaaaggaattttggtgggaggatcccgaggaggaacaatccggcagtaggtgactagcgattgacagggttccacgaactaagtcggaaatttcgctcttggaaacttgtcctcctgctgggctgatcttcccaacagggggctgctcggctctctgcaaacaaaatctgccagaaccctgaccccccacctctagaggagggaaggctgccccgcttcctggagagacacccccaccccaaccgtccacttatctctgcggggcctgcctcaccagcctgtggaaagttttcagctgcccctcacccccacccccgcattcttgtgcgaggatgtcatgtgggaggagcctgctcgccccactgggctgcctcgtcccggccccctcaaccgcactcattgtctgaaactgagagtatgcattcgaggtcacctaaagcaggggccgcctggggaaggggggctcgctcagcagaggggagctgggaagacaagggggcgatggcatgggccggagcagagcctacaccacaggcttatggccagaaagctcgtagggaacttctcatcggggggtttacagaccgtgttaagtaaggttctgaggacttgctttaggaggcaagtagggcccatcacaaagggcttcagtgtcctccaacccttcaaccccctccaggggctgcaggatccatggctagaaaacaagcataaagtctgctggtgctgttgaactttctcattttactcaaaggaaacccaagaccagagatgaggggggagttagccaaggtgtgtgcaacgcagccactaaacctccaattccttaacgtcccgcttatctcagcaaagaagctgccagagagagggaatgagccagccctccaaaggttggcctgcattccacaaatgctctgcctcatggccatttccagaaaaagtcacccattgaaaatccacattgctgtggagatttccgctgtcacaggccctggccacaccacgccacggcttcctccatgtgaactcactaatgcccaagcctcattccccaaggagagtctgaatgaattggcccttttctgggcccagtgtgtcatctatagaggccccagtggaaaatcaatagaggtcccaatgggaaatttgtggccctggggacattcagacaagaaaggcagacccttggcccccctccaacctctccctcaacagaagcatttcccaaaagctccgcgggtgatcctgatatgcagccaggggatgtgcaccccgggtccaactcagtcacttctatgtacgaaagaggagtttgaggcccagggagtttaagtatcttgcctaaggccacatagtgagctgataacagacatggaacttgctcctggtactccaccgtgggaccacagtgccgctgtaccagagctactcagtatacattcgtgggatgaatcaaaaataacagccacatttaaaagtactcatgtggcaggcactgacctaagcactttactattaagtcatttgattatcacagccaccctacgagatagacgctatgatcctctccattttacagatgaggaaacccaggcacagagaggtcaaggaaatggcctaaagccacacagctaaaaatgtagacctgggatttgaacacaggcattcttgtttcagagtcatcaatcataaactccacattctgctgtttctcaattcattcattctttttttttttttcagacaagcatctcctctgtcaccccaggctggagtacagtggtgcgatctcagcttactgcatcctccacctcccgggttcaagcaattgattctcgtgcttcagcctcccaagtagctgggattacaggtgcatgccaccacacccagctaatttttgtgtttttggtagagacggcgtttcattatgttgcccaggctggtctcaaactcctgggctcaagtgatccacccacctcagcctcccaaagtgctgggattacaggcatgagccaccgtgcccagccacaattcattcattcttaatgaatgagttagtccagccttaataaggaaactgatgtctgggaaggatctataatttccactaacagaactaatgtgtgtcaaagcagggatgagcttaccaagattccatgattccaaagctaaagaccagaacctgggaatgcagaacccccttccctgcaacccagaaccgtcactcaccctggcaggcatcctccaccttctcgtagcctgcctggcacaggcactgcccaatgggcaccagccactcgccatccactgcacagtgcatacggggctcttcaccccccggtggcaccacggcatggtccacacaggtgccggccacagtggccagggaaggtgcatcagagccggcgatggtctcagggaagtgggccaggccctgcagcagctcggggcacttcttgtagtagacacggacggagagcagcgccacacaggcaccgatatcctggaaggccaggtagaagcctttgcgggtgagcggccccacggagcgctcctccacgttcagcttcacgtggcgtgcctcgaagtcgctgctgacggtgatctcatcgggcgcaatggtgtcaatcttggtgaacaggcgcttctggaagttggtgccgtagtccaggtccgactcggcatagtagaggttgaaagtctccttgcaggagctggcgccaccagggaagctgttgcagtcacgtacagtaaacttgagctcaatgaagatacgctcagcctctcctcggtacacccagttggtgcggagccagttgtcctggtcgccagacatcacgttgcacacggagtacatgtagatcggcatgtcattcatgatgttctgcatcaggtcccactgtggggggaagatacaggttagtgtgggcaggtgcctggggaaactgaggcccaggtggcagagtagggcactaggaagatgctttccagttcgtgctctccgggttctacggtgaaggaaactgaggcctgaggcgggtgggggctgcatccataagtggctgagctggaatctggcccctggtctttctggcacatgtctggaagccaaacctctctattaggttgtgagcctgcaggtggagtccgggactccatgtgacctcaggtgggttatgctctctaagccgcaatttcctcatctgtacaatgggagcaagaccccctacctcacagaattgctgtgaggataaaggacagaatgtctacactggctgaacacagtgcttggcacaaggtaacaggcatacgggcagccagtatgattattgttactcttggtattattcaccatgcacccatgtgtgttggcaaacgcaggagtggcattaagtcaaaaacaacggatgatgctctccgtcatttagaatttggctttgcagcagatgaacatgttcctccctccctggatcataactcagccttctccagaaagaattcccaggttaggctacagttgggccaggtgccccccgccacccaactcccaaagttgccatgttccctttaccctgtaccccttgccatttaccaaagtgcacttggcacggcacatggggacacccacatctgggctcccacatgagattctgagctcctcagccagagtctgcatctaattcacctgtgtcctgtgtcccgagagccggcctgagacagagtaggtgctcagggaagcgtttgttgaatgaataaacaaaagaatgaatgaaagcacaggggaggaggacagaggcccgggctatactgtgtggcgttggccaaggccctacatgcccttgggcctcagtttcccactctgtataaagactgggttgtattaggtgacccgtgttccctcccagctagacttccaggatcctagaaacctgctcagggctacaccccagccaagcctgcccagagctagggtgaccggggacaagaactcgactcatgcagatctggccagctctgggaactattccaagtagcccctgggagacagccccctttctcagctcagggtcccaggacaaactcagcaagggcccattgtatagagagggaaactgaggccccgagagccacatcttccccaagatcacacagcagacacacacagccaggggaagaacccccagcccctgcccccattcctggtcacatcaggacggcatagaggggaagacctgggtgagaatgaggcagagaaatgcagccccccacaggaaggggaagcaacagctagaggtgggaaaggggcgggcaggaaggaacttgatcaggttttcctgttccctgtctcttcttcacccctcacctcctgggctgagacctcaagacagggggcatctttaaccccttccctcccaagaggtggatgggtggtgccagagatccctctgactgtcagcccttctggaacatggaaggcccagctccgctagggccttctctgtctccccagttccccccacctctcaggcttacacccacaccctcgtaccttcccacgcccatccagccctggcctgggccggctgactctgagcctggtgtgagaagctggaccctgagcctgagacctggctgagctgctgaattgaagccaggccccacgctccctgggcctcagtttctccatctctacaggggaccagcagccccattctcacacctctccccaccccgaaggcttacatacccctttgccatacgggtgtgtgagccagccgagctcccctccagctgcagcaaagtccagcagtaccactgaaagggagaagggagagggggtgagcctgggggtgtcttcaggagtcagaccatggcaggaaaggtgaggatccctccaggaaccccaactctcagacagagcgagagggaccccaccacacagggtcaccatatccaagaaaatcatccctcgactcatgagggaaacaggcccagaaaaaggatggaacccagctgaaggcacacagcaggctggggtcaggactgggcctccagtctcccaggccaggattccagccatcctgtccccctccgttagtccccagctgggcagagcaggccagggagctcagcccggcaggagaacagcagctgggcagagagctgggctgagcagggtattaagtgacaccacaccgccccctctgcttccttgaacaaggccctttggcagcacttcacgtgcatgtgggccttagggacactggtgtctgcttctgccacattccccccagcaggaaacacaccaaccccactcaggtcatgtagcacacacatatgcacctatatgtacacgtgcatcttgcggtactccaagaagagagtgctgtgaacaggtgggaacagctccagggtggaggagggaagagggtatctggaaaccgatcttctcaccacaaaagccacagagcaggcaggataaagccctggacccatagggcccctaagaggggcccaaagatacacacagctggtgaggtcccctccctgggaaagtcactcccaccacccctgcccctcacatcctgaccactgccctgccaggggtgccagaggttcctgggggatcaggaataaaagcccttgtaggggacattctaggcccagagaccaggtgtcaggaccatcctgttcccagagaggcaactggagcctggcggagggatacactcccggggtcttccctagacctagtcctgccattgggcacctcccactgatccaccccaggttctctgccaggctcagaggccatagacaaaacctaagaccctaggtactgtccccactctatttccaagtaaagtccaggtagctgccaataagtgctaccctccctagagggtaaggagataggagaaaccggggcatagaacctatgcaagatggattcagagggtaaagccctaaggtgggggtaaagaaaccaagtcaatgcttcctttgggccctggagcatgagggatctgcctcagaagccccattcctcaaggccaggaccggagaaggactcaaagggtggacagagctccaggcaggctgggagcagggatggcctggtttgtggagatgggagctgggctctgagggtggtcttgaagaccgcctcctgaagtgacatggccctcctacctgggctgaaggcccccaggctggggcgtgaaatgctgccacccccactactgaccggggccaaacctctctaggaagggtcaggcagcccagacaggcaagaggaaatccaatgtgacaccggccccatgacagaggctgtggggataggggagggtggctgggggcagcggggtgggcaggggcagggatttgttcagacatgcccagggccggggctttgaaactcactaaccccactagcaaatggaatgttccagctacacaggaaggaatctggaggctcctgatttcagctgggtgggtagaaggacaaaggttcctcacagtcctgcagcccccccttagattgacaggaggctgaggtctgtgcccaagtgagagggctcaccgctaccaggcttctgaagggttaacctggcatggagggccctccctttccagcctaggcctggctctagaagtagcacagggctcaatcggagaagaaaagaagccctcacacaggaaggagccccccctgcaggggtttccaaccccggccccctcccagggaaattccctcgaaccaaccaccaggaacaggaggcgcccagcgctgggtccctccgccctgacgcgggcgcggctctttccccaggttcttccagggacagaggctcccgcttctctggaaagggtgggagcctgggagcccctcggctgacccagacggcttcctggagaggcttaggctaagcagggcttatccatgagctctctatccccttaccttcccatttctggggggaaaaaaaaaaagcaaaaaacacctccttctttgccatgagttccaccgtaagtgccatctttgtgggtccacattgctccacagcttcttccacaaatgcaggactgccacccactcccggtctccggtccttctccgcagcctccgaggctgtggttccctccccgcttcccccattcctctctaaccaagactagctaatccctaaaggaagcagggaggtggggactctggggaaaacatgaaagaaaagggaaaggggacagagggcagacttggccccggtagaaccagaaaccaaggacttcctggcactctccagccctcttcccatcagcagcaccccagctcagcaccccctgccacccgcccaggcccctgcccagctatgcctgcttcccaggaaaatctaccatgacaccaaccacaaagcaggcagggccttggctctggcagccaagaagcgggatgctcaggtctggtcctctgtccagaaggccctggttggcaagggctcgggcctccctcagtttccccatttgtaaaaatgagggcagattcagtggctgttgatgacctaacaggagccacgtgggcaaccaagtatagcctaggggtgagggggcaagaaagaagtctgaagcagcctgggggtaggtgaaaaaggcacctgtgtcctcctgcctgccccctaagccacccccaggcagacccaccacatacagcctgattcccaggaactgaaaccagcagctgccagctaggccatcatgcccacccccacctaggcacacttctctagggactctttcacggggactcagagtcgaagcaaaaatgtacccccaccccagtgcaatacacaagcctttccccctgcatcccatggggtgtgggggtggggtttaatcacacaggctggggagaggtggacacaggggacaaggacaaggcagctccaggcttccaggccagcttggggactgcagcagcaaagcacccgcctaatcccccacccccccatgggcagccgaggagaaaggcctatagtgattccagctgtctctccccttctctccaaccacagtcccccaggaagggggaggaccaaacgttggtggggcggatattgagggtggcagaaatccttgccatgagctcctgcaaccagaagtcccggttgagaccccaacccgggccctgtcactccagagactgagacaggatgccacccccaacacctgccactgcccaacggctccagatccggcctcttttcctcccaacacagaacagcaaaacctccaaacccagtttgggaggcagaaaaagaaggaaacaggccgggggtggtggctcatgcctgtaatcgcagcactttgggaggccgcggcgggtggatcacctgaggtcaggagttcagaatcagcctggccaacatggtgaaacctcgtctccactaaaagatgcaaaaattagacgcgcctggtggcgggcacctgtaatcccagctactagggaggcttgagacaggagaatagcttgaacccgggaggcagaggttgcagtgagccgagattgcgccattgcactccagtctgggcaacaagtgcgaaactccgtctcaaaaaaaaaaaaaaaaaaaaaaaagaaggaaacttctcaccggcccaagtttcctcccggcttcccccttgtggagcctgcggaaacctcgctctgcccaggcaggaggggaagccttgccctcactgttggaaattgaagctggcctgggctgggtggacaggaaggtcttcggccagggcaggagcccccatcctcgccctgaccctagcggagggacaacacccccaccacgcacccgctgcgccatgagcaaagtctgcggcccctcactcggcgcggctccgggaacactggggcgggggtgggtgattcagtcccccacccccgggtgtcctgactccctggtggccctgggctgacagctccacaccttgggaggccgcacccccacctgccgcatttcctcgttctgagtcacccttgctcagaacgcttgactttgggacttcctgtccgcactcgcggcccctaacctgccccgggagcccgggagtgcggcttgggaaggagggaaaggagtgtgtgagcagggattggcccgaacctatctccacgctctcccccgggactggaggtgaaggggggcgtggagaaaatctcagggaacaggggcttcgacagggggctcccgcccgcccgagccccctccccaaaatgcgaggcctgcacagtatgccttctccgcaaaacctcggcaagcgggttagtgaattcaggtcactaagaagctgagcccgcggaaagctgcccaaacacccccttctctaggggactccccacgccccccgccgggacgcgttcccgaagtcgccgcctggactgcaaccgcgtggcctgcgccgcgtcctcttctccgcagcctccgaggcccgtgcgaccaagctgaaaccgcttattctccggagcccctatgaccccgggtgggggccagggctcgcctcgatcgcagcccgtgcgccctccggactccagttcgccgggactgggcgacaccaggtaggttccaaagttgcgcgcgtcaaggagcgccgggctctagggggcactggggcccgggggccaggggtccagacgccgcgcgcactcaccttccttgccctgcgccgccgcggccgcggccagcgcacagccccacagcagggcgaagcaggcgcgggctgcctggagctccatgccgcgcttctcgctctcggtccgatccccccgagcccggctcccgcacacccgcacgcctgcacgccggcctcggtgtccgctcccgcccgccggcctgcgcgcaacttctgcccctcctgccccgagtccttaatggaagttgggtgagaaccgactcctgttcattcat

SEQ ID NO: 16 - DNA, 32234 bp, Homo Sapiens
ccgctaaggccaccctgcgggcgtctcgacctcggctgaccgccgctggccccctgggaaccgcgtgccggccgcaggagaaggtagattcccgggagccccggcgcccaccgcggtactaaccgcgcctgcgccccgccctccctcccttcgggctccgcccgcgcctgcgcagttgcggggtttcgcgccgccggagtctgagaggccggaagtgccccttagcgggtgggggaagctggtaggcacgggcggctccgcagtgaccggactcgggggaggtgagtgatttgcctaagtaaaagggaaagataattgagcgcccccggcagctggtctacgcatgcgtccgctaggccggctgggagccggcaagggaaagccgagcgggccccattgggggaaaggggtcagtcacttcccggaagaggcggggccgcgcgggcccggcgctggattcgaaacgcttcctggtgctcctgggcctggcggttgagcccggggagctagtctttgcttgggtaaagaaagaggactttcctttttttttttccttttgagaaaattcagaaatttggaggcacagtagttaggattcaggccaaactggtaaatgacgaaggggcttcttccagagccaaggaggaagggttgtccgggtaagtcccgcgggacgtggagagacggcgccgcccgggtcctcccactgattcctttgaccatctggcttacggacgagctctttgttcgctgctcctccgaaaacgccttcaatgactccctttgaataaagtaggaagtccgaaccgagccgccaggccgcgacttggcccctgttttccactcgcgagggccctgcgtcaccccgcctcgggaaagctgcgcgttctccggccgcttgcgcttggccgaagctgctgggtcccgctgtgcttcccccgggcatgcgatggggataattcccacgcctcgctcaaagccatcccgggagagccctccctggtccccataggcacagttgggtgttcccttttccgtgttaaccttgtatttcggatatagttctgttatagtaattactttaaggtattgtagttatttacaatcagtctttcccccacggtaacctagagtgtaaaccccctaaataaacgtcagaagtaatgaagtcttaacttccttggcttaggtttcagcgcccttctcaaccccacactcccgcttcagtctttacacaacccttcccatgaatatgctgacctaacaagtaacctacttttcatactccaaaatcttctcttctgtgtggggaaaataatgcattgactgccacctcactccacctccaaataaattgatgttgaaattctggcctccggtaatggaattctttacatcaaagtcactttttatttctaaaagtaatcacatatatattatattcctactgtggcccttgccatggatcaacgaaaaatatgacatagtcaaaatagaccaaaacatctggccttgttgtaaccaatgggaaacacggttgggaggtccctacttacatgtcacttgcttcaggaaccgttccttgattcctaagtgggggaccttttttcctaaatacaactatagcttgctttcttacctcttaagccctttttatctgcagtctcacttaccctactaaggtctttaaatgcagggcttgatcttccattattgtatctccagcacctataaagctttcctgttaaatagtagacatttaataagtatttattgataaacgtgaagtatgcctcaacgtttaggctaaattcatatgaaaataaaattgaaaaaataattttaaagaacagcattagttactgagattatgtggtaaatcccttaaaatataatcttgcattgaaatagttttcaccatttaccagtctttatatgaatatatactcatctaaatggaaattgggaaatttaagcattttctgcttttccgaagtaaattttctaatgtttttcttaaagctgaactaaattgcaaaacttgctttaataaagtgtgtatttttgcatcagttaagcccctgacctctttatgttctttaaatttgattcattagtgaaattaacaaggttctgtgtttttctcacctcattcagttttataattaaccaataaaagcttattagcttttaaggaagttttaggaacttaaattgatttatgggcaccatatggttacatcaaaggacttgtttttgttttaactggaagtggattcttaagtcctttaagatggaaatttatgttctttctattataccaagcaatactttctgaaatagagtgatttttttttattccatgctaccagttggtcatgcaattcaaatattaaatactagattacagatattagaatcttgtaatgcatctggtttaatacctgtcattttgtagaacggttaaatgtcttcccaaggtcatacacctaatcagtggtatattcaaaacccaaatcctaggcttcctatctgaagtccattgcttatgaagtggtttgctatgtgttctgactttgttgattcaaataagtaagctaaatcaatttaagccattaataggtttataaagttatttgctatgtgttgttcttacatcattgattcatgtaagtagacttgtgtgacagctaattcttaaaaaattatgaagatgttagacttcttttgatatatatatgttgattgtatgaacagattgacatcaatatacttattcattataaaagatttgagtgggaactcaccaaatcccacaccaaaaaaatttaaaattttaccatagtaaaaaaaactaaaaagcaagatgaaattatacatagttcttggtgtagtatttttaatttttattatttatttttatagaaatggggtctcaccattttgccaggctgttctcaaactcctggcctcaggtgatccgcctgcctcgacctcccaaagagccaggattataggcatgagctaccatgcccggctagtgtagtatttttaaattttacttaatgctgagccattttcaaataacctcatcacattgattatgacctcatgcaagaaccatctgttctatctttcagtgtagttgtactttaatatcttagaagctattgcattctgtccttttttggaatgttttatgcttttacagtcttaaccattgcttcttaatatcacttccgcggaacagctggtgcaaagaacatgtgataaggaatggaaaacaattgatgatggaaacagagatttggagttaattgcgttcttaaaatattatgatgttctttctaataaaatgtacatttcacataattttcctctttcagaactaaccatggttaatcattctttaaaccaggtttgtttccgacaaaagaaatgaaataataaaaactaaattctaactgtagtaatcatgtgatattaaagatattatttatggggttaaaagccctctttatcttgcttaggggtttccaataatcgaatcagtgctggactttttttttttttttttaggcatggctgccccctgttaataatatatttaattaacagctttacacaatgatcttaatatacttgaaatacttagaggactgcagtttataaaatcaagagtctaccttattgctgttttatttttttttttaccataaccctcagaaggaatacagttaacatcacagtcctatatataaatgtgtgtttatgtgtgccatcataaacatcactgcactaggtggcaatcttcactactattcatttgtgtatgtgtagtcaacctacgaaaggaatcattagaaacagggtaggaatgttgaaccttagaaccggaagttgccagagaaaatatgtgccctggccaactccacaggactagttctaggcaatctgaaggaaaccagaaaatgtgaatttctcttccctcaaaaagctatactgaagtagtatttaatattcaagtacttgtaaatttgcagaacagtactttttaatttgacccatgaattctatttaaatttgtcacttaatatttagccaagaagcaaaccatctaaaaagatttctggtttatttctccaactcctaataaatagggtcacatattttttaacttttttctaatttgaaaagtaatacaggcatatggtattttaaaaatgaaacaacacaaagggatatgttttgaaaagtggttcttgccatccctgaactgtaatcatccctaacatattcatacctgttttcattttaaaagttgggtcagtttttttattagtacatgtatttctatcctactgatttatttgctatatcatctaatttagtttgaatattccataatttacttaattagtcctgtatggagacctagctcttctcagtgtctactattataaacaatgctacagtgaatattgttgtataaatccatacacaccacgtaacatatcttaagttcctggaagagatattgctaaaccagaagataacctgcatttaaaattttgactgctagggtcagggtcacatttaaattaaattagaacaaaggaattgcataattgtcttcgatagcaatctattccagtgtgcaccgtgagtcacaaaggaaagcaaaactgtcaataactttcttctcagacttttggtttaatgtgttctgatgggttaataatttgtctcatttctcttcataataatgactttgagaatatttgtactgcactctttttccagaattaaccacaacttttcacagtaactgaattaatgccacaatggtacattcaaccagtggggcttcaggatgtgaaatagacaatattctgggccactgttactaccaaatactttctttacctttaagtctgtatatttttatctgtaaagtgacatccatagatgtcactgtacacttcatagaaatgagtacacagaataatactcatggcagggctgggtgtggtggctcatgcctgtaatcccagcactttgggaggctgaggcaggcagatcacttgaacctgggaggcagaggttgcactgagctgagatctcgccactgcgctccagccagcgtgacagagcgagaccctgtctcaaaaaaaaaaaaaaaaggaataatacttatggcagcactggccacactataaaattcaggttcagaaaaacagggtaagtcacagacagcaacgcttccagcatttattttctttgcacccatgggcaatttgagaaaatttacctttagaacgaactctgttaaaggtacagacaatacagtactttttattcagaaggtttctgcataaaggtgatagtcttttgacttaatatattattgtctcctgccttgtgtttctggaatgaatgaaggtcattatttagaggataatctgggttgtatttgtgtcgtcagattgaattttcattgcacatgctacttaatgtctttaccaaataataacaaagggaaagaaaaccaaatatagatgtataataaggaaaagctggcctatagaaaataccaaaccagataatagtagcaaagtttaagccaattttgtttttaaaatgtcatgtacgtggaaaaaggtttaactttagttttctttgggtggtggttaaaagttataagtgattaaaagtttttttctttttctacaatgaacattatgtgaccttgcaatttaaaaagccaacgcccttttaagaaagttatgtccatcagtattcctctaacttcattttctctcgtttcttcttccctcacttttctaagttttcctttattaaccccatttttctttagtttgtttgcatgcttccttgcttttctttttttttttcctgggtatgatagagaattagtcccattctctaagtatgtaaatcaaggagtgaattttcaagtagacaaaaatgatttacagcatccttgcattcgctaccgatctctgcttttgttagctcttgtttttagctgggaaaaagccaattaccgccattttaacgtttcaggtgttcttaattcattttgaaacgctgactgatgaaaaaaataaggaatatcctctatgaattatcctgaactggcttataatatattgtttgaattcctgttatgagcttctgtttctttaacaatattttgtaaagtgtgtttcacataacagcagataatcaccagaatgggagtgaatgacttgtggcaaattttggagcctgttaagcaacacatccccttgcgtaatcttggtgggaaaaccattgcagttgatctgagtctctgggtgtgtgaggcacagacagtcaaaaaaatgatgggcagcgtcatgaagccccacctcaggtatagtaaaagctcttacagtataaatgtatgatgtataaacagtcttggtatcttgattttgtttcacctttttttttcttttgttgttgttattcttttacattttgaggttttaagatctatttaacatgtctagattcaccatctttatattaaggactcacattcgtacctcttaccctttgagctccagactcacatagctatctcctacttaacgtatccactaggatgcttcagatactaaaagccggagatttgggagacattttctccctattttacttctctccacatctaatccgtcagtaagtcttgccagttctacctccaaaatatactttgtgttcacaaacttatctcagtgtccagaggcaccacctcagtctatgccaacctcatctctcatctatactcctgaagtgccatcttcactagtttcttgctcttggcctcccctaccccagactattttccacatagcaattagaataatcataaatctttcttgcttaaaaatattcagtggtttggccgcgtgcagtggctcacgcctgtaatcccagcactttgggaggccgaggcaggtggatcacaaagtcaggagtttgagaccagcctggccaagatggagaaaccccatctctactaaaaataaaaaaaaattagctgggtgtggtggcagatgcctgtaatcccagctacttgggatgctgaggcaggaaaatcacttgaacctgggaggtggaggttgcagtgagccgagatcacaccactgcactccagcctgggcaacagagtgagactccacctcaaaaaaaaaaaaaaaatcagtggttttggccgggcacagtggctcacacttgtattcctagcactttgcgaggctgagatgggcggattatttgagctcaggagttcaagaccagcctgggcaacatggtgaaaccccatctctacaaaaaatacagaaaattagccgggcatggtggcacacacctgtagtcccagctgcttggggactgaggcaggaagatcacttgagccaggagattgaggctgcactgagacaagatcatgccactgcactccagcctgggtgacagagtgagactctgtcaaagaaaaagaaaattcagtggttttccactctaattaaagcttaagtaaaatgttattacattaacgtttttgatactagtctaatgttcttgcctttgtgttatactattttgacttttactatcagtgtttgatgattaatgtattactaatttatatatttcaggaacttattttttcgtatctcatatttaacacaaatggatgtaaaactggtatttgttatggaaggggaaccaccaaagctgaaagctgatgtcataagcaagaggaatcagtctcggtatgggtcttctggaaaatcgtggtctcagaaaacagggagatcacattttaaatcagtcttaagagaggtgagcattcagatttgattcagtaattccgatttgaattaaagggtgcattttactcttaatagtttgtcatctttaatacttattaattttattgtgactagcagggatgtgcctagagaaaagagtttattttttagagtgaaattgacctgagtttcattcttggcactggtatgtagaaactctgagacactgagcaaaatttgtaacctatctctaccttgtatgttaccttgtgaaatgacaacagtaatactcagcagggatgtgataaaaataagagaaagtatatctaaagcaactagtacatggtaggaacttgatcatattaccttttataacaccttcaggacttaaagaagtcccagaatacatgagatctcattaattcgtacttcactcattcagaattcatgatagttcatatacagaatatatatttggcttcccttagggcttgtaattttaaaaactgtcgttacattataatatattatttatatgttactttaatattgctatattttatatttgtatgaaacttaagaaagaaatcatctatagtatataattaaaacaataggaagcttttttttttctgttttctttttttggttgttttttttttttttttgagatggagtctcgctctgtcacccaggctggagtgcagtggcgcaatctcggctcactgcaagctccgcctcctgggttctcaccattttcctgcctcagcctcccgagtagctgggactacaggcgcccgccaccacacctggctaagttttttttgttttttttttagtagagacagggtttcactgtgttagccagaatggtctcgatctcctgacttcgtgatccgcctgcctcggcctcctgaagtgctgggattacaggtgtgagcccctgtgcctggccttttttgtctgttttcaaatgtgtgtatttttaaagagttgtagtagtacacatgatttttaacctagccttttcacttaatgcttcatgttgtcatatttcccttttgtcacattctaatcaaaatcataacttgtagtggttgtgcaacatgtatgaagctatgaatcatacccctgattgtatatgttatttacttttttagtttttctctactatacatggaagtgtgattaacattttttgtgtatataatgttttcttgtgatttgaaattttagataaaattacccaatgttggattgatgggtcaaagttttggaatgattttattgctcttgctgattaatttctgctaatgcagatgtcagagaagcagtgtcggtgcactcacaagaacattggatgttaggaggcttgtctttgtaatatttagtgtgcaacaacaaagatatttaatatgcatttgtcttttaatagtaatgttaaacatttcatctatttttagtctccctttgggtaatggctatcatcatgtcctttacctacttacctcttgaggttttaatttttcttttgtgcaagttctttatgtattaaggatataagcttctatcatatttgctttgaatttgtttttctttttaattttagttaaaaaattatgccatttttctcctcttctgaaattttattttctactcacttttaaaaatagttttcaattagtgaatattccaccctaatgactatcagcagttgaagaaaatatctgtgctaagttctaattacttcttgtataatcaattcctggaaatattcatggtcctcaatcttagagtgttaaagaaccagcataaaacaaaaaaagagatgtccatctcttcttaagaaaattgctccattcctgtttctttattgctgcagtaattatggtgttcttaggcattttgtgtcagttcagtattgcctgttagtcatttttatatttctgtactcttcagttactaggccctgcttcctcctaatccactgctatcttttaggtattcgcatgaaaagcacaaattagtagtcctccaataccacctccaccccacatggtagagacatagagtgggaaaaattgcaacagccttataggaaattctgtgctggttctttgaaaaaatttgaagtggcaaatagtacaagaagttgaaataactgtattatgaaaggctattttttacctaggggtaaggtcgaagcaacactgtcacaaaactgtctctctaaaatcacggggccagcgtcctgaaaagtgatatttttcaacatagtactttgactttttgaaccttgtctgccttgggcaacatctgacagtggtagttattatgtaatgtggcgtggaagtgattaatcaaagcaagaaatggtatttattctgtcagtctctagaaactacaagtaagtagccttttctccccaccatactcagtagtccctgatagagaatgatacatgacaaaaaagaatggcgtattacaagaaagaatgaactaggctataaggccagactacaagctacccagcggggttaaattcataaaccagaggaaagtcacagcaaattatttgtgcatcagcaaaatgatgtaatcattctgcacaaacatttgatttcctaggaggacactgacagctgacttctccgcagtttcccacaatacgagagtttcattgtacagggaaggcaagatgagaaaaaaatgcaaacattaaaattcaagccaaaactgtatgatagcatcttctttggaagtacgcgtattgggttgaccatcatgtgagaaaaattattgaagtcttctagatgtaaatcttaatatgattaattattatttaaagatattttcagaatctgactataatagcaatgaaatgtgaatatggattactttgtaattaacattaaaatcttaattttttattacagaaaatttaaatcaacacaaaagtaacccatcactaatcttaaaccattatcttggctcatcttgtttcatctattcccctatccacacatcattttgaagcaaatcgtagacataatattgtatcattccctgtatttcatgttttctaaaagatgattcctaaaaaataaaaagaaacataaccacaatataatttttattagcacacgtaaaagtttggcagttcattccttaaagccctcaaatattcagtcattgttcaaatttccaagtgtttcttaaatatcgtaatttttaaaacaccaaaatagctactattaatatttgtaatacagaaataggtttaatagtaaataaatgagcagtgaaaacattctttaacatcttgcacctgctttttgttttcagtgcctccatatgctcgaatgcttaggaatcccctgggttcaggctgctggggaagctgaagccatgtgtgcttatctcaatgctggtggtcatgtcgatggctgcctcaccaatgatggagatactttcctttatggggcccagactgtttacaggaatttcactatgaatacaaaggtgtttattttctttctctttttcagcatttgtttacgaactaccttttttaaagggctgattaaatgaaatagtagatataaaatgcttactgtaatgccttgcacgtagcaattgctaattaaaatgcttactgttattaaaaatcattgccacatagttcattctcttcaaaatgtggatttatctcataagaacttgacttgtttgtttcacatggtttgattctaaatcattttcaaaaatacatcacgaattgcatatgaaaatgtgttgctttgatcctgaatttccagtttagtgtttcatcctcagaaatacctccaaatatgcaaagagagagatataaagatgttcaatgtagcattgttaataattacaaaaatttggcaagcagcccgagtgctcattgatagggacatggttaaatccttcacacttactggttcccagttggagagatactgctgggagacattttggttgcaacagttcaggcttgggcaaaggagagtatagatatgtgatggcttggtgccaaccaaactaaaccttctgccagacatttctgctatccctcccgaaatgctaatattagcacccccattgagaaacactgtttcagagtccatatgatgtaatacagtgcagtcattgaaaaggctattattgacataaaagatatccagacatattaatggtggaaaatttctcaaaatagtatttttatataatcctacttttacttaaaaaacgtaattaacaataaatattcatatatatgtatcaaaggagatggttttttggaagaatatgcaccaagctattaatgatagctcaggcagtgcagttacggggaatgtttactttctataatatatatatatatatatgttacagtgttttattttgtaagatggaaatctacattttttagacaccagaaagcaataaaatggaaaaaattggctagcatagttatttttaagccatttttgaaactacaactttattttcatatattgaaatgtcagattctataaagattctgctgatcaggataattttcttatataaagtttttggaataattaaactttttttctttttttgagacgtagtctcactgtgtcacccaatctgaaatgcagtggtgtgatctcagctcactgcaacctcctcctcctggcttcaagtaattcttgtgcctcagcctcccaagtaactgggactacaggcacatgccaccacgcctggctaatttttttgtatttttagtagagatggggtttcaccatgttggccaggctggtctcaaactcctgacctcaagtgatacacccaccttggcctctcagagtgctgggattacaggcatgagccaccatgcccagcctggaataattaaacatttaaagataacattgacaaattatttttgtaatgtggtttaatgtataaatatgtactttttgaggattaaactaaatctgttctttctttaggacccacatgttgactgttacacaatgtcatctatcaagagtaaactaggtttggatagagatgctctggttggattagcaatacttcttggctgtgattatctcccaaaggtaagctgaaattgtcatatttatttgctattcataaagtctttttcgtactttatgtgctgtataaatatgaatataatatggctatatgattaaaaatcgaatttaaaatataatttcaggcataataagctattcagtgactaaaataatcggcatttcagatggcactaaaaagctgacttgtgacacttaatattataagcaagaatagaataatgtagtaccacagcttgaatctcagtaaactgttactctagattaagagattcacatttatgtttgactatctttttaaataaatataggagttattcttttcttgtattatgccattgtttctttcactcttttttctgttttttagttttcagtattctttgtgcacatgctcaatgctattactgttgctaagtcacgtgatcattgggataagccattcatatttccatgcctctcagcgttgtgctgggttttgttcatggaaatatttgtatcttaagatgcacaatctagtgctctgtaacaaataggtataacaggtgagtgatgagttaagtattatgagaataatcccatttttttaaatgtagtgtttaaaaatagaaaatgactggtattgtaggtcttactatgtagttcccttattatgttcctactgattatttctgtatccttacaatccgtcattttacctctattcccaagagaagtataaagaagaatgacatgtaattttttttccatctgagctcaggagaaaggaaaatatagcagggtaataaaattattaagcctaatttgtaatttatatcatcaaagaactttttttaaactgtgaggaaaagaaagcaggaggaaagaaacttttaaataccacaaaccattattttgtaattctccttctaaagtaaaagacgatttcctaaataaaattatatcataattaaaatctataaacagcccaatgtttaatttaagaaaaaatttgctgacttgaactcacagaaaccaactttagctacagtggtatttaaattatgcattagccatagctatattgaccttttgtgttttttaaaaccaaaactgctatgtatttacattgttctacttaaagacttttaagactatgtactaacttgatttgccttcaaaaacttaaagctaatgctaatacaagaagaatgatattcaagatatctaataacgtgtatgccaaagacataggcaatagagatggaagagacttctgggtatccctgctgtgccatagactctctttttagtagctggattctgggtataggtggattgggaagtattcaggttagatgggacattcctgtgcaggcagatactcagaatgcttgggcagtagctatttactaaccagttaacacgagtgtgtaaatcctagtgtgtactggttaaataacagctctgcttataaggacatattcatacacttataggggctggaagactcagtttaaatcagaaattgtgacaggaatatacattaaggcatatcattttcgtatattggaaattcacactttaaattttcttaagtttttaatttcaagagttaacttaaaacgttccttcgttctctgtttatgtctgggttttggaatattaaatgttcatgtaattaaatgaacttgctttttcctgattacaaacataaagttaggttaaattaaaatattatccaaataattaacatagtaaatgaaagccctctaaaattatgaccctcccttccctaaaataaacaccatcagtggtttggtatataactcgctgaaatttttgtttacatagataacagtgtaattgtcatttactttacaaatcctgatcatatacactattgtgaagtttttgttttatgcatagcagtgtatcttgcatatcttttcctatctttattgaagagttacctcattctttcagctgctgactcttccgttcaattaatatacttttaaccattcctagtgattaacattggaattattttttttcccactttctgaaagggagtccctggagttggaaaagagcaagcattaaaacttatacagattttgaaagggcaaagtttacttcagaggtaactaataattactttctcttgtgacattgaacctttattcttgctgaacttaataacgaatagtacaggaaacaattgttttccaaaaaagggttttgtatttttaaactgacctatattttgtttgatttaagataatttatttttatttattttgaaattttccaaaggaaggatgagaatacatgttccaagccgtattgcatttttttttctttttttggagacaaggtctcactgtgtcgcctaggctgcagtgcagtggcgcaatcactgctcactgcaatctcaacctgccggagtcaagtgatcctcctacttcagcctcctgagtaactgggacaacagatatgcaccactgtgcccagccaccatactacatttaaaatatacatattatttatattaaacatgttaatatattaatttttaatttttttttttgtagagatagggtctccctatgttgcccaggttggtcttgaactcctgggctcaagtgatccccctgccttggtttcccaaagtgttaggattacaggcatgagccacggtgcccagccaccatactgcattttaaaaaatctattattagctcactaaacacatttagtacaatgtcaagtgcatttatgtatgaccatgggcattttgccactagctattttaaacccttttaccaaaaggtaaagataaacatgacattaaaataattttgtatttaatactttgatattgtattttctttctataaatgaaatgtctgtggcgtgttgtaaatatttaataataagcaacattaattgaaatcttactcgactggcctttgctttatagctacatatttaataataacattaattcgtttagtctctatagttggaggattcagaacaagatgcagattatatagaagttaacaaactatgctatttactatctcaaaaacacatgaattatatttgctgatgaaagcaatgttttataaaaattaatattaatgatgataggtatagaatcaataagaaaggaactaggacactgggaaacttaaaacagtcttggcctccagcaggttcgagatggcaagtgcctgaaaaaaatgttaagaggtaaaaatgaaaaaggaatgaccataaaaaatacatcaaatcactgtattctttcctatgatacttctcttttagctgtaaaactgttgataaatgtaagacttcagtaaatccattattgacatcagttattactgtgcccaagcaagaaaggaaaggtataatttggcctgggtgtgagttaaggaatcatttgggaattgtaaaaaataatataaagaaggaaaagcaagtgaatataacacctggctaactccaaaccattcttattgaaacagtttcagcaaataagcactgttgacacttgaaaataataaaattacatttattttataattatctattattctgttttatatactgacttttcctctcagttatttttaatttttgccgtgctattctttatctggaagcaattaatgctaatttttaacaggcttgtacttggtctttgtagtaaatgaattagaaattccagaagctaaatagtaactcttaagtaccagatactgcacaatgacctgaagagataatttagcttttataaaaacttcaacttgtttaagtagaggaacataattcagaacacatacgttttatgattaatacctaaccataccctttgtggctttatgttaacctggaactttagccaaaaacgaaattaacttttaattagtagaaatctttatagtactatacatttttcttaaaatcttttatgaagcaggtaatgttttgctctttgcacaagagattaagaaatgattattttacatgatttagctttttgatacagttttcacccagaagattaatgttttatttaattttatatattactctttactcttctttctgatatagagaaatgttcatgattctgttttgtactctggcacacagagtcagtctgctcacatactgctgcctaacttaagattcttcaaaaaaaaaagactgattggatatatatatacatacatatatatatatacaattttttttaatagagataccgatatatagatacacacacacatatactctctctcctgtcttgcagttctgctgtccttgggccttggggccacatttaaagcttgtgactgagggttttcccacactaggccagcaactttatcagccaccaaagggaaaataattaggtaggtgaaagggaatagatcagcctgatatttgagaacataccgtttttgtgacctcattttttttcctttttttaaaaaccactttctattaaaggtttaatcggtggaatgaaacatcttgtaactctagtccacaactgctagtcactaaaaaactggctcattgttccgtatgttcccatccaggtaaggagacatagggaatggttattagtatctcatacccatgttttaattcttgttcacatagtactttttacatgccaatattaataatactttgaagggttttacattgtcttctccactagattaggaattccttgcagtcagttttgttatatacacatagtagtcactcagtaaatgtttattgaaaccaataatgtgatgtagatgataaatataagtacagtttcaaactatgataccaaattacttagatcttaaaactatgttttcaatatagaaatccattttaagaaaaaaatatatactaataagtcttagggaaaatggaactgaaaccatttgttaatatattggtgatttatatttatctacttaaatgattcttcattgtcctgtaatgcattttgtgtgtgaagacagtgacttaaaactaatttctaatacatgttcactattcttgaaaatagcttggatcttcttcattagtcttggtttaaaaaaaaaaaagacactacggaacacgtactggatcagaaaggcctttcattcccaaaagagattaggatatcatgttaactcatcttttaaaagaaattctgctatatctagttgtcttaatatatttttattaacattattaaattatagataaaatcatggaagaaaatcaatgtttttataaataagatgctattgtatagttttttgataacttataaatgacaattttaggtcatatcaagtatatgtgctcttacatattctcaagacaatgttgaaagtaatcacactttgcttttaaagggaattaaatttccacacccgtgccacagtcatcatttgttcatgttccaaggatagtttaaaaataactgtaactgagagctagacactagcagaggtaattaactgctatattcttttaatacactcgttaaagaaactattctattagagctattctattaagtaaataatcttttttgctagtaattacatcctactttttatgcatgtagcttccacctaaaccagaaagttttctgttgttgattattgtaaatgtataatttcaagtgtctaattaacactttcagatagaagaataattttttctaaagtgtcatgtgatagtaatagctcaagatctacttgagcccaagaattactatggtgtctattactctattcatcctaaatgtattgaaacctttctatatgctaggtagtgtgctaggcaatattaattttggaaaatttagatactggcaaaaagaatgtatgtagaaagtaattataaaaggcaaaaaatattatactttttttgggtctccataaaggttcacctaaggatcatgaacgtaatggatgcagattatgtaaaagtgataaatattgtgagccacatgactatgaatactgctgtccttgtgagtggcaccgtacagaacatgataggcaactcagtgaagtagagaacaatattaagaagtaagtttttttaaaaactcatgatttttcctggcatgacctatacacatacctttggttgaattatttccatataatctttccccatatctagattagtcacatgtttaactaaatttttttttcatttctgttcaaaaatttagctaacctaggagatagtaatgtaatagttattcaaagggaagcttgactgtttgggatactgtaaattcacatttcttattaaatgggaggagattggctgagatgatttcagagtctaaaattgtctgattatagtaataacatgtatataatttttttttcaggaaagcttgctgttgtgagggattcccattccatgaggtaatatccagtaattcaactctattaattttagaaactttcttaaaagtttaaatctcagtttctattttcttttttcttgctaggttattcaagaattccttttaaacaaggataaattggtgaaggttatcaggtaccaaagacctgatttgttattgtttcaggtatctgaaaataaattcttctttactgtatgaagttatatgctggaaagataggaacagatattcactctgattggtcttagaggaggtttaaaattaaaacaggcagctcttatattttttcagcatttatttctactctctcatttgccatacagtggccatctttgcacactataagacaaagtatagttatgctgttttagaagatgccttaattagcatatgtggatatattgcatccatggatattttgggggaagagggtttaataacaagagaatgttaagatcaagtatataattatggaaggtagtatcatttacaaaaacattgatatctgaaattaatgacctaaatttaaatttggaccgtattccacctactgtgtgaccctggatgtgtgttattctcaaaacagaaataatattacttatctcataaagtcaccatgaggattaaatgagattatttatattaactcctaatatagtggctagggacacggagtggctcaataaattgcaacaactgggtacttacaagtaccagctgtaagtaatgacagccacattaagaacgacagccacattaataatgacagccaacatttgttagacatttaaatttgctgttatgtttaatgcattgcatgtaatctcaatctttgtaatctgtgaagtgggttgtaatattttcacattacagatggtaaaactgaggctaagagagtttaagtaagttacccaacatctaagaaatatcatcctggcgttcaaaccgagagccttcactcttaatcattatgcaataatgattcttccttaggaggctcattgtttctagaatattctcattgatactactttaacttacgttaattctaaaggaaaaaatattaatatcacctaggagtgctatttgtctccaagagataacaaaatcttgttttatttttattatatttatagagatttactcttgaaaaaatggagtggcccaatcactatgcatgtgagaaattgctggtacttttgacccattatgacatgatagaaagaaagcttggtagcagaaactctaatcaactacagccaattcggtaatgtaaagaactgtatggtgaaggtggtgtttttacttgagtattttataattaaaatattcctaatatctttaagctcgtttttgtaaaggtggaggaaaggcctcctggaatattaaaagcttattcagggcttataatcagaacaacatagtaagtcatgctttatcatacttttctacttcaaacacatagtaataatagattataaaaagaaacaagcataaaaggatatagccaggctttataagacaactatttcagtggaccagaaaaggaacaaacgtgttaagggaatgtgggaactaaaactggttttgcagagccttaaatctagaagcagccgtatcatccaggaggtaaatcgcttcagagaaaaaaaaaaaaatggggaccaaaagtgcaagatgttgatggagtcaggcttatttcttgaaacccagtagctagggtggaatttctctgttcctatcaggagattagaggctggggtagataataaaaaactaaccaaatgctgcctgaagcccagaaagcccactggaaattactcaaagagactagagagatagaagtgaagacagataaaatataaaagaattgaagaagaaagcttaacatataaagaaatataatatttttaaaatcaacaattgcgtcatgaattcacttcggattaaattaagttttaaaacagtctgacaggttttatgcaaggggtgggtgtggttggcctttcagaatgctagaatcctcaaaaagatgaagacatatgtctgtaagcaacagaaggcaaaattataaaaatgtgtgtaaatggatggatataaaaagtgaactattagcttaaaaatagttgttgaaataaaaagcaatcaaggggtctctaggctaaacttggtccaaaaaaattagtgatttggaagacaaatcaagtcacacagaaatgatctcaaagactctcatataaaaaatgcttaagagtagttttggattagttcctagaagctaataaaagaaaaggttgaaaagtaatttttgaagagatgatgtctgagagttttccaaaatttaagacagatagttatactacaaattatagtcgcaatacatgaaatacccaaggcatattgtagacatcaacgataaaaggaatattttaaaaagtaccaaaccaatcaggcaacaatcatcaatggatgttaaaaccattagatgaaagattgctgcagagaaaggatagtcacagtctcaagtaccgctctacagattaattacaaaggaaaaatggtatcttcaaaagtggagaaatccagtggacatcagtttaactcagtgattaattaccaataaaagaacaatagactgctttcatatgctttctaatacgttaaactgagaaagatactacattatcatataatatttttgccaaaaaagcttgagctaggtggggcgtggtggctcgcacctgtaatcccagcagcattttgggagactgaggccggtggatcgactgagctcaggagttcaagacccatctcttccaaaaatacaaaaaattagccaggcgtggtggagagcacctgtgatcccagctacttggaaggctgagttgggaggattgcttgagcctgggaggtggaggttgcagtgagctgagttcataccactgcactccaaacttggtgacagagtgagaccctgtctcaaaaaaaaaaaaaaaaaaaaaggaaagtttaatctgtatctaatcatgaggaaacaatctaatgaatccaagtgaaaaacgttctgtggagctattatcctggactcttcaaaaataaaaaatatctaggtagttttctggattaaaataaagagacaacacaattcaagaaaaatgatcctgattgaattctgaattgtttttaagtcataaaggaccttttttttaggacaattggggaaatttgaatatggtctatattgtatcattgttaaacttccagagtgtgaaagttttttgtggcaatgtaggaaaatactctacatagacaggctgcagtatttaggggtgatgtgccatgagacatgtttgcaactaacttgcaaatggagaaagcaaatgtgataaaatgttaacaattgatgaatctcagtaaaagtatgtgagtattcattgtactatttttgcaacttttataaaggtttgaaatttttcagaataaacagtttgctgggaagtataaaagaaaaaagatcagctatctgatagcacacatctttcataaccgtaatagatgccagaagatgctggagtgatgtttcaaagtaccgagtaaaaataatttacaaccttgaaatcattaaaacattattcataggaaaagcgtttttaaacatatgaagagtaagagagtttaccactcaaaccttccttaaaagtgcagttaaagggctgggcgtggtggtttatgcctggattagcactttgggagaccaaagcaggcggatcagttgaggccagggattctagaccattctggccaacatagcgaaaacacctgtctactacaaatacaaaacattagctggacctggtggtacatgcctgtaatcccatttacttgggatgctgaggcacgagaatctcttgaacccaggaggcagaggttacagtgagctgagatggtgccactgcactccagcctgagcaaacagagcaagactcaaaaaaaaaaggataatttattttttaaagtgttgttaaaggatatacttcagcaagaaaaaaaatgaacacagagggaagatgtgaattacaagaaacagtggtcagcccaggaattgattaaaacgtatttggataatttaataaactgactagaaaaaattatgtatataaatatttgtataatatttaatgattaatacatgatgatgatgatgataagccaaaactcccaaagtatgcattcaaacacttaagagtacctgctagaaatataatctctgtcttccaaaccagtacaattaaaataagaaagtaaaactatcaaaccaaaataatacaggcagaaggaagatggaagtaacaaagaaaaagctggtgacagcaaacaaaataaggtgcatgaatgaatccagcagctttatcagtaatcaccaaaaatgtaagcagattaaactcacctattaaaagacagattatattggataagtaaataaaattcagcaatattcagcttacaaggtacatgtagaataatactacacagagtttgaaaataaagagatttaagaagacttagtagacaaatactgtacttaccaaagtaatataacaaattttaaaacaaaaatcattattgtgaagatgaggaacactgcataataaggtaagaaacaacttacttagaagaactaacagtaataaactctatgtacctaacaatattatcttttgaataaactagtcaaaggaataggcagtaattccttaaaatgtttttacctgggaaaaaaaaatctatggaaattattcaggttagaaatggaaaatttccaaatatcttatgcaattagacttcattaaatgaatttgtttttcagaattgttaagactcgaatcagaaatggagttcattgttttgaaatagaatgggaaaagcctggtatgtattcactttaagcaaaatattccatttataatatttgaccatgtatgtctagtaaatattgtatatgtgtatatatatatatatacacacacacatagatatgtgtatatatatatatacacacacacatatatgtgtatatatatgtatacacacacatatatgtgtgtacatatatgtatacacacatatgtgtgtacatatatgtatatacacacacatgtgtgtgtacatatatgtatatacacacacacgtgtacatatatgtatacacacacatgtgtgtacatatatgtatatacacacacatatatgtgtgtacatatatgtatatacacacatatatgtgtgtacatatatgtatatacacacacatatatgtgtgtacatatatgtatatacacacacagcatgtgtgtgaaaaataaagatgaaacccatcacatgcaccacaggttgatttcatagtttgcctgtgttattttagataggttttgactaatagtaaatatgataaactttgattttattttaatgtctcaatttgacatttcttttgtaatgtttaaggaagtaataccgaaataatttttatttatatttctcaaatacatgcttttacaaatgctgtggtcattcaatgtcatgtatagttgcatctgaaaaaattgagattgttaaaatactcctggggtacacttcctttcctttttttttttaaccctgcttagttttcagtgggaattttttattgtcaaattattcttatttttgctccagacagaaatacagtgaactctgaattagctcccaaactggagatagtgaaaaacagataatttaaaatgaaagtaataatactttttttttgagacggagtcttgctctgttgcccaggctggagagtgcagtggcaccaccttggcttacagcaacctctgcctcctggttcaagtgattctcctgcctcagcctcccaagtagctggggttacaggcacctgccatcatgcctggctaattttcatatttttagtagagatggagtttcgttattttggccaggctggtctcgaacccctgacctcaggtgttccacccacttcggcctcccaaagtgctgggattacaggcgtgagccactgcgcccagcctggaaagtagtaatacttttgatggccctttcaattgtgttcttttcagaagctatcactaaagaaagctgatgttgagttttaggaaactgtttcatttcttacctggaattttaacacttaactgaattaaaccaaccaaccttacctaaacaaagttttctgtcctttcagctactgctaccatctctgaaataagaggatttaaagttctaatttagaaagaatctccatccggccattgccaggcaaaaagaaaataaattatgtactgctatcaacagattgttagaatatagtgttataaagcaagatttgcaatgaatagttcatttgtgaatgatttattttacctgataaagctagttacctggaaagattgatttttttttttttgagatggagttttgctcttgttgcccaggctggagtgtagtggtgcgatctcggctcactgcaacctctacctcccaggttcaagtgattcttctgcctcagcctcctgagtagctgggattataggcacgcaccagcatgcccggctaatttttgtattttttatagagacatggtttcaccatgttgatcgggctggtctggtgttggtcaggctggtctcgaactcctgacctcatgatccgcccgccttggcctcccaaaatgctgggattacaggtgtgagccatcaagcctgaccgattgaatttttttaaatgcctaattaaggacactttgctgtatttttaatcttttagaacattatgctatggaagataaacaacatggagaatttgctttattaacaattgaggaagaatcattgtttgaagcagcatatcctgagatcgttgctgtttaccaaaaacaaaagttagaaattaaagggaagaaacaaaaacgtaagttttgggtttgatagctatttatgccacatgcaaatgttatagaagagccacctcttctgtttgaatctgctgtgtctaaattttactgaaaaatctataaactcaaaagtcaagaattgtattcttccttctttgtcttcacatactttcttttaaagctgaaaagccaggaataaatcattctgttctgtctactaacttagacacgtgttaataataatagttatactgactagttgttcagcagctactgtttatagcatattcggattttaaatgttttctttatttcccagaactcagtgaggaaaacaactcaattataacattgttttcagagggaaatattttataatctagcaatgcactgagatcaaaaaaaggcagaaactattcatagagatttctctctgaactgtttatttttttattttttacccaagttaaagcaaagaaaataaatgttgattatatgtattttttttcttttcaggtattaagcctaaagaaaacaatttgccagaaccagatgaagtaatgagctttcagtcacacatgactttaaaacccacatgtgaaatctttcataagcagaattccaagttaaattcggggatttcccctgatcctacattaccacaggaatctatttctgcctcattgaatagcttgcttttacctaaaaatactccatgtttgaatgcacaagaacagttcatgtcttctctaagacctttggctatacagcaaattaaagctgtcagtaagtctctaatttcagaatctagtcaacccaatacctcatctcataatatatccgtgattgctgatctacacttgagcactattgactgggaaggtacttcttttagtaattctccagctattcaaaggaatactttttctcatgatttaaaatcagaagttgaatcagagctatcagccatccctgatggctttgaaaatatcccagaacaactgtcctgtgaatcagaaaggtacactgcaaacataaagaaagtgttggatgaggattctgatgggattagtcctgaagagcatctactttctggcattactgatttatgtcttcaggatttgcctttaaaggaacgaatatttacaaaattatcatatcctcaggataatctacaaccagatgtcaacctgaaaactttgtccatacttagtgtaaaagaatcttgtattgctaacagtggttctgattgtacatcacatctttcaaaggatcttccaggaattcccttgcaaaatgaatccagagactctaaaattctaaaaggagaccagctgcttcaagaagactataaagtcaatacttctgtcccttattctgtcagtaacacagtggtaaagacctgcaatgttagaccaccaaatactgctttagatcatagtagaaaagttgatatgcaaaccactcggaaaattttaatgaagaagagtgtttgccttgacagacattcctctgatgaacaaagtgccccagtgtttgggaaagctaagtacacaactcaaagaatgaagcacagttctcaaaagcataattcatcccatttcaaagaaagtggccataacaagttgagtagccctaagatacatattaaagaaactgaacagtgtgtcagatcttatgaaacagctgaaaatgaagaaagctgtttcccagattcaacaaaaagttctctgagttctctacaatgtcataagaaagaaaacaactctggtacttgtttggatagccctcttcctttacgccagagattaaaactaagattccaaagcacttgaaatttaaaacacttaggtataacttaactattttagtactatcagcaatagcagagacagagggaaggtatctagttcatgtgtggtaaaaattttaatgttctctgtgtcatgaaacacttgccattttaatcaaagttgtaatttttaaaaagtcacctaaaactctggttttaaaagatcctctgtattgaaaacttctgataatgtatgtcattatgtccttactattccttaattgtagttttaaaatattggtatagtacttgacagagtaaatacttcatctgattgttcatttttactttttcttccacaagcctctaaagtatttatattccagcttgttcccaagaggataattctttatacttctcttcattcttttaaggccttgcaaggtcttccgttataactcgctttcctaaaagctattttctccctcagtgtgaagatacctttagtgtgctcttccactttggaaggccatgcaaggtgttccattataactctttttcctaagagttatattctccctcagtttgaagatacctttagtgtgctcttccacttttggtgtcttagtctcttttgaggggcaaaaatagaaaaggagagaagatgtcagtatgtttagtaaaaatcatgctcgtaatggctgaataaactgagcaaagtaactccttatgtatccccagaagttcacaggtatatcgggtggaaaaagatttggaaaatcaaatgtataaccaaaaggattagaaactagcccaggatcacgtagctaactaataatcctgtgggaatcagttttcttgcctgctaatttttttatttttctattttttccttctatagcacttttcccccttttgttttgaatctatgcaatattgactttaataccaccaaatattaagtcatgcattaatttaggtcgcactcaaaaattctagagaggcatccagattgaaaaggaaaatggtgtctgcagatgacaagattgtatgcatcaaaaattctaagaaatccactagaaaactattaaaactgataaagcgagttcatccaggtcgtagaatacaagaccaatgtgcaatgatcattgcattttgtttttgtttgtttgtttttttttgagacagagtctcactcttgtcgagactggggtgtagtggcgccatcttggctcactgcaacctctgcctcccaggttcacgcaattcacatgcctcagccacctgagtagcagggattacaggtgtgtgccaccatgcctggctaatttttagtatttttagtagagatgggattttcccttgttggtcaggctagtcatgaactcctggcctcaagcgatccacccatcttggcctcccagagtgctgggattacaggtgtgaatcaccatactcagcctcaattgtatttctgtacacctctaaataaatggaaatacattccatgttcatgaatcagaagacataagatgaccatactccccaaactgatctacaggttaaatgtaattcccattaattccagctggtttctttgctgattctaaaattcatatggaaatttcaggaacacagaatattaggaagaatcttgaaagagtttgaatgacccacccttcctgattttaagtatacagaactacagtaatgaatgtgttgtactggtataaaggtagacatataggtcaatatagatcaatggcatagaattgagaattcagaaaaaaagccttcacgtttatggtcagttgattttaaaccagagtgccaagacaattcaatgggaaaaggaaacagtctttgaaccaactgtcttctggatctattggatatctatgtaaaaaagagtgacatttgattcctacttcacatgatatttaagaagtaacttaagatggatcaaatacctaaatgtaagctaaagctataaaactcttagaagaaaacatagacgtaaatctttgtgactttggattaggcaaggatttcttaaatatacccaaagcataggcaacaaaagagaatacacaaactggacttcatcaaaactaaaaactgttgtttgaaatgacaccatcaagaaagtgaaaagacagcttacagaatgggagaaaatatttgcaaatcataaatgtgataagggacttgtatcttggtggtatataaagaactcgtaactcaattataaaaagacaactttgaaatgggcaaaatagctcaacaggcttttctgcaaagaagaaatacaaatgaccaagaagcacatttaaaaattttcagtactattactcatcaggaaaatgcaaatcaaaaccacaagacacccaatgtctacaatcaaaaagataataactagtattgatgaggatgtggagaaattgaaattctcataacatgctggtaggaatgtaaaatggggcagccactttggaaaaagtctggtagttcttcaaatggttaaatgtagagttacgatatgatccagcaattcctctcccaggtatatacccaagataaatgaaaacttatatccacataaaaacctgtgcacaaatgtccatagcagcgttattcataatagcctaaaagtggaaacaatcccagttccagaatgaggaaggggagaaactaatgtgtattagctattgtgtgctaagcattcaactagattatttacaaaccttgtatcatctcaactctttaaggactgtattgcaatgttttgaatattcagagagaaaaaagtcgttgctaaaacattttccaaggttctgcttattctgatttgttcagtcgtggctgtgatagttcaggaccatctagaccaggtaaataaaatatctagaggcattcttgagattgtatgagatgaaaataacaaaattagttgggagtggccagtctgagttcattttgctatatagctcaggagtccccaacccctgggctatggacaggtaccagtccatcacctgtcaggaaccggcctgcacagcaggtgttgagcggcatgcaagcgagaattaccgcctgagctctgcctcctgtcagatcagcggtggcattagagtctcataggagcatgaaccctattgtgaactacgcatgcgaggatctagtttgtgcactcctactgagaatctaatgcctgatgatataaggtggaacagcttcatcccacagccatctccccctcatcatccgtggaaaaactgttttccacgaaagtggtcctcggtgccagaaaggttggggactgctgatatacctaatataggcataagtgtaaaattatagttcctcctcctcaaggatttctctgttttcattgtccaggttataccaattctttttaaagcattccatgttcttgttccttgatgtggtcatgttatcacttgtaaatcaaatcttttaagttgctgcttacgtatttgctcatcacttcattgtcttgttgaggatgccttgcttccctttgaaatactctgccaaagatctgcctccagctgctaggatcctgtaattggtttctttctgatggctccatgctaaggccctgctctggcctaactgctttgggctttgtgtaatcaatcttaagtccttggcggtttttcttttagatttttttccatataaaatctctatctggccacacatggtggccgtgcctgtaatcccagcacgctgggaggctgaggcgggtggattgcttgaggccaggagttcaagaccagcctggccaacatggtgaaaccccatctctactaaaaatacaaaaatcagtggggcctggtggcgtgcacctgtaatcccagctactcgggaagctgaggcaggagaatcgcttgaacctgggaggcagaggttgcagtgagctgagatagtgccactgcacttcactccaggatgggcgaaaaagtgtctaaaaaaaattaaaatttaaattaaaaaaaaa

SEQ ID NO: 17 - DNA, 147702 bp, Homo Sapiens
ttaacttttagggaacacacatgccaagttctttaattgattttatttttttacataaaaagttcagtaaaaattggataaagtaaagtgattttaagcagtaaatcaatcttatcaacatagcacaaggctggccaaaaccacaaggcagcctgctttagaatatttacatgataacaaattaaaccttgcaggagaacttaaactgtccttacaaagtcttcctgtgatcctagcatgtagaggctaaaagcaaaacgaaaaccaaacaaaaaccaggaaaaaacaaattattttcaatatattcacatatacattaaaatataatacagatcatcagggtaaagggttgtgggtggggatgcgcatgggtctgtgcgctgacagcaccgccaaggagaagacccaggtttaagagtggagtcaggtctggccagggtcttttctaagcccttgcacctctgatggcttctaaccacatgccaacagctcacaactaggtaatcacttgtagatggagttcatttttgtggccttcagttgacatctgcagggttgaattccccagggtgatgtatcatcagtagcacagtgctgacaggggtgggacagaaaggcccacaggatttcctctccctagagtctgtcttacctgaccacccatcctcccaccctggcccaacagtcactctaattcagtgtcctctttgggtttgtaaacagccccaaacttctgcatgtacttcttaatgtactccttggttttgtgtttcacattctcattgcactccaggtcctcaggattcttacagtacttcagctccttattcataacaccgtgagtcagctgtccagggcacaggaagagagaccacagccaccaatcagagcagaaattatatgagggggaggacaggggtggtaatccagcctgctgcttcagggcccttctcaccaagacaggaagttaataagggggtagatgttggggcaggctggtgctatgatcaccagaaaggacaagctgagctctgaaaatttcttagagaactactgctgtcatgtaaggtacgcatccctccccaaaccttccctccccgttcctgggtccccagctctgacatctgacaagaaaaaaaaaaatactttctatgatgaaaagggcttcttagaaggtacacagtttgcccagaacattgcctggtgggctaccaaaagcaaggggagtaccttgcgagccagatgtttaaagtcttcagttgtggtaattcttcccactttgcagtcaggtttccggtaagggttcaggcactggacgatgaactgggacatctgcaggcagagaaaagagaacacgttgctcaacagtccagagagggcaaggagttgtactgaggaaataactagaaaaggtagtgagtaaagccagccaatccttctccttttcctccctcaggttaactggtttggacagtggaatactagtaagccagtaagatctgagaaaaggatacgggctcagcctgagagggaaagagctcccctggatggactaagcaagccttaaaggaggctggagggactcaacagcatgacttcaatgctgagtccttcagcagccccaggtttcagtcaatgaattttgtgtccttggcataaagacagtagctgggttctctgggccctggaggcaaggcagagcacagcaggtgttccagagcttctatgaggcttagcaatcccaggaaccacaggaattttgtcattgaagggtacttagattctttaagtggtcataccacagcatgtgaagcagatggaagcatgatatgacagccagcaaaggaaaacctaagcagaatccttttccttccaccacttactatgtcctccctgggctgtctaagtatggtctgtcctacccaggtgctcccaaacactctaggaataggaccttcagaggtatttgtggtgctaagatcataggggacaaagagaataaagaggccagtcatagccatttcatcagagagcactttgaacaaagtctacccatcactaaaattcagtgagccttcaggtgttcaaagaacaaggctatatcacaaggtaggcactaaataaacagctgctggttcaatgagctgaaataccagtatgttcacaaagggaccataagaaactaaattttatccctgcataagccttttaactcaaggtttttctggggtttcctggcctccaaactctcttccttcagtctatcccctcaaacacagatagggatttcattaccccctgcttaaaattctgcaatggttcccgataacccacagacacatagttcctatatgaagaagaacaataccattccacctcattttcaacagccctcccatatcttgtgctatagcccatcaggccacttacaactccctggaagggaagatgctctctcttgcctctgtacattctattgatataagttagatcccctgctgatccatctggccaattcctacccctgattcaagcgcccttcctgactgcccagattgtggctcccagccctaatatggcatacttttcacacagctgtcgctacttatttacaggtctgtttcttccaaaacactacaagccccttcagtgaatgaagattggagtttagaacctagatgctatgaagcagacaagtttagtgtcttgatggttggtaagacacacttctggtagcataaaaaggagcagcattctcccaagccctggagaattaggcagctaccaaatgagatattacagaaagagaactggactttgagccagaacgcctgagttcaaatcttttgtctagaacttgccttctctgaaccttaagagttctttcacctgaataagaggaaaggcaatctgtcttgcctacctcaagggctgttgtggggacaaaatgagtcaatgggtactgaagtgcttaaccagttgaaaaaggccacacctctttcaccaatgtgtcattcacataacaactaagtcaaatcacagaagcaagaggaatacccaaagacaaggcagcctaccactacagacagctttcttttgccatagatgctacagaaggcccacagtcaaacaagcaaatgtggtctgagaggggctcctgtcaagccaagaaaagatggctgaggagttttcagtgctaaaagaagcacttcagcaagacatacacacaaggaacaccttgtgttcctgcctatcttggggcaaaggagatattcgacatacttaggacaagaaatgaaagggttcagatttaagcctgaggagcttagtgcttatatccaccaaaccttacctcttttctgaatacttctttgcttttctttgctagttcactggaggtgtctgcttctgctgtcttgggctttttcgaggcctaaaaatggaggagaaaacacagtggtgctggcatgagaagtcagtttagtgatgccctactgtcccagaaccctcctttctttcccctagcagggatacctgattcttggtattagaatccgtttagaggccctgactcaggtacaaggcctggagtcaacttggctattatgtttcaaatcctgttacatggtttggctctccttcttataagttaagttccaattctctaccctaagtcaaagctacaactttgatatagccacacatttcagagtcactcatgtccctgttctgggttcagctccctgaactatcaagcaaggccggcacaaaacaagctccatctctcccacctctgacactctaggattccaggacagaggcgaaatgctctgttctgaagactcttgaatactcatcacctttcctccaaaggtggagttggctagactgtagaagacagtctcagtatgcaagagaggctccttggaggttggtaccttcagtttaggaacagaaagattaaggaagtatcacgatattgacggggaggtgatgaaggtcatcaaagccagtgaacagataagtagatgatgacacagaagatactctatgtccccagctggcaagataatgacaaacccaggaacattcccttccagcactgctagagggaggcttccaagttccctctaactaggtactgcaccaggaggcgatgagttggaagctttggtattcagagcacctgtcatgcaggccatctccccatacctttgcccaccactagccatcaggccccttcccagtaaatgtgcttttccacggaaaataataattatgagcattcccctccaaatataagttacttcataatggatctagaagctggagttgatattataggtacttcacacttttttgttaggggcacagggtagaataattttcctgctccccacccatctcctggttctgcttcttccatttccataaacagtatgaaggctctggttctaaagcagctggactagctccagagaaaggtggcactcccttggctttaggctgttacaaatcaactttctctgctgtgtcataaaagctttacgtattttctatttttccaatttcttcatgtagctgtatggggagattagggggtagagtaaaaagaatataaagatccaatttgttttttaagaaaacaaaactaagcaaaaataatgctaataatataagttaagtctattttcaagtgttttgctttgggattttgttattttttttcccccagttgtagatggtatgagtatgctccacagtaagaccttaggtagcaagggatcaagaattatttgagtaagtcaagaaaacttcaacacatccccagctactctcttgtagctctcagaagtcagcagcaacagaaatgagtacagaaagccccttcaggtctgggtatctcaaagatctgggtcctatagaagaggccatgctctcagcgagggtactatgtaaatagaaatgtcctgtttcactctggatagggtatgcactcacaaagctaaatgaacccaaagcacttttaatagatttataatttaatccctgacttgatgaggttggcgggggattggtggggggtggcctttaaaaacacaattatagaatacaatccactgagctctgtctaggagctttcttggtcctcctgagtgctgagcaattgggatcgagaaaggaaatgataaaatgaggggtccccagacttacatcatggaaatcatgaaccaaaatggaatactcttgagagtactgaaattcatgaaaccctctcttcatggtctgtgatttgcaaatggcatgggaaataatttcagaaactggctaacatttactcaaatctaatgccaggcaaagtaaccagagtctgagttgaggacagcacttgttattgacatgaacaaccttaggaccccccactccaaaaaagtcccatttaaaaatttagcaggtaaggctgggtgtggtggctcacgcctgtaatcctagcactttgggaggcggaggagggcggatcacgaggtcaagagatcaagaccatcctggccaacatggtgaaacctcgtctctactaaaaatacaaaaattagctgggcgtggtggcgcgtgcctgtagtcccagctacttgggaggctgaggcaggagaatcgcttgtgcctgtagtcccagctacttgggaggctgaggcaggagaatcgtttgaacccgggagaggtggaggttgcagtgagctgagatcatgccattgcactccagcctgggagacagagcaacaatctgtcacacacacacacacacacacacacacacacacacacacaaatttagcacgtggggttcagtgactcatgcctgtaatcccagcactttgggaggccaagatggggagattgtttgagcccaggaattcgagaccagcatctctataaaaaaactgaaaaattagctgggcatggtggctatgcctgtggtcccagttacttgggaggttgaggttggagagttgcgcgagcctaggaggttgaggctgcagtgagctgtgatcatgctactgcactccagcctgggcaacagagtgaaatgctgtctccaaaaagaaaaaaagcacttttaaggaaaccaccagagaacagggtaggggctctgatacataaaaaagcgagtgcttccagatcctcagcaataaacaataatcagtttgccttttctctgtgttggcttatatagagtatcagtcaattaaagattctggtggaaatctatgtgaggccgtggacagttaagagtacacaatgaaatgagcaggcaaagggcctggcagaaagccagagcttactgcctttagaagctgaccctgctgtcagccttcacctgtggcacatttggattcctaggaaatctgttctgattatgacaaggcaggcctgagtacctttatattacccaaggtgaagcttgagaccttctggattagttggcaatggccttaagcttattgggcagttctggtaaccatacacaggctgtgtaacacaacagaatcaccctttattataaatattgacatgactatgtcacaaagcccatgtgacttggaaccaagagggtatggcttgagttacagaaatgagtcctgacaaaggcagagcaggacatacccagctaatacttctctctccctgtatttaattaaatactgattagagggctgggcacggtggctcatgcctgtaatcctagcactttgggaggctgaggcgggtggatcatgaggtcaggagttcgagaccagcctggccaagatggtgaaaccccgtctctactaaaaaatacaaaaattagtcaggcgcggcggcgtgcacctgtaatcccagctactcgggaggctgaggcaggagaactgcttgaacccgggaggtggagtctgcagtgagctgagatcgtgccactgcactgcagcctgggtgacagagcgagactctgtctcaaaaaagaaaaaaaaaatactgtttagaacataaaatgtaaatcattcagtgaggaactacatcttttgtggcagcatgaatccagaagcaggaggagaagctgagccatcataaacactatccacacaattcaacctaagctctgcagcacatgaacctgtacatgtcaatttttaaaaggttaagatcattgaaaataataaaaacttagtacagctggtgttctgcatctgtaggccagccatggatagaaaatattgaaaaaaaatacaataaaaataatacaaataagaaccaattttaaaaaaccccaatgcagtataaccactatttatatagcatttacattgtattgggtattatacgcaacacagaggtgatttacagcatatgggagtatgtgcgtaggtgacatacaaacactacgcccttgtatataagggacttgagcatctttagactttggcatccatgatagggtgtcttgaaatcaatcccctatggatacagagtgacaactgtaatgtgtctcaaggtattcttcttttggttgattttacttgggatcctttaggcttcatgaatccgtatgcctatttccctctctcaagatgggaaattttcaacattatttatttcttaaacaaattttatatagcctggatgtggtggctcaggcctataatcccagcactttgggaggccgaggcgagcagatcacttgaggccaggagtttgagatcagcctggccaaaaaagcaaaaccccatctctattaaaaatacaaaaaggccaggcgtggtgactcacgcctgtaatcccagcactttgggaggctgaggcgggtggatcacgaggtcaggagatcgagaccagcctggctaacgaggtgaaacactgtctctactaaaaatacgaaaaattagccaggcgtggtggcaggcgcctgtaatcccagctacttgggaggctgaggcaggagaattgctataacctgggaggcagagggtgcagtgagccaagatcacaccattgcactccagcctgggcgacagagtgagactccgtctcaaataaacaaataaacaaacaaacaaacaaattagctgggcctggtggtgcatgcctgtaatcccagctaattcggaggctgaggcacaagaaccacttgaacctgggaggcaaaggttgcagtgagaccagatcacaccactgcactccagcctgggcgacagagcaagaccccgtttgaaaaatacattggctcttgatgccacctctctgcaactccctcaatgcaacaaatactctaaaactactattttaacataacatagttagaggagatctattataccttatgactgttaattaaaagccaggaggcagcagtaaataaactgctgcctcaattgtgcaagtagtaataattcaggtcagaggtgctcaaagggaagacctgactttacactttacacttaccaccacttacacttatcttgatggtgagtacaagacaatgaagggaacaacaatggatggaaaagagaaaaggaacagtctcacaatgtttagtctcatcatcaaaagcttttactaccagacagcactcttcaaagaattatctgaccattatatgccttccctatgtcactccatacagctctgtctccaacaagcaccaatttactgatgactcaaacccagatttgcctgcctagcagccactgcagggagctcaaactccacaatgaacttaatctccacacctcctcctcctctttctttcattccctaggctgaatgatgggatcttatccacccaagctaagaatgagggtgcaggccatccatgactcccttactcacttgtttgctaaaccctcaatcctgcttttcagtcttggcaagattccccagcatctccagtcgtagttcctaactttgcctaactattaacactctccaatttgatttcactattactgatctcacctttattaatgagcccatttcactagaaggacacacatttgactgtctgactcccttgcattaaaaccatttattgactcccaagtacctattatacaacattacattaaccatactagcaaagcactaagacttcagacaatttaaatctaacctacttttccatatctttgtcttgctaacttccctatatgcatccaaactctcaccaaaccaaattatttttcagtctcctatatatactggcttgttctttcttaagcctttgcaaaaaatcaccttatctacctagcatactcagtcctggttacctataggtgaaactgtactcctatacatctcaaaccatgtatctctctgttcccaaagcatttcatactttcttctactatagcaattaccccactgtattcttgctttataaacttaaacataagacctaaaaccataaaaagcctagaagaaaacctaggcaataccattcaggacataggcatgggcaaagacttcatgtctaaaacaccaaaagcaatggcaacaaaagccaaaattgacaaatgggatctaattaaactaaagagcttctgcacagcaaaagaaactactatcagagtgaacaggcaacctacagaatgggagaaaatttttgcaatctttccatctgacaaagggctaatatccagaatctacaaagaacttaaacaaatttacaagaaaaaaacaaacaactccatcaaaacgtgggcatggatatgaacagacacttctcaaaaaaagatatttatgcagccaacaaacatatgaaaaaatgatcatcatcactggtcattagagaaatgcaaataaaaaccacaatgagataccatctcacgccagttagaatggcaatcactaaaaagttgggaaacaacagacaccggagaggttgtggaaaataggaatgcttttacattgttggtgggagtgtaaattagttcaaccattgtggaagacagtgcggcaattcctcaaggatctagaaccagaaataccatttgacccagcaatcccattactgggtatataccacaaggattataaatcattctactgtaaagacacatgcacacatatttttattgcagcactcttcaaaatagcaaagacttggaaccaacccaaatgtccatcaactatagactggataaagaaaaggtggcatatatacaccatggaacactatgcagccataaaaaaggatgagttcatgtcttttgcagggacatggataaagctggagaccatcattctcagcaaaataacacaagagaacacaaaaccaaacaccacacgttcttactcataagtgggagttgaacaatgagaacacatggatacaggaaggggaacatcacacactggggcctgtcagggggtaggggactaggggagggatggcattatgagaaaaacctcatgtaggtgatgggttgatgggtgcagcaaaccaccatggcacgtgtatacctatataacaaaactgcacgttctgcacatgtaccccagaacttaaagtatatatatataaaataaataaataaaataagccaatcacaaaaggccatatattgtattatttcatttacataaaatgcccacaagaggcagatctatcaagaaagaaaatggattggctcatgcctgtaatcccagcactttgggaagctgaggtgggcagatcacaaggtcaggagatcgagatcattctggctaacacggtgaaaccccatctctactaaaaaatatttaaaaaattagccatgcgtggtggcgggcgcctgtagtcccagctactcaggaggctgaggcaggagaatggcatgacccgagaggcggagcttgcagtaagctgagatcgcaccactgcactccagcctgggcgacagagcgagactccatctcaaaaaaaaaaaaaaaaaaaaaaaaagagaacacatggacacaggaaggggaacatcacacaccagggactgttgtggggtgggttgaagtgggagggatagcattaggagatatacctaatgctaaatgacaagttaatgggtgcagcacaccaacatggcacgtgtatacatatgtaacaaacctgcacattgtgcacatgtaccctaaaacttaaagtataataataataaaatttaaaaaaaaatggattagtgcctgggctaggaagtcactgcaaatgggtatgagaggtcttattgggaggaggaaaatgttctaaaaccagattatggtaatggctgcataatttggtaaattactaaaagctattaaattgtaaatctaaagcgactagattttatactaggtttattatacctcaataaagttgctgctgctgctggtttttttttttgtttttgtttttttttttgagatggagtctcgctgttgcccaggctggagtgcagtggcgcgatctcggctcactgcaacctccgcctcccgggttcacgccattctcctgcctcagcctcccgagtagctaggactacaggcgcccccccgcacacctgactaattttttgtattttttttagtagaattggggtttcactgtgttagccaggatgctggtttttttgttttgttttgtttttaaaaagcttgtccagacttgtgcttctggtcatgacagattaactgttaaatgaattagccctctcagagttaaaaactggaaaactagacaaaatacatgaaaaaggcagtttgcacacactggacattaagcagcactaaactatgatcctgagacaagggacaaaatgaggtaagccctatgattaccttggcttttctgcgtggagaaatttaccagactctggggcagagaggaaaacccacgcacagcatggagttctcagtgagctaaggagacaaggattggaatttagagtatctgagataaactataagctaacaattctcagagctcacaaaaggctgggaaacatgtgagcttccatcagctaaagtgaagagatatccattagataacctgtggcattcagtggagatcccagacaggtgatgccttaggagataccctagagaaaaaattactctggactcaacccgacaaagattaagaacagcctctaaaaaatcaaggtgatccacaagtaacttgactggctatcagaacaaagctcaacattcttaatggaaagtaacaaaattctgaaactcaacaatgtaatggtcacaatgtccagtgttcaactgaaaatagcaggcaactattaaaaagctattataaatgctcacagttatgaaagaaaacatgaacacagtgaagaaattaaaactactgggccaaagggacagactcctgagaagcacaggtggcatcatgttcctgactgtcctccccaaccacagtagcattcctggtggcagtagattggtcatctggagaaccactactggctgagcatgccctacctgaccacagggcaggagtaggctacactgtagtgcacagggcagaggcctttgaggccatgaagacagccaacacttccaagttcccctcacatagatttgttgtagactagctcgaccatctcaatgtcaccaacaaatggtcctaaccctgaactatcaaacacccccaaacttttaattttttttttttttttgagacgaggtctcactctgtcaccaggctggagtgcagtggcatgatcttggctcactgcagcctcgacctctggggcttaggtgatcctcccacctaagccctccaagtagctgggactacacatgtgcaccaacatgcctaatttttttttttgcattttttaatggttttgccatgttgctcagtctggtctcaaactcctgggcttgagggatccacctgctttggcatcccaaagtgctaggattatacaggtgtgagccactgcgtcaagccacccttcaatcttgtagatcacagggctgccctgtctttatctggtcatggaactcaaactgtagcttctataaaaatgtaagcctatggatcagaaacttattaaaacacacaaataaaaagcaaaaaaaaaaaacaaaataaaaaacacacaaatataagtatagtggtctgcatatagaatacctgggactctaacccccttaatacttaaaaatataatcactgtcctattgtgtttcttgtttctttgacctgacaggaagatatcagggatttcctggggaacacatggtataaaatgtattttgaaaaaagctacaataaagctacaaactatgatttgggggtatttgcttaagtatgagatacttgataggggctttatcatgcaaagttagtttgcttaactgccaacacttaaatgcagtttttcagttaaacatattcctaaaaatagcattttattctgggacttgactacaaaaagcggacatttaaatgaagtaaaaatggctgggcacgacgactcacacctgtaatcccagcactttgggaagcccagatgggcagatcacttgaggtcaggagtttgagaccagcctggccaacagggcaaaaccccataaaaatacaaaaattagctgggcgtggtagcaggcacctgtaatcccagctacttgggaggctaaggcaggagaatcacttaaacctgggaagcggaggttgcagtgagccgagatcgcaccaccgaactccagcctgggcaacagagtgagaccctgtcttgaaaaaaaataaaataaaataaaatatgaaaaatacaatgaagtgaaaggtatttatcagcactgttaaaaataaaaaagaaattaaaactattaaaaaatatgcaaattaaaatttgagagcagaaaaatataactgaaattttaaaatgaatcaatggatgagcttagctaattcaatacagcagaaggtaaatcagtgaactttaaatagaggccaacagaaaccacgcaaactgaagcacagggagaaaagagctgaaaaaaatttgacagagatgtggtgctctgtgagacagtatcaagcggtttaataacatgtatgtaattggagtcccaggaaaagggacaatggtataaaaagatatatttgaaaaaatttccatatttgatgaaaactaccaatcatggatctaaaatgtacaagaatcacaagcagattaaacacaaagaaaacaaaaccaaggtataccacaaaccgctaaaaactgtttataaaaggcaaaatcaagacatatgggggaaaaagataattatatttttattagaaactattattaaaaaatggaaacatcttttaagtgttgaaaggaagaaaatataaatttagaattccatatccagtgagagtatctgtcataataaacctgtacatggatgtttttagtagctttatttataattgccaaaagttggaagcaaccaagatgtccttcagtaagtgaatgataaacaaactgcggcgcactcagacattcagtgctaaaacgaaatgagctatcaggccatgaaaagacatggtggaagcctcaatgcatattgctaagtgaatgaagccgatctgaaaaggctacctactgtagctaactatatgacattctggaaaaagcaaaactatgaagactgtaaaaagatcagtggttaccaggaactggggaagagggatgaggagagaaggcatgatgagtaagcagcagctcaaatgatttttagggcagtgaaactattctgtacgttactatgatgctatatagatgacacgatacctttgttaaaacccacaaatgtacaataccaagaatgaaccctaatgtaaattatggactttgggtggtaataatgtgtcatagtagattcatcaattgtaacaaagtaccactcttgtgctttgatgttgacagaaagggaagcttgtgcgtgtgtagtgacagggggtatatggaaactctccgtacttcctgttcaattttgctatgccaaaacagaactaaaattgctttaaaaataaagactactttttaaaaagtggtaagataaatacctttcttcagacaaacaaaagctgacaaaatgcatcaacagtagatctgaaatactagaaatgttaaaggaaattctttaggctaaaggaaaatgattccagatggaaattcaaatctacatgagagaatgaagagtgctggaaatggtaaatatgtgggtaaatataggacttaatggtagattgtgataagataaatatgcatactgtaaaccttacaacactgttttttcaaatgtgtaggtacaaagagtataaatatccctttatattcttaaaacactgaggaccgcaaagagcttttattcgtatgggttatagctatcaaaatttttcatattagaaattaagttaaactgagaaaaaataaagcattattttaaaataacattagcaaatctattatataacaatacatataacaataatataattttttgtgaaaagtaactgttttccaaaactaaagcaattcagttaagagtggcagttttacattttggaaatctctttaaacatctcgcttagaatacagctgaagtctcattgccttctgcattcaaatatgtcatgtgccccctggaaaattccatggtatatttgtgaatgtaccaaatgtgacagaggcatgtaatgttttcatattattattaaaacagctttgaccttgtggctcccttgaaagagtcttaggaacctagaggtccccacaccaaactttgagaaccactgtcttaaaaccaccaccaagaagtaaagcaggccaggtgtggtggctcacacctataatcccagcactttgggaggccacaacaggaaaattgcttgacaccagaagtttgagaccagcctggtcaccaacaccaccagaccctgtctctacaaaaatgtacaaaacttagctacttgggtggctaagacgggaggatcatctgagcctggtaggtggagactacagtgaaccctgatggtgccactgcactccagcctgggaaacagagtgaaccatggctcaaaaaaataaaaaataaaagaaaataaagaggtatggctaagccaataggaaaaacaaaaacaaaaaaaaaccagaatacttgaaataaattctaaatcaatccaaaagaaagcaaagacaaataaaaatttaaaaacaaataataaagctgggcacggtggctcacacctataatcccggcactttaggaggccgagacaagtggatcacctgaggtcaggagttcgagaccagcctggccaacatggtgaaaccctgtctctactccaaatacaaaaatcagccaggcgtggtggcaggtgcctgtaatcccagctactcagtaggctgaggcatgagaatcgtttgaacccgggaggcagaagttgcaatgagccgagatcgcaccactgcaccccagcctgggcaacagaactagactgtctcagagatgaaaaaaaaaaagccatccttaaagactgaattgctttccacaagtacttgtcaattcctttatttacagtatcatttctgaattttagggcctataaacataagccttgagataaattttactaaaaaaaaattcaaaggtttcccaccatacaaaggttcatattcttttacattttcaaatccccaagatctatccccaacaatgcccttccaacctcatgctggattacaagttttatgatgcctatgttcccatacaagtaaacagagctattccccaaacatatcccgaacactcccttccttccctgcctttgctccagctttccttttagcctatctttgcttactgaaaaattcctcatcctttaaagctcaaatgccactttctcacaaagtcctcctaactttctctggttgagtttcttctatgctcccaggatgaaaaagcataacagagctataagcaaccatttgtaccatgctgaggaagcacatggtgcaggactgccagtgtaggcagggacaggcttgaaggagaagtaatctagaaggaggctggcttgaagcctaggggaatgtgtgtatctcctaagaactgagggggactcagctcttgagtatagagaagttaatctgattgattgtatatgtgaatttctgactgaaaaccaagaccaaatcttaacacttgcactcaagtaactaaagttataagccctgtcatggtttgattttttttttttttttttttttttttgagacagagtctcgctcttgttgtccaggttggagtgcagtggtgcaatcttggctcactgcaacccccgtctcccgggttcaagcgattctcttgcctcagcctttcaagcagctgggattaccatgtgctcaggcatgtgccaccatgcccagctaatttttctatttttagtagagacagtgtttcaccatgttggccaggctggtctcaaactcctgacctcaggtgatccacctgcctgggcctcccaaagtgctaggattacaggcttgagccacagggtttcaccatgttggctaggctagtcttgaactcctggcctcaagtgatcgggccacctcagcctcccaaagtaggctgccgtgcctagcctatgattattctttttgggagagaagacctctacctttatttgttcacaacaggaaatacatttggcagcttaattctttctgcactctcattattatttgcggatttatttatgtatacatacaatggcagaaaagaataaaagtgcctctccaatcttctctaacaactgagtgaagctgatacctttgaatctccattggaactactactctataaccccccgaggcagttaagagctagtattaggaggaatgttttctctttataatctcccgttccctttcgtttttatacatgtacctcccccaacacacatgagcatatcaatatatcagaattaattgtgaattaagtgttagatttagtttagtgctcttttccttcctaggatagactatattttcttttgcaggcctctaaagtccttgtttgttgtctctacaacaatttttaacaattagccaggcatggtggcatgtacctatagtcctagccactcaggaggctgagacgaaaggattacttgagcctgagagttcgaggttacggtaagctatgcttgcaccactgtactccagcctgggctacagagtgagggagaccctgcctctaaaaacaaagcaaagcaaatcaaatgacaaaataaataaatccctcagtttaccacttaacatataataccgtacattttcaaaccttaccttcctatgacccctgggagcaatagccttgccttatactgtttttgtacccccaggtctgggcatggcatttgtgctgaataggaactcaaatgtctgataaataaccaaaatgtgaaagagtgagatgaagttcagatctgtgtgtatttaaaatgtgtatttagagatccaaagttccaagctagtagattataattcaggcattgccttttggatataatactttcaagagcctactccccaggcacacatgcacctatggtaacagaggagtaaagatcaaacataacctgacaaatatactcactctgggtggttggatatagtaaggttttatgatcatacttctcttacagttgatcacagacaatactgccaattatttagacttgaatgtgtaattaccttgggaccttgtatcacttcagattctgatctagcaggtctgggacagggagtgagactctgcatttttaacaggtggtgcctggtgctcttgggtgctgagcagacctaactactacaataagctcattgtgaaggcgccagctccatggtcaacccctccagtccatctccagcagagagccttgtaaaaggcaaatgttactgatcaaatcactttaaaggtttccctttctcaccagctagccagagaatgaacgtctaattgtgtagcatggcacataagctgcccttttacttggcccctacttctcagctcctactttgtgcttggctagtttgatgacctggatttcctaacacaggtcttcatataagaaaggcaattccttgagcattaaataagcaacagtgaacttcatgcccattcctcattcgctttgaaaggcctaatttaatatgcatatactagaccaaaagactgaatcaagattaatagttacggtgcccatgaacttgggcttttaagaagggtaaggcctccaacatgctttataaacttggccccagaactcagctgtattgctgcaccagatcttatcttaatccctttgtttatttttcaaaagatataactaacacagtacagaagtctggaaatgggagttgtgatttttgtttgtatttaagcttacatataatttaaatgtcaagtgcctagcagtcttgggcatattcctaaatgattcaggaaaacaagacagcacaacagctggagtgaagtggctaagtgatttatgtgattcatttgaaatttagcaaactccacatggattgaacgtaagtgtgtatctttttgcaaatgccaaacacatgtgaaaagaggaaaatatttcctccaaaagtgaataaaatataaacaagaatgaattcatttctactttaatcccttctcactccagctccttttcttccctcttccttcttccacctattcccaataatttaaccactgaagtacttaattcttttcaaaattaaaaaaatattagtcaggttttagaacataaaaatatgatatctgatttcattcaagacacttcatacggtcagctgtggtggctcatgcctgtaatcccaacactttgggaggctgaagcagccagattgcttgaggtcaggagttcaaggccagcctgggcaacacgataaaacctcatctctactaaaaatacaaacattagccaggcatggtggcgcacacctataatcccagctacttgggtggttgagacatgagaactgctgaagcccaggaggcagaggttgcagtgagccaagatcacaccaaaaaaaacaaaaaacacaacaacaaaacccacccctcctattggttttgaacagaccaatcacgaaagcatatgttatgggcactaacaacagaatgcaaagagaggccgggcgtggtggctcacatctataatcccagcacttcaggaggccaaggcaggcagatcacctgtggtcaggagttcaaaaccagcctggccaacatggtgaaaccctgtctctactacaaatacaaaaattagccgggcgtggagtgcacatctgtagtcccagctactcgggaggctaaggcaggagaattgcttgaacccaggaggcagaggttacagtgagccgagattgtaccactgcactccagcccgggcaacagagtgagactccgtctcatttaaaaaaaaaaggcaaagagaacaagagaggccctgaagcgatcatagtaatgggtgttttgaacacccatcacaattcttggccatatatctccctcaaatgagtaagtagttagtatgcatctgagtctctcaatgtctaaaaaaggccattcttttttttttttttttttttttttttgaaaagggattcagggttgtaatgggattattttttatatttttttattttattattattatactttaagttttagggtagatgtgcacaacgtgcaggtttgttacatatgtatacatgtgccatgttggtgtactgcacccattaactcgtcatttagcattaggtatatctcctaatgctatccctcccccctcccccccaccccacaacagtccccagagtgtgatgttccccttcctgtgtccatgtgttctcgttgttcaattcccacctatgagtgagaacgtgcggtgtttggttttttgtccttgcgatagtttgctgagaatgatgatttccagtttcatccatgtccctacaaaggacatgaactcatcattttttatggctgcatagtattccatggtgtatatgtaaaaaggccattctttctccctgacttcatctctacaccttgatacatgcatagtcactcacttatttttcagaataaagaaaaaagaatcccaagaccatgcgggatggtcttggacggactcccaaatgatcaggaaatacatgtgtaagccacactcaccttcatggggttttcatcatatgttggagttcccaggtccatctcagcttcatgctcaaggctggcatcatctcctgggctttcccaagtaggaggatcccactgagtctgcctagaaagagacaaaaacagccatgctgtcagggctaggaaacagagaatcctgacataaacatcactgctcatacatacataaaatacaacatacaataagacatagaataagtcagctccatgagttaaagacaaactttttctatcttcctaacagcaatgattctagcacagagatatgcccctcttcaatgactgtatttctgtgggcaatgatgtggcaacactgactgggtgtcaaagagagcagtaaacccaaacatcctgtctgtctctcacctgactcttaatgtcatgcaaataagactgggcaaagcctaaaatgtacaggaaataggtccctgcctatgtcacccctctgtagatgaagaggtaaacagtgactgtacctagcatataaatggagcaaaataaatcatgtaacacctctcacagtccttgaccacgtgagaaaattatcccttgctttaggagttttctttttaatagttctgcccctctggtttaatgactgacaagaaaaatacgtacaggttaaaaacttgtacccctggccaggcatggtggctcatgcctgtactcccagcactttgggaggctgaggcaggtggatcacctgaggtcaggagttcgagaccagcctggccaacacggtgaaaccccatctctactataaatacaaaaaatttgccagtcgtggtggcgggcgcctgtaatcccagctactcaggaggctgagtcagtagaataacttcaacctgggaggcggaggttgcagtgagccaagatcgtgccattgcactccagcctgggcaacaagagtgaaactctgtcttaaaaaacaaacaaaaaaaaaaacaaaaacttgtaccctctgctaaaaatattcccgaccgactgcaaaaagaaggtttcggccatgttaaccctttaaatgtttacagtcattttgaaaataagcaagcaaagatttttcttttttaaaaaagatctgtaggataaaaagtggaagtaaggatattcacgttcaggagtctgaagccagctgtaacagagaatgttatgaggacagtgacttaaaatgtcaaaagcctcaaaggatctaacaaatctggcaggtcagtcttgtcactacagtcttctgctttaccaccacatcaatcttcagtcaacaacataacaacattaaagacacttgatataaatcagtgtatatacatatatatagactattgtaaaaataggcttacctctgacctatggaactcatttattttaaaaggctcaagatttctaccataataaaagaaccacaagcagctaaggatgttattatagaaactgaacaaatatatacatgtctgttcttagctaccagataaagaaaacctagaaaagatgggaaaggtacacatataaataagaaatacaaacttttttttttttttattctgatatggagtctcgctctgtgacccaggctggagtgcaatggcgtgatctcagctcactgcaacctctgcctcctgggttcaagtgattctcctgcctcagcctcctgagtagctgggattacaggtgcgtgtcaccacgcccagctaatttttgtatttttagtataggtgaggtttcaccatgttggtcaggctggtttcaaactcctgacctcatgatccgcccacctcagcctcccaaagtgctgggactacaggcgtaagccaccatgtccggcccaaactttttttatttttggaagattgatagaatatttaaaatttgttttggtgttaaaaaacaaagttctggccaggtgtggtggctcacacctgtaatcccagcactttgggaggccgaggcaggtggatcacctgaggtcaggagtttgagaccagcctggccaacacggttaaaccctgtctctaccgaaaatacaaaaaaaaaaaaaaaaaaaattagttgggcatggtggcaggtgcctgtaatccctgctagtcaggaagctgagaggcaggagaattacttgaaccctggaggcagaggttgcagtgagccgagatcacgccactgcactccagcgtgggcaacaaaagtgaaaactctgtctcaaaaaaaaaaaaaaaaagttctggttaaaccacacgtggtttttaaaatcattacacattcaattagcaacataatgaggactcattttataaaagcctttttgttttttgagatagagtctcactctgtcacccaggctggagtgcagtagcgcgatctcagctaactgcaacctctgcctccagggttcaagtaattctcccgcctctcggcttcccaagtaggaaggattacaggcacctgccaccaagcccaactaatttttgtatctggagtagagacggggtttcatcatgttggccaggctggtcttgaactcctgaaatcaggtgatctgcccatcttggcctcccaaagtgctgggattacaggtgtgagccactgcacccagcctatagaagcattttaatgcgagtaaggaaggcccttctaagcagaaagggaaaatatatgaaaattttaagcttctttatgtcacaagatatcagaaacaaaactcttgataaagaaatctaacactggacagaaaatgggtagatggcccacacaagtaactcacaaaagatacaaatgaccaacaatcgaatgaagacatcccatctcaatagtaaaataactgaaaataaaaatatttcccacctgttagacttgcaaggttaaaatagatgacatgagggaaaaggattttttttttttttttttttttggagacaaggtcttgctctgtcacccaggccggaatgcagtggcgcaatcatggctcactacagatctgacctcctgtctcaagtgatcctctcgcctcagcctcccaactagttgtgactacaggtgcacaccaccatgccaagctaattttgtattttttgtagagatggggtttcactatggtgcccaagctggtctcaaactcctggcctcaagcgatcctcctgccccagcctcccaaagcattaggattataggcatgagctgctgtacatggctaaaaggaacttatacatacttctttttgtgagagtccaaattgatacaaactattgtttaatggtaagctgacaatatttctcaatttaaaatgtgtacctgttttgcccaacaattccacttctaagtaccctctcgaagaagtagtaagattagtgtccctaaggatgcccaaggttatagttagatataaaatagtgaagacctatcaatgagagtgagttaaatacaatttgatatagctatacaatagagcaggggttggcaaactttctctgtaaatgattagatgataaatattttgacctgtgggccaaatggtttctatcacaactactctgtcattgtagtgtgaaagcaaccatagacaatttgtaagcaaatgtgcatggttgtgctccaataaaactttatttgccaaaacaagtggcctgtgggcatagtttgccagccctgcagcaaagtataaacaattactaaaactaacagttgtagctgggtgtggtgcctcacgcctgtcatcccagcattttgggaggcttaggtgggaggatcgcttgaagccaggagttcgtgcagatcagtctgggcaacaaagaaagactctgtctctacaaaaaaaagaaaaaaaaaattttaaagaaaaaattccatagttctatgttaattgataaagctctatgaaatagattagtaaataaagcagactacaaaaacatctatcttaacaatttacgtaagattatatagatgggtgtatatatacacacacacacacacagagacacacacacacaaagtacatatacccacataaagctatctgtctaaacggtattttttaaaaacattaaatgagttatctctgagtagtggcagttccaggaattatacttccttttttagtacttttctactatatttgctttctacagtaagcataaataatgtgtgtcaaggataaacaatctagctatttaatttggaaatagaaaagcgctgtccgtaaaaaaaattgaacagcagagttgagtagctatgatatagactgcttggctggcaaaacctaaaatgtttattttctggccttttacagaaaagatctgtctatgacccctgatacttatacaatattagatgaaggagcatttaaaaaatctcctcagctttctccaagagtcttgcagattagaaatacaccaaaactgccaggtgcaggggctcaatcccagcactttgggaggccaaggcgggcagggcagatcacctgaggtcaggagttcgagaccagcctgaccaacatacatggtgaaaccccgtctccactaaaaacacaaaaattagccaggcattgtggtacatgcctgtaatcccagctactggggaggctgaggcacgagaatcacttgaacatgggagcagaaggttgcagtgagttgagatcacaccactgtactccagcctgggtgacaaaataaataaaataaaaatacaccaaaacaaatacaaaaagaaccaaagtctaacgtctaaaatacacttaagatgtgattctggaaatccagcagccttcaagcacagtgaaaagctaatgacaagaagtttacaactgtaaaactccccttatagtggcaacttctttgattaagtaaaagcagacatgggaacgcccatacagctcctcttaccttgtgatcacatggtagtaataaatcttcccttctggatctcgagctgtcttccagttgggaggtaagacaatggtttttggtttgggaggagaggggggcggcagatccaagagattatttgtcacaaccatttcagactacaaagaaaacacacacatttttgatcagtgatctctctcttaatctggctgaataggacaaaatagcccacttaaatatgtaaaaatgtacatctacctcctcttaaaaaaaggataaaggaaaggtacagtctgggaaataagggacagtatatataaagaggtttacagagctatcagaaaattgacagttggctctaagtttaccatccaagataccatatagtttatcatatagagcagcatttttcaactttaaaacaccaattctaaggcatatcaactgcaggataccaattaactaaatgggatacagaaatatctttatctttaaaaaaaaaaaaaaagaaaaaccaaaaaaccccctgagaagcaaatatgacagaatgttaacattatccattatattttttccgtacttgaaacctcaaaactataaaatattagtgccacattctgaaaaacataaaaacctcataatcacttatggactgatttttgtttccccaaaacatgtatgttgaagctctaatcctgctgtgactgttactgggacacagggcctgtaaagagctaattaagattaatgaagtcaaaagagtgaggactttttatctaataggatggtgtccttattaaaagagaactgacaccagaggacactcacagagaaaaggtatatacagcaagaaggcagccatttgcaagccaaggagagaggcctcaggagaaaccaacactgctgacaccttgatcttggacttccagcctcaagaactgtgagaaaatttctgttatttaatccactcagtctgtggtattttgttaccgcagccctagcagactagtaatcaccacaaggatatatacttgttccttctttcaagcctattaatgaagaatacattttttacctttacctttgcttgcacagttaaagaggaacctgaagaccccaggctcagataaaatgtgttcacttttaagcaaacacgggtctttgagcattcttgctttgtgtatactcttttttatctcttatttcacccagctggggttttctggcccagcttaagtttcaattcctccattaccctatcctttagcttataaagtgacctcttttccccaagcttctgtgtcccttaatattccaaaccatttatctcttaatagtttaaggcaaaaaagaaaaaatatatattccaaaccattcagtacttattcccaacacaaaactttatttttagtgtagtcaccatctttctcttgtgatcatcatctctcttatttgaaagatcagcttttaagaatacaaatggaaacttatttatgtttgtattaaaaatgcctagtcggccaagcacagtggctcatgcctgtaatcccagcactttggaaggccgaggcaggtggatcacgaggtcaggagtttgagaccagcctggccaacatagtgaaaccctgtctctactaaaaatacaaaagtattagccaggtgtggtggtgtgcacttgtaatcccagctactcaggaggctgaggcaggagaactgcttgaacctgggaggcggaggttgcagtgagccgcgagatcaaaccactgtactccaggctgggcaacaaagcaagacttcatctcaaaaaaaaaaaaaaaaaaaaaaaaaaaaaaaaaaaaaaaaaaggcctagaagggctcaactcgtaacaagcactcaaacatctgctctaagtacacattatcttattatcctgttatttcacatatagtatttttagtccatcttcactaactgtcctgtctaaagtcatcatcaattgctggattgctgcaagagctttctccagaactgtaggtgttctaaagtgctgatttgaccatgctattctgtttagttttttcagttgtttcccatgccaacctcttattttccactttatccaaaaacaacaacactttgagatttcaccatatcctcctacatatgttgcagaataccaaaagcttatcttaatattaaacatcatataaaaaactttttttaaacattgtacaacatgtatagtgaagtatatcacacaattctacatgcctagtccatggtgactagtacagtatcatattctagtacaggttaagcagccctaatacaaaaatacaaaacattttgagtgctgacatgacactcaaaggccatgttcaaaggaaatgcttattggaatatttcaagctatacattttcaaattagagatgctcaagtggtaattatagtgcagatattccagaatccataaaattctgaaatgtgaaatacttctggtcccgtgaagctcagataagggatactcaacctgtacgcggtaaatactgatagatagctggtctaggaaattgttacttcggccaggtgtggtggctcacgcctgtaatcccaacactttgggaggctgaagcgggcggatcatgaggtcaggagttcaagaccagcctggccaacatggtgaaaccccgtatctaaaaatacaaaaattaaggttgggcacagtggctcatccctgtaatcccagaactttgggaggccaaggcgggtagatcacgaggtcaggagattgagaccatcgtggctaacacagcgaaaccccgtctctactaaaaatacaaaaattagccaggcgtggtggcgggcgcctgtagtcccagctactcaggaggctgaggccggagaatggtgagaacccaggaggcggagcttgcagtgagccgagatcatgccactgcactccagcctgggcgacagagcaagactccatctcttaaaaaaaaaaaaaaaaaaaaatacaaaaattagctgggtgcagtgatgcacacctgtagtcccagctactcaggaggctgagacaggagaatcactcgaacccaggaagtggaggttgcagtgagccaagatcgtgtcactgcactccagcctaggtgacagagttaaaaaaaaaaaaaaattattacttcaaaaattcatagtaaaatataaaaatacaaggtcagggtaaacaacaaataaaaaggatcctaggagcattttttttttttttgagatggagtcttgctctgtcacctgggctggagtgcagtggcgcgatcttagctcactgcaagctccgcctcccaggttcacgccattctcctgtctcagcctcctgagtagctgggactacaggtgcggagcaaaatatgtattaacggaactataaattccacagaattaaaaaaattttttttttacaaaatggttgagttcacgccctcagggtggctcaggtgaatttggtggctacacaaatttaaaaacgggccgggcgtggtggctcatgcctataaataatcccagcactttgggaggctgaggcgggtggatcacctgaggtcatgaggtcaagacgagcctggtcaacatggggaaactccgtctctactaaaaatacaaaattagccaggcgtggtggcacacacctgtaatcccagctactcaggtggctgaggcaggagaatcgctttaaaccaggaggtggaggttgcagtgagccaagattgtgccgctgcactccagcctgggtgacagagcgagactctgtctcaaaaaaaaaataaaataaaataaaataaaacaaagaacacgtgaaaaaaaaacccaaaaataaaacccaaaacaaatccaaaccaaaaagaaaaccttccaaagacaaagtagacagccaatgagttttaacaactgaaacatttcttactggctgcaagggctgaggctgccctggtgcaactattgtagtcactgctgcggctggctgtaccaccactccttgtggatgagctgtgaaaatctgttgcccctggatatactgaagacttggctgggcataactctaaaagataaaatgaagaaatcaataatttaagcttttgtcactttaataaacagactgacttccaagttggcacaatcttaaagatatacccataacattttaaaattttttgtttatatatttggacataaatgtgcaaaacaattttttgtttcaaaccccaaagtttctttttttactaattccctattcatttacttactttgattttactttatcataagaaaataaaagcttttttttttttggtcatagaaattctccaactgtttagctttcaatgacattggaatgacattgaaaattaaacaggtggacagtttctataagcaaaaaccaatgaagtgctgctcctgggatatccaagaaacaatgccacgctgctcttttcaggaaggcttttgctaccaacttgtaataacaaacaggttgtttggatcagaaaaggtcaaagggtgtgaatcatagtaaataagatgatcaaattttaagctaccttttgttttagctttttgtagtcttctatgataaaaccccttggcagaaagcagaatcaatgcatctgaaattctcacaacacaccaatttatacagtgttctatgatgcaagaagccccttaacatacatcatctcatttagtgctgaccaccatcaaaaccaggtactgcccatgcctggagtttcataagaaataagtactatgctagggcttaaacctactctgtaattatttctcaagcatagaaaatctgcttaaataagaagaggtgataagaagactgaaaaatagccttgctgtcctaagaggtggtgactgttaaggaattgaatagacatgtatcctgtgcttaaggagagattttgctcctatggactgagattctagcaggtaaaatgattacagaaacatcaaatgctaagtactcaaaatacaaaatataattccaaatgacaccagtaaaaactcaagtagtctgaataggcaatgcagctatctagcaggtttctgaatgaataattactgacaggacacaggaaaaaggaaaagaacacttaatttggtattctggatcagcttaatctacttggataataaaccagactgaaaaacattaattgttaaggcagaattaccatcagaatagtatcacaaagcctgagaggaaaatgtacagtcatgtattgcttaacaaggggggtacattctgagaaatgcattgttaggagatttcattgttgtggtaacatcatataatgtactttcacaaacctactaagtgtatgaggtacttacacatcatacagtgtacttcacaaatctattagatacctaggctatatggtatagtctgttgttcctaggctacaaacctgtacagcatgtttctgtaataaagacttgtaagcaactataacttaacagtatctgtgtatctaaacatggaaaagttacagtaaaaatacagtataaaaattttttaggccggggcacggtggctcacacctgcaacccgagcactttgggaggccaaagtgggcggatcacgaggtcaggagatcgagaccatcctggctaacacggtgaaatcccatctctactaaaaatacaaaaaattagccaggcatggtggcatgcacctgtagtcccagccactcaggaggctgaggcagaagaatcgcttgaacccaggaggtagaggttgcagtgaaccgagatggcaccactgcactccagcctgggcaacagagcgagatgccgtctcaaaaaaacaaaatttaaatggtacacctgtatagggaactaactataaacaaagcttgcaggactggaagttgctttgagtaagtgagtggtgagtgagtgaatatgaaggcctaggacattactgtacactactgtagactataaacacttgggctacactaagtttattaacatttttttaataaattaactgtaacttactataacttttttactttataaacaaattttttcaactttttaactcttttataacacttatcttaaaatacaaacacattctacagctgtataaacaaccctcctccctcctcctcgccagggtggagagcagtggtgcgatctgggctcactgcaacctccacctcccgggttcaagcaattctcctgcctcagcctcccgagtacctgggactacaggtgcgtgccaccacgcctggctaattttttttattttagcagagacggggtttcaccatgttggccaggatggtctccatctcctaaccttgtgatctgcccacctcagcctcccaaagtgctgggattacaggtgtgagccaccgtgcctggcctatattttttttaaaaaagagtctcattctgtcacccaggctggaatgcagtagtgtgatcatagcttactgtagccttgaactcctggactgaagcaatcctcccatctcagcctcccgagtatgtgccaccacgcccagctaattaaaaacaaatttgtagagacagggtttcgctatgttgtctaggctagtcttgaactcttgtgtttgagtgattctcctgccttggcctcccagattgctgggattacagatgtgagacaacacactgggccaaatattttttttatatccttattcttattctataagttttttatagaataagttttctaaatatatatatatatatatatatatatatatatatatatatatatgtattcttatatatataaacttattcttttttttttttttttgagacagagtctggctctgtcgcccaggctggagtgcagtggcacgacctcggctcactgcaagctccgcctcccgggttcacgccattctcctgcctcagcctcccgagtagctgggactacaggtgcccaccaccacacctggctaattttttgtatttttagtagagatggggtttcaccttgttagccaggatggcctcgatctcctgaccttgtgatccgcccgcctcagcctcccaaagtgctgggattacaggtgtgagccaccgcgcctggcctatatataaacttattctatgagtttatattatatattaaatatataaacttattctgagtttatattatatattatatatataaacttattctatgagtttatattattatatataaacttattctgagtttatattatatatattatatatataaacttattctgagtttatattatatataatatataaatttattctgagtttatagtatatattatatatataaacttattctgaatttatatattatatataaacttattctataagtttatatatttgtacatatatttatatgtttttcttatatatataaatttatgtttcttatatatataaacatatatatatatgggaaaaacatacattttgatagaggaaacatgaccaagtatttcatagatcagtaaggtatctatattttagaataatcttattgtatatttcaaaatagctagaagagaataattgaatgtttctagcataaagaaaagacaaatatttatggtgatggatatctcaatacactgatttttacaaattatatgaatatattaaattatcacatgtaccctgaaaatatgtacacctattatgtatcaacataaaaaaacaaaaactaagatataaacacacacactagcctaggcttacacggagtcaggatcatcaagatgtcagaaggccagaagaatttttcacctccataataatcttacgaggatcactgtcataaatgccatctgttgttgaccaaaacgccattgcatggcacatgattgtatttatgtacaggctgagcataaacatttctgatttccctaatcagaaatcccaaatgctacaaaatatgaaactttttgagcgtccacatggtgctcaaaggaaatactcgctggaatattttggattttgacttagggatgctctaccactaagtatatataacgtaaatattcccaaatctgaaaaaaatccgaaatacaaaacacttcaggtcccaagcattacagataagggatactcaacctgtatacatttcctctctctttttttttttttttttttttttttgagacagagtctcactctgtcacccaggcggaagtgcagtggcgcaatctcagctcattgcaacctctgctgcctgtgttcaagcaattctcctgcctcagtctcctgagtagctgggattataggcgtgcgccaccaagcccagctaatttttttgtatttttagtagaaacaaggtttcaccatgttggccaggctggtcttgaactcctgacctcaagtgatccccacacctcggcttcccaaagtgctgggattatagatgtgagccaccgcacctggcctattttcttatccctctactcataccatgtgcaagtgaccatattctcttgccatgaccattatttgtctccctacatttttttttttctgagacaaggtctcactctgttacccaggctggaacgcagtggtgccatcaaggctcacagcagccttgacctcctgggctcagatgatcctcctgcctcagcctcccgagtagctgggactacaggagcatgccaccacatccaactaatttttgtattttttgtaaagatgaggtttcgccatgttaaccaagctgatctcaaactactaggctcaagcgatcctcccacctcagcctcccaaagtgcttagattacaggcatgagccaccatgcctggccagtctcctacttttgcccttgactcctgcaatctcttttacccagagcagccagtgatcctctcaaaatatgtcagatcacgctattcaattctaactgctccagtggatttccacattactcagtctaacaaccaaaaatccttttaaagctccccctaagaccctattgtaacttctttgacttcatttcctactactggtatcttcacttatttggaatagaatgggtttcataattacctaacatattttgagtgtgaacatttaatattctgatattgattttataaaataataaaaaagctagttcgaattctagttttgaaaaaaaaaaaatcaccagggtaaaacatgttatttctagagtgaccaggaagtcaatcatccaaatgtacaatagaaaactgctaatattttggaagacaaaatttctttggccatcagtgacaatatgttcatgaagaatttttctgacaagaccggatgtttaagtaaggctcattatgcagacactagtatttgattcatatggaataaagctgtggtttagaagaacacttccaaatgttggctgggagataacaacagcagtatctacttatgttaaaagcctagacttctaggcttttaacagtattaatttggtttctataaaccagtttgactggaataatgcagaagatatacacgtttgttgacacatgtacatatatcatgtgacttttctatttgctaaggaaaaacctatacgagatttttgttttttctgtatcacagaaaaacatgaatgttcgtttttttgtacccaggctggagtgcggtggcacaatctcggcttactgcagcctcaacctcctggatttaagcaatcttcccacctcagctctcccaaatagctgggaccacaggcatgtgccaccacactcggctaattttgtttactttttgtagaaacagggtctcactatgttgcccaagctggtttcaaactcctgggttcaagtgatcttcctgcttcagcctctcaaagtgctgggattacagatgtgagccaccacgcccggctgaaaaacctgtatcacatttaaagagcccactcattcaaatgacttaaaattacacaaatgtggccaggcatggtggttcaagcctgtaatcccagcactttgggaggccgaggcaggtggatcacctgaggtcaggagttcgagaccagcctgaccaacatggcgaaaccctgtctctactaaaaatacaaaaaattagctaggaatggtggtgcacacctgtaatcccagctactagtgaggctgaggcaggagaatctcgaacctgggaggcagaggttgcaatgagtcgagattgcaccactgcactctagcctgggtgataaagccagactctgtctccaaaaataaaaaaaaattgttacacgaatgctagtttctcaaatatatacccactagaagtatctttaaactgtgacttttttttattttttgagacagagtctcgctctgtctcccaggctagagtgcaatggcgcaatcttggctcaccacaacctccacctcctgggttcaaatgattctcctgcctcagcctccccagtagctggtattacaggcacccaccatcatgcccagctaatttttgtatttttgtagagatgggtttcaccatgttggccagactggtctcgaactcctgacttcaggtgatctgcccaccttggcctccaaacgtgctgggattacaggagtgagccaccatgcccggcctaaaatgtgatttctaatgggaattacagaagaaatgtgagaaggtccaataggttatagagagaaaaatacaatttttctgttaccacctctagaataataaaaaatcattattactttatatctggatcacttcactttatactatgtcagtgcaaaagtagttttcaccatttttaacagcaaaagccatgactacttttgcaccaacctaaaatgaaaaattatagtctaagcactcaaactcttgagatgtaattttgtataactttgtgagagtaagtcacttattagtgtcacaagaccactacaaattacgtgacctctgttaaaattgagcttttatgtttagtatgcagttgtgtaaaaaaatcagtcacctctgataacacatttgctccaaatattaaagatactgaatatgtagatacacagacgtaaatgtatattatatcatgttacatattacttcaccgccaaggttatcacagcttgcaaactctgagtagccatgttgtatggttaacactgggcttcaacaacacaaacttcaaggctcctagaggtcagatttttagggctagacaacagatggatgaacatgaccagatgttacttcacagcccattaatgtcaataatctcccctgaatactattaaggtaactatttgtgtaagtaaccatcaaggtatatggtgctttgaatctatcattattaatatcccttatcttaatgcaaatcaaaccattctgaggcattctgctcattttatagatgagaaaacaaagactcaagaatattaatgcctgtttctaggatgcacagtaaatgataaaccaggactcaaaacacatactaacaatatattctatgtttctcaatacccccaaagcccagtatcatctgatcaattaatctcacacagtggggaacggaaggatagttgaaccaccacagcccatttacctactacttaagtacacacaaagtagattagggaatcagtaagtacttcttgatagggacagaatgaaagactagaagcaagtaaattgtgatgcttggctcttagggctaatgaataaaaccaagagaatctttttttctcattgggaaggaataaatggattttattttataagaaaaatcatatgaccagggagctctttactgaggagtctttaatggatatctttcattgctgttgcttaggctctagtactgagatgggacctatttcaggaataggaatggggatagacataaaccatttttactgtatccctgatacatatttttagggaaaaactcaaaactaatggcttggtccaagaaagaatatggctcatacccaagtcaaactgacagtaaaacaaaaccaaaaccaaaacccaaaacattctgtaggagggagaatgaaacatactctctccctacacacacacacaaacaattcacacctgatgaccaataatgcccacatttttactagccttctgtaacaacagtcattttaaaccaaacagcaaacaaaaagcagaaaaaaactataagcatgtttaatggaatgctatttataattatgaaaaataacttttcatttaaatgactacccccagtaaaatggatgactatataagcaaatagggtattatacccattaaaacatttatgtatgtatatgtatatgtacacacacacatatagtataatagtaaataatttgaaaaagtggttacaaatcattttaaggaattgagtcaaatctctttcccctactccaagatcccatcacagtggtccccatacttatccccactggctcctcttaaataaagtctgacttactatcttaaaaaaaaatcattttaagtaggaaaacatgggataaaaaacttcaagtcaagacaaatatataaaatacataaaacttgctttaaaggatcataaaaaatgaaagtagttaatacagttagggttttagtaattaaaacaggataccttgtcatggccattttaacaaatgttttaatacagcttcattatgaaaatatgaacagaagtaaaaattactgtttaatactaagtattatgtgcaggaaacattgttgggagtcttcaacatccacaataattcatttttaaggggtaatgaggagtgctgggagagagacagaaatgtggtgatgataatgctttgaacatttttttttcaaagctttaaatgtactgctggccaggcacagtggctcacgtctgtaatctcaacactttgggagggccaaggcaggagaactgcttgaggccaggagttcaagaccagcctgggcaacacagtgagaccgcatctcttaaaaaaattagcagggtacagtgatgcacacctgtagtcccagctatttgggaggtgggaagatcacttgagcccaggagtttaaggctgtagtgagctatgatcgcatcactgtactccagcccgggtggcagagcaagacctaatctcttaaaataaaataaaaaataaaaaaaagttctgccggccaggcacggtggctcacgtcagtaatcccaccagcactttgggaggccgaggtgggtggatcacgaggtcaggagattgagaccatcctggctaacacggcgaaaccccgtctctactaaaaatacaaaaaaattagccaggcgtggtggtgggcgcctgtagtccaagctactcgggagcctgaggcaggagaatggcgtgaacccgggaggcggagcttgcagtgaaccgagatcgcgccactgcactccagcctgggggacagagcgagactccgtctcaaaaaaaaaaaaaaaaaaaaaaaaaaaaaaagttctgccttgtataatctaaaaaaaaaaaaaaagaaaagaaaacatgatttttatttatttatttatttatttatttatttatttatttatttattttgagatggcatcttgccctgttgtccaggctggggtacagtgacgctatctcagctcactgtaacctctgcctcctgggttcaagcgattctcctgcctcagcctaccaagtagctgggattacaggcatgagccaccatggccggctaattttttttattttttagtagagatggggtttcaccatgttggcccggctgatctcaaactcctgacttcaggtgatccgtccacctcggcctcccaaagtgctgggattacaggtgtgagctaccacgcctggcctgaccatgatttttagaaaacacaaaaatattaccatgatgaagggttctcccttgggagaaatggaggcctgctaacaacaatgtgagtaggttggaaagtgaatctctatatctagttcagccttcagatgactgcagccatggccaacagcttgactgtaatttcatggaaaaccctgagccagatccaccctgctaagctgcttctgagttacttattgtcttaagctgacaagttctggcaatatttcacacaatagataaccaatacatataaagttgatcaatatatacaagtagtccatggtaagacttcctcccctataccagatttaactaacatcccatgaacagaccataaagcagaaaagaaaagtttcagaattagttacctgtacaattggtggagttgtctgtgaataaggtgatgtcacaccatagactgttggacatgtctgtccttgataatatatggttgcttgagactgtgcaggagagtactgctgctgtacactgacagactgttggtttgaatcccaaacactataattctgtccctgaactgggccgggggccggcactggcaagacagcaacgctggagtcttggtgtactacaccatcactctgggccacatactgggaactggaaacttccacaggagctgccacatgtggcaccactggtactggtggaggggcagaaaggggttctgtagaatgtcccaccaagggctgagcatgatcataaggagcaggagaacacactgggtccatgctgggtgtgggcaggagcacctttccagcattagggttgctgggatccacataggcctgcatgggataacctggtgggtaaccagcaaagggatgatgcggggcattataaccaagagagtcatagggcagtggtgatgtcattcccaggttctgcatctgttgctgttgtttctgagcctcccgttgagccacctcttgctcaaacaacttccggcgttcctctgtagaaagtttattgcggtctttaattcgtactttctttttagaagttggtgtatcatatctagaaagaaaataaggaccacaaaaagttgctccctaaatcatagacacaatcaaagcactaataagtattatgtcactcatgactaaaccactaaccacatcaaaccctatttggcactggtttacaactatactcaaaattactcagcttgtcttgcacacagaacagaatcccaaggaattgacaaagagatgaaaataatttcatctctaatttcatctctacccttagtttctagaattttaagattaaagatagatacagcatcctattctttatagctggggacatttctataatcacaaattctaaaattaaaataaaaaacaaaataagtgtcataaaccaagaaataatccaatactcaatccaatttattgtccctaaattccacagtacggttaagcaggagattagatatgaagagaaatagttgaaaaataaccttcaaattcaaaagtccaatgaattccaactgggaaaagaaaaagaaatcctcataaaaacatacagcagaaagacatatacaaagagagcctcttaaaagcagaccaagagaaaagcccgattaaagaaggatgaaaattagaccaagtctcacaaaaccagttaagggaagccagaaaactgaagaataaatagagtcagaatgttgagagaaactatttccccaaaaaaacttcctttcaaaaatgagggagaggccaggcatgatgaggcaggcagatcacctgaggtcaggagttcaagaccagcctggccaacattgtgaaatacccatctctactacaaatacaattagctgggcctggtggtgtgtgcctgtaatcccagctactcaggaggctgaggcaggagaatcgcttgaacccaggaggcagaggtgggagtgagctgagactacgccactgcactccagcctgggcaacagggcaagacaccgtctcaaaaaaaaaaaaaaaaaaaaaaaacacaaagagggagaatattcacataagacttgtacatagcagcaacattcacaatagccaaatgtctctgaaatgatgaatttataaactatggtacatgaatacaatggactactcagcaattaaaaaaaaacctaccgagacacaaaataacatagatgaatgaatctaaaatgcaatacgacaagtgaaagaaggcaaattcaaatgctatatactatatatcacttttttgacattatggagaagacaaaaccagagggtcagaaagcagatcagtggttgccaggagttagggatgtggaagggactgactacaaaggggcacaggggaatttttttttttttgagatggagtctcactctgttgcccagactggagtgcagtggcgcgatctctgttcactgcaagctccaccccccgggttcatgccattcttctgcctcagcctccagagtagctgggactataggtgcccgccaccatgcctggctaatttgttgttgttgttgttgttgtatttttagtagagacagggtttcacagtgtttgccaggttggtcttgatctcctgacctcgtgatccgcctgcttcaacctcccaaagtgctgggattacaggtgtgagccaccacgcctggcctttttttttttttttttttttttttgagaggttgtctcattcttgtcacccagactggtgtgcaatggtgtgatatcagctcactgcaacctccacctcccgggttcaagtgcttctcctgccttagtctccccagtaactgggattacaggggtgcatcaccatgcctggctaatttttgtattcttagtagagacaggtttcaccatgttggtcaggttggtctcaaactcctgacctcaagtgatccgcccgcctcagcctcccaaagtgctgggattataggcgtgagccactgcgctcggccgcaaattttttgttttttttttgagacggagtcttgctctgtcacccaggctggagtgcagtggcgtaatctcagctcactgcaacctctgcctcccgggttcaaacaattctcctgcctcagtctcccgagtagctgggactacaatcatgtgccaccacacccgggtaatctttgtatttttagtagagatggggtttcaccatattggccagactggtctcaaactcctgacctcatgatccactcgcctcggcctcccaaagtgctgggattacaggcacaagccaccacgcctggctgggaattttttaaggtgatggaagtgctctgtatcatgattgtggtggtggttacaaaactgtatgcattttatttatttattttttcagacagtctttctctgtcacccaggctggagtgcatggtgtgttctcacctcactgcaacctctgcctcctgggttcaagtgattctcatgcctcagcctctcaagtagctgggattacaggcatgagccaccatgcccagctaattttttgtatttttaataaagacggggtttcaccatgttgaccaggctagtcttgaactcctgaccttaggtgatccaccagcctcgagacccaggaattcaagaccagcctgggcaaaatggagaaactccgtctctacaaaaaaaccaacaaaaaaaccgggcatcgtggcacttccttgtagtcccatctactggatgggtgctgaagtgggaggactgcctgagctggtgcaggtaaagcaaggctgcagtgagccatgatcatgccactgcactccagcttgggcaacagagtaagaccctgtctcaacagagacctcattagacagagataagcatactcaaaattgtatcaatgtcaagtcgctacagaatcatctctttggtgggtagggttctaaggaagcagattttaaagaagagtaaaagtctgagaaaagacaagatttcccagaggaaaaccaagaaggcagtagtgatttgctaccaagacctaatagaagctacagtcatcatgagccccagaaagagatcttcccatatatgaaaatttgtgggagagaggcaccactgcagacaagtgaaaaggatgggttttcaagtaaatggtgctgggacaattgggtattaaataaaactgaatccctcccttataatatatacaaaaattaattgcaaatggattaaggatttaattctcttaaaatacaaaaaaaatcacctcctcaagggaggatttctaaaaacacaatttaaaaaaccataaagaaaacataccatatatgacacattcagctaaaccataattaataaattccatgtatcaaaaggtacaaaaagtgtcaaaatacaagccgtaaactgggagaagatatttgcaacaattatcaccaagacaaaattatatttagaatataaaggacacataaaactaaaaaagacaaataattcaatgaatgaacaacacatataagatacttcacagaacagccaggcgcagtggctcatgcctgtaatcccgcactttgggaggctgaggcagattacgaggtcaggagatcgagaccatcctggctaaaatggtgaaaccccatctctactaaaaatacaacaaattagccgggcatggtggcgggcacctgtagttccagctactcaggaggctgaggcaggagaatggcgtgaacccgggaggcggagcttgcagtgagccgagatcatgccactgcactccagcctgggcaacagagcaaggctctgtctcaaaaaaaaagatacttcacagaacaggaaacagaaatggccaatacaaacctatagtaaccaaaacaacatggtactggcataaaaacagacacatagaccaacagaacagaatagagaatgcagatataaatccacccgtttataaaccaactcaacttcaacaaaggcaccaagaacttacagtagggaaaggacagcaccttttcaaggacagcaccttacagtagggaaaggacagcacattttcaataaatggtgctgagaaaactgggtaactacatgccaaagaaagaaatggacaataaatacatgacacgatgttcaatctatttagtaattaggggaatgcaaataaaaatcacattacataccgagatactttaaaactaaaaaattctgccaaatgcagtatataaatgctttatctcaattttttaaaaagcaaatttaatttaaaaagaacttgtctgggataaatgttttctagcctccagtaaacgattacatggtttgtttttctaccagcataacaagagagcttctgactagatttattaaaaatcagcattttaattagtatggcacaaaactcataagaaaacaaagttctagcttttaaagaataaccattatctttgaagacttatctcccaccaacccccattgcgctcgaaagaacaaatctttggctcccaaaacgacatttaaatattatcaaataggagccattcaagaatcaaaacctattaatcttcacagctactactactgtcaacagagaatctgtcttaagattatcagtaaagttgtatactcactcatcaaaatgcaaatactaattccaaaagcccttgatgttcacaatcagaagtatatgacttgggtactttttaacttgctcaaaacaaaaacaaaaacaaaaaaactcacacaggccacttacctgtcatctggcctttttgttccccgctcataggcagaagagggtggtgagagggagcttcttcgtttccttttctctttattttgagtttgcttgtctgggtctctctctcttgacctattaggagtcttcggggcaggtgtttgatctctgaagccaacagcatcccttcctcgttcagttgctaagggaaaagggtggtttgtttgttttttttttttttaagtttatttggtggacttttctccatcatgacaatgtatcaactgtataataaaacttctatccaacaaatgtatctatggactcctccgtcatctacccagttctgaatttgaaagagatacaaggtcttatgtctgtgttcactctactcactaaaagtctctttcacaaatgcccttttctcctctttccctccaaagactcagtctaagccgttaacatttctataataagttctgtgagcacatgcatgcaagatattcccattacatttagcaaggcagtttacttgccagttcaaaaatgtaaaagccttcaactaccctataactcttcatatttataatctatagaaaagcagcctgatgtgctaagcataagaacctcaatgagaaaagtttatttttttttttaaaggtacgcatggtggctgtagtcccagctacttaggaggctgagctgggaggattgcttaagcccaggagttcaaggcagcagtgagctatgattgcaccactgcagtccagcctgggcaaacgaagcaagaccccatctcttaaaattaaaaaagtggcttatcaggcaacattttaatgaactacagttatctcttggtataaatgggggactggttccaggaacccccttctctccataccaaaatctgtgcatactcaagtcccacaatccacctcacggaacccacatatacaaaaagttgcccctccttataggctggtttcatatcttatgaatactatattttctatgtagatttggttgacaaaaaaatccactgtatgtgtggacttgtgcagttcaaacctgtgttgttcaagagtcaaaggtataaatataaaaggaaaatatatcaaacccaggtgataactttggaagtcatcaaagccagagagctacatcttaaaaaaacataataccaggctgagcatagtggcacacacttgtagtcccagctacttgcaagaggctgaggcaggaagactgcttcagcccaggcattctaggctgcaatgagctctgtttacaccactgcgcttcagcctgggcaacagagcaagatcctgtctcttaaaaaaacaaaccgacaaaccaaaaaatcagaatgccagcttcctattcaaagatggtattaataaccttcttaatttacagtgtctctctttacctagaatcgttcttaatctcactgttttcacttacccaattccattccagtgctctccaaagctgtcctaagtactacttttcactgatcacacctcctagtttctcatctccttaagaagtcaatctcggccgggcactgtggctcacgcttgtaatcccagcactttgggaggccaaggcgggcagattatgaggttaggagtttgagaccagcctggccaacacagtaaaaactctcctctactaaaaatacaaaaattagctgggcacggtggcaggtgcctgtaatcctagctatttgggaggctgaggcaggagaatggcttgaacccgggaggcagaagttgcagtgagccgagatcgcgccactgcattccagcctgggcgacagagctagactccatctcgggaggaaaaaaaaaaacaacaactactaaatctcaccactaaacatttcagtatcaattgactggcataatatgctgttgctttgtgtatgttagtattgctctcttattgagaatttctctcataggacaaggaagagtctcaataaacatttactgctttttctttttctcatctcataaaaatgttctatgggttgttttactccctcagcaaccgagttaggtttcataagcatttctcacagttcttttaggtggcccaaaaccccaagtatttgcaacatggttactaaactacagccaggtatgagcattcgtcaacaagaagctaacagaactcatttgtaccacatccgggtagaaaatgcagtataattaaattaagtgctccagttcacaaggtattagcactatatccttttatgaggtaccattatccagttgcatctggatctacccacgtctatcttgcttcctcctgcaaacccaggtttcttacctagtataaatttccttaaaatgtgactatttcttcactataccctgataaaacaaaaaaggaatcataccaacagttcatattctgactctgcaccttagaatatgtgaggcagacaagtcattccatttattcaggctgatttcctaatattataaaaatgagggtaaagttagactacgtatttcctgaagtgtttcacaatccttccaaattttaaaggttctatgctttgtttgacattaagaaatggaaaccaggcttatatatattatatatatgtaaatatatataaaatatataaaataatataatatataaaaatataaaataattataagcattatatattataagcattttcttattttagaaacctgagactgagatgaagggttctacatgtgaaagagagactaaggtcggcagaaaagaggctactccctgaaaagatatagttgttcattacagatcatcctctgcatctcatggatgcaaaatatttctccacaataatttgcaaatatctagccacaccagactagatatttacaaaatattatggagaaacgctcataggtatttaagctttgcttgtgtgctactaatagttttaactcagtgatcccagaaagctagcttctgataatcaaccctatagtggtgccactggttttgccaaccactattgcccagtcctgccttcttttttataggaagagttatttgcagccctaagtagaatgtgaggctatgaagagactaaaccagagagtggaactaaaaatattcgaaagacaaacaatggtgcaaaggttatctcacaggtctttaaccaataagactaagattatataaaaagttatgcacaccaaaaataaaaagacaaaaaaaaaaaatcacactggcttcttcattctacttttagtgggtcagtggtggaggtactcatgaaaccaataaccaccataagtgaccctattccttgaatctctaagtaagtgtgctggaagaaaggaaggaaattcttaaggctgggcatagtggcttacatctgtgatcccagcactttgggaggtggaaacaggagcacttaaggacaagagttcaagcctagcctgggtaacatagcgagactctgtctctacaaaaaataaataaataaataaataaccaggcatggtggcacacacctatagtctcagctactcaagaggctgaggcaagaggattgcctgagcccaggagttcaaggctgcagtgagagctatgatggtgtcactgtgctcagcctgcatgacagaataagacactgtctctaaaaaataaatcaataaataagtttgttggaaatgtaactaagtggtaaagtccagaaaccagattcccatggcctccctgctatccattctgaaacaatgattctaactttttcaggggtgactgagaatctgatcaaagttttgaacttgcctcagaaaagtaaatacagtcaacccttgaacaacatgagtttgaactggatgaaagtccacttatatgtggattttcttctaactgtgccacccaagacagcaagactaatccctcttcttcctcgtcagtctgctcaaggtgaagataaggatgaagacctctatgatgatctatttccacttaatgaagagtaaatatattttctcttatgattttcttaataacatttttatctagcttactttattttaagaatacagttacataatacacataacatacataatatgaggagtcaaaagttatgtggaatttcgacgcacagggtatctgtatctcctatgttgttcaagggtcaactgtgtacatacagaattttacatgtaaacatcttttttccttttagagacagggcctcactttgttgctcaggctggagtacagtggcacgatcatggctcactgcagcctcaatctcctaggctcaggtgatcctcctacctcagcctcctggtaattaggattataggcacacaccaccacacttagctaatatttttgtattttttgtagagacagggtttcaccatgtttcccaggctggtctcaaactcttgggctcaagcaatccacctgcttcaacttcccaaagtgctaggattacaggtgtgagccaccctgcccagctgcatataaatatcttgaggtaaagaccctcccaaagacatctagaagtataggtttaagaatgtctgctctatctggtgcgaaggaaaaaaaaaatcaaaatcacaataataaaagaaaaaaagactaaataaaaaaaataaagaatgtctgctctagaggacaaacgaatagaaaaaaagctagtaaagactgagttcaaggaaagcgacaacaaaacagtgtaagagacatttcctttggcaaaatgcattaagaataaaagcacaagtttccaaacttttacaccaaatatttcatttacctagttatatattctctagtttcaaaaacaaaaacgcttaagttcttatcagttacctctgcacataacaaaagaatatttgtaaagccatcaacacagagtatctctgaatacctacttgtgttttccttttcagtttgacttttctttggaattcgatatacctcctgcaaaaaataaaccagagggagggttattagtgagggtggaaatggtgattgctttgaaactgactgttttcacatgacaataaagaaatggaaagtaacaagctggtacttattctctaaaatttgacttatatctgggctttaaataagaatatatcctggccccttaaaaacaagaaaaaatatatagcagaaatacatatatttacatctatcaagcttgtacgatctcactagcaaagcagcatactaaatgactgggcaaggatacgcttcctgagcatcttttttttttttttttttttttttttgagacaaggtcttgctctgtcacccaggctgaagggcagtggcatgatctcggctcactgcaacctctgcctcccaggcacaagcaatccttctgccccagcctcccaagtagctgggaccacaggtggatgccaccatgccccgctaattttttctatttttgtagagatggggttttatcacattgcccaggctggtctcgaactcctgggctcaagcaatctactcagcctcccaaagtgctgggattacaggcgtgagccaccatgcctggccaagtattcataattctaatgtgcacttgccatctctacttagagaaagaaaaggttaataactacccagttatataaaaacacttcagaaaaattgtatgtgtaaagacaattcctactattcagtgtatttttctataaatgcaaaaccaacatgactaatggccaatgtaatatctactttcacattgtgtttgttataaaaaataaaaaatataaaggataagcattagatcactgctcctcttgatcactgtaccaaaattgatcctgagaaatgtgaactgttttaaaggcttttaagtaccttttcttgtgttatctaaggcctagaacctattttgttctttaacagctcttcactattccaccgtccatcgagtaactattgggcacaatactttcttatccagtcatcttaagtgggacagtaacaagcctacacactctcaatagtacataaggtgatatcatcccttcagaggaatctcataatattaaccacacctgtggcctcctctccacaattgttgcttctcacaatatttgtgaaaaataataagccacatgtcacacaactgaggaaaggtcatgatgtaatattcagttgccattaaaaaggatcaatatggactgcacagatccagggaaatctatataaatgaaaaatttttttaaacctccaatactatatgcatgctgacaaattaataaagatgattataattaattgtgcacttatactgtgtgccagatatcatgctgaacatttcaaatacactatctttttttttttttttttttttgagacggagtcttgctctgtcatccaggctggggtaaagcggcacaatctcagcttactgcaacctctgcctcctgggttcaagcaattctcctgcctcagcctcctgagtagcagggattataggcacacaccaccatgcccagctaatttttgtatttttagtaaagacagggtttcaccatgttagccaggttggtctcgaactcctgatctcatgatcttcccaccctggcctcccaaagtgctaggattacaggcgtaagccactgcgcccggcctatctttttgttttgttttgttttttgaaccggggtctctgtcgcacaggctggagtgcagtggtgcgatctcagctcattgcaacctccacctcccaggttcaagcgattctccttagcctccccagtaactgggattacaggtgcatgccaccatgcttggctaatttttgtatttttagtagagatggggtttcatcatgttggccagactggtctcgaactcctgacctcatgatctgcccaccttggcctcccaaagttctgggattacagatgtgagccaccgcacccggcccttcaaatacattatcttatttgagcttcaaaacgaccctatgaggtaagtactattacctcaattttccaaaaaggaaacttacttaaaaagcttagcaatctacccaaggttatgatgctaccagacagtctaactcaagagcacttttatcttctgtattagatgacacaggacatgcctaacaacattattttgagaaggagtaccattctgagatttatgcacaaatgcaggtgacatcctccatccccttaacctctccttcctatgtagaagaactttcattagagctgtgattctctaccctggttgtacaattaaaccacccaagaagcgttcatggaaataccaccccagacaaagtgaatctaaatctctggatgtggatgccagacatgcgtattttttagaagctcctcagatgattctgatgcacagagaaggctgagaactactgaactactggctattcttatcctcacccacccctccccacaagagagaatctgggagaaaaaactaggtaggcctgccctcagctaagagacatctgggctctcttttctcttgatctgcttttgcctttagagagggggtacattcccatctgctactatgagggacatctgaagttactgagttgtcaatttctagctgtgggtaatactgaatcaggaataaagacaggaaggagcaagctggcactcttagttctgtgtgtcttactcctctgtctgcctctcagaggggttattagacaggaaaaagtaagaacgccatttattaccatctacccacactataagggaaaaaaggtattctgctaattttaagaagcttggaaatgacatttgcattaggtactctgtaaacctaggcactccaaaagacagcaggttcattcacaaaaggtacttagaattggtgtattgagggtcccactaagaataacacaattttgacctagtttcttttgcataatatcttggcattataagcatttattacaaaaatttaaagtaatttattacataggcctcaagttggggacccactctgtagcggcagttaatgtaccaccagaaacgcttctcaaagataaattcttagttacgttcaaaagtttagatcaactactaagttgaaaatgtattttgatgttcacaaaataatgattactactgactaatgaccaggagctactatttactgtgtgcctaatcacatgagaaacaatttctatcaatatgtacctaagcacttggagctgctaacttgatcctctctctttctagtcaaggctacatacaaaatttaagctggcaactcaaattacctactgtctcctccttattttatatattaagagaatggggtcctgaaaatacaactgaagttttccaaagtcccacaacattgaaagctgagaaggaagcagccacgcgaggataactttgacatttcttaagatcattctgtcttgtgaataatagtattagtctcagtgatacttgagtctgtctggaataatgtcacatccataggccacagagtctgttacagaaaatgtttaaattggcttcattcatgttaacccttaatgtaagatcaccttactttgttaaatattccactcaagagactggcatactataacagaagatttcaaaatgataattatatgatctgccaaacaagggagaatagaataaggacatttttcagatctataaggtctcaaaatgttatttactggaagagaatactgaagacaatactgtggatgttctaagatttaatattgtgtgtgtatatgtgtgtatagcgatggggtcttgctctgttgcccaggctggtctcaaactcctggcctcaagtgatcctcctgtcttagcctcccgaagtgctggaagccatcatgtccagtgcagtggtgtgatcatagctcactgcaccctcaaactcccatgctcaagggatgctttgatcttcagcttcccaagtagctggcctacaggtgcgtgccactatgcctggcaggtttgatattctgtaagttaggttctaggactgctcttgccctcagacagacctaaaagaatctgcttccacactccatctgatactttttacatattgtcctcttatttctttagtgtctaggtgcaaacctcaactaacacacaattcatacacactcaagctataattattatgggcccatactgtcttattctttattgtatctctagcaccaagaacagtgtctggcacataatcaacactcaattcctttctgaatggaccaacaagtgaaattctacttctaatttatagaaatcacctacacagtgctacataaactcaaaatactgcatataccctacgcttttatccctggaaagaactactgtttaaaggcctcacctacagcccaaaacattgtgtttccagggtcagagtgataaatatacatttgaaattcaggaaacaggctaaagcaaaagatcacaatttggggaaatttaagaaacaataacatatagtgatactgctggagattgcccagacacaaaacatacagaaaaaaaaaaacaaataaaagtaaaaggtagaaagtctttaactcgaaatagtatgttccatatagtatgttttctattaataaacacttgaacaagttacctactactaccaggtcacatggcttactttacaacgttttcttatgacaggctcaaaaggtactcattggaagcaatgcagcacttcattaatacatcccaaataaactctaaaaatatactgtagaaacaggattaaaacaaaattattaaataatttataagaaatctttttctgacaagaaaaaggttaccactggtttagactgttcctgagctaaacaacacttataagaacaaaataattggtggggcgcagtggctcacgcttgtaatcccagcactttgggaggccgaggcgggcagatcacgaggtcagaagatcgagaccatcctggctaacacggtgaaaccccgtctctaccaaaaatacaaaaaattagccaggcctggtggcgggtgcctgtagtcccagctactggggaggctgaggcaggagaatggcatgaatccgggaggcggagcttgcagtgagctgagatcacgccactgcacttcagcctgggcgacagagtgagactctgtctcaaaaaaaagaacaaaataatttacaggcgcaagatttccaccttttgttatatagagatcagattatctgttctgtaataacagatttatttttgaaaactaagactagatttagttattccttgttaacaagtacagatcaaatctcgtataggccaaccaaaccttttttcctaaatattttcctaaatgacagcaatactgagaaagagaaaaaaagactgcaagcaagcctgggtgcagtggctcacacctgtgatcccaacactttgggaggccaaggcaggcagatcgctttaggccaggagcctgggcaatatagcaagacctcgtctctagaaaaatgaaaaaattaggaccgggcacggtgactcaagcctgtaatcccagcactttggaaggacgaggcaggcagatcacgaggtcaggagattcagaccatcctggctaacacggtgaaaccctgtctctactaaaaaaatacaagaaattagctgtgcgtggtggcgggcatctgtagtctcagctactcaggaggctgaggcaggagaatggtgtgaccctgggaggcggagcttgcagtgagccgagatcttgccactgcactccagcctgggtgacagagcgagactccatctcaaaaaaaaaaagaaagaaagaaagaaagaaaaaaaaaaaggaaaaatgaaaaaattacctgggcatggcagcccatgcctatagtcccagccactcaggaggttgaggcaggtggagctcttgagcccaggaggtttgaggttccagtgagctaagatagcaccactgcactctagcctgggtaacagagtgacattccatctcaaaaaaaaaaaaaaatactgtgagtaaactgtcactttcatagctaaaagaacagacaaaacgcagtaggaatggataaaaagaaagtagaaaagcaaagctatggagcctagaagttcaggtgccaacttcaggtaaaaggcattctaggaaagaagaaaatattttacaaaattaagcagataaattttccagaattaaagaaatatgaaatactactgagcaataaggctaagagggccaaagggaaaacagaaggattatgacctagcaagtctgcacctgagtagaggggaagcgcaagtaggtcaaagagatttgattagaagatactatacatgtctggagggtttcataaaaatcacatacatgggtgggaaagaggaagaaaagagtgagagggagaagaggaaaaggggaatgaaataattttgtttatgcttttaaacccctgaagaaacactctaacttcgaatagcagggctccgaagaaatgaaaggtaacaagatctgtgcagttttcagccactaagaaaaatgggtgaagaatatgaacaaagttcttaaagtaggaaatacaaacagaaagatgttcaatacctaatacatatgagaaaaattaaatcaaaactgcaatattccatttttgcctatcagtctgaccaagataaaacttgacagtacttgtgctggccaggggtggtgaaattctcattcttacgtatatacactgccaatgagagctgaattgatataataactatgaagagcaatttggcaatgcttatcaaaattacaacacagactgtagctcaacaacactaatttttagtaacttagccaacatgcatattcctacgtgtgaatgtgtgcaatgacttaggtgaaaattacttgctgctaaggcaaagaaagcaatcaacctaaatggctatgagaatgattaaataaattatggcatacctatacagtaaaataatatgcagttctgaaaaataaattctttataaattgatatcaagtaatcttcacattctattaaaaaggagctgaataatgctgccaattttattttaaaaaataaaatatatgcataatatgcataaattatctctggaaagctacacaagaaactgcttgattgcctcaaggaaatcagatggaagccaagggtagggaggaaacatttcactgtatgtctttcatattttgcctcatgtgcagaaatagcctgtttttaaaactaaaaaagaagaagaaaagataaaatacctcagaaaaagtcctaggcatagtaccaaagactcttgtgcattatgggtgtattcttggtaaagaccatagctactcacaaggcaacttgtaaatgttgttcttcagtaagtgccatacctagaaagtcctcctagttcactgcctctatttaaacttggtcccccaaccaccttcttttctagccttacccacccttcactacaaagctaagagtaggagccctcctgatacccaaatcatctagaaacactttttgaaccacagttcattcctttctcaacccagatatatacacgcccctgttagagaaattgcttatatttatggaccctcaccccagaaatgctatagtcttacatgtaattttagaggttctaaacatctcctgaagttcaattatggatcacagattaaaaatctctgcagtaggccgggaacggtggctcacgcctgtaatcccaacactttgggaggctgaggcaggtggatcacgaggtcaggagattgagaccatcctggctaacacggtgaaaccccgtctctactaaaaatacaaaaattagctgggcgtggtggcaggtgcctgtagttccagctactccggaggctgtggcaggagaatggcgtgaacccaggaggtggagcttgcagtgagccgagattgcgccactgcactccagcctgggcgacagagcgagactccgtctcttaaaaaaaaaaaaaaaaatctctgcagtattaaaggaaaaaaagatacttgaacaaaacactaaaatggtttctatgacattagaatgaattcagacttattatagtttctaaatcagaagcagattaagaatgatctaaaaaggctgggcgcggtggctcacacccgtaatcctagcactttgggaagccgaggtgggcagatcacctgaggtcgggagttcgagaccagcctgaccaacatggagaatccccatctctactaaaaatacaaaaagaaattagccgggcgtggtggtgcatgcctgtaattccagctactccggaggctgaagcaggagaatcgtttgaacccaggaggcagaggttgtggtgagccaagatcatgccattgcactccagcctgggcaacaaaatcaaaactccgtctcaaaaaaaaaaaaaaaaaaaaaaaagaagaatctaaaaagtatttgccaaagaaacacaattgcatgaactgcctagaaaagacagagaaatagttattttttggaccagaaaagtgagtggaagaaggcagtatttaaatcagaagacataagtcaattgtcagctgtcacttaaaagctaagttacaacctcatgggcctgtttgattccactttacagctgataaaaacaccaccacttaacttcacagggttgaaaagataacaatgtgcttatgaaaatattttctgaccatctatcaaataaaaaatatgttctagggattcgagaagcagtatgaaagaaagtatgaagttaccacagaaaaagatggactttcttcatattttcattcacatatttttgaaatgtcaaactacattaccaagctcttcacaggacactgggaagacccaagtgaccaagacataagcagtctcttccttcactcaatgtaccactataaaatgttatctgcctttgattggaaaagatgttgtgagagcctatacaaagggcaaaacaaacactctatcttggagaaacaggaaagactttccgggggggaaaaggaagaaatttaaatgagaagagacatccaaaacaaaagagttttcaggaatgaatgtatgtgtgtgaatattagcagcagaggtctactgcctgtctacaatggcttgagaggagactgcagaaataaatggaaaccagaccatggccaggcatgcaagccacgttaagaaaaatgaacttaatttcaacagtgtaatggtgagccatttaaaaattttaaataggaaactgagatgaaggatttatatttccgaaagattgctctagctactgaatgtagcacagattatagagggcacatagtagtcactcactattagtaagaagtaatttataataaccattactgccaagatgccacaataaaagtaactcttactacaaagattaaaaaattgtccatgcctttgaagaaagcaattccatggtctagtgaggggaaacaagcatctacacaagaagttttagtaatcggttaagataattacagttgtatagaagtacagaaaaggacaaagcatgaactgcaactcattcaaaagaaaaaaaagtattccaagtaaggagaacagtatgttcaaggacatgaagaggtgaatatgtatgagaagactgatgtgcctcatgcactgagtgtgtaaagagaaactgcctgctaggcaagaagtttagacagatacggaattactttctctatcatacactaaaggctttgttcttagagtaatggagtctctgagatgttactagaggttcctgttaatcacatctatgtttttaaaatactgtagcataatgaagggttacatgaaaggggaaaagaatgagagcaagaaggataaatgttgtaaaagtgtaagtaagaaatggcaggagcctgaattaaaagtggcaaagaagagatgctgtgccttatttatttttcgagacagaatctcgctgtgtcacccaggctggagtgcaatggtgcaatctcagctcactgcaacctctacctcctgggttcaagcaattccccctcctcagcctcccgagtagctgggattacaggcactgccatcgtgcccggctaatttttgtatttttgtagagacagggtttcaccatgttggccaggctggtcttgaactgttgacctcaggtgatccacctgcctcggcctcccaaagtgctgggattacaagtgtgagccaccacgcccggcctgctgtgccctatttaacatgtagaacaaaatacatctcaggtaccccaagaaatacaactttttaagggacaggcaaaagaagaatgaacaactgagagttacagaaggaatctcaaaagattcaaaggagggtatggtgtcagattaacagatggaaacaaatgatagataatagagtggtgaagtacattgtgtgtacgtacatgttaattgatacacacacacatatattttatacaatctactgacgggtcctagaaacactgtcctagtatcgacaacttcatctagaatccagatattggtttcaaaaacatttcccaacgcgaggaacaagagattcttgaagaaatgaccaattccggggctggggaagggacagtacaagatgagcctggaacagcatattgtagcaaaaaggtaaaagaaaataatggagatatgtcagaatgacacaaaagccaacatgaaagggcttctactggccaaatatgggacaatgaaggcatcaagtaaataatgaagttaatggattataatctattgggtaaaataagaatctatgagtaaaatagtataaatcaatgaatgaacaaataggagaacaagtaaacttcttgcttaaaaaagaatgtccaataaacaaagtaaaaggaataatgaattagaaaatcaccatttggcaaccaccacagtaagtaattcaagcaaatcactggatgctaaatctaatggatacattttatgaaaaatagggtatttacatatttccaaagttgctcatatgtgatgctttttaattataaagggaaaaatcgtaactttacactggaaaagtctggcagactactgcttaatcgagtgataaaagttgacaatgctagtaatgggacaattcagtaccatgagaagaacactactgtaatattcctgaccaaaaaaatgtatacctgaatccaagcaaaggaaagtttcagacaaacccaactgcggggtattctacaaaaattcaaaaatactttaaaatgtgaactttataaaaaataaaggcagaccgaagaactatttcagagtaaaggatactaaggagacatacaactcaattaatgtgtgctcccatattagattctcagccttttttttttttttttttttttttttgctataaaggccattatgtgaacaactggcaaaatctgaaagaggtctgctgattagatcatagtattttatcactgtgatttgctgattttggtaagtacactaaagttacacagaagaatatccttggttttaggaaatacacaatatccaggggcatcatatctataacttagttgttgttgttttgttttgtttttttttacacaaagtctcactctgtcatccaggctggagtgcagtgacaccatcatggatcactgcagcctcaacctcctgggctcaagcaatcctcccacctcagcctcccaagtggctgggactacaggcatgtgccaccatgcctcgctaattttttagtttttgtagagacagggttttgctttgttgcccaggctggtcttgaactcctgggctcaaatgatctgcccacctctgctgtaacttacttttttaaagttcagaaacagaaaacaataaaaaaaataaggtaaaatgttaacactggggaatctcagtgaaaagtttagaggaatttttcactgaattttctctagactcgtcactagaatgtgtgtaacatgtagaatatgtacagaatgctgttcttgcagtttttcattgagcctgaaattatatcataattaaaagtttaaagtattaagaaggaaaatgtatgtgttttcattatggttactataagacttaaattatactgcctacatctatactaaaacagtctcaagtttctgacttggtcacagtcctaagggaataacaatattccttaatgatcacttctagcttggaaattctataatgtatacaccctcccacctctcaagatagttgtacaaccaaatcacttcctaaacagcatcaagacttttttaaaaaaactaatttcatgggcagcaatagaaacatgatcattatgtctttagggaaacagaattaagagctcacccaaaagagtaaagtgaaaatgacttcattcaaaaccagaatgtttagagcagccagattctgcactttatcttttagatcagatgttggcaaactttttctgtaaaggacaagatagtaaatattttaggctttgtgagccatccagtctttctcacaactactcaactctaccactgaagtacaaaagcagccacagatgatagtacataaatgaatgaacatggctgtgtttcaaagaaaattttatttacaaaaacagacagtggggcagatttggccaacccttgatttagatgaaagtatttggttaaaaaatggaccaataaattttagaccatttttgccttctaccaaacgagacatttatttaaaaatttcaatgttgctgtagctaaaacagcattctttaggggcaattctaattttgttaaaggataagtaatattaatccttatggatacagaataatcttactctagtaagaattcaaaaattatcacagaaatccaggaaacataatttcattttcaaatgttgcacagcagatttcacatacaatattagcgagggagtgaaattccaaacagtgactcaaaacttctcagtttaggcaactctatgttttattttaacttttcatagagagttttaatacatagctttctagggaaatacttgatttgctgaattaaagataatgtcttgagataaagatgaaataagagaagaataagaatagtcattaggaagagttcaacttatcacatgtaggtaattttgtccctaaatcatctaaatccagatgcaaatggaaatacccagacttcattctaaggagaaatgcacatcctataatctaagtgtttataagagaggctctggaatcactaaccattacaatctctcggtgtttaatggcaaatgaaattgccaagttcacaggaaccttacctcctcttcttatgatccaaatgaatgaagatattccagtcaagttacacttagtcaccactggtaaccagctgttttgccctatgaagtctagggtatattttcagcatgaagggtgatatgcaacaatttcttctgcaaacagaaatatatgcacatatccctgctgaaaatgtagcctagtaaattttcacatgaaaatgaatacatgctcacaagtggcaatgtgctaggtgatgtttctggttgaggtctactttaggagtcaaaatgtgtaagccttgtggagtcaaggcagtggtcctgtgtatataggtatagaaaaagtagctcacttaatcctttctcgccaggagtagggattttcccggaacgacatccattgtcggcaatggacgcaccaaaataacgccggcgccagtgagttaaccacctctgtcctcttttcacctattatatttttcatgcatcatccaacttcccaaccatcttcctgtttcttcacagaatgcacgctaggttctcgtttttcttcagcacgaagttggaaatggagttgagaaaaggagacacatggtcagctggtgatgttaacaagctccttgctgccctgagaagctagatggaaatggttcaagttacaagggggatcatcatcagatctgggaggacaaagagtaattcatgaagcttcattcccttccctcccaccctctttcatttactgatgattcctatagtctgccatcacagcaaaaccaagattaaggaatctgaagcaatccctttctgttcttcactccatccagtgtgtagaaaagccaagcggaacacatgtccaccaatgttatggtggcccccggttggctggggagacttgaaatggccataaccacataaccacaatcttagaccaatgctttttagtacgatcttggaattaaagatcagcaactaacacagtgtttgacaataggtgcctaataaaggttggttgaataagacattttcttttcagccaatgtctactcgaacacataggtggaagtcagacagaagtagttaactctttcaatgccgggatcgtatggatatacagtaatcacatcatgtcaatgtgtttctctaaaacatgttcaaattatggattcctgatttcagacttctggttaaatgctatctatgtttgtctggtttttttaagaaccaccataatcagagttttgaaaacagagccatagtaaatgttaattagaatgatggatgaattaagaaccccagcaccaatgtataacaaaacatcacagttcacagtcaagtaaaaacatttctcagtaatacaattctagatgggtaatgattccagagcaaactaaagtttgaagaagagaggagaattttacttaacggctcccttgacactaagaatcaggaaaaatccaaagtatgaaggataagaaggatatattttaagtacaaataaagttttaaacctcaaatcaagaggatcatcaagctacatataaaattgctttgatgtttcagataggagtggggaagataagaagaaggggaagaaataattttgtaggactcaaatgtgtgtccagagtgtgagtttaaattaccatggttacatctaattgggttaagtatatcctagagagtaattcataccatcacaattacagaaacccactatcatacgaagaaacaagaatatttactttttccagattttaagatagctttacaatgattacttcttagcagttttaaaaaataacatcaaccagagacttctccggcaaaagtaaactactggtctacaaccctacttattcttccttccataaaagtacagctataaaggccttttctgtgtccatttgtgtacttgtcttcatctccaccttcttaactgagcttctttacaggctccactagcagcctccaaacacaagagggactccttttagggactcctgtgctgtcacaaagcaggccttaaataaaaatccatcaagtgactatcccagcacttctttcaattaactgcaattctgattcctgcagttcacatactgacttcataagtaaatttactacgaactcttcctttcatatttagaaaaaggcctgatttcctaagacataataaggctgactttatactgaattgtaagtgatgaaagtaacatgagtaagagctcaaatgggtaaacaaaagctgaaaccacaacatacttaaagaagggtctcaacacagcaaatgaggaagcatagtacacaaccaccaactactcattttgctcagtgtttaaggccagtttcattgggtcaaatcacaggatctaatggagtgagctttgtcatcataattaggggcagggaggattcaggtgttcatcttgctgcaaagagtcaggattgctggtttatttggttgcttcatctccggcagaagaaaggaggaacagaaaaatagaagctagttaagtaacctgttcccacagggtcctcaagacgtggatcccaagtccagatcacttacaaatgaaatgtaccacacctctcctaggtttatcctgttattcattcttgtgtttatccaagactcagtctgggttttctgcaaagcaaaccctgcacatcttgctacattcttcaacaagagattatgtatgtaataggcataagagttccagatctatttttcctcttttgtccaaagaaataggcatttaaaagcaggcccatttcagaaacaataatagaagtgaatacgaactagttccataaagttgtttttctaaaataaaaatttacattcaatcatttttagtaagctgctaaattatcttagttttccaattatttttaattttccattaatacaactgatttccaataaatttaaacactaattttttctcattacaaatagaatcctaagtttgctcctcaaaggatttttgtttttaatgtgaagagcacttaaatgactgaactcactattgtgatgtacttttctaagtgacagaaaagaagacatttgtatattagtttggctaatatgactcttgccacggtttagaggatgtttgagacacttataaataaaacagtaagagagacagtattccatttttcagaaatatgcatggctaaaaaaagtagttaattttgcttaggtttgtagaactctaaacctgagtaattcaagttgaaatgaacaaaagatgcttccttacctttaggtctttccaactgtccaggagtttggtggccaaatcacttatatccactgttttatctggctgttcttggctcctttcactctccacatcagacacaccctcctcttcatcttgggatggtgtttcttcattaataggttcttctagttttgtgccgttgctctctttgggctctatttcagcgtcagcttctggttcagatgtaggtagcttactagcttctatgttggtttcactatcaactttgcattcaggcagctgttgtgggagtagctgttgtgactgcaattcttcctcttcctctacagggacattttctaattgatcaagatcctctttgccatccttgccttctagctcactggttgcatcagagattgcactgtccatgctattttcacttataattttcagtctgcgaaacattagtttcttgggagtgtctgtgtcagcttctgtgctcagcttggtggaaggatcaggtgtgttgagtggtgtatgagcacgcgatgtattctcactagaatacccatctccttcactcaacggagggacagcagtcttagtctgagaccagcgttgaataattggaagtactttgctttcctccaacatatttttagtaggaatgggcaagtgttccaaagtctttataatctgattaaacataaaaaaaaattacatcactttgtacagttgacttttttttttttttttgagacagagtctcactctgtcacccaggctggaatgcaatggcatgatcttggctcactgcaacctctgcctcctgggttcaagcaattctcctgtctcagcctcccaagtagctgggagtacaggcgctagctgccacgcctggctaatcttttgtatttttagtagagacagggtttcaccatgttggccaggctggtctcaaactcctgacctcaagtgatccacccacctcggcctcccaaaatgctgggattaccagcatgagccaccacacctggctacagttgattttgttttttttttgagatggagtttcgctcttgttgcccaggctggagtgcaatgatgtgatcttggtcactgcaatctctggctccctggtttaagcgattctcctgcctcagcctcccgaggagctgggattacagggatgcaccaccatgcacagcttttttttttttttttagtagagatggggtttctccatgttggtcaggctggtcttgaactcctgaccttaggtgatccacctgcctcagcctcccaaactgctgggattacaggcattgagccacagcgcctggcctacagttgactttttcaatttctggatgggactcagattatttctgcaagagtagtgcagttttgctactgctttattaagaactacatctctgtaaacacaagcatatttaaaaatcataatattgttttccttaagaaagaaaaacttttaataagactgatcagcaagaatcacaacatcaaataggactgattaatattctctaccagtagttcctaaacctgggtagctttttaaacatatacactactggaccaatcctgggtatcttttcttaaaaagtttaccaagtgtctgtgatatacacttagcagctatgtaacaacatatttaaatgatgtctgtcatacacacaaaaatgcagacatctcttcagcttttgataaacagctgtctagcaaagagagatcccctcctcattcttagacaacctcccccattttgaaatccaagaattttttctgaagtattcctcaatgtagttccacagaaaccccaaggcttcctcaatttcctcaagccaaatctcctgggagaaggacagaggcaagaacaagtacttatctgcccattcctttttgtttgtttttaaaagtgttttattaaataaaagactctgggattatattacaaattagaaagttagaaaattttattaatttcatagaaaggtaaagacatcgtaactccactaataatgctgccaatgaacctttacttagatcttttaaaacacttatttaaaagattcctcaaaatgttcatactcttgttatgcagaattcagatctttaccaattctttagaccccacagttcaaattttatatgacttcccatctttttaaaactctggttttaacaacaaactggatctttcacttaactatgttgttgttattatatcttgctcttgtagttccctgctatgtagtaccaactttaaaaagatactataggaaaaccatgggacaaactactaacaaggtgtatgtacggttagatacgttaaaggaatgatactgagatgaaaaaattatttgattatttaataccaatgatacagtgctaaattcataattactgatattatcacatatccacaaccgaggcaatcaatataacagttttaagaaacaagcaagctaaatgtgaactgacctcttcctgaagcttctggttactttcccggccgtcacctagctctgccatccagatccacaacaaagacagcccatgacgttccagaaaggacttcaggcaggactgtgagtgtgtgttctttcatgggggaagggagacacgatgcagagcattgggaggcaatatcagaatattacaaagagcccgaggagagttcatgtatacgttacacattatagggttcacttacattcacaaaaaaaacctagaaactctgttttcattagcctaaatagaactctacaacaaatgctttaaacagattataatcttctctgatacacaaaatacagccagtcaactgggattttactaacgtagaaaattatatgaatattaataggtcatttataatgaaaattctgaagaactaagaaaaaattgcatctaactttttaaataaagctaaaaccataaaaattagtccttaaataattctttcttctctccctttcagatgattgttgaaaagacctctttttcctgttagttttttttttttaatcatcatggtttttttacactgtggcttacaactacaatctcagcactttcgaaggtggaagagggagggactggttgaggccaggagttcaaaaccagcctgggcaaaatagcaagacccttatctctacaaaaatataaatataaaaattagctggatgtggtggtgtgtgcctgtagtcctagatactcaggcaactgaggcaggaggatcacttgagcccaggagttccaaggctgcagtaagctatgattgcacaactgcgttccagcctgggcaacaaagcaagaccctaaaaaaaaaaaaaaatcattttgtgttatctaacatcttgtggcatacttaataaactggtgtaaaaaagggtaccgttaaaattttgtgcttggagatcacgtagtacaaatggctttgggatgctagtaactggagggtaaaaggctatggcaagtgtgatgaattattacaaaaaaaaaaaaaaagccaccacattctttgaatatagacagaaagcaaaccaggtctaataatgccatggtccccaacctttctggcaccaggaaccagtttcagggaagataatttttcaacaaactgggtgggggatggattcaggatgaaactgttccacctcaaatcatcaggcattagattctcataaggagtgtacaacctagatctctcgcatgtgcagttcacaatagggttcgtgctcctatgagaatcgaatgccgctgctactctgacagcaggtggagctcaggcagtaatgctcactcacctcctcctgtgtggccccgttcctaatcagcccatggcctggggattggggatccctgtactaatagattaaatgatactgaactctttagccattttaaataatatggtacaagctttgaaagtcatacacaactcacatatccatttaaaaaataaaactggccggccatggtggctcacgcctgtaatcccagcattctgggaggctgagacgggtggatcatctgaggtcaggatttccacaccagcctggccaacatggtgaaaccccatctctaataagaaaatacaaaaatcagctgggcgtggtggctggcgcctgtaatcccagctactcaggacgctgaggcagaattgcttgcacccaggacacagaagttacagtgaaccgagactgcaccactgcactccagcctggatgacagaacaagaccccatctaaacaaacaaacaaacaaacaaacaaacaaataaataaataaataaaataagactaactcttatcagaattattccttcttcattcatcttcattcattcattcccaccacaaaaccagaaataaaaaacaaacattaaagtgttcacctgtatgagttccagacaggtaagtttctgctccaaagtttcaattctaaccattagccgggataagctgagcacctggtttttatcagagagaccctcaccattttccatcagagcttctagctctccatccacctaccacagcaaataaaaatacctttttataaaacaacaacaacaaaaaaaaaaaccaaaaacccaaaaagttgctcaaccttatcaattatcaggaaaacacaaatgaagaccaaactgggaaagtactagactgggggaaaaagttaagaaggctgataataacaagtctactgttgatgaaagtataaagtggtataatacatttgaaatgcatttcattcactcatcaaatacgtagcaagaacttatatgagtcaagtataattctaggtggagatctgcaatgagccaaaacagaaaaacctgcccttatgggagaccatgaacaaattacattaaaccaaaaggacttcagagatcctttatggttcataaatatgatgaatgggttttcacgctgctgtgtgagatatatctccttcaaacttatataatttatatgttataatatataatgacctttttatgatgtcagcatatgaatgacccagctgataggggccgggtgcttcagaaaaaaataaagcattagcctgaaaaataaaatagttgtatccccatgcacagaaattctacttatcagaataaactgtagagaaattctgcacatgtgtacctggagattcataagaatgttcattgaagcaatatttataatagcaaaaaattgccaacaacccaaatatctgtacaagttggataaacggccatgttcactcaatgaaatataatactacagtgaaaggaatcaagtacagccaaatgcaacaacatccatcaatcttaaaaatatgtcattaagaaaaagcaagttccaaagaattacatgctatatgaatccatttttatgcacctcaaagctgaactttttagtgatacatatgtgaaaaactgcttttaaacaggcaaggatgaccgggcatggtggctcacacttgtaatctcagcactttgaaaggctgaggcaggaagatgacttgagctcaggagtttaagaccagcctgggcaacacagccagacttcatctctactaaaaatcaaaaaaattagccaggtgtggtagcatgtgtctatagtctcagctattcaggaggctgaggcagaaggatcacctgagcctgggaaattgaggctacagtgagttataattttgccactgcactccagcctgggtgacacagtgaaatcctgtctcaaaaaaaggcaaggaagtaagacccaaaatgtacaacagtggtaacctctaggtagggagaaggaagcagagaagcactaacaaggattttataattatgctttgtaacatatatattctttaagtattttaaatattaaatgtaaataacggggggtgggaatcaacctaccaaaggttatttccagccctgcattatggcagttacaggacataaagattctttcaaagaatttattatgggtgagattaaattaattcatatgaaaccaaacaaggaagcattaactgcaaatgttacatagaactaagaggcctacataagggagtaattagaatgagtcactgaaataagattagaaataggtaagataaagacaagaggaaagggtaagcaaagtagtggggaaaagtgtgaacaaaggaaaataagaaatcatgacagtgcttaggtcaacaaagctcaaacaggtaaggcatggtgacggactgagaaaaaccataccaaataaaagactgggccagatgcagtggctcatgtctacaatcccagaactctgaaaggccaagacaggcggatcacctgaggtcaggagttcaagacgagcctggccaacatggtgaaaccctgtctctaataaaaatacaaaaattagccgggcatcgtggcgggagcctgtagtaccagctatcgggaggctgaggcaggagaatagcttgaacccacgaggtggaggttgcagtgaaccaagattgtgccactgtactctagcctgagcgacagagtgagactccttctcaaaaacaaacaaacaaacaaacaaataaaagactggtgttagattagaagatctcaatttaacataaaataacttgaatttgataaaacctgaacagaatcctgaacaagggaatatatatgatcaaaatggattattatttttttattttttatttttttgagatggagtttcgctctgtcgcccagactggagtgcagtggcgcggatctcagctcaccgcaacctccacctcccaggttcaagtgattctcctgcctcagcctcctgactagctgggactacaggcccgtgccaccatatccagctaattttttgtatttttagtagagacagggtttcaccatgttagccaggatggtctcgatctcctgatcttgtgatctgcccgcctcagcctcccaaagtgctaggattatagccgtgagccactgcgcccagcccaaagtggaacttgataataatttgtgcggcaataacagaataaaattcagataagctagagactaaggagaagacaggtaacattacaacttagcaggaaatgatgaaagtctagaatgaaatgattcagagaaaagcaagctaaaaggaaagaatcttaagaaaattttctattacttttttcttttacttaactagctatttatcccttaatataatttcaggcaaggcactgaacatttttatttcatattgtacccaaaaattcacattctggtaaagaacaagaataaatgagaaaaaataaagtgctgcctgagagaggttgtagaaactcaaacccatttttctttctaaaatgtacatttaaggctcattctttttcatttccaataccacttaagtttttgagtaaatacatgaacagaaaaaccaatttaaagttgtcttaatccaagaaagacaatttcattaaagatatcttttccttgcatatcctaaatgtaagccttcctgtgtcccaaattctacggtattagatgagttcaagggctttaaaattctactttccccctcaactgtaacagccagaatactgcttttgacagatttttgagacgaaaatattcacagggctaaaaaatgagatattttcagccagacacagtggctcacacctgtaatcccagcacttgagaggccaaggcggacagatcacctgaggccaggagttcgggaccagcctggcaaacatggtaaaaccccatttctactaaaaatacaaaaattaggccaggcacggtggctcacgcctgtaatcccagcactttgggaggccaaggtgggtggatcacctaaggtcaggagttcaagaccagcctggccaacacggtgaaacccagtctctactaaaaatacaaaaattagccgggcatgatggcaggtgcctaaaatcacagctactcaggaggctgtggcaggagaatcacttcagcgcgggaggcggaggttacagtgagccaagatcgtgccactgtactctagcctgggcgacagagcaagactctgtctcaaaaataaataaataaataaaataaaataaaaattagccaggtgtggtgatgcacatctgtaatcccagctactctgatggctgaggcaggagaatcacttgaacttgggaggcggaggttgcaatgagctaagatcatgccacagcactccagcctgggtgacagagcaaaatactctcttaaaaacaaacaaaaaaaaagaggtattttctttttaaaattaggcatgttatgactgtttaaaaactctaaattatgttatttacattcattcaataacatttattgaatagatattgtgtaaggcatttccaggatataaagaaaatcacgttctaactaaagaaaaataaaccgtaaaaatgcagaaactgcagtataaattaagttttgcaaacaaaataaagatgaataacccttgaacattcctcagcggttatactgtaacacacatacacataaatgcatgccaattccagtggtgataatacagcttccctaattttgggtgctcaagcatagcaatcaattgtgcaataacttttagggtacctgggagacagaggtgggaagactgagtttgtctcccttcctttcaattaaattacatttattaaaagtcttagattttatgtatgggtcaacatcatccaagaatatgaggtaagtaactaaaagtaaacataaatgtaagaatgattagggtgtatttttaaattattgataaactgaaaatttatatatattaaatatatatttatacattatatatttatctgtaatttatagatagtatatatttactatatatagtgcatatatatgcacaattctatagtacttgaaaatgtattaagtacctaatcattgcaagatactattttttaatacttgaatatttgtggcactaaggggtctaagtagcattttaaatacttcttgatggaatacaacatacagtatgcagaatacacatatagacagaaatatataaaaacaattagtaaataggtttaataaacaggtgagcaacacccatacagccaccatccaggtaagtttaaaaaacagaatactgctagcattcctgtagtgccccatgtacctaccccttcctggttataacagcaacccttcctatgctttggagataacttatcctaacattttaagaaataggtcttcaattttctttataggtttactatccatatgcaaattcctaaatattaattttttttaagtgatggaagctaactttattagaaatgaaaggttcactcttgtccttgctccctaattactttaattttactttaagttctgggatacatgtgcaagaacatgcaggtttgttacataggtatataaaattttgtctatctttatggaaatgaaatcatactggacaaaatattttgtcatgcttctttcactcaaccttacattttaagagttatccatgttactgtatgcagccagtttattttcatgactatttcttttataatttatccatcctttttttttttttttttgagactgagcttcactctgtcgcccaggtaggagtgcagtggcatcatgtcagctcactgcaacctccatctcctgggttcaagcaattctcttgcctcagcctcccaagtagctgagattacaggcacccaccattacacttggctaatttttgtatttttagtagagacagggtttcatcatgttggccaggctggtctcgaactcctgacctcaggtgatctgcccacctcggcctcccaaagtgctgggattataggcatgagccactgcgcctggcccattcttatgttaataaatatttgagttatttctactttttctgatatcataagcaatgctgttgtgacttctgatatacattatagctagcctctctgcttatacacccaggaactgctggctcatatggtatatgttctttcacttcagtaaataatgtcaaagtattttcaaaagtggttgtccctcatttacacccctcaccaacagtgtatgagatctgttgttcttatgtaccatggaacttaatttttatcaatctggtgagagtgtaaataacatctaatagtaattttaatttgcactccccaattactaataaagttgaacagctttccacgtttattggctatttcaattagtaaagtgtctctggaagttgtctatttttcttttgtgctggctgttcttttcttattaataggatactagttacactcattatgcatattctggatagtagtattcatttgttatgagttgaaagttaagtatttcttctcactcaggtgggttttcaccctctttattacataaattattattgatttgtttcaaaaactcaaacaatagagactaagggaagtttcagattattttctgttcgtaccataaactacaaataacatcaggtcatagtagggacatattatacttccatcaagtaagtaagtacttaagtacccagtgtgtgacatagccaaagataatcacctgtcctggaagagcttatagtttggttaaggaaagaagctgtatacagatgcaatcataagaacaaggataaaaaatgtttagcaatcaaggggtaacatgagggatgtggattatagtgcaatcattattaacatcttcttgtcaacagtttatacatgcaaaactgcattctgaactgctagctatcttgtcctttccatggcatcctttacccaagaaattcccaaggctcaaccttgtgagttcaaacagttgaattctgtgattctgcttctgtgattctgctcaactgtaactgaccaaaactcagaatccaggcatgcaaaaaagaaatttctgcagcagataatccaagtaaaattaaagtacaattaacctctgcattagagtcaagggcaaatgatctttcacatcattctaggaacctaggttcattctgggatattcctctatctgggcaaagtttcatataaaacatcattgttccggaataacttcaaattcatatctggagcaaccgatgactgtagcctatggaatgactggatacaagttacatctaattcagtccaaaggcactaagacctatcctgaaattggcacactattacctgaatacaaccaaccaaccaatgacagaaatatctagtccttagttcttcagagttatccttaaatcttctcagaaaggtaaaaagccacctaatggaggtatgatacagatataatgccacctcttaatccatagtaaggtcacttctcatcaataaattagttttaaaaatgtgtttattctgtaagttttgaaaataggaaacagccattgggaagtttttctttttgttatttttttagatggagttttgctctgtagcctaggctggagtgcagtggtgccatctcggctcactgcaagctctgcctcctgggttcaagcaattctcctgcctcagcctccggagtagctgagattacaggtacccgccaccacgcccagcaaatttttgtatttttagtagagacagggtttcaccatgttggccaggctggtcttgaactcctaacctcgtgatctgcctgcctcagcctcccaaagggctgagattacaggcgtgagccaccgtgcctggcctggaaagtttttatggagatactagtttaggtcaacatgtttaataactactttgtggttgctctggtaaaccatgaattatatgaaacaagagttaacaacaaaagcaatctaatggagtttaaagaaaaatgtccggtagtcaagtgaagaaagctaacagactaggtatgacccagtgactacacttccatagataaatcttaaagaaacatgtgcaaaagagacatgtgcaaagatactaactttgaaattaatagcaaaaattggaaacataagtatccatcagtaggaaaatatgtcaataaactgttacatgatgaaaaaaaaaaagaaaaactttcaaatgaccatcatgcagaagttgagaaaaaaaaagaaaaaaattacagcaattagaaataaatgttcatctacatatatgaatacagatcaaattcaaaaataagagtaaaaaatgcacacaaatacatctatattatctcatttctttttcttttttaatagagatgaggtctcactatattgcctaggatggtcttgcactcctgggctcaagctatcctcccgccttggcctcccaaagtgctgggattataagcaagagccaccacgcccagctatattttaccatttctaaaaacttttaaaatgccacacaaaacaatatgttctaaaatgcagaaacatctattgttatggccatagttgcctcaaaggtaggaggggactccactctacagtttaactgtagtttaacacaatggttaagagcagagacaagatgctggattggagcttatttccaccacctatttgggtgacactataatctctctgtgccttagtgtgttcttaactgtaaaaaaggaaagatcattacctaatttatgagcttattgtgagaattaaatgagctaatacatcaagtgcttagaaaagtgcttggcataaagttacactatatatgctatctaaaaagagggctgaaggctgggtgtggtagctcatgcctgtaatcccagcactttgggaggccaaggcgagaggatcacttgagcccaggagtttgaagctgcagtgagctatgaatgcatcactgaattccagcctaagcaacagaatgagattttgcctcaaaaaaaaaaaaaaaaaaaaaaaaaggggggctgggcactgtggctcatgcctgtaatcccagcactttgggaggccaaggtgagaggatcacttgagccaggagttcaaggctgcagtgagctgtgatcactctactgtactctggcctgtggaacagtgcgagacgttgtctcaaaaaaaaacaaagccaaaccatttgaaaatatatacattttttaaaagagagagagagaaagaaagagctaaagaacacatgacattccaatgcatttgttcatgttgggtggtggaaatacaggtgtttgttatataaactgtccttttctgctttttttaacggacctttccaatgctttttttaactttttttaactgaatcttcttacagaattcagattcttaatacttaattccctcaaattaatttgtgctcaattgatgttaccttttaaccattatactctcatcacctccctcatgtctttttctatctccccatctaaacagaaaaattgctgtcatctatagttcttatgagtattaagttcctgaaaagtccaggaatgagctaactgcaaaagaatcacaggggaatttgctgactaacaccggtaaaccctcagcccttccactaagattcacaggtctagagagtagcccaaaaatgtgcatttttactatggatccagccagctggttctaaagaaagtgatccaaggatcacatttttgaaaaacagtgctctagcaaagggatcctcaaaaaagggaggagaatatttttttaaacacaaagtcctttttgcaattgatagtccctttagtaacaggatattccccaccaacaatcccatccccatcccaggagtaactcaggcaagacagggtacaaaatgaggctatcaactgctgtttcattaaataaaaagagcatctgtgactactcctgttggtcttaggttacctacttcctctcaaaacttttctcacactcaaaagaggattttcagagatttgaagaacactcaaagtttagagtaccaaacaaagacaaaccaataacaagagattagaaacgtacagcagacatagtgagctatcagggagaaaagatatgttttacttgtacttaggagttttaaagaatctgaaaaactattagtccaggtgttttcaataatactttaatagttctcagtacccaattccaatctctatgaatctgaaataaaaatagcaattgcatctcttttctggtaacaactcatctgatcttggatttctctggtggcagtagtatgactttataaccttcaatcagaaaagccacctcgctttttaaattttttattgtgaaagttgaaagaaaaatgcaaacttactgaatccttcttacgagatcgttccttcttcattttccctcctgctgctctgatgctgactctgttttctcctcccaggtaaccccggcaattggctgatccgcagaaacatttctgggcttcttttctgttcaaagagcataggaaagaagtcagctatgtggaagtaaaccatacaaaactgttggcaatacacacaaaagtcataccagtctaaacaaaatcaaacaaacaaaaaccataacttgaagagattccaacaagtctgctattactaatagaaatgtctgaaaactgctctttaaaaatattcattatttttccaatcatctttctttgggagacaaaactagccaagaaataaacaattcttccattttatgagaatacctagtaatatgaaaataagagatcatatacatgtttggattaagaataaaattgcttaaatagttcagagaactattacttatatgtaaatgtttaattggcacatagaacaaacaaacatgcattagtataagcagacataaaatgattaatacaggatacttaaaaggaaacatttgattattaaaagactggctgggcacagtggctcacgactgtaatgtcagcactttgggaggccaggagtttgagaccagcctggccaacatggtgaaaccccatttctattaaaaatacaaaaattagctgggcatggtggcacacacctgtaatcccagctactcaagaggctgaggcatgagaattgtttgaatccaggaggcagaggttgcagtgagccgagattgcaccaccgcactccagcctgggtgacagagtaagactctgtctcaaaaaaataataataataataattgagtattctaatagtaaactggtggacttaggatatgatagtggcaattagagggataaaaataaattgttcaataagtagagcaggaattcccaaacagcacttgatttccacttttctttccctcagagaggacaatacaagcacagaggcaaaaaaatggagcccgacacagaacctggtctgcattcatgccctgaatatctgacaagagaagcagacagaatcggaaacaaccatctggcatttgtcctagattataatcagatcatcagtttcagagttcactatgtttaagacatgaagcatgtatgaaacaatgtgaaggagtatgtaaaagaccttcattgccagaagtctggtaactgtcaccagactgaacagagtacaggaattaaaacctcatcatatggtagcattaaaagaattaaaatattcaggaaactctgcagctgtgtgcttttctagcataaacaccaaaagctactaattgatataggtataatctgaaaaaaataaaataaaaacttttagggttttgtatcttacttaaattttccaatattttaattgtactggtttcttaataatcagaaagtatcttgcataggtcactggtcctaaagacccaaagaagatagactgtttcacgggtaatgttgtgttctttcattatgaggcacacattagttgtctttttctgatattagcggccactaatgaccactgtttaggacccataccttactaagtgttgcaaaatggtgatatttttactacttaatttagttttatctttttgttttctgagacagggtcttgtgctatggcccaggctggactgtagtagcaaggtcatgcctccctgcagcctcaatgtcctaggctcaagtgatcctcccacctcaccctcctgagtagctgggactataagcatgcaccactcacctactactacatttattaactggaagacttgtacaaagaaaaacttcttctcatcaactatttggtttaacctaaagcagaagtcacttgagaaaggcagaataaatgtttaaatgcttaatttttttccttttttatttttaaactagtcttcaaagtcatgaattggttgactaatatacctttttttttttttgcttttttgtttttgttttgtttttttcgagacagagtctttctctgtgcccaggctggagtgcagtagcacgatctcaagtgattctcctgcctcagcctccggagtagctaggattacaggcatgtgccaccccacctggctattttttgtattcttagtagagacggggtttcaccatgtgaccaggctgatctcgaactcttgacctcgtgatctgcccaccttggcctctcaaagtgctgagattacaggcatgagccaccgcacccagcctcccaggcgtagttttttgttcgtttgctttttattttttttagatggagtccctctgtcacccaggctggagtgcaacagcacgatttcagctcactgcaacctccgcctcccaggttcaagctattctcctgcctcagcctccagagtagctgggattacaggcgtgcgccaccacgcccagctaatttttatatttttagtatggacggggtttcaccatgttggccaggctcaaactcctgacctcatgatctgcccgcctcagcctcccaaaatgctgagattacaggcgtgacccactgcaaccagcctgtagttttatttttaagtagtcattagaacacagggattttacataatgtgcttcaaacctcctcagtatctttattaatgcttcagtgttaataagaactctcacactttttgcttaggcagtctttgctattgcatcggttactgtttttaggaaacagaactaggtaaccaggccgggcgcagtggctcaagcctgtaatcccagcactttgggaggcagaggcgggcggatcacaaggtcaggagatcaagaccatcctggctaacacggtgaaaccctgtctctactaaaaatacaaaaaattagctgggcgtggtggcgggcgcctgtagtaccagctgctcaggaggctgaggcaggagaacggcatgaacctgggaggcggagcttgcagtgagccaagatcacgccactgcactctagcctgggcgacagagcaagagtccatctcaaaaaaaaaaaaaaaaaaaaaaaaaagaactaggtaaccaattatatttaagagtacaaaatggtacagatgaaatagactggttatgagttatgctaactgttaatgctgaataacggatacagaggaatttataatactgtactattctcttcagacacaaaaagagttggcatgtctaaagtttttcagaattacataagaaatataattatacaagtagaccatatgaagttgaggagaaaattatacagttcctgtacaacatcccttaagggtcagaagtgtcatacagtagaaaaacacacaaaaccaaaacaatatcttatagataagagttaagagtaaatataacttttaagtaatttatattaaagttttatatccttatatctgaacagcctatttccccatcagaagcagcaaaattagtagaaacaatacttacccatatctctggaactgatagtcaaacgttaactctgagcctgaaggaaccagtttggtggtaaaaaacccaaccctcagttgtccgttcacagtccactgagatgatgtttgaaaacaaaagaaattagtaacttattagtgtgtgtgtgtgtgtgtgtgtgtgtgtgtgtgtgtgcgcatatataaagatcatcatcatctgccttaattatgcaagtgggtctttaggcaatgaaggttttcccaaatagcacatggagacttttttctttaaaagaactaaaatatttaagtgtaactctcatttaatggactaccagattgcatatatctctaattcgtctctaataaaagtaactgctaaaaaaaagaaaaaaaagtaactgctattttaatttatcttaacatttccatacagtaaagattcacttgtactaaaaattggcaaacagaggatgcttgtgtcactgagtatcaaaggcaagtctatattaacatatgttaaaagtaaccatgttgtaagataagatgagatatagaaactaggaaacactgatcccaaaagtttaattccatgaagtggtggtcatctggctgagtatagtgaaagggacatcagaacagatgcataagactcaagaattaaaatgggggcagatacatgttaggcagatcttttagttccaaaacatgtaagcaagtcaaggactgaggagctctgatccagacaatttgcacatgttactaatgaaaactctggacttgcagagattaagggacactgtacagtgagagtctcacagctagacatgtggccaccagctctggcagaactataaccaaaacctaggttgaatgattccacagtaggttctcctttttgttatacaacttggctcttggaagagccatgcataaaatctattagtgtatagttcaaagggcaaaaaatatccagactcaaaagtgctatttcaacatgagaggaaatcaatgatatacatttgcagagcgggttcatagctttaaccttaaaaagttacaatcccagctgggtgcggaggctcacgcctataatcttagcactttgggaggctgacgggggtggatcgcttgaggccaggagttcgagaccagcctggccaacatggcaaaaccccgtctctactaaaaatactaaaaaaattagctggacgtgatggcacgcacgtgtaatcccagctacttgggaggctgaggcaggagaatcgcatgaatccaggaggcggaggttgcagtgagccgagatcatgtcactgcgctccagcctgggcaaaaaaaaaaaaaaaaaaaagatacaatccctctcaatgttagtccttcagtccctcatcagtgttattaaaagtcaaatgttgcacctagataagacctaataaagaatccaaatacacactgaactttcaaaattaaaatttagttttgtattttggcaccattaaaataatatacaaaataattatgggcaaggaaggagaggtgacaactaaatgcaatgtgagttcctggattggatcttggaccagaaaaacaacagctgtcaaaattggaatacggtcttcatattacttaatagcattctctggatctgatccttttattatggttatatatgatgttaacatggggaaagctaggtgaagactgatatatgggtgtagtcaatactatttttctaacattcctataaatctaaacctatttccaaataaaatcttaaataataaagtagaataggaaaaagggactaaaaaattcatgagtaccttagatatgggatctaaaattaatggtcagaacagcaatcgtgaacaaatacctcaaactctaaatccacctcaacttactttttgggtttcacaatttggttcacagctgtgattcatgaaacgagagcaatttcctttttgagtggcatctattatctgggagaagaggatcatttaagaattaaaaaataataccttaaatattcatgcaattacctgcaaaactacatacatctcttatgcatcaattaaaaaaaagattgtgctgcgaaacctaaccagttaaggtagggcagtgaggcctcctgactaccagcttcaaagtttttccactgtaaacaatggctcagtttccattatttctaactgaagacagatgacactgtgaattaaattaacccaatcaaaaaaaatttacacattttacaaaggaaaagcattaagacaaatgtaagatacatgcaatgcacacgcacgcacacacacacacactcccttatccccactttgcccttgcttcagagaactgtcacactgcttcccacttcaaagcaacaaatacctaactgatgcttttggaagatctgctaattattaacttttgcccataggcaaaattatctttatcagtgtctctcccatttatccttagccatttcttatattctattacatcctaatctcactgcatggtataatacttcactttaaagtgtgggctatgtcacaatgccataggtctcaaccttgagtgtgtatccaaatcccatggagagtttgttaaaacttgctgaacccatccctagggttaaactaaacagctctggggttaggtccctagaatttacatttccacactgaatacagaggcagatatatgagaattgaactgaattttattaagccagacattaaagagatttataaaaatgtaaagcgatgcaactcttttcactaaaaaaaaaaaaaaaatttaaataatcattttccaaggccaggcacagtggtttatgtctgtaatcccagtgctttgggaagttgaggcaggaggattgcttcaggtcagaagtgagaccagcctgggcaacacagcaagaccctgtctctacaaaaaatttaaaaataagccaggcatggtggcatgtgcctgtagttccagcacctcaggagactgaggtgggaggactgcttgagcccagcagttcaaggctgctgtaagctatcatcatgccactgcaccccaggctgggcaacagagcaagaccctgactcaaaaaaaaaaaagttatttttcataataccatgttatttttatcaataagtaatgggcttactattgttacagttaagtcctcacttaaagtcatcaacaggttctttgaaactgcaacttacaaaagcaaaacaacatacaaggaaaccaattttaccataggctaactgatactaaacaatagttaagttcctatggcagatttctggccacaaaacatcaacaaacttctaaataaagaccaagatgggctgggtgtagtggttcatgcctgtaatcccaacgctctgggaggccaatctgggccaacactcaagtgattctctgttttagccttcggtctgagcccttggagcagctgtaactagatgcatgcaaaaccatgcccggttaatttttttttgtttttgtagagatgaggtctcactatgttgcccaggctggcctcctttggcttcaaatgattctcccacttggccctaatgtggttttaaacagacattctaaatttctcagttgtgatttttaatatgattaagtataagtaattataacccacataacctatataagcaaaagcactttggggccaggcacggtggctcacacctataataccagtactttgggaggctgaggcacatggattgcttgaggccaggagttcaagaccagcctggccaacatggcaaaaccccgtctctactaaaaatacaaaaattagctgggcatgatggtgtgtgcctgtagtcccagctactcagaagactgaggcacaagaatcgcttgaacccgggaggcagaggttgcaatgagccaagatggcaccactgcactccagcccaggtaatatagcaagacactatctctaaaaaaaaaaaaaaaaaggcactctgggggtcatcaataatttctaagagttgtaatctaaaacacactacgtttatctttacatatatatatgtaaattcctctctcttccatgtttttattttctaccttgtcatgcaacagtaacttccacgctttttgaaaacaaatagacgctatttatactgctctgcccctcatttttgtcgcttaatatattttagaaatcagtcggcaggacacggtggctcatgcctgtaatctcaatgctttggtgaggtcaggagatcgagaccagcctggccaacgtggtgaaaccccgtctctactaaaaatacaaaaattagcaaggcgtggtggcgggcgcctgtaatcccagctactcaggaagctgaggcaggagaatctcttgaacccaggaggcaggggttgcagtgagccgagatcttgccactgcactccagcctgggcgatagagcgagactccgtctccaaaaaaaaaaaaaaaaaaaaaatcaaatcagtatcaatggctccttcaaacctaacagatctgtttcaaggcaaacatatccaagctgcttacctcatcattcttcagggccatgaaatagtaatggatgtttttgtttcgtgcatactccttcactcgagctttaaactctttatgatcgagtacctctccacaatattctaggacaaaggtgttcctgcaaaccaaaaggaaaaaaatagcacttcctacctaggagcagtagggaaaacatatatgctcaggcaaaaataaggaatttaaataaatactgcaatgtggataaattcagttattacacaaaataaatttcaaacacatgtcaagtatctagcttctaaccaaggttacttttctccttcacagtacttttcaaagaatgttgattctaagatgcttttataatttatacctactaccaaaatatatatcctttaactagatactaaatcattcaagtctggcttacaatatcaaaaaaagttattaacagctggaaaacagctctgaagaaatcaagagacactgaaaagttagaggatttttgctctaaaaaaaaaaaaaaaaaaaaaaaaaaaaaaaaaggcagccgggcgcagaggctcatgcctataatcccagcactttgggaggtagaggcgggtggatcacctgaggtcacaagttcgagaccagcctgaccaatatggtgaaaccccatctctactaaaaatacaaaaattagccaggtgtggtggcatgcacctgtagtcccagctacttgggaggctgagacaggagaattgcttgaacctgggaggcagaagttgcagtgagccgagatcgcgccactgcactccagcctgggcaagagagtgagactccgtctcaaaaaaaaaaaaaaaggaaaaagaaaaagaagaaggcaacttaaatatagcagcccttctgctgtctttactctcaaaggtctctaaaaatgttaaagatcaaatctaattccctttatgtaatgacattctctttgacgtctctttagaatgttatcagtaattgttatttatcttcttctttggcatctttcagttaccctttatctttgaatgttcttttcttgattatttacctatttattctgaactgaagatattaaattatcagtcttttccccttctcttaattctctaaaagctcattctaaccaatgacttcaactattagttctatgtagacaaatgttatactatgttttactctgaagttctgacataaaatggcctgcctgaaagtcttttcttatcccctcaaaataaacataccctaattctaatgaaagaaatttttttaatgtaaatcttttgtatttgtttacaacatactggcataatcaatgtacttattaaaggagttaacttcgccaactgaaaaaaattaaatccttttactttaaaaaataaagcaattaaaaacaaatgagaaaagaacacatatattaaaaagcagagctcaaaaacaggattggagaagtttatagtggatgtatatatatatttatatagtagtccatcacaaacacatttaggtctcaataataaaaatctgattattcatgggtaaacctagaaagtcaaattattacctctataaccaatatttgaaatgtcctttctaaccccagaagcttatcatcttgcaaataatttaaaatgatgacaaaatttgaggtcctacaatgttggactctccacttccaggattagtgccctccctcaagaaaaagaaaagtcactttgggtggcgggggggggtggggggggggtggcaggattgctttggcccaggagttcaagaccagcctgaaaaacacaggaagacctcatcttgacaaacaataaaaaattaaaaaattagccggccatggtattatgtgcctatagtccactacaccagttgaaagcctggggcaggagaattgcttgagccctgagtttgaatctacaatgagctacaatcacattactgcactccaggctaggtgacagagcaagaccccattgcattaaaaaagaaaaaaaagctgggcacagtggctcaagtctgtaattccagcactttgggaggccgaggtgggtagatcacttaagcctgggagtttccgaccagctgggcaacatggtgaaatcccgtctctaccaaaataaataaattttaaaaaatgttttaaaacattttttaaaaacttaaaaaagagagaaaaagaaaaatgacatcatggactgccttgtgaattaaatgtggtgactacaaaacatatattatccaggatctggaactgcacacataaaaaatatttccaatccctcttctgccaaaaatctatcttccctaaacttactcatttaaggcttgattacctgcttttgaaaggtagtatgaaaaataaaaataaagcatattgatgtcatctggcatcgatattatgcccatttgacaaataagacagagtttggataatgtaggtgatctatccaacttcataaagctcaattacagcctgggattcaaactccacctaaataactatttacctcattatattataaagatgctttcttgaattttactaaaatattcaattctaatgatattactctcaaatcaccttatttagaaaaagttcttaaatatcagagcctgaccagccagtaaatcactcagagtagagaccccacatcaggaagttggaaggatataccaacacacatggatctaacagtttgagcttgaggaagcagctgagagaagcatctcaaagtcctcaggaatttggggaatgtaggaagagtggctagaccctccagctgcctgacctccaaaaaactaaatgaggccagtgtaaaagtctatcatgcagtccttaaaactctaagatttaggtttcttagagaagctacgtgtctcaattaaaaaccaaaataaaaacaaaaacaaagcagaaaacatcatattgcctggcatgcagtgactaaatcccatgaaggcaaaggcaatgagaagtgtgattcttatgattcttattaatctttttctaagcctgaaatttgctcctggctgaatagggtcacttcattgaactccttctccttaaagcctgttcagggcaacagggctctactatggcaggtgggtggggacagaaattgtcactgtcactgcaaagctatggaaggtttaggggttaagggtaacgtctgcaactccctttaagcttcatcaaaaaaagactgatagataaaaaagagacgggcagacagagaatgtaaaataaagcaaacagaacaaaatgttaataactataaaacctaagtggtgcttacatggacactaactgttcaactctttcaacttttctgtaagtttgaaactttttattaataaaacgggccaggggtggtggctcacgcctgtaataccagaactttggaaagccaaggtgagaggatcactggagcttaggagttcgagaccaacctgggcaacacggcaaaaccctgtctctactaaaaatacaaaaaaattagcagagtatggtagtgtacacctgtagtcccagctactgaggaggctaaggttgggggatcacctgagcccaggaggttgaggcagcagtaagctgtgatcgcgccactgcattcaagcctgggcaacacagtgagaccctgtgtcggaaaacaacaaaaaaatgtggaggggaaagatggcttctaaaaaagcctcatttcggccagccacggtggcttacccctgtaattacagcactttgggaagccaagccaggcggatcacctgtagtcaggagttcgagaccagctgggccaacatggtgaaaccccctctctactaaaaatagaaaaattagctgggcatggtggcgcacacctgtaatcccagctactcaggaggctgaggcaggagaatcacttgaacccgggaagcagaggttgcagtgagccgtgatcgtgccactgtgctccagcctgagtgacagagcaagactccatctcaaaaaaaaaaaaaaaagcctcatttgcccaaatgtccatcaactaacaaaaggatatacaaaatatcgtatacccatacaagagagtattattcagccataaataggaattaagtgctgacacatgctgcaatacagatgaaacctcaaaaacataatgctaagtgaaagaagccagacacaaaaggccacatattgtataatttcatttatacgaaataccgagaatagatcaacccacagaaacagacagcaaattagtggctgccaggcctgggaggaggcaggtatgagaagattctgcttaacaggcagagttagttcccttttcagatgatgaaaatgttttggacacagacaaaagtggcagttgcacaagattatgaatgcactaaatggtactgaattgtaaactttaaaatggtcaatattatattatgtgaattttacctcaattaaaaccctatctggtatccaattacattaagtcaacctggactgccttctcttcctacaactgggagatttcctaaaactacaggggttttggtaataacctgcttttttggtggggtctgccatggcactttaacactaactagtaacttagctccaaataatttctcatcctgtgtagctctgacaatctgtccttattaaatggtaatactctaccagtaaacaacgcaagagttttgactagtttatgaaattcataaactattggtattacacatcatcatgtggcagttataggagtaggaaggtatgggaaacatggaaacattaagtcctagtatattttaccaaagcagggttctctgtgaatagctgaagaaaacggaagagctttaggaaattttaacctggcttataaactggagccatatatcctttcctcccttccccagtctcctttccccttaatatgagaagagcactgagctatcaaagagtgtctgttgcaagtaacagaatttagatcaggtttgaagctatgtgttttactgcagataccacaaaagaccagcatccagacagctcatccactattgtccctgtaagagaggcttgtgtccaaactgtggttcctttaaaaaaaaaaaaaaaaaaaaaaaaaaaaaaaatctcaagaaggcctggctggctagggcagaatgaaagaaggcatctttgaaaatgtgcgtctggactagaactagtgattttggaaattcaatgggctgctttgagaggtattgagttctgtatcaacagtgttcaaaggaagtgtaaccaattatttgtttaaaatattataaagaatccaatgaatggatatggggcatatgacaattctgtgggatatttgcttcaaataaacaattaaaaaccagttatgagaagcctaggcaacatagtgaggaccccatctctacaaaaaatagaaaaataaagtagctgggcatactggctcacacttatagtctcagctactcagaaggctgaggcaggaggataaattgagcctgggaggtcgacactgcagtgagctatgattgcgccaggatactccagcgagggtgacagggcaagaccctgtctcaaaaaaataaaaaacaataaaaaccagttatgagccagggtgtgtttttacaaaacttagaggagaagagaaatctatgaggttcctactagccccctttttgtgtaacaaaacatgttgctttctgattggttcccaaaaggatagattaatatcaacatcatttcttatcttcaaaggaaaaaaaaaaaaagaacaatttgcttatcaaaagatatatgaggattcctgtcataaaactaaattattgccaaggggaaaacagtgagaaaaaaaaattattgtctttattacctgtgttttgaattcccacaataaacagattaaaccccaccaagtcctgccccaactccaactcccatccaactgtggccatatgctcagagggttctgaaagaatagttatgtctaagttactagaatccagcaaatgttttatttccttccattttttcttttatatattttttaaatgtttcaaccataaacacatgtaatctgtttatatttaacttcaaagaggcacttgaccttcattaagaatactttttttttttttttttggagacagtctcgctctgtcccccaggctggaatgcagtgccatgatctcggctcactgcaacctcctcctcgtgggttcaagcaaattcttctgcctcagcctcccgagtagctgggattacagctgtgcgccatcatgcctggctaatttttgttttgttttttgagacagagtttcactcttgtcacccaggatggagtacaatggcgcaatctcggctcactgcaaccttcgcttccccggttcaagagattctcctgcctcagcccctcaagtaactgggattattggtgcctgccaccacatccagctaatttttgtatttttagtagtgacagggtttcaccacattggccaggctggtcttgaactcctgacctcaggtgatctgcccacctcggcctcccaaagtgctgggattacaggcgtgaaccaccacgtccagcgtaattttgggttttttgtttgttttcgagatggagtcttgctctgtctcccaggctagagggcagtggcatgatctcggctcactgcaacctccacctcccaagttcaagcgattctcctacctcagcctcccaggtagctgggattataggcgtgcgccaccacacccatctaatttttgtatttttagtagagacggggtttcgccatgttggccaggctggtctcgaactcccgacttcaggtgatccactcaccttggcttcccaaagtgctgggattacaagcatgagtcaccatgcccggccaagaatactttaaatatgctatatataagaaaattaaacatttccaggaaatactgaatatggtagaaaataaagtgaaccttttgctgtattacattaaaaacttacatcagttacatggaaagcaacatttattcattcaagaaatgtttaatgattatctatcaagtatgttttaattcttaaccttgatatgctcaggtattctcttctactctttttttttttctttaagagacaagagatcactgccatccaggctagaatgcagtggcgtgatcacagctcactgtaaccttgaactcccaggctcaagcagtcctcccacttagcttcccatagcgctgagattacaagcatgagccactgcacctggccttctcttctactcttatcccaactcaattttatgtatactaatggattctgtcccaacttctttttatatagcttcatagagattctgggggtccacagtaaacacttggtagttgcttggaattaaagaaaacataattaccaaaaaagaaaaaaagattttttaacaacaaactagctaccaagtggtcattctacataataatcatcattaaacctcagtgtaataaagaaattgtttccctacaaaaacatctaagttcaacaacacaaaaatgaagtgaagcccaggcgcgacggctcacacctgtaatcccagcactttgggatgccaaggtgggcggaaaacttgcggtcagagttcgaaaccagcctggccaacatggtgaaacaacgtctctaccaaaaaaatacaaaaaaaattagctgggcatggtggcatgagcctgtagttccagctacttgagaggctaaggcaggagaattgcttgaatccgggaggtagaggttccagtgagccaagatcgtgccactgcactccagtctgggtgaaagagtgagaccttgtctcaaaaaaggaagtgaaaggtaattaaaaaagaacttacgaaggaaggtctttggcagctctcaagccccagcctttcttttctgtgagtatgacttccacatctgcatgctgttttctctgaaaccgtctattggaacaataatccccatttggacaccgagaagaactgaaatgagaaaaggaggaaatttaattctttaaagcagcaaaagaaccaaagtaactttgaaaaaatgtgttagtataactacatatatacatacttttatggtataattagcatatgtatgactaacccccaactaagtcttcctttccttccatcacaaagggattccttagaactgagtatctacattgttacttaaacagatcatacccacaatacagccttgatatctggtcatcacagaaatatctaccactccctaggtgtctagaatacattttcaggctgcatgtaagctttcagtacattgacaactctgcagaacttatattctgtaagtgcaccttcccttccttctactctaatcacttttaatttcattttttgaatgcagctaactacttgatctacaattgagaaaatctaaagtcattattaaatatatccttgttcagagtaaacagaataacatggcatggctcttctcccatggatcctagagtaaaaatgataaaatcgaacactgattgacttcttaatatgtgatagatataaaggttttaacgatgattaaaactacaccagagggggctgagtacggtgattcatgcctgtaatcccagcactttgggaggccaaggcaggtggatcacttgaggtcaggaattcaagaccaccctcgccaacatagtgaaatcctgtctctctgaaaaatacaaaaattagccgggcatgatggtgcacgcctgtaatcccagctacttgggaggctgaggcaggagaattgtttgaacccaggaggcagaggttgtagtgagtcaagattgtgccactgcactctagcctgggcgacagagggagactgtctcaaaaaaaaaaaaaaaaaaaaaagaccactggaaattaccaatcattttgaatatattattatttattgcccacccagcagcaaataacatttttagcaatggtcaaaggatgaaggatttgctctagagtgaggcagtataaaggaaagctttcaggagggaagagaatttaaggcagaatctctaatgatacataggatatgcataaagaaagctggagatacaactgtccctgtctgtgtgcagaaataggaaaacaatccctgtttggacaaagagaaatgaaacaactaaagataactgataagaaaggtgagttgctggaggatgaaaagacaggctgatgatatgctaccaagggctctgaatacaaggctaagtttgaacctaatcatgagaacaaccgagaactaccaaaagcttaagtgtgtgaataatatgaagaaatatttttcttcatgtatgcttcacaaggttggcaggaaaacccagaagaatgactagggcaacaatatgaagttagaataatgctaactctatgtcttctcttcttacatctgtactgtcatctctctctctagtttggataaaagaataccaaaaatcctttctctttattttttcaaggtatatatattttatttttgcaacactataacatgagcaaaaccaaaaactgagctttggggaaaaaaaaccttcactaacatcaaaaataaggtatactctttccatgtaaaagacaagaatatatttttcatcaatcagattggttaaaaaaatttttttgagacaacatctcgctctgtcacccaggctggagtatagtggaatgacagctcactgcaagctccacctcctgggttcaagtgcttctcctgcctcagcctccagagtagctgggattacaggtgtgtgtcatcatgcctggctaatttttgtattttttagtagagatggggtttcaccatgttggccaggctgatcctaaactcctggcctcaagtgatctgcccgcctcagcctcccaaatagctgggattacaggcatgagccactacgcctggccaaaattaaattttttaatgtaaagatatttactatttataagaacaatacagaagcaaatgtctgtcaacagactaattaccggctaactatgaatagaatacataatgcagtcaagagaaagatttaggcaggtctgtacacagagctctgattaggtctgattagcaaatccaagcaagtatatagaataagattttatctgtatacataaaaagaggaaaacatctacctatgctagcataggcattaaaagttttctggaaaaatgacaaaacaatgggactgatgtttgggagaagacattcactttatgcatttctgaaatgttagggttttatttcactttatagtgaaagctaaaaaataccaacatttacctctaggacataaatattataaaagataaaaaagtactgaatagaaattaatattataggactactttaccaagcacttaaaacatggtgggtactgtaatctaatgcacaatgcaagggatatttgtttccctattaatatgttttctactatacatcaaagtgtctactatacttttttgcttgtagtcatccataggtaggagaaaggttaaattttattcttcattgataattcaatatttagagacatttaatagaagtgttgagcaaaagccgagtattctaatttacttaccattcaatcatgagaagacgattaagacaatcttccccacatgctatttcaccttgagctctttcatctttagaaagaggtgtacactcacactgcattcgcttaatatctcgatgagatttattcttctttctattgggtaaaatttcataaaaactgattaaataaatttcctggtaaagatataacatatataatcaaatatgtgccaaatctcattagattcttttgggtttttttaaacagggtcttgttctgtcacccaggccagggtgcagtgatgcgatcatggctcactgcagcctcaacctcctggattcaaatgaccctcccacttccacctcctgaatagctgggaccacagctcatgccaccacgcttggtttttgttattgttgttgtttgtttgttctttaatattctgtagagacagggtctctctatgttactcaagctggtcttgaactcctgggctcaagaaattcccctgcctccacttcccaaagtgctgcaatcgcaggcatgatccactacgcctggctagattcacatttaatgattcctgtaagtcaaccattcaaaataaaacatctaattattagtacttgtgagactgaaaatcctaagacctgcattaccaaaaaaaaaaaaaaaaaaacaaacaaaaaaaaaaacatgagaagggcaaccttaaccttggcaaatggggaagatgagatgagttcaagactactcattctggaactcagcccttatttcctactccaggtcagctaagccttggattcagaacagtttcaagtgttaaagtcatactaggttctaggaaaaataggaaaactcatgcatttcaaatagtgacatagctggttaaagttaagtttaagaatcagacctcatggatgagcaaataatagttgagatataagattgagggagaaaaggggtttctaaaaaaataagagtgagttctaactcaatccaatattttagagaatctttcagtaacatcacatctgcataaattttgtttaaaagcagactgaattttttaaatgaagtgtaattacagaataatcaggtaaatgtttaagagggctcaactttctccatgcagacagatttattttggagaagaacataaactgctaaaatttgattgcgttcataataagccatgccagagtgtgcaaagcaaaagtgaaaatgtgattatttattggcctttttgctgatgaactagtcttttaccctggtctaaaaacaaaacaaaacaaccaaagatggtcaaaaaagatctgttatgtttaagattagggaactataagaactataactcactctttgactatcaaacaggaaacagcatagctgctctaaatggttatctaatctcctacctctaatctgctttgatcttcaacatatgttctattctagtgccaattttatgaagtgcctcaagagtgttatgatagttttaactaagtttaggtgaaaagaatgattcctcttgattaaagacacaattcgttaatgagtatatgaatatgcttagcctgaagatgactaaacgaaattatctatttagaagtacttagctacaattttgaagaatcagcagcagctttattttgtattgctctagaaggctggaataggacgaatgggcatagattttggcaggtaagcccttttccattaaacataagaaaaatgttttcattatattcatattattttttataagagtttgtcttcttagtggctcctaaatgcctagcatataacaggcacttcaaaattttgaatatataggccaggcgtggtagctcacgcctgtaatcccagtactttgggaggctgagacgggcggatcacctgaggtcaggagttcgagaccagcctggccaacatggtgaaacccatctctactaaaaatacaaaaattagctgggcgtggtggcacccggcagaggttgcagtgagctgagatcacgccactgcactccaccctgggagacaaagtgagactctgtctcaaaaaaaaaaaaaaaaagttaaatatatataaatccttcccactgcaaagtggtggaagccctcttatgcctccactaaccaaatctatgtgcacagttttatatatatatatctgattctcaatgctaaagaaaagtcagagaattggactgattagttttatttatattcttttacaaagatcttgtaagttccattagtctactcacacaattcctaaagggtactacttaaaatattgaatattttaaatgtaaacttaatttataactagatataaatgaaaatagctgtaaaaggctctctgttaaaaggttattttgtaatagaaaaaaatttctggtaggacctacctttaaaattaagtcttttaccttatacacagaggaaaatttgatttaataacattttgatccttaaagatacaatggctaggttgattctcaactagcaggaaaacttccaaaaaaggagagtaagggggcaggatactttttgttttggttttttaagcacaatcaatataaatttacatcaggaaaatgagaaaattatcaaggaggggttaaagttaaaacagactgagaagccctgctctagaggactatgttttcattactcttattctcattataatttgtttcatgttagggattttttgataaaccactttatcatttctaaaatatttattacactattgccagatttaatctattaacaatagtctaaaaaaaaatgagagaagaaaattatgttctagtctagttctaactttataagtacctgatatggtttggctgtttccccacccaaactcaacttgaggaggtaactgaatcatgggggccggcctttctcgtgttattcttgtgatggtgattaagtcacacaagatctgatgggtttatcaagggttttcacttttgcttcttcctctttttctcttgccaccaccatgtaagaagtgccttttgcctcctgccgcaattctgaggcctccccagccatgtggaactgcaagtccaattaaacctctttttcttcccagtctcgggtatgtctttatcagcagcatgaaaacggactaatacagtacccaaagatacttcattctgcacatttttgaaaataaaatccaaagtaaccacttttttcttctctaagtacagattattttgctggggttttattctgtttttttggtcagactttcacatgtaaaaggaattacagaaatactgggctagcctaaattgtaccttgaaaaccaaacaagtaatgaaagaaaaaaatagacatctcctttcctggggatggggcggcggggggaatggggaaaggaatctatactatcaaatctaaataggtaaaaacacttttttagacttttaaatttactttatcccacaactctttcatgtgtttaatctcatacagtctgaattgtttaaaggctttttctaacaacaaaaaaagagttaaaatttgtcaaacaagtattaattagacttacctttctgttaaataaacattttcttcaataagatcaaagtaacatggcattttcccttgcttggcacattccttccatcgctgtgggtccctgaagtcatccatgacacaggagggcccaaccagtgctgaacctgggggcactgatgtctctccctgctctacctccactctaactttctttctgtcctgaagctcaccatcactttcagaatcactctctatttcctgcctcctttttttaagaggccctctatctttgatatcatttttttctaagttttttgaaaaatctttcttttcattcacagctaaagtgtccttaatggaattgctgcttatttcaggtgcttgcactgaccccttgtctttctgaagggatagaagaaatttatcggactggtctgaaaaatgggatccatcctgttgatcccaattctcctcttcttcacgatcatctgttagggaatctggtacttgtccttgagttcgatcatacacaaccccagttccaggaggtctacctgatcttggatcccagtaaccattgccttgccagtaatcacgtgtcccaccatactgttctgcattttgctgatacttgtgtccaccacaagctccatagctactgtcaggttgctgatacgtggtagaaggcttttcttgagagaagtcccaacctaagtttctgagctcttctgatgagtgcaagccatccacatgtggtatctcacaagaggaagaaaaactcaattctgtttttcccagtctactatctggcctgttttggaaagtggtctgttgccaagacttatttgggacatcttcaaaatcagaagaataaattggcagctcttcttgctgcctagaaggtattttggctttcacggtttcctctgaatttgggtgacccagagggtcagatttcacatctgtatgacttgtactatcaaccccatcactctgaggatgagaaagttcaggcaggcgattatctatttgttttctactggactgtgtaaaagaaatttccggattcttctctgttcctttatgaaggaaaaacttatcagtttgaggacaggctttacttgctatactttcaaatttttcctcatacaaatgtctccttgactccaatctctcatcttcccaatggtcagaatagtgtctataactttgactgctccgagaagaacaaggacttgtttcttccatgggcaaagtagaattctttggcacaaccacaacagactggagacggtttcttggaatactgctatcatccgaatctgtatcttctgaatcactttcatcatttgaactttcagaagagccagaataatcttcatgaactgtagacacaatttctggggcatgaccactactgtcacactttaatgcataagttacaccatcactgtcttccatggttaaattcaaatcacaagaagaaaatacaacttctgagtcatcagaagtatgcacatgtcctccttctcctctttcatctaaagagatttctggtcttcctcttctttcaggcaatatggaattcccttcttcttgagcctcttgcaaacatttcccagataacccattattacgcctgttctccctggaagcaaatccctttcctgaatcaggaaggtcactacctacttctactattgtttctttccctgcatgctttaaaaactctgaactttttttactctttagcactgcatccagaactggagatgtgttctctccgcatttcaagagagttagactgtccacctttattcctggtggaagactctgaagagatgaagcaatacctgaactcccaataggttgatataaatcatcaaaatgattaacagaagctgaactagtgctaccgatgctctgcttatattcttcacatgcaaattttgagtgatctgtcaaatttctactatcacatataactggttttgattccaaatgcacattcataaagctatttgaagaaatcttcataactgaaggctcaatattttcagcttcagagttacacaaagaagggttgctatcgttcaaagtacagtatatgtctgaatctttggttttgcagcaagaaaccctcgtatcaactggttctttaactactgttttggaataatccacagtcataactggcatagacatgagtttatcttggtgtggtgacaccagaggttctgtttctctaaatgggctttctgacttcttatgcagcatgcaggtatcatccaagtctttttctttgcacctactaatattctgaaatccatttgatgaaagcatgcatgctttgaccaaaggggataattccgatccagtcacactatcatcagaagtcattaaaacagcatcagttttagaagtgcaaaatgttgccaaatcagattctgccccaggagatccatttatatttaattctatgggacaaaaacttcttaattgatcattcttcactttagataaagagtctaattccttaatactatcatggctatcatgtgttataaattcggacttaaaaataggcaattcatctagcttttttaaagtaggtgaatcatttaatcgatttgatggagctggagacccagccttttctctttcaggatttttattaatcattcttaattcactaccttttgaacaaggtgtctgtaaactaaaagaatgagactgtttgatttcttcatttaattctgtacaacagaaagaatttttaaatttatcagacttgggtataggttttgaaagggtagatttataacgggaagcactactgtcatgcttagaatatgatgaccctcgtcggaatcccagttcattagggggagaacaacatcttttaattgcttcattttctgaagtccttttagattctctttctagttttgaagaatacttgcctcttctttccatctctaagtaagaggtctcagttttacagtcccgatcagatttagaataggatgatgtccttaggtctctgtaagaagaggaatgagatgaggtacgccttgagtatgtcttcttatactcttcttctgagtcagaactctctcgtgctctgttatctgtgtatggccgagaatagcgcgtcctctctcgataaggggagctcctatggtagcgacgatcagagtcataataatgagatcgttctgacctggaataggataaattagttctagagcctctctcagacctagagtgagatctgctccgccgtcgctctctttctgatctacatcgggaagatacataccgagtatctctttcaagttttgaatagctaaaatatttatcatctctgtctgttttagatcgtgaaggtttccctagatcctcactttttaaaggtgctgagctctttttaaaatctctttccttttcaatgcttgctgaaaattttaaatcatgtgatctttgacttgaagaagtccgtacagaatcttcatcagattctgaaccaagaaagatgccttcagattgtgaggatttcttcttagaacctgtttttttacagctcagactaatcttagaactatctggaatttcttcatccttcccaatatgggaatcttctttttttgaggaaatatctgcttgctcattcaatatttgagttacgtgttcttctaaactattagatatagtgtcctgcttagtatctgcttctaaagattctggtacaattataattggtggttctttcagagatctaactgctacatctactggtaagggtactggtgctgccattagaactgttattggtgtatgtggcaaggccactggctctgttactggtgctggtgatgagagtgttgtggcttgggcaggtggaggcggtggaggcggagatgagggcggtgagtctacagttgttgattctgctatcactgctggtaatggtgctgcatgagtaggtggagatgctactgctgtggtagtagccagcagtggcctggatgttacatgaagcagatgtttcttaaaatgaattttgcccaattccacccttgactttggtggggaagattcttctgcagtagataaggtatcaccaatttccattttcattttaggagtcgagtctacctgaagaggtacagctggagggtttggagtatcactttgcttttcattgccaagtgcagtgagaaacctattctgcaaagttttctttgtaaggctgaagctgaatgacaccttctgtcgtccctgttcttccaaattaacttttgttttggtgcctttgggcaaaaatcgactagaagcaacacctttgaacattggtcctttgatgaaacctgttttctgcacattttcaatctttgcctacaaatgaacaaaataagcaattactactacaataaatagttactttcaaatggactgcacagtttaaaatgtttactggagaaatgaaaagccctttttaataacaaatagtatgaatttcactaagctatatatatctttattatgaaaattttcaaacacagtcaaaagtatagaaaatggtataataaatccctaagtatccactccaagcttcaacaattacctattttccccattcttactttctcgtacataaataacttttttcagttttataactattttccaggtagcattttttaaaaagaattttttaaaaacctgacatatgtttgaaagacatttgtataaagggcaatatctaacatctcagtactcaatatggtttgttcttgtgttctatcagagatgaaaaatcagaggtcatcaagaccagtggtctcctggcatcacatggagtgcacagtaaaaatactcatctgggtcgagcacagtggctcacacctgtaatcccagcaccttgggaggccgaggcgggaggatcacttgaggtcaggagttcgagaccagcctggccaacataatgaaaacccatctctactaaaaatacaaaaattagcagggtgtggcagcatgcacctgtaaccccagctacttgggaggctgaggtgggagaatcactggaaccccggaggcagaggttgcagtgagccaagatggcaccacagaactccaacctgggcaacagagcgagcctctgtctcaaaaaaataaaaaatttaaaaattaaaaaaaaaaacatactcatctgtgatccacactctaggaaatatcaaatatcaacgagctattgagctctaagatgaggaaagggtttgttttttggggtgttttgaggttttggtttttaaaaaaaacaaacaaacaaaaaagcattacataggcaattctaatcaatgtcccaggtttgggaaaccactgatacagaggaacttcccaccttacttgttttacagatgaggtaaccaaatgaggaccaggccttctgccttcctggagagtactctgccttggcacatatcactgtctctgcctgggccccccaccctcaagtaataatactgctgtataagcaacagttacaaagtataaacctaagaagactacttttcttccatgtttgccaaatcaccaaaggaaatggttagccttggaagttcaaggcataacgtaggttgtacaaagagcatcagaaaaatctacagcaacaaactcaatcctaaattaaagatggtggtatacttctcatatgcaaaattcttctaattaatgttctttaatccactttggctatttaagagagtaacttccctttcaacacagtaaaatctgaaatcagttttcaaaattacatagtagtcattcaagttggaaagtaaatactttcacatatattatcatggagcagtgaattccaaatactttatttttttgagacagagtcttgctctgttgcccaggctgaagtgcaggggcaccatcttggctcactgcaacctcctcctccccagctcaagcaattctcctgcctcagtctcctgagtagctgggactaagccaccatgtctgcctaattttcttatttttagtagagatggggtttcaccatgttggccaggctggtctcaaactcctgacctcaagtgatccacctgcctcagcttcccaaagtgctgggattacaggcatgagccaaatacttttaagaaacagaatccacttttcaagttaaatcttaaatggaagctcaatacataaaaaacaagtaaaagatatttttagaacttccaactttctctacctttcctaaatctcttgaagctctaaagtttaaaaaccatttttctgagatacacaacatccctcactgggataagttaccatggctctaaaaacaaaattaaaaactattacttcatttcacattcaaaatgatagctacattttgagtgttttcagcttttacccaatttctaaaatgtgtttagtggtccatctcataatcattgaatgactagttaaattatacttacctcattttcttcttctctatttccattcagccaagaaaacatgcaaaagaataaaaagaaatcataaatacttaaaaacgattgaaataatagttatttgtattaaaacttgggatacttactacctacaggtatattctatatggattgtccattccttcacactcagttacatttagtttaacaaatatttactcaagatagtgtcacatactgtgctaagggctggagaccaaatttgaataaagcagcatccctgccctcaaaaagctcagcttcctgtaagtcacaaaaaagaaatttgtaacaaaagtaataccaacataatggagtaaatataagaatagaaatatatatagtaaggcagcaaagaggacgataagcaactcagtttagtgggaaaataggaatgcaaagaatttttcctgcctaggtgtggtggttcacacctgtaatcccagcactttgggaggctgaggccggctgatggcttgagcccaggggattgagactacactgggcaacatggtgaaaccctgtctctataaaaaatacaaaaaaatagccagacatggtggcgtgcacttatagtcccagctacctgggaggctgaggtgggaggatcacctgagcccaggaggtcgaggctgcaggtagccatgatcacaccactgcactccagctgtggtgatggctgtctttaaaaaaaaaaaaaaaatcctgaagagacgattcgtttttgaagaatacatttgtgagaagatcccaggcagagtcagagattaacacataaaataaggctgggtgtagtggcccacacttgtaatcccaacactttaagaggctaaattgggaggatcacttgagttcaggagttcgagaccaccctgggtaacatagcaaaacctcatctctcttaaaaataatttttaggccaggtgcggtggctcacgcctgtaatcccagcactttgggaggccgaggtgggcagaccacctgaggtcaggagctcgagaccagcctggccaacatggtgaaaccccatctctactaaaaatacaaaattagccgagcatggtggtgcgtgcctgtaatcccagctactcgggaggctgagaatcacttgaacccgggaggtggaggttgcagtgagccaaagtcgtgccattgcactccagcctgggcaacaagagcaaaactccatctcaaaaaatgaaaaataatttttaaaaggaaggctaagttgggaggattgcttgagcctgggagacagaaattgcactgagccaagatcatgccactgcactccagtctgagcaactgagtgaaaacctgtctctctctctcacacacacacacacacacacaaaataacatagaataatatgtgtaaagtatctataaacagttcaatattacctgaatataaggtgtaaggcagaaagaagccaacaataagatggagtaggaggcagtggtcaggtttctcatgagaagaatcatatttcatcttatggatcaatgcttctcaatcgtttttggtatctgttcaacagttccaaaggcaagactattccacattacagtgcatctgctccataacacaatgcgcagctctctgggttatgttctaacaaaggtaaccacactgactaagagcaatcaaaagccacaagtctagtgtacactagcacaccaacgcatactgagggactgtctacttggagaaaaggaagctacaaaaggacatgacagcgagatttgtattttcagctagtcactcattggactatgtggcaagactggaatacaacaatctgttttcaatgttcctgaaaggaaacatataaaacccttttccccaaatgtaggcctaacttcatcataattcattccattcgccagtgtctgtggtagccatacaaaaccaagtaatgacagggggagagggggcagtaagctgataatacatgaatgagatctgaagcagtgccaaaattaaccatttttttctactccaaaaccactaaaaacctcataaatgtgatgttagcactactgtacttcatcaattctatgatgtacattttgcccacaggatgcatgctatcaatggtataatagttttaactgaaaatttttttcacgtctcaacgttcataaaataatcattttcttacaatcgatggcatattagaacctatggtatattcaatttgatttaaattagtaccatttgaaattttttcaagacagaaggtaccaggagatgtccaaccaaggcttatctgcatagtacgcacacatacgaaatgctagaaatacaaaagtgaccagaacactttcttaagcctcagcagttctattttggacaggcagatgaaaagaataatcctgacaaaatatgatgaaaataggctcaggttatattgtaaatttgtggagttgggagggaagggggcataatgaaggtccattttagaaatcaaagaattgtttgacagaaatgacaagacaggagggggaagtgtttaaaaaagaaaagaaaagaaatgacatttcccagaacttgataaaataaaatgtttataataaaagaatataagcacaatcagaaatttggagggaaattttctcatcattaaaagcatttagtgttaatagataaaaatcaaattacaaacaagcaaaagaaaagtccacaatccaactttccagagacaactactgttaacactttgatctacagagctttctgcactcgtttgtgcatgcacttgagtgtggtttttaaacagagatcattgtttttctttttaaaaacatacaagccattctgtatcttgcttccctccctcatgatagagctggtgagcagacaagttgtttagatcacagaaaaagtatggaatcaccaaattagattgaggaagtgatctcaagagaaggagatacaggctgggcgcagtggctcacgcctgtaatcccagcactttgggaggtcaaggcgggtggatcacctgaggttaggagttcaagaccaccctgcccaacgtggggaaaccccatctctacaaaaatacaaaaattagccaggcatgatggcaagtgcctgtaatcccagctacttgggaggctgaggcaggagaatcgcttgaaccgggaagcggaggttgcagtgagatcacgccattgcactctagcctgggcgacagaatgagactccgcctcaaaaaaaaaaaaaagaaaaaagaaaagaaaaaattggtctctacttttctgacataattagttgaaagctgggggaagagacagggtaaaagacaaagaaaattcaagcgttaggcaacagaagtggaagtagactgtaatcctcaatgttgctgcccaaagttggacattaccaatttataattgagctcattagcatacttattctatttttgttgaagggattaagccatcagaggtaacagctagtgaattaatccagcaagattggcgggacaagaggggtagaaggcaagaagttgagagaactgatttctcaaaaatattaaaataactgacctaaagatccctagataatagacagggagtgaaatctgaaggaagctcataaactcaatagggtagggacaagatattgggggctttaaagagtggatttggtggaaaccaggaagagaggtagaagggtcaataaggtggaagaactggaaattatggtcagagtattattttagagttgaagtacatttccaggagagtcttcttgggtaggagacctaggtacggccaggaagagtagactgctgcagcaataagaaggcaggacctttttgaagaaattaatacaattgtgagaccacaattaacagcaagaattagctacaaatgtttttaacataagaacacttgtttcggtaaataatatcaagagcaaagaagagagtttttgaagaaaggttgatgaaacaagggtatagaaacaagaagttaagagtattaaacttcctgtactccctaccataaaaaataaggaggcatgtgaaaacaagtatttaactccacaggatgagatcatgctagaatagcctatttcttctttcaaaaaactactacagagaaaaaaaaaagaatatgttagccagttatctgtcaaaaaaatagtgaagtgggcaaatctgcagcttgctgatggaattatatatttaaagaatccatatcaacacgaagataaatctctattaggtcacatggtatatatagaaaaagacttagttaagagttttagtcatggcaagctcaaggaaccaaagaatgacatgacttaaaaaaaaccaaccaaccaatctctcaggctaggacattagaagtaaggtttacaaagggaagccctataaatgagagcaatttggccctatcaagcgcattaataaatataaacaagttggatagtaaagaaatctattctggataccatgtcacacaagaaatggttaaagctaaatagaagtatttttatctaccttagaagaaaaaagatttacaggaccatagtagtttatttcaaactaccagaaagtttagaagatgaaataatcttattttgtgcaattctgaaagtcagaactgtgaccaacaaatagaagttacagaatgacagcttttagctcatttttagtacattttaaattaattttttttctttgagacagagtatcgctctgtcgcccaggctggagtgcagtggcgcgatctcagctcactgcaagctccgcctcccaggttcacgccattctcctgcctcagcctcccgagtagctgggactacaggcgcccaccaccacacccggctaattttttgcatttttagtagaaacggggcttcaccgtgttagccaggatggtctcgatctcgacctcgtgatccgcctgcctcggcctcccaaagtgctgggattacaggcgtgagccactgcacctggccaaattaattttctttatttgaaaaagtactatatgtagctgcgggaaattttataatacaaagagatatacaactaaaaacaaatcactctccccagagcaactattgttaagtttgcatattctttttttttttttttaatttacttattttttgagacagagtctcactctgtcacccaggctgcagtacagaggcgtgacctcagctcactgcaacctccacctcctgggttcaagcaattctcctgcctcagcctcgcgagtagctgggactacaggcgcgagccaccgtgcccagctaatttttgtatttttagtagagacagggtttcaccatgctggccaggctggtcttgaactcctgacctcgtgatctgcccacctcagcctcccaaagtgctgggattacagacgtgagccactgtgcctggcctagtttgcatattcttattcgaaaactttgtgtgcatatatgaacatacacatatctttttttttttttttttttgagacaggatctcattctgtcttccaggctggagtccagtggcgcaatcttggctcactgatgcctcaaccttccaaactcaagtgatttttctgcttcagcctcctgagtagctgggactacaggtgtgagccactgcaccgggctaatattttttgagacaaagtctactacaaaactacaaaaactagccaggtgtggtggtacatgcctatagtcgcagctacttgggaggctgaggcaggaggatcccttgagcccaggaggtggaagttacagtgagcagagattgtgccactgcactccagcctagaagatagagggagactctgtctcaaacaaaaacaaaactagatgtgtcactgtacaggacacttaagattccttgacatcaaaaatgtttaagaatctggataagaacttaactaagataagacaaagaatattcctgtcctcaaggtggacagccaaaagtgaggtcctaggtctcactccagaccttctactgaatttcgtaactacaaatcagaaatagctttttactttaccttgattttaataagcaaagacttcaaaaattcactcctacctaaagatttcttactaaaactaaaatacagtgtttcttacacttgagtgtagtataggcctcatttaaagaaaaaaactgtcagacatataagaatagatcacagttcaagatttctgacagaaaacaaaaattagcctattaaaatttatttcatttgaaaactgtcattgcagagaattttaaacttaaaacttgtcaaaataatttttaaggtctataggttagaaaataatattgtatcagtgttaatttcctgaatttgatcattgtaatgttgtttttaggaaatacatatttgaggatataggagtaaagaggcatcatgtctgcaaatttccagcattccaggaaaaaagtaatgatgtatacatatatgtatataaacaaagaatgacaaaacaaatgtggtaaaatgttcttatctcgggaatctgggtgaagggtatataggaaatctctgtgttttaaaaaaatatattttaatacatattttttgtagagacaggggtctatgtggtccaggttggtctcgaactcctgagctcaaacgatcctcccgccttagcctcccaaagtgctgggattacaggcatgagcaactgtacccagtggaaatctctattttttaaaccattctgtaattattttttaaacttaaagataatcaaatatgaaaagttgttaaaaattctcacagaatcccccccaacccttaagaatatgtgggccaggcgtggtggttcactttgggaggttgtggcaggcagatcacatgagtccaggagttggagaccagcctggccaacatggtgaaaccccatctctactaaaaatacaaaaattagccaggcgtggtggcacatgcctgtaatcccagctactcaggaggctgaggcatgagattcgcttgaacccaggaggcagaggttgcagtgagccaacatcacgccactgtactccagtctgggccacagagtgagaccctgtctcaaaaaaaagagtatgtggacccttggaaatcctagagcctcagctggaaaaacattacctcaaatcttcctaaatttatattctggtaagcactgataaaaataagctacataaaaactagactctggagtatgagattacaggggtaacgatactgtgaagagaaaactcaaagacaggaaaactgataacaaaagaaaggaagccaccaattacaaatcaaagagtatttcataatattgcttttaacatatcctagcccagaggtaggatagcagtacccttaacttcctagaagaaaggtgcttgttgtcccctgcccaaagcaagacagaaacagaaatattggcagggaactcttctcaattactaagtgattaccttcaccattaggaaaccaggaatttcattgctcctgctgccccatcctacactatacctcatgttttgttttaattttaggattctaaatccttgatccgcttcccagcaagtacaggtggaagcctctgttgtgggggggaaaagtttggaacgaatgagttaaagtcatgcatgttttgacatttatacatttaagcacctatggcgttatatattcaagagttaaacttcctccaatcttcactgatctagaaatatgcatcaggcagaaatcttcaaaattaaaacttttatcacaaaaggtcacacctacctagctctctgcttggactatggtcatacacatttgcaaacctcttctaaacacactgagccaatccttctgtaggctagagttttggtagggaatggatgtcctagctaactaccaagagtgagctgggcttatggcaaatgtgaaaactacatcagaacgtatctcagtagcacacaaccatgctgatggactgctcaatgactttttttttttttgagacagagtctcactctggtgcccagactggagtgcaatggcacgatcttggctcactgcaatctccgcctcccaagtgattctcctccctcagccactggagtagctgggattataggcatgtgccgccacacatggctgatttttgtatttttagtagagacagggtttcaccatgtcggccaggctggtcttgaattcctgacctctagtgatcaacccacctcggtctcccaaagtgctgggattataggtgtaaaccaccacacccggcctgaatgacattttagaaaggtaacacttaactataaatatcacctctcatatcaatcagaggctatttgttcaataattatttaaggatccaccttgtaaaagcagtgctaggtctgtaaaggcaaaatgtcagttcacagtctctaccccaccaggaatttcatacttacttgaagtaacatggcacagaggtacatcaaataactataatacaaggtaacaaataataattgccatgagtagaaaagccagtaaggtgctttcttttaagcttcacttttgggctcacctggtctcaatttttctgattctctatgaaaacacacctttagtatttattactttgcttgttagggtggctttttaaatttgagacaggacctggctgtcacccaggctggaggcagtggcacaatcttggctcactgcaacctctgcctcccgggctcaagctgtcctcccacttcagcctcctgagtagctgggactagaggcacacgccacttacgtccagctaatttttatattttttgtagagacagggtttcaccatgttgcccaggctggtctcagaactcctaagctcaaacaatctgtccgccttggcctcccaagtgttgggattacaggcatgagccagtacaggcacgcctggcctaggggtggcaatttaatacagaaaaaaaatcaaacttgatacctaggtcagaatcctatccctgccatttattaactctatggcttgtgccactctgttcccttactctcctagatgcctatttcacacattcccctaccccaaatctctatcaccatgatctccatgaccactctcaattgacgatcccaccactttgctcagtgtcctatcctcttgcctcaaggacttccattttctatttatttcctctcctctatcatcagtctctctctctttcctctctattcattctcattagccaaacagcttttagtaagttactagaccagcatcttaaagctagtgatcaatttctttcctaggctttcacagaccacattcttcagtttttcctcctcccctcactgctactcctccttaatctcatttgttggctcctcccacccatccaactaataggtactacttggatacctcctacatctcaaatatagcatggtcaaaattgaactgatgacgattatcccatatacctaattcagtcctcccccaagtcgttcctatgacagtaatactaccatctacccaattgctcagatcaaacctcatttgtccttaatttttctctctccactcacagcccactccacatacctgcttatcctctttctgaccttacctctttccatagtccctcctcctcattctctaggttttagccacattagccttctctctgtccctcatacattccaagataatttctggctcacagccctttcacctgcttgttccttcttggaataccattccctccagatcttcaccagactgctgcttctcgataataaaatgacatctcacacagccataaaaatgaatgaaatcatgttgtttgcagcaacatgtatggagctggaggccattatccttagtgaactaactcagaaacaaaagaccaaatactaaatgttctcacttgtaagtgggagctaaacaatgggtacacatggacataaagaaggaaataattaacacttggggctccaaaagatagggcagtgggttgaaaaattacctaatgggggctgggtgccgtggctcacgcttgtaatcccagcactttgggaggccaagataggtggatcacctgaggtcaggagttccagaccagcctggccaacatgtcaaaaccccgtctctaccaaaaatacaaaaattagctgggcatgatagcgggtgcctgtaatcccacctacttgggaggctgaggcagaagaatcacttgaacccgggaggcagaggttgcagtgtgccgagatgacgccactgcactccagcctgggcaacagagcaagaatccatctaaaaaaaaggattacctagtgagtacaatgttcactactatttgggtaatgggcacactagaagcccaatccccaccaacatgcaacatacacgtgtaacaaacatgcacatgtaccctttgaatctaaaataatttttttaaaaagatgacacctcaaatgttatttcctttgagattctcccatcattctatattatagtaccttattttattcctagcatttattattatttttattttattttatttttatttttgagatggggtcttactctgtcgccaggctggattgcagtagcgtgatctcgactcactgcaaactccacttcctgggttcaagcgattctcctgcctcagcttcccgagtagctgagactacaggcaagcaccaccacacccagctaatttttgtatttttagtagagatggggtttcaccatgttggccaggatggtctcgatctcttgaccttgtgatccacccacctcagccacccaaagtgctgggattgtaggtgtgagccaccgcgcccagccttcctagtatttattactataagagttggttgtttattttttatttataaatattttatgtaatgcccatttcctcccactagcatacaagcttctttaggacagagatttggttttatcttgtttacagctgcatttaactgccaaaaacaccacttagaagatatggagcactcaataaatatctgacattattataaatttttctttttttctgagacagaatcttgctgtcgcccaggctggagtgcaatagtgcgatcttggctcactgcaacctctgcctcccaggttcaagcaattctcctgcctcatcctcccaagtaactgagattacaggcacccgccaccacacccagctaattttattttttttttagtagagatggggttttgccaagttgaccaggctggtctcgaactcctgacctcaggtgatccacccgcctcagtgtcccaaagtactgggattacagtattatcactttcttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgccgccacgcctggctaatttttttgtattttcagtagagacggggtttcaccgtgtcagccaggatggtctcgatctcctgacctcgtgatccgcccgcctcagcctcccaaagtgctgggattacaggcgtgagccaccgcgcccggcccactttctttttttttgaaaccaagtctcactctgtcgcccaggctggagtacagtggcgcgatctcagctcactgcaacctccacctcctgggttcaagcgaatctcctgcctcagcctcccatgtatagctgggattacaggtgttattattattattatattttgagatgaaatttcactcttgttgcccaggctgaagtgcaatggcatgatctcggctcaccacaacctccacctcccaggttcaagtgattctcctgcctcagcctcccaactagctgggattacaggcatgtaccatcaagcctggctaattttgtatttttagtagagatgaggtttctccatgttggtcaggctggtcttgaactcccaaactctggtgattcacccaccttggcctcccaaagtgctaggattacaggcgtgagccaccgcgcccagtcaagcctggctaatttttgtatttttagtagagacggggtttcaccatgttggccaggctggtctcaaattcctggtctcaagtgatctgcccacctcagcctcccaaagtgctgggattatcattttcctacctagttaagctgcttttacactactccccagaaggaatctcaatagctatggtggtctcttttaagttcaaatctagatcagtcttgttcaacgtctttctttcttttcttttttttgacagggtcttgctctgttacccactgtcacccagagtctaggctggagtgctatggcacgatcatagctcattgcagcctcgaactcctgggttcaagcaatcctccctcccaagtctcctcagctggctaattttctttaactttttatagagacgggctcacttatcttgcccaagctctcaaattattttttgtattgctcgtttcatcaccttcctccctctcagcctccacactacacacataccacatcacccccatatctaccttaatccactcagggaccactaaagcctttccttcctttgacaattatctgaatgtctagtaggtactcagcactattatgccttttcctatccttttcttacctttccagatactactactaaattcaactcctacagcatatactttacaatctgacaatcacatacagccttgacttgcatttattgttcttgtctccccatatagagtttaaatttcaaagagacaaaggcaacatcttgtccttattatataatctcccctgggcctaacattcccgttcctatcatacattctcgttactttttgaatcaaagaaactccttaacaacagtactagtttttagcttcctcacttcaagcaattcttaaaggaaaagagggaaacatctcaaaactgacatgtagaaaaagcaagatatataggccataaaatttatgaaatttgccgcattctcatctaagaacaaggacacgtgaagacaagtgaattaaaaaaaaacactgatgaaaaatatacgttatttatgtggtcaataaagctatgagtgatacactgctttatcaaagacattgaaatttcaggtaaagcactttggagtaagtatgctaacctgaactagcatgagtagacttgatatacaagcactccttctcacttgtttaagtccacatcttcaactggtatagtatctcaaacatacaaagaatcctattgatcaatatataccgactaaatctagaaaaaaataacttgatcatactcaccaactattcttacaccccaaaaatagctgaaactttattttaatgtggaattactacacaagtgagtaaagctaacttattttctttaaaaaagtcacttctaacaagaagtgactttgttaaaaagctaatctcaaatgtgtcactacggaattctaatcagtgaggaaaggttaagactataatcccaaatgttaacaactgtatttatgcctgaaatgtttctctacttgtctgccaaatagatacacaagaatacctacctaaagtgaatgatattcacctgttaaagccatctgctttttccaaaacccataagttggaacgttgggtgacctaacctgaacattttagagcccagtgttgaagactattgtattcaattgaattccagtaattttactcattactctgagttaatcttttcaattatccatttgttttcctcattagcaaaaagtgagagaggaaaacctccaataccaaataagcctcaaaagataaatatgcataaatgctgaaattcatctttagtacaagccagtgaatcacacagaaagagttgactggccaggtgcagtggctcacgcctgtaatctcagcactttgggaggccaaggcgggtggatcacttgaggtcaggagttcaagatcagcctggccaacatggtgaaatcctgtctctactaaaaatacaaaaattagccaggcatggtggcagtcatctgtaatcccagctactcgggaggctaaggcacaagaattacttgaatcccagtggggtggaggttgcagtgagctgagattgcgccattgcactccagcctgggtgacacagcgagactctgtctcaaataaaaaattaaaattaaaattaaaaattctaagtatcgaatacgaagaaagacatgagataggtttctgagggagatggcttgttataattagactattataattagactgtagactctaagctcgcttggttaatattgtttttttgtgagacaggatctcactgccctcacccaggctggagtgcagtgtcatgatcttggttcactgcaacctcacaccacccacccccgccccattctagtgatcctcccacctcagcctcccaagtagctaggattataggcacacaccaccatgcctggctaatttttgaatttttagtagggatggggtttcaccatgttgcccaggctggtctcaaactcctgggctcaagcgatctgcctgcctcagcctcccaaagtgctgggattacaagcatgagccactgcacccagttggttaatgtttaaactgtacctatcttgtattgtaccagactaagtacttatgtcagccttcctgtcctactcttgcttaaccacattaaatgagaatacaaaaacagctctttcaagttacagcctttcatgcaaattagctctgaaaaacccaccttctaaataaaaacacagaaataaaacctgtgatgtgattaaatggaaagacatgagaaagacaaggtctctctttttatacatatttcagatctctttccatcataaataactgcttactttcatcttaatactaaaaatgcttctgaaaataattttattatttcatgtttcacaagtaagttttcttttgttataaagaaaaaataaaaaaatgtgtgggctgctttctattttagaaacataccaagtacaacaattcaaaaagtttctagcataagttaccacccgaccaaaatcaaaacacattaaaaaacaattcagtactcttacggaacaaaagcttaaatgcaataaaaatagccattgtttattttctggttttggtaaagagtttaagcatttttttttcattgtaattaatgtctgaggtatagaaggaaaaggtttcaagtcaactaacacaactacaagtagggtaaaagctatccataccttaaaaaaaacacttgaaacacatattcttacaaggcaaagccaaatgataatataggatgattgtgaattacaatgcactgaatgcaccactatccatcatttcatacagaaaaaggttaaaataaactgcaaaaggctatctgtgtgctagtaaaaggttgtaacagtgactgaataaccctggtacatccgttcaatgtggtagtatgcagcttcaaaaagttctaattacgaactttgatctaaaagatcataataatgggctggacgtggtagctcccccatctgtaatcccagcactttgggaggctgaggcagtagggttgtttgaggctaggagttcgagaccatcctgagcaacatagtgagacctcgcctctacaaaaaataagcaaaattagccaggtgtgatggtgtgcgcctgtagtcccagctactcaggaggctgaggtgagaagactgcttgagccccagaggccaagggtgcagtgagatgacatggtgccactgcactccagcctgggtgacagagcaagaatctaagttaattaattaatttaattaaaataaaaggtcataatgaagatctctgtatactgctccggaatgtactgttaaggaaaaaaagcaagaaacaaaacagtaaatttagtatgctacttcgtggtggggggaggtggggaaggggaataccatatatacattgtctttttttttttttttgagatggagttttgcccttgtcggccaggctggagtgcaatggcgcaatctcgctcactgcaacctccgcctcccaggttcaagcaattctcctgcctcagccttctgagtagctgggattacaggagcctgccaccacgcccaactgattttttgtatttttagcagagatggggtttcaccatgttggccaggctggtcttgaactcctgacctcaggtgatctgccccacctcagcctcccaaagtgctgggattacaggcgtgagccactgcgcctggctcattggcttcttattttcaaaatggaaaaatgaaagttggggctgggcatggtgggtcacacctgtaatcccagcactttgggaggctgatgctggaggatcacttgagcccaaggagctcaagactagtctgggcaacatagtgagagcccatttctacaaaaaatttaaaaattagccaggcgttggtgatgcatgcctgtagtcccaggtactcagcaggatgaggcaggaccactgcttgagcccaggacgtcaaggatgcagtgagctacgatctcaccactgcattccaccgtgagcaacagagcaagaccccgtctcaaaaaacaaaacaaaaaaactttattggggaaaaaaccttaacaaaagtagacataaaattctgctgtgttcaaggagagaaacactaatattccaaatatttaaatccactttccacctatctgtaatcttttaggataaggcactacagtgctaaattttcatttcctgcaaaaaatatcttttgtgctcttaaggtaaacagaaaaataagagtatttttgaacatcattttgcagattagaattgctatctagtctactgatctttttaatttctgtaagttgctcattattaaatactaacagtatataactgcatattcatataataaagctagttgatctataaaacaaacttttatcagaactttatcccattggttttatatctcaaatgtcaagttacattataccagaactttttttttttattttgagacggagtctcgctgtcgcccaggctggagtgcagtggcgcgatctcggctcactgcaacctccacctcccgggttcatgccattctcctgcctcagcctcccgagtagctgggactacagacacccaccaccacacccggctaattttttgtacttttagtagagacggggtttcaccgtgttagccaggatggtcccgatctcctgacctcgtgatctgcccgcctcggcctcccaaagtgccgggattacaggcatgagccactgcgcccggccacattacaccagaacttaagaaaatgcagttgtcccacagctctagctgtcaagtttctagccacttaatcagagacaaaacttaagtgctataaacagctcacttgaggaggccaaatcttatgctctatgacaaagaactactccaagctgacaaagtaaatgtatacctcacagaaacaacacagggcaaaatatcagaagccaggtgcagtgactcacacctgtaatcccaacattttgggaggccaaggcaggaggatcacttgagcccaggagttcaagaccagcctgggcagcactgtgagaccctgtctctaaaaaaaattataaaaataaataagtccagccgggtgcagtggctcatgcctgtaatcccagcactttgggagaccgaggcaggcgaatcacgaggtcaagagagcgagaccatcctggccaacatggtgaaaccccgtctctgctaaaaatacaaaaattagctaggcgtggtggtgcatgcctatagtcccagtctcagccacttgggaaactgaggcaggagaatcgcttgaaccagggagtcagaggttgcactgagccgagttcgcaccactgcactccagcctggtgacagagcgagactccgtctcaaaatataaaaataaaaaataagtaagtccagaaaaagaaataaggccaggcacggtggcccacacctgtaatcccagcactttgggaggtcgaggcgggtggatcacttgaggccagtagttcatgccaacgtggttaaaaccccatgtctacaaaaaatacaaaaattagatgggcacacacccgtaatcccagctactcgggaggctgaggtacgagaatcgcttgaacccgggaagctgaggctgcagtgagctgagatcacaccactgcactccagcctgggcgacaagtgagactctgtctcaaaaacaatcaatcaatcaaacaaacaaacaataaataaatattttaaaaataacagaatatggcttggaattaaatagtagacaatattatatccaaaagttaaagtacgcagctggttttcatgcctacatctacagaggtgagaacactgaaaaatcaaaactgacaatgtgtaaacataactagaatgatgaaaaaaactgcaggttgagtaacgcttactgaaaacacttgggacagtaagtatgtccaactttttcagattctggaatatctgcatatacacgagatatcttggggccagatatcttggacccaagtctacacaccaaatttgtttatgtttcatataccccttatacacatggcctgaaggtaattttatacaatattttttaataattttgggacatggaataaactgtgttgtatgcctgtgttttgtttttgtttttaagagacggggtcttgctttgttgcccaggctggagcaagtacagtagtacaatcccagcttgctgcagccttgaactcctggactcaaatgatcctcctacctcaggctcctgaagggactacaggtgcatgccaccatgcccagcttggctgtgttttgactgcagcccctcacatcaggtcatgtgtaaaatttcccactgtggcatcatgtcagcattaaaaaagttttaacttttggagcatttcagatttcacatttttggattcagctgaggcctgtatacagtttaagaactatataacctaaaaggaactatgcagctgaacaggtgtggtggctcatgcctgtagtctcagcactttgggaggcccccaacaggaggagtgcttaaggccaggaatttgagactggcctggacaacatagcgaggctctgtctctacaaaaaataaaaaattagctgggtatagtggcttacatctatagtcccagatactcaagaggctgaggcaggaggatcagttgagcccaggagtctaaggctacagtgagctatgatggtgccactgcacttcagcctgggtgacagagcgagaccctgtctcaaaaaaaaaaaaaaaaaaaaaaaaaaagctatacagcctaaattgtctgctatggtctttctagtgcctctgtccagaaagcatatcccacttgctcttatctcccatcttgtactctcaaaatgtcagctggagaggtaccacccacagtacaatatattaggagcaaaagctcttatattcagtcaacctgaatttgaatactgactccaaagttttttaacctaagttactaaaagaaatggaggccaaagaagctagctataaaactgaaatagtactatatttactttaaaaagagaacgagtgtctatttaaaatccttcatatagccgggtgtggtggctcacgcctgtaattcccacactttgggaggccgaggcaggcggatcacctgaggtcaggagttcaagaccagcctggccaacatagcgaaaccccgtctctactaaaaatacaaaaattaaccagtcatagtggtagtcgcctctaataccagctactcgggaggctgaggcaggagaatcgcttgaatccagaggcagaggttgcagtaagccgaggtcatgccactactctccaacctgggcgacacagtgagactccgtctaaaaaaaaaaaaaaaaattccttcatataggccaggcatgatggcacatgcctgtaatcccagcattctaagaggccaaggcgagatgactgcttgaagccaggagttcaaaaccagcccgggcaacatggagagatcttgcctctacaaaaaaattttagaattatccaggtatactggcgtttgcctgtggtcccagctgcttgggaggctgagacaggagaatcacttgagagtccaggaagtcaaaactgcagtgagccaggtttgcattactagtccactctaggtgacagagtgagaccctgtcttcaaaaaaaaaaaaaaattccttcatatagtgcctggcagagagtttatactcaataaatgagagctgtaacatatttgtttttgtttgtttgagacagggtctcactctgttgcccaggctgaagtgcagtggtgcaatctcagctcactgcaacctctgcctcccaggttcaagcaattctcctgcctcagcctcccaagtagctgggattacaggaactcgccaccacacccgctaattttttttgtatttttagtagagacagggtttcaccatgttggccaggctggtctcgaattcctgacctcaggtgatctgccctcctcagcctcccaaagtgctgggattacaggcgtgagccaccaagcctagccactgcatgtcatttttttttttttttttgagacatagtctcaccctgtcgcccaggatggagtgcagtgacgtgatcttggctcactacaacctctgcctcctcggttcgaacgattctcctgcctcagccgcccgactagctgggactacaggcatgcaccaccacgcccagctaattgttgtatttttagtagagacagggtttcaccaggctggtctggaactcctgatgtcaggtgatccacctgcctcagcctcccaaagtgctgggattacaggtgtgagccactgtgcccagccagcatgtcattttttaagatagtttctaggccgggcgcggtggctcactcctgtaatcccagcactttgggaggccaaggcgggcagattacggtcaggagatcgagaccatcctggctaacacagtgaaaccctgtctctactaaaaatacaaaaaaaattagccgggcaaggtggtgggcgcctgtagtcccagctacttgggaggctgaagcaggagaatggcatgaacccgggaggcggagcttgcagtgagcaaacaccactgcacgccagcctgggcgacagagcaagactctgtctcaaaaaaaaaaaaaaaaaaaaaagatattttctttcagctcctatactttctgcactcttgttcataaaggtatgcttagaaccctcttacaaaattaaagtattatactcattggtgggctaaaaatatattttagtaaacctaggcttcaactataacataaccaactgaaacttgtttttttggttgtgttttgttgttgttgttgttgttgttgttgttgttgtttttgataaagcgtctcgttctgtcacccaggctggattgcagtggcgcgatctcagctcactgcaacctctgcctcctgggttcaaacaattctcctgcctcagcctcccaagtagttgggattacaggcacccactgccacgccgggctaatttttgtatttttagtagagacagggttttgccatgttgcccaggctggtcccaaactcctgacctcaggggatccgcccacctcagcctcccaaagtgctcggattacagacatgagccactgtgcctggccctgaaactttattgaaacagaacaatgttactcccctcaaactttcttttaatgaagacaaaaaatacaaaaacagggaaatttcaaagtacaatctgtgttcaagtattctccaattttttataccttctttctacctctatactattctaaaatgagcactggtttttaaatgaacttcaaataaatgcacatttctgaatcagacaatcattaattagggtcttaaattaatgatgtttgacttagaactgaggttagaataataaaaaccccattttccagtaggaaaaactttatagacatccaatcgacttacatacaagtttcttttttaaaagtggccataggccaggcacggtggctcacgcctgtaatcccagcactttgggaggctgaggcgggaggatcactacatggaataatggtgaatgaaggcttgagtttcatacgggattaagctcatttccagtaaagatttcagactacttaaggcacctggacagaaaaacgggcagatctgaatgatccccatatccagtttaccttttgctgaatgatattcatacccataatcctccagcatatacatttgcaaagtcagaggaaagaaccaattcaaatacagaatcacctgcaccctccaaattgaacaattataagtacatcaaggtcaattctgaagacctttaggaaaacaagtaactcaatacagaaatccagttgtttatgaatggcagctattctaaatgttattccttaacatcattaaaaagtcagttttggacaaactggtaaatgaatattacccaagttctgatatgccactaaactagctagtgagcacaacctgtatgtctttggacttccttttcttccctttataaaattagaggcactagctccccttgcccttttaaaatcacactcatggcaagtcacaatgagcaagctaaaggggaaaaaaaaaaagttgggagccacagaaatgaggaattattagatatagtagaaggactccctacactagacacctcttatagcactcagcaatttacacttggttaaaaactgaaggggaaatgggcatagggttcatcctctctctgtatcctcccccataatgtagccctacaacatcctctaccatctgcctactccatttttgcctaagtcctactcttcaaggctaagttcaggtattcttctgggctgccctccctgattgcccacctgatccccatcccagtagaagtcagatatccctgccatagcacattgtgcttacttctgtatccttagcacaggtctggcattcaacaaatgttagctgaataaattgtcaagagttcaagagttcaatctcagctagttgttctaaacattaggttaaaaggctcgatataatgaaaagagtttaaatataacgtttttaattgcctcatacagttagaaactgacagactttagaaaactgaatttttttgtatgctaggtataaaaagtatcagctaccctagagaagaacaaaagcctctatttttggagtactaaattttctatcatttttcagtgtcttttggcatatccaaaaatacttttttttttttttttttttgagacagagtctcgctctgttgccaggctggagtgcagtggcgcaatctcggctcactacaacctctgcctcctgggttcaagcaattcccctgcctcagcctcctgagtagctgggactccaggcacctgccaccacgcccggctaattttaatttatcttttgtattttagtagagatggggtttcaccacgttggccaggatggtctcgatctcctgaccttgtgattcgcccgcctcggcctcccaaagtgctgggattacaagaatgagccaccgtgcgcggcctcaaaaatatcgtttgatttaccactgcatctgaggttcctcacttcctttttgcccgtaatattttgcccataatatttataaagagataaatgagattactgatctgagaaatttggatagaaagtcaacagaacaagggtaaagtgcagcttacccttagtttaaggattacccatcctggaaaatacacaagtacaaaacaactgaaaaggctgggagaaaaaagtggtctagcataccaacagaagaagcataaaaagtgctatgagcaccaagtcactgccattagcccaacacataccactcaattccctgacctctgtcctaatcttatagttatttaagaatgtctggtaataggctgggcacggtgtctcacgcctgtaatcccagcactttgggaagctgaggtagggagactgcctgagtccaggagttcgagaccctgtcgctacaaaaaataaataaataaaattaggcgtagtgggaggatttcttgagcctgggaggttgaggctgcagtgagccgtgatcgtgccactacatttcagcctgagtgacagagaaagaccctatctttaaaaaaaaaaaaaaagaaagaaaaagaaaaaagaaaagcatgtattataatagaggtcagcaattattaacaatgctgctggtaatcaaattagaataatgatcgttacaaagaatcaggtcaattcaaacatttactaagcatgtactaccatgtacccaactactagttactaggattcctccattaaaagagaagaacatattctataatatattcatcatgggtcttgaattttctgatacatagatctacaaaatcccttaggtcctagcaacaaaaccaaacaggtctaatgagaatagatgaatgctaagatagccaggcttcaatgaaatgttagcctttcttgaaacttcgtattaataatcaaccaaaacatcttaaaaattacagaattataaaaatacatatataaaaacatatcttttaaaaacttatatgaaaaaatagcatcgatgaaaataaaaaagcttaagcaatcggtacatttcaaaaaagcacacagctaacaaaaaaattgtgcagcacacatacgcacaactggaaaaaaagtcctatcacagattctaactcctgctcccagtttcatatcctgacaccatcatgatcttctctaagagcatgccgcgtacagtggctcatgtctataatcccagcatgtggggaggccaaggcgggtggatcacctgagatcgggagttcgagaccagcctagccaacatagtgaaactccatctctgctaaaacacaaaaattagccgggcgtggtggtacgcgcctgtaatcccacctacttgggaggctgaggcaggagaattacttgaacccgggaagcggaggttgcagagagccaagatcgcaccactgcactccagcctgggagagagaccaagactcttgtctcaaaaaaaaaaaaaaaaaaaagtttggaaagaaaataggtagtcaaagaaggaagagcaccaaatacttcttgcaaatctcatcatctccctaattcatatgagcaatactataattgggggaacagtctttttatattcaatcactacggtttgaatgtgttcaaggtgttcatatcagctagtaacactacttccttacacaaactgctaatctgccaaaaagtatactatacttttcataattgtgacaactggtttcctgaataattgtacaacaaaagttgttttgtttttgttcctcaatagacatggtaagcttaagcttgaaaatatacctattatggttaccttgaggcaaacttgaagagattttcaccaatttctaaaatgttgtattgtacctcaaagaaatttgcctttactacagataattcttaactacattttcagcacagaaccagtaccataaaatgtgtagcttatgttttagagttgatactccaatcaagtattgataaattaatggaagagtcgtatttttaaccaggcaatttttaaccagatgtattttcaaccaggtctgtgtgtgctcaaggccagaataaatggatttctatagaaagagtttttacagtcatttaatataatttgtgaaaaacagtatttgctccactttacattcacacaaaactcataaaaaatttaaactttaaacctagcatcttctgcttcttcaaatagagtatgtaattaataactattcatcatgaggccaaatatcagacaaaagcctcaaaacacaagttagaccacggattcacaaagagctaaccatgaagcaaatagtgttgattacgataatagtcctccccaaagagagggtccaaccacacttggcagggaagtgggccacaggaagaactacaattggaaaccaccacttgctctaggttcttgcaagcccagagcagtgctcccagtaagcagacctcccagaagcctgccagcacaattgcagtcttatcaacacccacatcatcccaaggatattttcacttgcaagatgttagcatttgacagaaaaagcattctaaaataaaaagcaactatgggaattcagacctatcttaaacctccattgaaatgacaatatgtttgctcagctggaaaaaagactgaagtaaccattagcttgaccaaaaacacaaaaaacaggcatggtggctcacgcctgtaatcccagcactttggaaagctgaggcaggaggatcacttgagaccaagagttcaagaccagcctgggcagtgaggtgagacccagtgaagtgattatctaatttttaaaattaaaaaattaaaaagcaaagactaccaaattaaacaaagtaaatttacacaaattccaaagctaagagactcaaatacaacattttattacacaatttttattaaccaaaaattatacaaggtaattaaccaaaaattatacaaggtaattgcctttcatttgaatgagagacttccaaatactgtataagtccaactatggaaaaatgacaacaacaaacctatcaaattttgtcttagctctgttggccagcctcaaaccaaccattttcaagagactccccacttaaggccaggcacaggggtgcccagcactgtaattccagtgctttgggaggccgaggtgggaggattccttgaagccaggagtttgagaccagcttgggcaacatagtaagactcctatctctacaaaaaaaatttaaaaattagctaggtgtggtggcgcatgcctgttgtcccagctacttgggaggctgaggcaggaggattgcttgagcccaagagttcgaggctacagtgaactgggatcataccactgcactccagcctaggtgacaagggaggccctgatccaaaaaagaaaaaaaaaaaaagagatcccacttaaatgccttcagtttcctttttaaaagaaacaagtaactaatcaaagtaaggcaggaataaaaattatctgcttaatccatcagtaccatatacaaatagaaataagtacagattttttaaaaaactctaaacaaaatcccccaaacaccatcataaccagaaaaactcactctgtggagaaatacatttggaaagagacaccttccacgtagcacaatatgccctaaggctcttttaaactgcctaatatactaaccagacatcttaagaaaatcaaacaacttaacatggtacatccatactacagaatattgttcaactatttaaaaaaataagcacgtcttggccaggcgcgatggctcacacctgttatcccagcactttgggaggccaaggagggcggatcatgaggtcaaaaaatggagaccatcctggccaacatggtgaaaccccgtctctactaaaaatataaaaattagctgggcgtggtggtgcgcgcctgtagtcccagctacttgggaggctgaggcaggagaatcgcttgaatccaggaggcaaaggttgcagtgagccgagattgtgccactgcactccagcctgggcaagagagcgagactccatatcaaaaagaaagaaagaaagaaagataagcatatcttatatgtaaatggaaacaaatacagaatgtaggaaaaaggcagaaaaatacatacagtaatatgactccatttgtgtaaaaaaataaaaaccaaaaaaaggaaaagatctcgaaaaatacattaagttcttggatatggtatttggagaggtggagcagagaagagatactcagggaggatttttactttttcttctataaacatttgtattgtctgacccttttgcaataagcatttattgttgtggtaattaaaaaaacaaaacattggccgggcgcggtggctcaggcctgtaatcccaacactttgggaggctgagacggacggatcacaaggtcaggagatcgagaccatcctggctaacatggtgaaacccatctctactaaaaaaatacaaaaaattagctgggcgtggtggcgggcgcctgtagtcccagctactccggaggctgaggcaggagaatggcgtgagcccaggaggcggagcttgcagtgagccgagatcgcaccaccgcactccagcctgggcgacagagcaagactccatctcaaaaaaaaaaaaatcttaaacatactatcagaccctgttattgtttttaaaatatcacattcatggttagtacatagtaataaagtacttccaaaacaaatttaaagttatcctcagagattgaaaaagactaagagacatgacaattaaatgcaatgtgtaatactagattgaaaaaaaaagacatctttgggacaactggcaaaatgtataaattacatatcaggtaatagtagggttacaaatgttaaaatgtctgaatttgattactgtatattgattatctaagacaatacttgttcttaggtaacactatcagatatttaggaaagaaagatcatgatgcctgcaatttactctcaaaaggttctgccaaaagtaaataaaactttttttaaaatatagaaaggtaatacaaacgtggcaaaattccaattactggttaatctaggttaaaagtacattatgggaattcactgtgctattcttgcaactttcctgaaagtttaaaattttttcaaaataaaaagtgttttctgacaggcgcagtggctcacacctgtaatcccagcactttgggagactgaggtgggtggatcacttgaggtcagaaaaccagcctgggcagcatggcaaaccccatctcttcaaaaaatacaaaaattagccgggtgtggtagtgtgcacctgtagtcctatctactcaggacactgaggtgggaggatcgcttgagcctcagaggcagaggttgcagtgagccaagattgtgccactgcactccagcctgggtgacagagtgagaccctgtctcacacacacataaaaaagtgtttttttgtttttgttgttttttttttctgtcagaaaaacattctaacctgatttcagtgacttaggtgtaaatggcttagtttccaatataaactatctctcagggttttacaataatagttcttagtgtattacaaaatcaagtactctacggtactcttggaagaattaacagaaatgaagctagtcaacttttttaagaaactgagcaaagaacaattagcaaattgagcagcctcttaaccaggataggttcagagaggctccagcagagccacgtaatagatttatggacagagaagctggtcaacttttgattctcaaacccaggctggccatcctgcttccatccaaaacctgacaatgctcatggaacaatgaatattagggttgagaaaatttattacaaatatctattacagaataaactgtaatgtattaaacaaaatttttaagtgaataaattaaatcaacgagtcactacagtgaaaaatgactgagaagatctggaaacaccaaagtcctgctaaggaaactaggaaagtatgactgatagataatcttgtatgtataaaatacggcttggcaactagagacaattcttaggaaaacacagttgtatcaacagttgcttgatacttttctaaagacataatgtgtcaataaaaggagaatggtatgcctaaaatgtagcaaaagcaaatggcaaagagggacatgaatattaaagaggtataccctagcctaagcactaggatagttcaacaggctttccatacttaccagcaaaccctccaagtactatactggcctcctgtgcatctcagtagcccaaagaaggtaacctggcctgtagcaccatacctccatcactacaaagctctctctctcatcagaaaaatggattcaactgtctataaagctactaaaggtccagattatatatgaaatctggtaaccacatgatactttctctcagttggcttcctaaggtatctctatcttctccattctaacatgaattataagaatttgacttgctgggcacggtggctcacatctgtaatcccagcactttgggaggccaaggacaggagttcgagaccagcctgggcaacacaccaaaaccctgtctctataaaaaataaaaaattagccagggccaggtgcagtggctcacgactataatcccagcacttttgggaagccgaagcaggaagatcacttgggcttaggagtttgagaccagcctgggcaacatggtgaaaccccatctctacaaacaaaattagttgggcatggtggcatgtgcccacagtccccgctactcagaaggctgaagtgagagaatcacctgagcctgggaagttgaggctacagtgagccatcatcgcgccactgcactccagcctgggcaagagcgaaaccctgtctcaaaacaaaaaaattagccaggagtggtggtgcacatttgcagtcctagatacatgggacaatcacttgagcccaggagttcagttacagtgagctataatcttgccactgtactctaacctggacaacagaacaagtccctaaaaataaaaaattaatatagaatctgactatcctgactgctttgtatctcatttgaacatgctgaaatattctttcccagttaaactttcttttgaccaaatttgccatactttcacatcatggcgcctcataagtaccgttctttctagctgacttgttccattcaatactaacaataaaagaactgaccaggggcgtggtggctcatgcctgtaatcccagcactttgggaagcccaggtgggtggatcacctgaggtcaggagttcgagaccagcctgaccaacatggagaaaccccatctctactaaaaatacaaaagtagacaggcatggtggcgcatgcctgtaatcccagctactcgggaggctgaggcaagagaactgcttaaacccagggggcagaggttgtagtgagcccagatcacgccactgtaccccagcctgggcaacaagagcaaaactccatctcaaaaaaaaaaaagaaaagaaaaaaaaaagaaactaacactgtcctaattcttaaattctcataaaaccctttgcagatgatactaccatgatccccactttataggtaaggagtaattaagaaacttgcctaggttcacaaagcaattaagtaaaagagatgagattctaaaccaggagttctgtctccagagcccagggatttaactttttttgtgccctataccattttggcaatctaatgaagcttgtggattccttctcagtctaatattttttaatgcataagataaaatacatatgattgcaaaggaagacaattatattgaggggaaaaaaaccaatgtgtcatattgcttagtatgtgcttctcaatctagtggattttgatataatgataaacatatttcaagattctataaaaaccacaatacagtttgcctttgaacaacatgggctggaactgtccaggtccacttatacacagatttttttcaataaaagttacacaccttgtgcctgcctccagttctacctcctccacctctgtcactcaagacagcaagactaaaaccccctcctcttcttcctcctcagcctactcagtgtgaagactacaaggatgaagacctttatgatgatccacttccacttaatgaataatatattttcacttccttatgattttcttaataacattttcttttctctagcttactttcttgtaagaatacagtatataatacacataacatacaacaaagtatgtgttagtagactatgttctcagtaaagtcaacagtatcctagtagcagttaagttttgagggagacaaaagttatatgcacatttttgactgtgttgcagattggtacttctaactcccatgtttgatcaagagtcacctgcatattttattattaaaatatctgatttctacacaaatcacaattaatactactgtagtttgttatttatattagtaattgaaagaaatgctaacttctagtcagaggttaccgaagaggtaattttcccaagttcacagatgtcatccatgttaaaacctcaaactgcacactaaaacagttctcttaacacaggcatttaaaaaaccaatcaagccaagtgtggtggtacacatctatagttccagctactcaggaggctgaggtgggagaatggcttgagcccaggctgaagaccagcctggggaaaatgtaagattccatcttaaaaaaaaaataaaaagaccaatccttggcccttctctctttctaccaaggattctctggtaatctcatccagcttcatggcttgaataatacctaaactggtgaaaacaaaatttatctccattccagacctttcccctgaacttcagacttggttatcaaatcaactcaatatctaacaggcaatctcaaacttactatgcctaaaattgaactcctcctaatctagtcctcaaatttgctccttttagtcatcactgtctttgttgatggcaactttctaacgctgagaccagaaaccctggaatcatccttggttcctctctcacatgtcatattagttccatcttcaaaacatatccagtatccatccatttctcactactcttatattaccatcttggtactggcagcatctcttttctggattactagcttccttactagtctccaggcttccactgttgttccctttgcaattcaaatgatcctttgaaactgaaagcagactatgtcactcttctgttcaaaactcttggcaaagttcttagaatggctttacaagactgtaaaaaagctaaacctcagccgagagcagtggctcacacctgtaatcccagcactttgggaggccaaggcaggtggatcatgaggtcaggagttcaagaccagcgtggccaagaaggtgaaaccccatctctaccaaaaacacaaaaattagccaggcacagtggcaggcgcctgtaatcccagctattcaggaggctgaagcaggagaatcgcttaaagccagggggcagaggttgcagtgagccgagatcacaccactgcactccagcctgggggacagagtgagactccattccaaaaaaaaaaaaaagctaaaccccatctcaccctaacccagtttattattacaccttcttgctcattccattctagccataatgggcaaaactcacaggtctgcctcaacaccttgaaactattccctcttattgaaatgccttcaccccagttattaacatggctacttctcctttaaatctttcctaaatatcactctctcaaggatactcacccagtatacctcactttaaattgcaacctcttcctcaacaattctgaatcccccttactctattccactttccaaagcacttacctttgaacactctacattatttatttaattttattatttttttttcgagatggaatctccttctgtcccccaggctggagtgcagtggcacaatctcagctcacggcaacctccgcctccaggttcaagcaattctcctgcctcagcctcccgagtagctgggattacaggcgcctgccaccacaccagactaattttttttttttttgtatttttagtagagacgaggtttcaccatcttggccaggctggtctccaaccactgacctcaggtgatccacccacctcggcctccaaaagtgctgggattaccgatgaaagccaccccacttggccagaacattctatatcatttattatcacccctattaggatgtaaactccacaagggcaaaattttgttttgtacaccaattacccttagtgtgcctatgtttggcatacaacagacatgcatatgttcaaagacctgcacctctatcactgtaaagtacttgcctatctccttcattaaaagagttccttaaagactaactggatctactttgccgtgtcctcaacacctgtccctgggcctgccccataatggacacccactgcacagatactcaagtgattacagccattttcacctgaaacacaatgtcctctatgctgctgaataaaaaagacatcttgcagctgtgtctgattaaaagcatgggtacaagacaaacccagaacatcagacgctaagtgttacttcagtcaaactgaatttacatttttgcctcaatttcttcatatgtctaagtaccatttcaaaccatccaaagtctaaaaagggcacttggtcatttctcccctgagccatgttgcccacctagtcttttcatcctcaacttaaatcctaccttttaacttttccctgatgaccccaactagaagcacttacacgtgccacattctgcgccaagtgctcttcatgcattatctcattcaatcctcccaaaaagccccagtaagttgttaaccattataatacctatataaaagatgagaaaacccaagttcagagagatgaagtcatcgtccaaggttaaaatagtgttcagattcaggtctgactctgaaatccaggttttttaaaccctatactgcctttctctctcctctctctagcattataaacactaactagcttactatctcaagagtttgctgtcacttcacttctctagccttcattttcttcatatgccaaacaggtgatattgctcaggatacctaccatgatcccctccagtctttatagtattatgaaaaaaaggaaaaacaaaacaacaacaacaaaaaacatgttacaattctttactccatacaggttaatacacaagaagaggcctggcacaatggctcatgcctgcaatcccagcactttgggaggccaaggcaggaggctcacttgaggccagggattcaaaaccagtaacgtaatttatttttttttaattagctgggtgtggtgacacatgcctatagtcccaacccaggaggctgaggcaggaggactgcttaagcccagaggttcaaggatgcaatgagccatgatgacaccactgcactccagcctgggtgacagagtgggaccctgcctctaaaaaaaaaaaaaaggaaaaaatacacgagaatttaaaaatatataatcactgttagaaatccaaagcagtggatttctactacattaaagcaataaaaataaaaactccaaaacatgtaaaaccataaaacattcttgattccttccccactcaggtctaccaaagatgcacttctgagtccattttcccacatattatgaaaaattgtttttccccaagaagtgtaaggatgtgatccttaaagcttccggacttcaccaaacaacctggtaaaaggaagtgaaagcaggcacttagcctattcaggggttagcatgttactttgtacagagcaagtgctatataagcatttattgaatcgtgatataaaattttttttgaggtttttcaaactaaaaacctataacatgagctttgtaattggactgatggtgcagtaaatcaaaacaatcttacctaactgaccctgccagtagcaaaacaaaaagaccaatctaattaaggtaatgttaaccaatggccaagaacccatgaaaggaaaaagccatgttaacttactattgcaagtaagagttgggtttttagaaaagcaaaataatgatttatcttgttgtgcagaaatgaccaacacctcaacagaatccgtttgtgttgcaatcaaaactatcaattaagatccagacatttctggaccaatgtgagaagatgtggcaagggattcaaaaacgagccagagcaaacctaaggtaaaatgtgtcaaaacagcaaagctcttggaatcatcctggtcataaaagtttgacagtttcatgtgaaacccctatcaaccgataagttttaaatcaatagtatattcctaggtctaacaccagcaaacggtgtttaagaacggcttttcaaaacaatggtctcgtgagggttcagggaaagaagtgactccaggctttctgagatagcagatacagcagcagattcagacctcaagagaaatgtaaaggtgtcctagactgaaaaattactattgggcaaaactgtgtgtcggttttccacaacattgtcttctttagagaatcctcaaacgattcttggtttttaaccaagtcttcacaagaaatagaaagtcatccgtttagggtaagagattcctgttaccaagaaaattgtgtccgaaagtgtgaaaatctcacaacctgcaagaaaatgtatgtccctcaggaggctttcattttcaagcggaaaaacaaacccggtgtcacctcaacaacgggaccacacaaacctcgccattacaaaacccaagtgccaaaggtgcacaatgtgaatccggaagcactgcaaggccaggatcgagttcccaggaggaaaaaatcaaactcaggagtgcagcgcgggcccctccacggcccgggggccaggcaacccgcgctaggcccttccggtccgaggcgccgccgtcgcggggaggtcgggcgacgggtcgagcttccacccgagcccggggattcgcggcctaccctcaccggcgccctcttgccgggcccggcaccggcagctcctccgactctgccctttggctagcagcggggcccggacgagccacgaggagcccgagaggaccgccgagccccgggatggccgggtcggtgcggacacggcggtaaccgtagggaccgtggccgcccctcccccaccggcccggcccaaccgccgccgcgacacgagcagcggcgccaacgccgggcccaaccgcgggcctgctgcggccccggccaagcggctcgaagtggcggcgcgggcctgctcccgacaccgaccgcgcgaggccaccgtgggcctgttactcctcgcgccggcccgcgccgccacccgtcaggacgcgccgccctcggctggggataaggcggccgacagcagcggggggccgcggagctgatacttactcaggggtcgggtgctccgggtcgtagaaatcccccatcttcggaggcggctgcggctgcagctgcttcatcgggagcggctggagacggcgacgcgagccccctccccgcagcagggcgacgcgggggaggggaggggaggaggccgcaggtccgaccgcggcggcggcggcggcggcggcggcggcggcaggggcggcccgcgtcgctacctcgctcgtcgctccctccctccctcggacgcccgccagccgct

SEQ ID NO: 18 - DNA, 44896 bp, Homo Sapiens
ttataccaaaaaacattttattatttttattttatatttaaggtacatgtgcagatttgtaaaacaggtagactacatgatgttgaggtttggatacttaataattccattgcccaagtagtgtacatcatacctaagcagattttctatgcttgtctcccatccttcctccttctttttagaattctcagtgtttattgttttcatctttgtttccatgtgcgcccaatttttagcatccatgtatgagtgagaacatgtggcatttgtttttctgatgcaataatttgcttagaatggcctgaagcagagctgcattcatgttgctgcaaaagacgttacttcattctcttctgttgctgcatagtattggaggttgtataagtacatcatttttcttatccaataaaagattcatgggtaactggttaaattctgtttttgctattgtgaatagtgctgcaatgaacatgtgagtgctggtgtctctttggcaaaattatttattctttttgggggcagatatccagtaatcggcttgattggtcaaatggcaattctatttctagttctttgagaagtccccaaactgctttgcacaggttctgaattaatttgcattcccaccaacagtgtagaaagatttccttatctctacaacttcaacatcttatttatcttacttttaataagtcattcttactggtatgaaatagtatcacactgtcactttgatttacatctttctgataattaggaacgttgagcaatttttacatgtttattggcagctcttatgtcttcctttgagaagaagctggctattcatatcatgtttgcttttttattaaatgtattatagattctgtacattaatccttcattgtctgcagtttgcaaatattttatttcatactgtaggtcatctgtttactttgctgatagtttcttttactgtgcagaagctctttggcttagatgccattttttatttttatttttgttgcactcatgttagatgttagtcataaattctttacagaggccagtattatctaagtgttattctaagatttttgtagcttggagactcacagatcaagtctttaatctatattgagttgttttttttttatagaaaaaggtagtacagttttcttccacatatgactaaccagttttcccagtattacttactaaatagggagttaattccccttttgtttatttctgttggctttgtaaaaataacctgattgcaaagtatagcttaattcagtactctctcttccatttcattggtctagatgtttatttttgtaccagaaccatgttatactggttattctgatgcaatcttggctcactgcaacctccacctcccaggctcaaatggttctctttcctcagcctcccaagtagctgggattacaggcatgcaccaccacacctggctaattttttacatttagtagagatgcaggtttcaccatgttggccaggctggtctcaaacttctgacctcaggtgatccatccatctcagcctcccaaagggctgagatgacaggcatgagccaccatgcttggcccagatttattcttttagtctgaagttttcttggctatttgagctctttaattcttttgaatgtattttagaatagttttctttttctaattcaataaaaatcgtcatggatagtctgataaaaatagcacttaatctgtaggttgctttaggcagaatgaccattttaattatattatttgaatccatgagcaatatttttccatttatttgcattgtctctcgtttctttcagcaatgttttgttgttctttgtagagatattttacccccttgatttaatgtatttctaggtatttttttgtgtgtttgttgctattgtaaatagagctgtgttttttattttgttctcagtttgaatattattggtgtacagaaatgctatgcatttgtgctgattttgtattctaagattttttttgaagtctttttccaggcttagaactcttttggtgaaacctttaaagtattctaggtggacaattctttcatcagtaaagataatttgactttctttgttttctgtttggattccttttattctctggctaggatttcataacttcaataggactgtttagaatggatattcttatttttattctcatggagaatgcttccagtttttgctcttttagtatgatgttggctaaggatttgtcatagatgactcttattaagatattttcatcaatgtccagtgtgttgacaacatttttgagttaatattgggttttcttgaatgctttttctgcccctactgttatttttttttcttttaattatctttacatggtgaatcacacttattgacttccatatcatgaaacaccttcatatatatggaaaagctcacattaatgtagcaaaataactttctgatttgcttttgaattcagtttgctagtatttcatggaggattattattccaatattcacccagaatattgacctgtactttcctttttttgtggtgccttcactagattttagtttcatatatttcactgatttaatataacaagttagggtgaaatcccaccttgattttttcgaatgcattcagtaggcttaggtaaaactctttgcaatgtggtaaaacttcgctgtgatttcatatgatccagggctttttatggttagtaggtttattattacttatacaatgtcattatacattttatacatttttgctctgctaaagacttctgttattaggccaggcactgtggctcatgcctgcaatcccaggactttgggtggccaaggtgggcatatcatgaggtcaggagatagagaccgtcctggctaatatggtgaaaccccatctgtactaaaaatacaaaaaattagctgggagtggcggcgggcgcctgtagtcccagctaattgggaggctgaggtgggagaatggcatgaacctggaagctagaccttggctaatttctttatttctttttagtaaacatgtttagtaaacatttctttttagttccactatgttggcaaggctggtcttgaactcctgacctcaggtgatctgcccaccttggcatcacaaagtattggccacagtaagccaatgtgtctggaaaaaaaaaaaatctgtgttttgaagaaaaaagtatactttaaatttaattataactcttcaaagatctacttcttttaaagttatatacaaataattcttctttttgccaactttagttttggattttttcctatactcagcagtctgatttagtgtaatatctgaagtttgagtgacaggtatttctactgtgaattagctgatatttacataaacttaattttggattaaatattttttatatttactgtatctgcaaaaacatattttagtataaacgcatttgtgttttataatctgtagtttttgaaaaaatgtttttccaaatttattaaatttgcagggttattcttcaatataaattccctgatgttgagcaaagttggaacaactacctcaggttttcctgtagtacaaaatgtgtacaataaaatctgtgatacaagtacatgtactacaaccctcttaatatttataatgtgtttcctcaaaataaatattcttctgtactttaacagcttttattttctgaaagatctagtgacagtgattgcacttttaatacttttatttagtatgaactctctgatgtttaataagctgtgagaagatattactggcattaacaaaaatttttttttccagacagtctctctctgttgcccaggctagtgtaaatgctttcctttgcaataaggcatgagcactggttaaatgtttgtcacattgtttattacagtagttttctccagtatgagttatcttacctacaatcaagtgtgacagccacttaaaggctttgtcatattcttcacttttctaggatttctcatctgtacgatttcttttatattcagaaaagtctgaggtgttgccaaaagcattgtcacatctttcaggtttgtagagtctctcttgtgtatgaattagcttatgtctcttaagaattgaggatctattagaggctttcccacattcttcacacatgcatggtttctctccagtatgagttgtcttatatgtagtaagccttaaggactggttaagggcattgcaacattccacacaattgtaggaattccctccagtatgaattacatgaatgtttagtaaggattgaggaatagctaaaaggcttgccacattcttcagatttgtagggtttccctcctgtacaaattcccttatgttcagtaagcgttgagaattaattaatagttttgccacatttttcatatttgtagggtttttcctccagtatgaattcttttatgagtagtaaggtgtgaggaccagttgaagtctttatcacattcttcacatttgtagggcttctcaccagtatgaattctcttatgttccataaggtttgaggactggttgaagcctttgccacattcttctcatttgtagagtttctctccagcatgaattttcttatgtgtaggagggttgggaactgtttaaaagctttgccaaattcttcacatttttagaatttctctccagcatgaattttcttatgtttactaaagactgagaaccagctgaaggctttgccactttcttcacatttgtagggtttctctccagtatgaattttctatgataactgagggttgaggaccacttataggctttgccacattctttgcatttgtatggtttctctccagtatgaattaccttatgtttagtaaggattgagaacatactaaagcctttaccacattcttcacatttgtagggtgtctctccagtatgaattctcttatgttccataaggtttgaggaccagttgaaagcctcaccacattcttcacatttgtagggtttctctccagtatgaattttcttatgataactaagggttgagggccacttataggctttgccacattcttcacatttctagagtttctctccagtatgaattttcttatgtttactgaagactgataaccagctgaaggctttgccacattcttcacatttgtagggtttctctccagtatgaattaccttatgtttagtgaggattgagaacgtactaaaggctttgccacattcttcacatttgtagggtttctctccagtatgaattttcttgtgatatctaagggttgagggccacttataggctttgccacattcttcacatttgtagagtttctctccagtatgaattaccttatgttttgcaaggattgagaacataacaaagcctttgccacattcttcacatttgtagggtttctctacagtatgaattttcttatgataactaagggttgaggaccacttataggctttgccacattcttcacatttgtagggtttctctccagtatgaattaccttatgtttagtaaggattgagaacgtactaaagcttttgccacattcttcacatttgtagggtttctctccagtatgaattctcttatgttccataaggtttgaggaccagttgaaagctttgccacattcttcacatttgtagggttcctctccagcatgagttgccttatgttcagtaagtcttgagggccagctgaaggctttgccacattcttcacatttgtagggtttttctccagcatgagttgccttatgttcagtaaggcttgagggccagctgaaggctttgtcacattcttcacatttgtagggtgtctctccagtgtgaattttcttatgttccataaggtttgatgaccagttgaaagctttgccacattcttcacatttgtagggtttctctccagtatgaattaccttatgtttagtaaggattgagaatgtactaaagcctttgccacattcttcatatttgtaaggtttctcttcagtatgaattttcttatgataactaagggttgaggatgacttataggctttgccacatgcttcacatttgtagaatttctctccagcatgagttttcttatgtttactaaagactgacaaccagctgaaggctttgccacattcttcacatttgtagggtttctctccagtatgaattacctcatgtttagtaaggatggagaacatactaaaacctttgccacattcttcacatttgtagggtttctctccagtatgaattttcttatgataactaagggttgagggccatttataggctttgccacattcttcacatttgtagggtttctctccagtatgaattaccttatgtttagtaaggattgagaacttactaaaggctttgccacattctttacatttgtagggcttttctccagcatgaattgccttatgtgtagtaagggttgagaccttactaaaggttttgccacattcttcacatttgtagggtttctcatcagtatgaattctcttatgtttaataaggattgcagatcggttaaaagctttgccacattcttcacatttgtagggtttctctacagtatgaattttcttatgataactaagggttgaggaccacttataggctttgccacattcttcacatttgtagggtttctctccagtatgaattaccttatgtttagtaaggactgagaatgtactaaagcttttgccacattcttcacatttgtagggtttctctccagtatgaattctcttatgttccataaggtttgaggaccagttgaaagctttgccacattcttcacatttgtagggtttctctccagtatgaattaccttatgtttagtaaggattgagaacttactaaaggctttgccacattctttacatttgtagggcttctctccagcatgaattgccttatgtgtagtaagggttgagaccttaataaaggttttgccacattctttacatttgtagggcttctctccagcatgaattgccttatgtgtagtaagggttgagaccttactaaaggttttgccacattcttcacatttgtagggtttctcaccagtatgaattctcttatgtttaataagaattgcagattggttaaaagctttgccacattcttcacatttgtagggtttctctacagtatgaattttcttatgataactaagggttgaggaccacttataggctttgccacattcttcacatttgtagggtttctctccagtatgaattaccttatgtttagtaaggattgagaatgtactgaagcttttgccacattcttcacatttgtagggtttctctccagtatgaattctcttatgttccataaggtttgaggaccagttgaaagctttgccacattcttcacatttgtagggtttctctccagcatgagttgccttatcacattcttcacatttgtagggtttctctccattatgaattaccttatgtttagtaaggattgagaacatactaaagcctttgccacattcttcacatttgtagggtgtctctccagtgtgaattttcttatgttccataaggtttgaggaccagttgaaagctttgccacattcttcacatttgtagggtttctctccagtatgaatgacctcatgtttagtaaggattgagaacatactaaaacctttgccacattcttcacatttgtagggtttctctccagtatgaattttcttatgataactaagggttgagggccacttataggctttgccgcattcttcacatttgtagggtttctctccagtatgaattaccttatgtttagtaaggattgagaacttactaaaggctttgccacattctttacatttgtagggcttctctccagcatgaattgccttatgtgtaataagggttgagaccttactgaaggctttgccacattctttacatttgtagggcttctctccagcatgaattgccttatgtgtagtaagagtcgagaccttactaaaggctttgccacattcttcacatttgttgggtttctctccagtatgaattatcttatgtttagtaaggattgcagattggttaaaagccttgccacattcttcacatttgtaggatttctctccagtatgaattaccttatgtttagtaaggattgagaacttactaaaggctttgccacattctttacatctgtagggtttctctccagtatgagcactcttataataagtaagggttgaggaccagttaaaagctttgccaccttcttcacatttgtaggaattctctctagtataaattcttttatgttgagataggtgtgaaagcatgcaaaatgatctgacgtattctttacattgcaaatgtttctttccagtatgccttatcttatgtctgtttgaatttgaacatttatgaaagacatttgcatatttgccacgttgaaatactttgctctgtgtagttgtcaaactctggttaagtttattataaccttctttgtgcaccttacactcatccacattggtataaccaatttttaagtgtaaattctcatgtccacatttttcataccttctcaatatcactttttggaaagaatcttctatgccctgctctggccaaagatcttgagcaaaatgagaacatataactgaaaagaaataaaaatcacaaattagcctacttattagactcagataaatacagtttctaaatctaaactataaaattattcaaactacataagcaagatgacactgcaatatgacacaggccctaattcttcatagacatataaatctaataaaaacatatagaccgaaatacatatgtggataatttatacatgagttaagtgtgtgcagtgcctgaattaagctgaatgcagagtcacacagaaaaaaagaaaagtttgttaaatttacccagtacgactctttctgttcctcaatattacctagtaccttcagaactaaattgtcaacttctgtttgtgtttttttgttttgttttgttttgttctgtttttaaggaaagtaaaatattggcacaaaaaatttaatttatgtcttctacagccctttccacacactggtttctgtctcccatgacataaaatgctgaaagatatggtggtatacttagaaatgacagtttgagtctgctgagaccaaaggtaaatgcactgcagcagagcactgcagtcctgcagagagagaccagatgtaccaagtgattacttttcagaagaaagataaataatctctctcaactaaaagtaaatgcaaaacttcagacaagaaatctgaagatgtttgagaggcccacataatcttaacccagaccattgttttctgactatgccaggacaaagctacattataaattttgtgacaggtagcctttttaaatgtccaaatctcaaagattaaaatctatacaatatagggcaatataattccatcaaaaatattatacaattttcagaaagaacccattagcaatggatatactaattttaaaaactgaataacactcaatgagtgaaataggaacacaaaagtgtatagaaaatcagaaaaatgaggataagaacaaaaatgaccagtgaaatgtcaacaaaagatttgcagtccagaagaaaactgtgtgatatagtcaaagtccaaaaaaaaaaaaaaaaaaaaaaaaaaaagctatcaagtgagaataataccatcagcaactctgtcctgcctaatgggggaaaaaaaacaactttcaaaataactaaattcttaagaagtatattagcactgcatatgtcttccataagaaagatgccgaaagcagtttttaccactgaaaataacataatgtaagaaaacaacacctaatcatataaaaatacattattttctaggaaagacatgcacagacaaaaaattgaatttctagcattattctaatggtgcagaaaacatttttaattattctctaacatttaagagataaaagcataggaattattataaacatctgttaatgaatatacgacataaatcaataaacttagcaacatcggtgacaaatttaagagcagacataatagggaagaattttttatgcaaccaaagttaatttttcacctgattaaaatatattgttgtatttttaggttctatgcaatccccaaggtaccacacacacaaaatatctgtatacatacagaaaagaaaactaagatagtgaaagcatatccatacaaaaatcagacagaaacaaaggaagacagaaagagaaaatgagagacaagatgcaagaatcaaatagaataggtaataaaagtaactccttcactttcagaaaattatttaaatatatggaaagttaactttcaaatcaacagatatctaatagatttattaacatttattcttttgagacaaagttttacttttgttgcccaggctggagtgcaaagaccctatctcagctcacttgaacctctgcctcccaggttcaagtgattctcctgcctcagactcccaagtagctgggattacaggcatgcaccaccacacccagctaatttctgcattggtagtagagacagagttttaccatgttggccaggctggtcttgagctcctgacctcaggtgatctacctgcctcagcctcacaaagtgctgggattacaggcatgagccaccgtgcccaggctattaaaaaattttaaatatcaagatccaacttgcctttctacaagagtcagttgaaacctaatgttaaaaagactcaaagtggcaagatggaagtagacatttcatgcaaatattaatcaaatgagagcagaagaggtcaaaataatattacacaagctaaatcttaagtcaaagactcatattttataaaatgcactttacagtgaaactccaaagagacaaagaaagatattaaaaataatggattaactcagaacctgtgaaaacgttgaatacgtgtgtgtgtgtatcacacattaggattacaaatacagaaagcaaatactgacagaatagaagaaacacaaggagagcaatacaattatagtaggatattattacaccacactttctgtaataaaaatcaaaatagaggaggctgccaagatggccaaataggaacagctctggtctacagctcccagcgcgatcgacacagaaggtgggtgatttctgcgtttccaactgaggtactggtttcatctcattccaactggttgaacagtgggtgcggctccctgagggcaagccaaagcagggtgggatgtcgtctcccctgggaagtgcaacgggttggggaactccctctcctagccaaggtaagggtttagggactgtaccatgaagaaccgtgctctccagcccagatactgtgcttttcccatggtcttcgcagcctgcagaccaggagattccctctggtgcctatgacaccagggccctgggtttcaagcacaaaactgggtggccatttgagcagacaccaaactagctgcaggaggctttttttcccccataccccagtagtgcccagaagtccagtaagacagaaccgttcactcccctggaaagagggctgaagccagggagcaaagtggtctggcttggcagttcccacaaccagggagcccagccggctaagatccactggcttgaaattctggctgcaagcacagcagtccaagctccacctgggaagctcgagcttggtgggggaagggcgtccgccattgctgaggcttgagtaggcagctttaccctcagagtataaacaaagccacccggaagattgaactggatggagcccatcgcagctcagcaagaccagactgtatctcaagatgcctcctctttgggcagggcatctctgaaaaaaatgcagcagccacattcaggggcatatagataaaacgcccatctccctgggacagagcaccttggggaagggacagctgtgagtgcagcttcagcagacttaaacatccctgctggacaactctgaagagagcagtggaggtaccagctcagcatttgagctctgctaagggtcagactgccacctcaagtgggtccctgacacccgtgtctcctgattaagagacacctcccagtagaagctgatagacacctcgtacaagagagctctggctggcacatggcaggtggccttgggacgaagcttccagaggaaggaacaggcagcaatctttgctgttctgcagcctccgctggtgatacccaggcaaacagggtctagagtagacttccagaaagctccagcagatctgcagcagagaggcctgactgttaaaaggaaaactaacaaacagaaaggaatagaagtaacatctccaaaaggatgtttactcagaaaccccgtccaaaagtcatcaacatcaaagaccaaaggtagataaatccataaagatggggagaagccagtgcaaaaaggctgaaaattccaaaacccagaatgcctgttctcctccaaaggatcacaactcattgccagcaaagaaagaaaactgaatggagaatgagtttgacgaattgacagctcaaatttgacaaatttcagaggtgggttataacaaactcctccaaactaaaggagcatgttctaacccaatgccaggaagctaagaaccttgaaaaaaggttagatgaattgctaacgagaataaccagtttagagaacataaatgcctgatggagatgaaaaacacaccacgagaacttcatgaagcatacacaaatgtcaacagctgaatcgataaagcggaagaaaggatatcagagactgaagattaacttaatgaaataaagcaagaagacaagattagacaaaaaagaataaaaagaaatgaacaaagcctccaagaaatatgggactatgtgaaaagaccaaatctacatttaattcgggtacgtgaaagtgacagggagaatggaaccaagtaggaaaacactcttcaggatatcatccaggagaatgtccccaacatagcaagacaggccaacattcaaattcagaaaatacagagaacaccacaaagatgctcctcgagaagagcaaccccaagacacagaatcgtcagattcaccaaggttgaaatgaagaaaaaatgttgacggcagccagggagaaaggtcgggttacccataaagggaagcccatcagactaacagtggatttctctgcagaaaccctacaggccagaagagactggggggccaatattcaacattcttaaagaaaggaattttcaaccaagaatttcacatccagccaaactaaacttcataaatgaaggagaaataaaatcctttacagataagcaaatgctgagagattttgtcaccaccaggcctgccttacaagagctcctgaaggaagcactaaacataaaaaggaacaactggtaaaccagccactgcaaaaacataccaaattgtaaagatcattgacactatgaagaaactgcatcaactaatgggcaaaataaccagctagcgtcataatgacaggatcaaattcacacacaacaatattaaccttaaatgtaaacaggctaaatgccccaattaaaagacacagactggcaaattgaacagtcaagatccatcaaagtgctgtattcaggaaatccatctcacgtgcaaagacacatataggctcaaaataaagttatggaggaatatttaccaagcaaatggaaagcaaaagaaagcaggggttgcaattctagtctctgataaaacagactttaaaccaacaaagatcaaaagagacaaagatggtcattacataatggtaaagggatcaatgcaacaagatgagctaactatcctaaatatatatgcacccaatacaggagcaccgagaatcataaagcaagttcttacagacctacaaagagacttagatacccatactatagtagtgggagactttaatatcccagtgtcaatattagccagatcaatgacacaaaaaactaagaaggatattcaggacttgaactcagctctggaccaagcaaaccaaatagacatctacaggactctgccacaaatcaacagaatatacattcttctcggcaccacatcactcttaaattgacaacatacttggaagtaaaatactcctcagcaaattttaaaaaatggaaatcataacaaacagtctctcagagcacagtgcaatcaaatttgaactcaggattaagaaactcactcaaaactgtacaactacatggaaactgaacaacctgctcctgaatgattatagggtaaataataaaatgaaggcagaaataaaaaagttctttgaaaccaacaggaacaaagacacaacacaccagaatctccgggacacagacaaagcagtgtctagaaaatatatagcactaaatgcccacaaaagaaagcaagacagatctaaaattgacaccctaacatcacaatgaaaagaactagagaagcaagaataaacaaattcaaaccctagcagaagacaagaaataactaagaaaagagcagaactgaaggagatagacacaaaaaatccttcaaaaaaatcaatgaatccaggagctggttttttgaaaagattaacaaaatagactgctagccagtctaataaagaagaaaggagagaagaatcaaatagacacaatcaaaaataataaaggggacatcaccactgattccacagaaatacaaactaccatcagacaatactataaacatctctatacaaataaactagaaaatctaaaagaaatgaataaattcctggacacatacaccatcccaagtctaaatcaggaagaagtcaaatccctgaagagatcaataacgaattctgaaactgaggcagtaattatgagcctaacaaccaaaaatgtccaggacccgatggattcacaacctttgtaccagaggtacaaagaagagctgattctattatttctgaaactattcccaacaatggaaaaagagggactcctgtctaactcattttatgaggccagcatcatcctgataccaaaacctggcagagacacaacaaaaaaagaaaatttcaggccaatatccctgattaacatggatgcaaaaatcctcaataaaatactggcaaactgaatccagcagcacatcaaaaagcttatccaccaagatcaagtcaggttcatctgtgggatgcaaggctggttcaacatacacaaatcaataaacataatcgctcacataaacacaaccaatgacaaaaaccacatgattatctcaatagatgcataaaaggccttcaacaaaattgaacagccttcatgctaaaaacttgcaataaactaggtatagatggaacgtatctcaaaataataagagctatgtatgacaaactgacagacaatatcatactgaatggtcaaaaactggaagcattccctttgaaaactggcacaaaacagggatgctctctctcaccactcctattcaacatagtattggaagttctggtgagggcaatcaggcaagaaaaagaaataaaggatattcaaataggaaaagaggaaatcaaattgtctctatttgcagatgacatgattgtatatttagaaaaccccactgtctcagcccaagatctccctaaatggataagcaacttcagcaaagtctcagaatacaaaatcaatgagcaaaaatcacaagcattcctaaacaccaataatagccaaatcatgagtgaactcccattcacaattgctacaaagagaataaaatacctaggaatacaacttacaagggatgggaaggacctcttcaaggagaactacaaaccactgctcaagaaaataagagaggacacaaaaaatggaaaaactttccatggctgggcgcagtggctaacgtctgtaatcccaccattttgggaggccgagacgggtggatcatgaggtcaggagatcgagatcatcctggctaacactgtgaaaccccatctctactaaaaacacaaaaaaattagccgggcatggtggcaggcgcctgtagtcccagctactcgggaggctgaggcaggagaatggcgtgaacctgggaggtggagcttgcagtgagctgagatcgcaccactgcacttcagcctgggtgatagagcgagactccatctcaaaaaaaaaaaaaaaaaaggaagaacattccatgctcgtgcatagaaagaatcaatatcatgaaaatggccatactgcccaaggtaatttatagattcaatgctatccccatcaagctaccattgactttcttcacagaattagaaaaaaaaccgctttaaatttcatacagaaccaaaaaaaagctcatatagccaagacaatcctaagcaaaaagaacaaagctggaggcatcatgctacctgacttcaaattaccctatgaggctacagtaaacaaaacagtatggtactggtatcaaagcagatatatagaccaatggaacagaacaaaggcctcagaaataacaccacacatctacaaccatctgatctttgacaaacctgacaaaagcaagcaatgggaaaaggattccctatttaataaatggtgttgaaaaaactggctagccatatgcagaaaactgaaactggaccccttccttaaaccttatacaaaaattaactcaagatggattgaagatttaaatgtaacactgcaaaccataaaaaccgtagaagaaaacctagacaatactattcaggacataggcatgggcaaagacttcatgactaaaacaccaaaaacaatggcaacaaaagccaaaattgacaaatgaaacctaattaaactaagagcttctgcacagcaaaagaaactatcatcagagtgaacaggcaacctacagaatgggagaaaaattttgcaatctatccatctgacaaagggctaatatccaggatctacaaagaacttaaacaaatttacaagaaaaaaaaaccatcaaaaagtaggcaaaggatatgaacagacatttctcaaaaagacatttatgtggcaaacaaacatatgaaaaaaagcacatcatcactggtcattagagaaatgcaaatcaaaaccaaaatgagataccatctcatgccagttagaacggcgatcattgagaagtcaggaaacaacagatgctggagatgtggagaagtagaaaagcttttacactgctggttggagtgtaaattagttcagccattgtggaagacaatgtggcgattcctcaaggatctagaactagaaataccatttgacccagcaatcccattactgggtatatactcagaagattataaatcattctactataaaggcacatgaatacacatgttttttgcagcactattcacaatagcaaagacttggaaccaacccaaatgcccatcagtaatatacaggataaagaaaatgtggcacatatataccatggaatactaggcagccataaaaaaaaatgagttcatgtcctttccagggacatggatgaagctggaaatcatcattctcagcaaactaacacaagaacagaaaacgaaacacagcatgttctcactcataagtgggagttaacaatgagaacacagggacacaggaaggggaacatcacacaccagggcctgtcaaggggtgggggctaggggagggataacattaggagaaatacctaatgtagataacgagttgatgggtgcagcaaacccccatggcacgtgtatacctatgaaacaaacctgcacgttctgcacatgtaccccagaatttaaatcataatttaaaaaaacagaatattaataaggaaacaggctacataaagatggtataaaacaactatttctgacagaggtatagagagcactccttaacatcaggatacacacccttctgaatagctcatacaatatatttcttgatagaccacctcttaagccaaaaaagaagtcttaccaagttttttaaaactgaaattttatgaattattttctgtgactaaacttgaatgccagtatacaacaaaaatagaaaaaaactgaaaacaaaacaaatatgccaggtgcggtggctcatgcctgtaatcccagcaccttggaaggccaaggctggtgaatcacaaggtcaggagatcaagaccattctggccaacatggtgaaaccctgtctctactaaaatacaaaaaactagtgaggcttggtggcacgcacctgtagtcccagctactcaggaggctgaggcaggggaatcgcttgaacccaagaggtggaggttgcaatgagccgagataatgccattgcactccagcctggtgatagagtaagactctgtctcaaaaaaacaaaaacaaacaaacaaacaaaaaaaatatatatgaatttaacaaaacactcgagcatgctcttatgcaaaggttgtaatgttaatattgtaaagatgttcatcctattcaatgtaatctataaatttaatgaaatgtttttcaaatttctccttgcatttttgaaaaaatagaaactgcaaccctaaaagtatatagaatctcaaaagacaataaagtacccaacaatcttaaaataataataataaagcaatgttgcaggcattaaagttcctgatttcaaaagacattccaagccacagaattaaaacaatctggtataaggatgaaaaatcagactaaagaaatagaatgcgacacatatactttaacatgtatagtcatatgaggagtcatttacatagcaataattattactgtaagctagtaggtaaaggcaatgcaaatttctgtcaccaaatcattcagtaaatataatctgaaatataaatatactggaatatcactcagttttaaaaaagcagaaaatattctaccaattataacgataaatcttgataacattatgcaaaatgaaatgagtcagccacaaaaagacaaagattgtatgagatagagagatataaagcatttaaactcttagaaacagataaaaacaaaaaggtctcctatttgcttaacccccaacagcaagaaagtttgtcagtcatccgtgacaaaaatatcttaatgagggaaccaggcatcatggttaacatctgtaatgacagcaacatggtacagtaaggttggagaattgcttcaggacaaaattttaagaccaacctgggttatgtagtgaaaccccatctcaaaaataagtgcctttaagagagctttgagatccagggaggcaattgtgaaactttgctaaagcccaagattgaggagcacccttttcagcaggcaagctttcattcaagtggcaaactacaggacccctgctcttgactacagaccagaaaatgtcccacccaacttggtcccacggagaattttgaacttactctgtaaccatcccaaactcctcccagccacagtctgtgagaggtctttgtcttccagaagcctggagagagatacccatttagagccatgacggcaggccggcagaccttggtccttactgtggttccaataccagtttcatgactcagttccagtttcctaagccacggttcatggccacttctgcccatgtagaaacctacagtgacctcagaaatgctctctggtactcagtgaaaccatactaatccacatcctattataaagcccaccatacgcagacctgactgcagaaacctgccctagcatctgataccctactgagcaaagtcctgagggatatttactctgtccaaaaataaaatgggaattacaactaccaaagccccttatagtaagccaactctattgcagagccagcagccctgtgaccgagctacaaccctctgaaaccagtttataaaaactttaagaggtgtttactccttcaaattcatacaccaatgcaaaagtatattgtgttcattgtcaatgcttctattttaacacagcacttgaagtatgtggaagaaaaattagtcaaaaaaattttaatgtcattgaaattgaagacaaataagtaaaacattgctgtttgtaaatcatgcaatgttctctataaaaaaccataaacagtacattaaaaccttttcaaaccaataaatacactcagtaaattagcaaaatataaaattaacatacaagttatgtttccatacacttaaactatctgataaaatagagtaataaaacaatcttatttacaatagcactaaaataataaatatctgagaacaaatttaactgaggagttgaaaaagttttcaagtgcaagatttatcaatgaaaaataatgagaacacaaataaattcaaatacattttatgcctatcaattcaaagaataaatggtaaaatgccatattatccaaagtgatctctagattcaataaactctctatcaatattccagtgtttttttcacagtaatgaaaaatacaatcataaaatttacatgaaactacaagaaactgtgaatagccaaagcaatcttgaagaaaaagaaaaaagcagaaggacatcatactttataatttcaaactatatttcaagactacagtaataaaaacaggatgaaatgtacagaaaaatgaacaaaaaaaccccaaagatacagaaactactactctcacacatttcagagatgatggaaagagagaacttataagatagtttaacatggagtatcttaaaatcatgcagatatctgtgtgtccacaaaaacaaacaaacaaaaagattgtgcactctcttgtatgccatgaacagtactttggctgtcactgtaaacttgaaggaagattactgaagggaaagaagaattcttagaaattttaaaagtgtaagaccgaagatgcccctgtgtgagagaaaattaaagaataaaaataaaaattagtctctccagaaactacttcttttggaacacagcttccagaatcactttaaggactggcttcctccttgactttcgacctctcatccatgttgtctgtattcactctcacctacctggggattcttccaccatctcatgtctcttcatattccaggactcttttccttcctccagaaaaatgatcaggtctggcttaaaggcagcaatacctgttttattaaaaatgaacaacatgcttcttgctcatattctccaattaccaactcagtaatgtgctcagtaaagaggatgtaatagaatattctaatagatttatcccaaaatactaaattataataagttgggaaaaaggcttatggggtgcctgtataagctggccataaaaatatgggacaatatgttgtggaaagccacaggaggcctccgaggaggaaagcctccttactgccatcacgttcccatgaccagagcgtgacctgctctcttacttataaacactgtgctcaaggagaaagatactcctttgaagcactggaatgtggccagatatgcaggctcctagttaggcccaccccccaacagctgctctccggtaagttaaagaatgaatcagtagttaagtttattctgcttcagcacaaagaaactttgcctaaaccaccactgctatagattaggtgtatgacacactacctccctttcaccatttcacccctgaacatctgcttcttagatctaagtgattatactcaataaatactgtggagaccagaacttgatgccttttgcagcctccaaaagtgcaactggtcccctggcaccccaccctttgtgcactcttaacctgtctcttctcattccttcgtcgccaccggactttctgtaccctacaggtggtattgaagctggtccccaacaataacagaaatttctaaatatttagaaaattctctaattttgtaggttcttaattttatcacctagtaatactgaattaaaaattggtggttgccagtaaacttttgaaattaccattaatctaaagtgaaggacacagatcagctcaagaatgtggtaagttcaggtcaagatgaaacatcttgaattttttttctatatggaaaaactcctatgattttcttgaaaatagaaatctgaaagcataaattaccaaaaagaaattatacaaaaaagaaatggtgttgggagctgaaagcctgagggtcatgaccaactcagcattccactggaggctatatgataaacagcaaacagtttatcatgaatgcagaatgtgggcaaacttgcttctgctcctgccaccagaaggtacactgaggacagtcactccctggtgccatgctccttgaagttatctactggaacatctggagagtgctgttgaaagaatacagtcatgcaggccttcattaagtcaagcagctgaccacaacctcccccttctccctatctcctttactcaataaatacaaagggctatagaagctcaggacccttgttgactagaagcaaggaggcccctgaccccttcttccaaatatactcttttgtctttgtctttattctcacattcatcctccgttgttcagtccaataaggtctgcagcaaaatgaaacctgtagtgtatactaggaattgcgtattaaagttattctcacccaggaagaccaggtttctgtagttctctaacatcacatttctatataaattctgctgtgcagtgtccaggcattgccactcctccagagagaattctatggccacatccctaaatgtcaatgatccctggaaaacacaaacacacatatttatcaactggacatgggcagaatttttaatttgactcaaggtaaaatgcagagagtaaagagagctggttctgacttataagcatgactgaaattattcaataaaataatttttaacacaaatattctctaacatattctctctcttttttctttttttaattattattatacttcaagttttatggtacatgtgcagaatgcgcaggttaattacatatgtatacatgtgccatcctggtgtactgcacccattaactcgtcatttagcattaggtatatctcctaatgctatccctccccccaccccccaccccacaacagtccccagactgtgatgttccccttccggtgtccatgtgttctcattgttcaattcccatctatgagcaagaacatgcggtgtttggttttttgtccttgtgatagtttactgagaatgttccaatttcatccatgtcccaacaaaggacatgaactcatcattttttatggctgcatagtattccatggtatatatgtgccacattttcttaatccagtctgtcattgttggtcatttgggttggttccaagtctttgctattgtgaatagtgccgcaataaacatacgtgtgcatgtgtctttatagcagcatgatttatagtcctttggatatatacccagtaatgagatggctgggtcaaatgttatttctagttctagatccctgaggaattgccacatggacttccacaatggctgaactagtttacagtcccaccaacagtgtaaaagtgttcctatttctccacatcctctccagcacctgttgtttcctgcctttttaatgattgtcattctaactggtgtgagatggtatctcattgtggttttgatttgcattactctgatggccagtgatgatgagcattttttcatgtgttttttggctgcataaatatcttctttggagaagtgtctgttcatatcctttgcccactttttgatggggttgtttgtttttttcttgtaaattagtttgagttcactgtagattctggatattagccctttgtcagatgagtagtttgcgaaaattttctcctgttttgtaggttgcctgttcactctgatggtagtttcttttgctgtgcagaagctctttagttcaattagatcccatttgtcaattttggcttttgttgccattgctattggtgttttagacatgaagtccttgcccatgcctatgtcctgaatggtaatgcccaggttttcttctagggtttttatggttttaggtctaaagtttaagtctttaatccatcttgaattaatttttgtataagatgtgaggaagggatccagtttcagctttctacatatggctagccagttttcccagcaccatttattaaataaggaatcctttccccattacttctttttctcaggtttgtcaaagatcagatagttgtagatatccagcattatttctgagggctctgttctattccattgatctatatctctgatatctctgttttggtaccagtaccatgatgttttggttactgtagccttgtagtatagtttgaagtcaggtagcgtgatgcctccagctttgttcttttggcttaggattgacttggtgatgcaggctcttttttggttccatatgaattttaaagtagttttttccaattctgtgaagaaagtcattggtagcttgatggagatggcattgaatctataaattaccttgaatctataaaatacctagtatggccattttcacgatattgattcttcctacccatgagcatggaatgttcttccatttgtttgtatcctcttttatttcattgagcagtggtttgtagttctccttgaagaggtccttcacgtcccttctaagttggattcctaagtattttattctctttgaagcaattgtgaatgggagttcactatgatttggctctctgtttgtctgttattggtgtataagaatgcttgtgatttttgtacattgattttgtatcctgagactttgtcgaagttgcttatcagcttaaggagattttgggctgagacaatggagttttctagatatacaatcatgtcatctgcaaacagggacaatttgacttcctcttttcctaattgaataccctttatttccttctcctgcctaattgccctggtcagaacttccaacactatgttgaataggagtggtgagagagggcatccctgtcttgtgccagttttcaaagggaatgcttccagtttttgccgattcagtatgatattggctgtgagtttgtcatagatagctcttattattttgagatgcatcccatcaatacctaatttattgagagttttattctctaactctgataaaagaaagtggtataagatccataacatcagtttatatgtaatatttttctagataataaagtataaactgagggcataaacactaacatgtacaattttgagtgctatatttacatcatacagaattaattgtgtgccaggcatggtggcttatgcctgtaatcctagcactttgggaggctgaggcaggcagatcacctgaggtcgggagttcgagaccagcctgacaaacatggagaaaccctgtctccactaaaaacacaaaattagccaggcatggtggcgcatgcctgtaatcctagctactcaggaggctgaggcaggagaatcgcttgaacccgcgaggcagaggttgcggttagccgagatcatgccattgcactccagcttgggcaacaagagtgaaactccatctcaaaaaaaaaaaaaaaaaaagaatcaattgcatttttcaaatggaaagacatagttttgtgtattattcagatggaatagatgtgttgagttagaaggtatcactcaaattttaatgtgtacaacaagctagagatcctgttaatgcagattttttttttccagaagatctgagataaagtctgagttactgaatttctaataagctcataagtatgccaaagtttttggcccaaaaagactattttgtcaaatatccagtaattgaatgagcctgtgtttttctcagtttttctggtttgtaaacaaagatgagaggtttcattttccaaaaacagacaaatggaaaggaaacctaagaaagaagggcagcagccagattaaatgtgttggtttattcacatcagctgcataaagatacttgatgatgaagagaaaaataattaattctatagtgaaaaaatgtgtcagaaagcttatcaaccaagtgatttattaacatcaactacactagaacacatttttataatgtcctgatgcacccagaaggacgcagcattactgctgagatattgccccctgaaaggtaaattatagtctgagtttaaccataaggaaacattagttttatggaaagttcaagatacagatatctcccatgttctgtaatttttagtagtgattttaaatagtctttctttagcactgtagaaagcgggtatctcctaacaatttttaaagaattttctgggtaataaataccatactgcttcaatgagtgttttcttatcctgtactgcagagacataataaagaacacagatgaaaccacaacattatatgttctgtcttcactaaaaaccccaggttttccccaataggaattttgagtgtctacatcttcccatgttccacagccacaaagggacatttttaatattgcagattataaattcatagtgagatttctgcatggcatagaagaagccgtaatatagagaaggctctggtatacagaaaaaatatatatttttcagagactttgattattgtcagaattttttcaaatagttaagacaaactcattagggaggaaaaacacaaatacagaagtacaggtttgcaagtactaaacacatgttttctggaggaagcagactggacacagatcttgatctgagacatgtttagctgaaaaagaaaaggccatttttttctccttctcctccttctctaggattctttctcaaataaaattttctagacaaattacacctgcatcttgagaatatgcctttaaaagtgtcagcaccacaggtctacctgctgtcaccacatccacaggcagaaggaccaagacagaaaaactccatccatttctgtcctttatagccgaagagattaacaaagagtagctccacagagataaaaatatgcttttctttattttgtcctcaggagccatcccctgacacaggcaccagcaatttctgccacagtaatggaaatatgggccacgctgtactgtccctaccaaatccaaacagaattaggttcttggaccaccctttaatgcaaagatggaacttaactctcatgaatgtattttgaattcctcatacttgattctggcctcaccttagagtcacatgagccacttaattaaaacaacatggatgcttccaccaagaacaataaacagaatccatggacagggcacaagtaaaaagagttctgcaaaatggccaagtgatactaattagaagcctgggctgataactccttaagtaagcatttcctctcaagctctaatgagcttataaaatcacttggtaattttggccccactctatgaaatgtaattctgcaggtatggaaagggtccataaatgggtcttttaaacaaatgccctgtcaataatgatgttgctcccactgggcttattattagcattagtcagagaaatgaggcacaatgcagagtcccttacacgcagcactcttgtcaaaacacaaatacttctggtacaaatgaagacaatcattcttcatcctaaagtattatattctttgctgactctttaaagtttgcagaggaaaaaaaaaagcagcaatttctgagtaagtctgcatttggaaaacaacatgtgcacatgtactactacaatgtttattaagcaggtactatgtgctcaataggaagttacagagcactgtgatagcacattatgtgatttaatcctaataacaccctttcagttgatactaagtgttcaataattccaaggctttaaaggacccagcatttttatttctatttctgtttaactgtcattgattttttcaaaaaatgtatagaacaaaagctaaatatagacagatgaaagggatacagatggaaagagtttaatgcaatttagatacatttttattgtgtttatatttactttcttgtgacttgtgaatcaactactagatctggaggaacagaaaacaagctgctaaataaagtctcttcaagcactggttttaataaaaaatttgaaaagtaagatcctataatacatactttatatttcccatttatctgcttttaagtttcagaaaatgttgaacaccagctctaaaaaggcaacaggattcatgacccaaaactctgatctcttctaatcggttctttcaggcaagactccagggtagggccagacataaataaggcctccaaaaaagggtgaatatgaacagggctggggcagagtgtagagccgatgtacaattctgttctctatgccactggggggtactgtcagttcttttttttaagcttacttaagtaaacttaaatccgagtttgtataattttaatcttttttagccactgccctgtaaattttatattacatactaataagcaattcaaaaaaaaatcccttaaggttttctagaataatttttttagaagaaaaataagtattcttagcagggtaaaagaaatacaaataataataatgactcttccgtttataagttcaggtgtagacatcagaaaccacaatataaagaaagtggctcaaataaagcccaagttgttttttgtacatatctatttattgtacccaccatatgatccataattcaaccatttttccagttgctagtctagactacaacttccaggatggtagcaatcatgactgcttatctgtttttcttttctttttttttttttttgagactgagtctcactttgttgcccgggctgtggtgcgatggtgtgatctcagctcactgcagcctcctcctcccaggttcaagagattctcctgcctcagcctcccaagtagccaggactacaggcatgagccaccacacccagctaatttgggtatttttagtagagatgggatttcaccatgttggccaggctggtctcgaactcctgacctcaggtgatccacccatcttggcttcccaaagtgctgggattacaggtatgagacattgcacccagcctgtttcttctatttttttatgactatatgaaatggaagcaattagtttatctgtttgagcctccagacctcctgattttttacccaagtaccagggaactggaaaaactctcatctggctaccaaccagagatacttcttgtataacgggtgaaacaaacacgagatgactcatttctctcacactgggacagaagcagaattaatcactcttgtcagcctgacacaattctgttctggacattctccaatgtctcagagattcataggtaattgttagacggttccctgtgaacctgggctgatggtccaatgataagacaggcagagaagactcaggatgattctaaataaaaaaatggaactactttggctcaactccagaatccgggttgtccgtcctgatttgctagctgttgggtaagtagaaggacaagaagactctactccagtatcacattttacaggtaggtatagttgtggtcatggctctggatactttgtggtcttaagatgcttgtttacacttacagattctgccatcagattctatttactcctggagcctctcatataactgtggcaggttaatgaagaagatgtgaaaaggtcaaaaagccacactcccaaaaaaggaatttaaaatgtctatgttgatatctcacaatgcagaaaatgcctcctgttggttttctgtaaattctcaatccaaagtctggccctgccttgtaaatcccagcagaggccaggtcttatttgcaaattctaggtgaaatcaacctcactctgcatttttgggtgttacagcaagtagagtgaaatcaaaggagagattccctcctagaggctgctctaggatattctaaataatattttaccttaaaaaagctgacacaacatgaacataagcagacagtttatttgggtcaagcttaagtattttaacttgagacaaaatattcaagttgcctggaatctacactttcattagcagcacttacaagtggatttgtgaaggcaaaaaagaggaacagtgagtgagctgatacaaaattggttgtgagaaattcttatttatgtaaagaaataactttaataattgattggatatacatcattaaggttaaggatatggaatatagtgtccagtgtagaattattagtttaatttatagctacttgtggcaatagtgaacagtttcaatagataaatatatagctgaaaaaaaggagaaaaacgtaattgtgctctcattttaatgtttctctgactttagtaactaaaaggacttgcattcctcagataaaaacttatttttttcttttcaattctcaagacttagatttagaatacggagctgcaaattcaggtcctgcatgggtaaagtagcaataggtgttacctgaacatttgtgggcattttagcatgaggagggagggagaagtggattctcacgtctacaggtctactcagtgcacatattttactctgattgggtttctgtgccccatggtcactgaatcagtttcaggtctgaagacacaagtcattgaaagaggtaaaatggttaatatctgacctatgaagtttgtagaaatctgttctagcctctctaaaagtgactgcagaggatgatagataccaagtacgtagagacacaattccacctgcatatttagggtacagcatgcacttcacagcacaactgtgaattgactggaagcctgagtggaaaaggcccatctagagtaaagcttagttggcaccttatgtgtttgtattatgtctggtaattctagacaaggtttgggaaatataattagaagcacaattttcttcagccccagaggaactccacataacagaacagaaagaaaattgttttattacacaattacatgtgaatatgacatgcattatagtcaatttgctcaagagattgcaaagacagaaagacagtgaccataatttgtctacaagtagaatttacagcaccatgtcatacatagttcatcctaaattcacatggtagttgggaaggccatccatgtatgctaattggttataatcaatgacaaaataaacttttcacatcttcatgactggaggtagttttgcaacttgaaccccggtgcctactgaaggtaggctttgactcttctacaaaaagtgttgattcgggtgctatctttttggctatttacattttaaagcaatagctctctactccctgagcactgggctagagcactcctgctttccctctcttggtggctagtgtactctcttgaccccaccatctgccactgaggcacagcccacagcacagggctcacagctggaaactcacatcttaggtgaaccccatttgccacagcagcactccagtggcacatcagacagtgaagcctgagcagcaggaggagagcctgcaggcctcctgggtagaattgcaccttcacaataatagaaaagggagcactgtttcagcctcagtttttatttataatggtgacatgaaaaaaatactgctgggttttagcatgagtccagatagagacagctctgagagttctcactgtgacagctcacgtctttcacagacaccacgggatactaatagggcttctcaaacagacacacaatgcattagagagaaaaaactgctctcattctgagaaagattatgttgagagaaaaaagttaaaagtgtcttaagaaaaaactgagattagatataagattgatcaagtcagccagaaaatatttccctaagaagaatttctctccaaacacccaaagtgcatagctactctcagcaagggaaacatgagcattattgaataaagggggcacattctcagcaaaaaaaaaaattttttttttttgagatagagttccattcttttttttttttttttggacagagtctcactctgtcgcccaggctggagtgcagtggcgcgatctcggctcactgtaagctctgccttctgggttcacgccattctcctgcctcagcctcctgagtagctgggactatcggcgtgtgccaccacacccggctaatttttttttgtatttttagtagagatggagtttcaccatgttagccaagatggtctcgatctcctgacctcgtgatccacctgcctcggcctcccaagtgctgggattacaggcgtgagctgccacgcccggccaaggagtttcattcttgttgccctggctggagtgcaatggtgtgatctaggctcactacaacctctgcctcccgggttcaagcaattctcctgtctcagcctcccaaatgactgggactgtagacacacaccaccacacctggctaattctgttatttttggtagagacgaggtttcaccacattgtccaggctggtctcaaactcctgacctcaggtgatccaccccccttggcctcccaaaatgctgggattacaggcatgagccacagcgcccagctctcagcagaattttaaaagatttatcttccatctctgctgttctcttatttcctaaccattgaatgtgagatatattggaatatatctgacaacttccaccagcacttttttataaaaattgaaatctgactgtgttaatatagtagaatatattagagcttgcaacatagctaactggagagcaattacggtttttgggtagccatatcacttgtctttgtcctgtaatagtagcaagctaatttggtaaaatatatgacactaaaattatgctataattttatagcataattttatgctataattttatagcataattttatgctataatttataaattatatacctataatttattcccattggataaattaatatgcatgtcagactaatatctactataatgatttaatggtaaatttttttggatatcagatacaaatatgtaagtatgaataattttatgtactactcataatgtatgtaagattttaaaaaattatctgaactatacttcagttgaaacactatatttcaaaaatatgaataatattaaaataactaaggaattcaatctaagtaaatacgtggccttaaattcatactattgtagaaaatactgtttatatgaatgcaggttgtctacaaacactacacataactatactaactgtactgaagtaacccaagtacaacagactccactgttcagtctatacactgaactcttctggcttttgcagtgtaagtatgtcagccagcaaataatcaccctggataatcaggtttctgccaaagaacttactcaggatcttttagtctttattattctgtattgctaaatttaatccaatctttgtgctcaacttctttatgctcttgaaatgaactttactctgaacaaatttgtgtctactttaaagactaaagacaaaaaaaaaaccaatattttgccaagacaaaaagaaagcaatgaatctcaggtcccagataaagacaattctgagtcaaaaagaatgacaaatggtttgtgttattgctaatatgatttacatatatttcaaaaagcagaaaaaatatatacatataatctaaaccttttataaaaatcagcaagttatcctcccttattttcacatatgagaataaagcttcttatttctaatttatattttgtcttacaacagccaggtctctggacaagttcttgaactcttggacatctgaattttgcacactgtgtgcacttgaaagaatgtttatggggggaaaagcagaagagaggaaggtgttataaaaaaactccatgggttcacatgaataaagcaagttcttagagacctatgaagagactcagaatctgacacagtaataatcggagactacatctgacaagcactaatggacagatcattgaagaagaaaattaacaacaatattacgacttgaactcaacacttgaccaaacagtcctaatagacatctacagaactcttcatcgaaaaataccgtaatatatgttcttctcatcaccatgtggcacatactctaaaattgaccacacaatcagaaacaaaacaattctcagcaaattcaaaaatccgaaaattatacaaaccacacacacagattacagcttaagaaaaaaatgattcaataccaataaaacaactggaaactatacaattaaataaaaattaaatggcctacacttgaataactttttggtaaataatgaaattaaggcagaaaccaagaagtgttttgaaacaaataagaacaaaaatacaacacaccagaatccctgcaatacatctaaagcaatgttaaaagaaaaatttatagcattaaatccccagatcaaaaagttaaaaagatctcagtttaacaacctgacatcataaataaaagactgagagcaacaaaagcaaatcagcccctaagctagcaaaagacaagaaataaccaaaatcagatctgaactgaaggagatttagacatgaaaaattacaaaatatcaagagatccaggtataaaatctatttttttaaaaaaggtaaataaactactagctagattaatgaagaagatacaaataaacacaattagaaataaaaaaaagagacattagcactgaccccacaaaaatatactgaagtctgctatgcatataaacaaacaaacaaacgaaatctagaagaaatgaaaaaattcttgaacaaacacatcctcccaagactgaacacacacacacaaaaatcaaagccctgggctgagtgcggtggctcacacctgtaatcccagcactttgggaggctgaggtgggtggatcacctgaggtcaggagttcgagaccagcctcaacctggggaaaccccgtcactactaaaaatacaaaattacccaggcatagtggtgcatgcctgtaatctcagctactcgggaggctgaggcaggagaattgcttgaacctgggaggcggaggttgcggtgagccgagatcgagccattgcactccagcctaggcaacaagagcgaaactccatctcaaaacaaacaaacaaacaaacaaaaaatcaaagccctaaatacatagataagctcaaaatattgaattagtaataaatagcctaccaactaaatgaagctcaggaccagacatactcacagctgaattctaccagatgtacaaatagaagctgatattatttttactagaacaatttcaaaagattaaaaagaagaaactcctctccaactcattatgtaagaacagcatcattctgataccaaaacctaacagagataaaacaaaaaaaggcaacttcaggccaatatccttgaaaattgatgcaaaaatcttcaacaaaaggctgggcctggtggctcatgcctgtaatcccagaactttgggaggccaaggtgggccaatttcctgaggtcaggagttcaagaccagcctagccaacatgatgaaaccctgtctcttctaaaaacacacaaaaaattagctgggcatggtagcacacacctgtaatcccagctactcaagaggctgaggcaggagaatcacttgaacctgggaggcagaggttgcagtgagccaagattgcaccactacactccagcctggatgacacagtgagactccatcccaaaaaaaaaaaaaaaaaaaaaaaaaaaaagaaaaaagaaaagaaaagaaatcttcaacaaactactggcaaaccaaatccagcagcatatcaaaaagctaacccactatgatcaactatggtttattttggggatttaaggtttgctcaacatacagaaatcaataaatgtgattcatcacataaacagaattaaagacagaaagcacaagattatctcaatagatgcacaaaaagctttcaataaaatttaacatttttcatgttaaaaaccctcaacaaactaggcattgaagatgcatacgtcaaaatagtaagttatctatgacaaacccacagccaatatactgaatggacaaaacctggaagcattccttcttgaaaactggcacaagacaaggatgccttctctcaacactcctatattcaatataaaattggtagtcttagccagagcaatcaggcaaaagataaaaataaaaggcatccaaacataaagagaggaagtcaaactatccttatttgcaaacaacatgattctacatctggaaacccatatactctcagcagaaaagctctttaaactgacaaacaacttcagtaaagtctcaggatacaaaagaaatgtacaaaaattagtagcaaccctatatatcaagaacacctaggccaaatccgaatcgaaaacacaatcccattcacaactgccacagaaaagaataatatatctagaaatacagataaccagaaaggtaaaagatctctatgacaagaattacaaaacaatgcttaaagaagccagagatgacacaaacaaatggaaagcaactttatgctcatgaataaaaaagatcactatcataaaaatggtcatactgcttaaataaatttacagatgtaatgctaatttaatcaaaccaccaaaatatttttaacagaactaaaagaacaaactattttaaaattcacatggaaccaaaaaagagcctgaatagccaaggcaatcataagcaaaaacaacaaagctgaaggcattacattacctgacttcaaactacacaacagtgctacagtaaacaaagcaacatggtactggtacaaaaacaaactcataggtcaatgcaacagaatagggagcccagaaataatgccacacacctaaaaccatctgatcttcaacaaaggtgacaataggaatgtgggaagaatttcctatttaataaatggtgctagaataactagctagcactatgtagtagattttttataacaccatataaaaaaatcaactcaaggtaaataaaagacttaaatgttaatcttaaaaaggatatattttaaaaaaccctggaaggtaagaagtgccattctagacatagaaactggcaaagatttcatgatgaagatatgaaaagcaattgcaacaaaagcaaaaactgacaaatgggacctaattaaactttttcacagcaaaggaaactatcaacagagtaaacagacatcctacaaaataatagaaaatatttgcaaactatgcttctgacaaaggtctactatctagaatccataaggaactaaaacaagtttacaagaaaaaaaaactaaaaagaagaccaaaaaaaaacatgaaaaagacgtttgtcttcaaaaggagacaaacatgtggctaacaagcatgtaaaaaaatgctcatcactaatcattagagaaatgcaaaagaaaaccacaacaagaaatcatctcaaaccagtgagaatggccattattataattcaaccattgtgaaaagcagtgtggtgattcctcactaaactaaaaacaaattaccatttgacccagtaacctcacaattgggtatatacctaaaaatatataaattattctatcctaaagacacatgcacaatcacgttcattgcagcactattcacaacagcaaagacatggaatcaacctaaatgcctatcactggtagactagataaagaaaatatagtatggttgggcatgttggcacacgtctgtaatccagcacttcgggggatgagctaggtggattgcctgagctcaggggtttgagacaggcatggacaacatggcaaaatcccatctataaaaaaaaaagtacaaaaataaaaattagctaagcatggtggcacagactttagtcttagctacttgggaagcttaggtagaagaggattgcttgagcctgagaggttgaggtttcagtgagccaagatcacaccactgcactccagcctgggaaaaaggtgagaccctgtctccaaaaataacaaaaaaattaaaaactttattaataaacttaataaaaacaaaatatgggctgggtatggtggctcacacttgtaatcccagcactttgggaggccaaggcggcagatcacctgaagtaaggagttcgagactagcctggccaacgtggcaaaaccccatctatactaaaaatacaaaaattagctgagtatggtggcacacgcctgtaatcccagctactccagaggctgtggcagaattgcttgaacctgggaggtagaggttgcaatgcgccgagatcaagccactgcactccagcctgagtgacacagcaagattccatctcaaaccaaacaaacaaacaaatatggtacataaacaccatgaattcatgaaatactgagtggccataaacaacaacaacaaaaaaaacaagattatgtcctttgcagcaacatggatgaagctggagatcattattcttagaaaactgatgcggaaacagaaaaccaaatgcatgttattatttataagtaagagctaaataagaacacatgaacacagaggggaaaaaagacactgaggcctagtagagggtggagggtgggaggactaaaagggtcagaaaaagtacctttttggtgctatgattagtactgcagtgacaaaataatctgcacaccaaactcccatgacataattttagctgtataacaaagctgcatgtgtacccctgaaccaaccaaaaataaaagttaaaagaaaacaaagtccctgggttggagagagtgcaatgcaggtggaaggactggtttgtcctatagatagtggcccaggtggggctgtactctgatttatttctgggtccatgcaggcagataagattatgaaccctaggctggtggagaaaacaggttgctactgcagattcagtgtctgaaaatagagatatgccaggagacttgtagacacttttgtggtttttggccaaaaaaaccactaggatcaaaaatgctgtggtaaaattcctgagggtggtgccttgtccagagaggagtgtggacacatcaatgtcaagtgggtgtttgtgagtgggtagaaatcctctgctggcagctgtggcaaaagggggtttgtcatcagatctcttttaagttttcagtcctctgtcaccctgggaggagatctgaaatcaaagaacaaggggcagtgtgacagcctgtgtagaggagatcagagcttcccattcccagacacccagagtttcattccaggccaggagtctgtgatatctttcttctggcaccaaatctgcagagtttgatgaacaccaacaattctccaacagcaactcattgtctaacacttgaattctgacaccacccagagtcagcacagaccctgattcagggctcagtcccacaacattgtcctcactgcagatgccagtcacaaaccccatgggctcatctatgcttctgacctactgtttaaaaattggggactcccataacctttttgaaattcaataacctgatacagctactcacagaactcagcagaacactagttatacttactggcttcaaataaaatatacaacccccaaaaagtcaaatggaagaaaagtatagaaccaagaaaagaggtgggaaaagatgaagcatatagataataaatagccgggattagtaaaattctctatcctctgtgttctccaggaacacttatgaaaagaaaaacccttctcatcatgacttagatggtgctcttttcttacctactacacaaccaggaaaacactctgcatattttcttcttcttctcattaaaaaaatcagctgaatttgccttcagtggtcaacataaaataccttttaatcaaacttaagtttattttcttcccacaggctcctgaactctgagctactctcagtccgagccaccatacaacctcattttatgctactgcagattcagtgtctgaagaacactcctaagaacacactgacttcagggtaaaacattctctgatctaaaatctgattatttcacccttcatttaaacattcccctcaccttctttctaatcttatttgcttttccctaggaaaaaaagcccttttctacctaatctttgcaatccttaaagatcttatagttggtacttcctcctgttgtaatactcctttggaattcaattttttttttaatgtacgtctaactggtttattttaaaacctctcgaatctgcctcaaaacagtaacaatttactgtttaacaatttagggctagggttcagtttagggttaggtttagggttccgtaagacacccccaaacctcttctatcttaaccttaactgcatctgcctgtggggccccagctttccagggctctgtagcttctctcactatagaggcttcttccatggctgcggtaagcaggctgggacatctgcaggaaaggctttccagaaggaactaactgggcctttaataacctccgtctgctggctcaaaattaaccttagcttgcagtcattaggctcaagctttaatttaccatgtcagagtcattcacttagtttttgaaattgtgtttgaaaaatccagcaaaatgattcaaaaacagtgttcatataagaaaattttaaggtgcttaccttttgtacctcagtaagagaagcaaatgtatttatttcttttggacaataaagcattattttattttttgtattaaaaatcatgtggtaaacagttatatgggaacacttctaggaggtaccaagtttcatgacataaaatttaccattaaactcagaaatcgaaaaacaggatatagaacaaagatatttatttttgcaaattcaccctgcaagaaaagaaactgatgttttcacgaatctgtgtaactcaccaattacctaccgcattttcttgtggaaatatattaattctctatagccaaaatggaagaaaaatttttatttttttcctcagtagctaacattctaaaagctagatggaattctatttgaaatcactcagccataaaaaacacacctgagggccgggcacggtggctcatgcctgtaatcccagcactttaggaggccgaggcaggtggatcatgaggtcaggagattgagaccatcctggctaacacggtgaaaccccgtctctactaaaaatacaaaaaaatttgctgggcgtggtggcgggctcccactatttgggaggctaaggcaggagaagggcgtaaacctgggaggaggagcttgcagtgagatcccgccactgcactccaacctggggacagagcaagactctgtctccaaaaaaaaaaaaaaaaaaaaaaaaagtaacacctgaaaaaactcctaaattcactctgagaaaataaaagatgaatgagaattttcaacaaataaaatatataattagatattgttttttgaaattcacctttttttatgccctttgtaaatattttcttacctttcaagccctactaataaaatgcaatttacagttaaaaaactgaggtcagccgggcacaggggctcacacctgcaatcccagcactttgggaggccaaggcaggcagattacttgaggtcagaattttgagctcaaacagcacggtaaacatggcaaacccccatctctattaaaaatacaaaaagtagccaggtgtggtggcaggcacctgtagtcccagctacttgggaggctgaggcataagaatcacttgaactcgtgatgcagaggtttcagtgagccgagattgcaccactgcagtccagcctgggtgacagaggaaagcactgtcttaaaaaaaaaaaaaaaaaagggccgggcgcggtggctcacacctgtaatcccaccactttgggaggctgaggcagccagatcacaaggtcaggagttcgagaacagcctggtcaatatggtgaaattccgtctctaccacaaatacaaaaattagccgggtgtggtggtgcacacctgtagtcccagctactcaggaggctgaggcagaagaattgcttgaacccgggaggcagaggttgcagtgagcagagatcataccactgcactccagcctgggtgacagaatgagactctatctcaaaaaaaaaaaaaagaaaaaaaaaactgaggtcaaaataagtgaacaatgcatttaatcatttcaaggtacagatatgtctgactcatgtgtcaagtcaggccatccaattacttgagagattctcccaccccatcctgttcacttaagtgctcagtaaccattctctcaggagactctgaactatgccccagtgagtgccccaggtacattttactttgcaagttcttgcaccatctcactggggtcagtttttttttttgtctttggagtgctattttttttcacaaactttttaccatttttatttcactatttttctgtcccctaagagaatccaggggcaaaaattattttggtttccccttcaataccagcatctgattgtctgaacagcaatatgtctccaagaaatggaagctgcgttgggtaaagacaacactaatatctcaaggggttagctttccaaaaaaacagcacaccagaagatgcctctcagccccagggtattcacctgctctcttgagaggctacactccatatctcatgttgtgttatgggagaagagaggctacactgtgtacctcaggttgtcttatgggagaaaatgacccaggagctgatattcactagacgctctcgcagacatagccatggcgggtatcttagtttttccccagatagtactgaatctcaggtccaagaaaaaactgaagggtgtctgaggacacatctccctataaagtttccaaagggaaaccttgacccaaaacattctgatatctatgtctacggaaaacagaagaaaaaatatttacaaacagaaaacaaatctttttaaatgtgccatcaaatgctttgtcaaaaaatgattacaataggtatcaaaatgtaaactaaaggacaaatagttgatcatgtgaataagggaggggaaattggcgtttgggaatgtcagaaggaactggaaattaagtattttactgcaagccagagtcaggctggagaaatagggggtggcagatagacttgaggtcctgcttgggacacatgtgaaaaatgcaaggaaacagcaattccttgtggggtgtgaaaataattaagtggctggcagttagactgaggaggctctagtttctaatttctacttttaaaaaatctaattcggccaggcacggtggcttaccctgtaatcccagcactttgggaggccgaagcaggtgaatcacttgaaatcaggagttcgagaccagcctgaccaacatggtgaaaccccgtccctgttaaaaatgcaaagttagagggcatggtggtgcatgcctggaatcccagctacttggaagtctgaggcaggagaatcatttgaacctgggaggcggagattgcagtgagcccagatggcgccactgcactccagcctgggcgacagagtgagacttggtctcaaaaaaaaaaaaaaaaaatctaattcaaatgcattttttgtaaattactacattgggggaaaaaatttcaggcttaacacactataaactgccaattaacctctgattacataaccaagaaacttccatcttgatgttacaaattaagaaaccacaaggccgggcgcggtggcttacgcctataatcccagcattttgggatgccgaggcgggcggatcacgaggtcaggagatcgagaacatcctggctaacatggtgaaaccctttctcaactaaaaatacaaaaaagtaaccgagcgtggtggcgggcggctgtagtcccagctactcggaaggctgaggcagtggaatggcgtcaacccgggaggcggagcttgcagtgagacaagatcgtgccacagcactccagcctgggcgacagagggaagactccgtctcaaaaataaataaataaataaaacaaaacaagaaactacgtaactgtacctaaccaattattgaatgtggttttcctcgttatgcaccttataaaactctttccgtcaaaccccttcaatagaccattaactacaacccatagctgggtgctctacaattttggaatcactctttgattaaattctttaatatttttgaggtgacttccataaatttttaataggagaaaacaggaactgggagcctcacggaccaaagctcttcccattcatgaacccacaccccaagtcaggattctcctctcacgaccctctcatggtccctgcacatctgggagagactccgcgctgcgggtgcagagcggccccaagagggctccaggccagggcacaatcacagcgcagggaagagacaggacgcccggggaccgggtgtcagcgcagcctccatcttatggctgaaccggactgaggtcgagctaggcaagaactcggggcacagatgtggagctgactgcggggaggcctgagtcccgccacagccacttcccaccggttccaagcagcccgggccactctctcagtgtgtcggacccggcacactcaccatttctaggcttccagggggtcctggcgacttagttgtggatctcccaatacctgcaggtcatagggccacagaggctgggactctaggagcagaggacacacagcagtaaggacgagaccttgacctccggctgcagcgagagacaaaggaccgaccacatcccggaagccgacctgtcccctccagctgcctgcct

SEQ ID NO: 19 - DNA, 65550 bp, Homo Sapiens
agtgtgcaggcaggcgggggtgcgcggggcggtcagcgatctgcagcttcgcggggacagagatgtaacccaactcgttcacggatgttccgcgcgccgtgtcaccggctgcgggccaggggtactcggaaggcgcgggcaggagcctggcgaggatgcaccttcccctgccttggaaaggtagaactggggagtgcgggagggtggaggtggcccggaaaagaacacctcttcgcaaccaaaaaaaaaaaaaaaaaaaaaaaagaggaaatagaggaaaaatgtgttatttcaaccgccactcagaacccatcataattcagccagtcggtgtcatttttattgaattaaattttaaaaaagttttctttgatttccagagcgtttttgcgggaggaatatgttaaaacaaactcaagatacgaaatgagacttttgaagtgcctttgatttctgggtacggaaattcttttgataaagcgtgtgtacgttaagatttaggatgactttttttttcttttttgtaatacaggtctaatggaaatgacattctttatgaattagaacccaattatgttttaaagtttataataagtcaaatgattctctcagtccctatgtccgtattagtgaaattctatctccatattagcgaaatttgcatagatacacacctttttctttttgtcttttagtcttgctgcagtgtatcggacgagtttaaccagatatccagcactagccttctaacagtttctaactcagtggtgacattttttagttcttaactcccccaatccttcttagcctaacaaacctcttaattaaggtccatgaaagaccataaaccaacctgattatgcctttagcaaggctgtgttcacttaatctctaatcccatatcataaaagtccgctagtcactcctgacctccaggaacccacctaaccagggtggacactataagaaaacatgtgttttaatggaatgagaacttttttgagttgaagacacgctagcctcaggaagcagtgagctcaccatccctggagtgtgagtcaagcactagtcttggatgaccccttgataggaacgttgtagacaagattcaaatatcaaatagtatttggactagtgatttcaaagtctattccagacccctgtgaaactgtatttccaaccttggcatttctggatttccactaaattaagccactttccttgctcattagcatcttgtagagctgtgtggctatttgagcgcttgaatgtggctagtccaaattgagatgtgctatatgagataaacaccacgtttccaagaattagtatgaagagaaaatgttaaatatttcattaataattttaatattgattacctattgaaataatattttgtcatattgggctaaataaaatatattattaaaatgaatttcatctattccattttacttttttagtggagttactagacaatttacagatgtgtctcaaattatatttctattggacattactgttcaagactatcacctgtggtaacttgaggccccatctttaaaagtggtgactattaatactgaggagtaggtggtaacttctagctgccatcctaacttctcaaattaaagtgagacccaaactcagcctctgaaagctttattatttatttatttatttattcttcttcttattttttttaaaagatagagtctccctgtcatccaggctggagtgcagtggtgtggtcatgtctcactgcaacctccaactcctgggctcatgcaatcctcccaactcagcctccagaatcactgcaattacatgtgtgctctgaaaccttttttttttttttttttaactttgtagagagtcttgctgcgttgcccaggctggtcttgaacttctggcctcaaatgattctcctgccttggcctcccaaagtgctgagatgacaggcatgagccaccatacctagcatctctgaaacctttaaatagaattctgccaacatctaacacctactgtttaatctttaattaattaattaattaatttttcttttaaagacaggtctcactctgtcacacaggctggagtgcagtgggcatgagcatggctcactgcagcctcaagctcctgggctcaggagatcctctacttcagcctcccatgtagctggactacagatgtgtgccaccacatccagcagttttttttttacttttgtagagatggggtcttgctatgttgaccaggctggtattgaatgcctgacttcaaggaatcctcacaccttggcctcccaaagtggtgggattacaggtgtgagccactgagcccagcctgtttaatacttaatgtagggttcaagcccagactatgggaatatagtatagatatgtctgatgaactcagacttggtcaccacagcttttcacattatggcaataggaagactggaggccggacacattggcttacacctgtaatccgcacactttgggaggctgaggcgggcagatcgcttgaactcaggagttctggaccagcctgggcaacatggtgaaaccccgtttctacaaaaaacaaaaaaaaatttaaccaggtgtggtggtgctgcctgtagtcccagctactcaggaagctgaggtgggaggattgcttgagcctggaaggctgaggttgcagtgagccgagatcatgccactgcatgctggcctgggcaacagtgagaccctgtctcaaaaaaaaaaaaaaaaaaaaaaaaaagagagagaaagaaaagaaagaaagagaaagattggaaactccaatatgttagttgtgactctgccaaaaaaaactatttagaccccacacaaaacctgcacaggcagagcctcactgcgactcttcaggagataggaagaaagtggggagacagagcagtatgctcattctaagattgggtctctagcagaagcctgcacaatgaaaaagtataccatattcttggatgggaacacccaacatgacaaagatggcagtcctccctaattcatctgcacctctttacactaaattctgataataggttctgatcatcctgtttcgttcctttgttgtagcagtctgtccactcaggaccataatataattactgtaaatttggaatatgtttgaattgctggtgggccgagtcctccacatctcgatgggtccctttactcctttttttcccccagaatgttcctgttttcttttgcttgccattttccccatgtggatttaaaatgaatttgtctagttttaaatataattctgtcggcattaaaaaaaaaaataaagtgggattcttatctcacacatcaggataaattcctgaagaattaaagaggatgaagtagaaagaaatgaaaccatagacatgcaaggagaaacctcaaaggatttttaaaaaaatctcagagttggggaaagactttctgagtacgacaataaacatagaattcataagatgtaatttttttttctttttggtagagacaggatctctctacgttgcctaggctggtcttgaacgcctggcctcaagtgatactcctgccttggtctccaaaagtgttgagattacagttgtgagccactgtgctcagctgggaggagctcttgcggccaggattttaagaccagcttggacaacgtagcaagacctgtttctaaaaaataaaaataaatagttaagctattctggaggctgaggcaaggggattgctctatcccaggagttcagggccgcagctcaggctacagtgagctatgattttactactgcactccagcctggcagctctaaaaaaataaaataataataataataatataaaaataatttaaaaagcaatggtttaaatggtaatttgtatcttacttgtatttaaccacaataaaaaagaatatacaactactgggacatttttttttgagaccaggtctcactctgttacctaggctggagtgcaatgactcattgcagcctcgacctcctgggctcaagtgatccccctgccttagcctcccaagtagctagggctgtaggtgcacaccaccatgcccagctaactttgtgtgtgtgtgtgtgtgtgtgtgtgtgtgtgtgtgtgtgtgtgtgtgtgtgagagagagagagagagagacagacaggttcttgctatgttgtccaggctggtattgaactcctagtctcaagtgatcttcctgccttagcctcccaaagtgctgaaattacaggcatgagccatcatgcctggctcactggaaaaatttaaagttcatccatggtatgtctaaaagaatctcacacagtgtactgggccatattatttgtgagatgctgtagtggttcaatttcaggctctggaatcctactgcctgggtttgagtccagttactgaactgccatttgcaagttacttcaccttttaaagattttatttcggccaggcatggtggctcacacctgtaatgccagcactttgggaggccagggcgggcagatcacttgaggtcaggaattggagaccagtctggacaacatggtgaaaccccatctctactaaaaatacaaaaattagccgggcgtggtggcaggcacctgtaatcccagctactggagaggctgaggcaggagaatcgcttgaacctgggaggcagaggttgcagtgagctgagatcatgccattgtgctccagcctgggggacgagattgagacttcctctaaaaaaaaaaaaaaaaaagaaagaaagaaaaaagttttttttttttttgtctatataatgaggatgcttataactctcatagggtattaaaagtattcgatggaataatgtatgtgttgtatttagcccaatacatggtatataataatgaccattacatatttgtaaacaatcaaattggccaggcacagtggctcacgcctgtaatcccagcactttgggaggccgaggcaggcggatcacaaggtcaggagatcgagaccatcttggctaacacggtgaaaccccgtctctactaaaaataaaaaaaattagccgggcgtggtggcgggcgcctgtagtcccagctactcgggaggctgaggcaggagaatggcgtgaacccgggaggcggagcttgcagtgggccgagatcgcaccactgcactccagcctgggcgacagagcaagacgccatctcaaaaaaacaaacaaacaaacaaacaaaaaatcaaattaatggggatatccagtttttattttgtcttctcccagtaaccacagccagtactatgttaaccttgtcaatatgtcttattatttttaattactgctgatactaccattaagaaaaacaaatattttaaattggcatttaataaagagaattagatatgcaaaaacagttaaaatggtaaattttatgtatttttaccacaataaaatctttttaaggcacttgttgaatttagtgtcacttccaatgatttctgaaaggacttggtatagatttatttgtggtaataaatcagtagcacatacacccacatacatatgcaatgacaaattgggaaaaatgtttgcaacccacatatcacagggttaatttccccaataaataaagagtttctacaaatccatgaagaaaacacaaaccagtagaaaaataagcaaaggatatgaacacagttatcggaaaagaaaatatgaaaggcttttaataaatgaaaacatgctcaattgtagactattgggatataaaccatatacagaatatataaatatagggaaattgaggcactcagatacaaagacggccattattctttcttgacagtttaatccttgcttccctcctttctacctaagggttagtgatatttttccagcttcattggtgaccaaagaagcaaagagtttgcatgcgtggaagccacgaccgtctttcaggttcagtgtaaaatccctcccatccaaataatgttatctttagcttagtggcatctccttactttgtacatagaaatcccccgaatcagcctcttaaggccagcacaactataagtatgtaagaggctgatgctctcaacacatccccatccattcctgcttttaagtttaatgcctgtacgttgctggtgataccagtctctccaaaaccatcaccttattctggcttttcgttcaagctctctattctcttttaaaagcctcatgaagagttgattacatgataaacataaattgtctaattagtagagagaaactatgctatgcaataaatggtgttaggttacagctaaccgtttggagaaaaatattaaatctcccttacatacacacacattttatatactgcgcatttaaaatgtatgtacttttcagctgggcgccgtgattgttaattactgctgttattaccgttaagaaaaataaatattttaaattggcatttaataaagagattcaaatatgcaaaaacagttaaaatggtttggtcttaatgtgttatggaaactttacacctgtaatcccaggactttgggaggctgaggcgagaggatcacttgaggtcaggagtttgagaccagcctggccaacatggcgaaaccccgtctctactaaaagtacaaaaattagccaggtgtggtggtgcatgcctgtgatcccatctacttgggaggctgaggcaggagaatcgcttaaacctgggaggcggaggttgaagtgagcagagattacactactgcactccactccagcctaggcaacagagtgagactctgtctcaaaaaaaaaaaaaaaagaaaagaaaaaagaaaaagaaaaagcatgtacttttctacgaatttaattttgagaaataatcagacgtatgactaaagatatatttatcaaagtaatcactataatgttaaatattagattttaaaaagaacaaaagagtaaacaaccaaataaaaaccctttagatgtagggttacagaattgattatttgattgaactaaccatagtatatgcaagaagggtacaaattatagccattaaaacaccctgggtagctttatatgtattaacagttatatatcttggctgggcagggtggctcatgcctgtaatcccagcactttgggagaccgagagaggcagatggataaagcccaggagtttgagaccagcctgggcaacgtggtgaaactccatctctacaaaaaacaccaaaaaaaaaaaaaaaattagctggatatggtggcacaggcctgtagtcacagctactcagaaggttgaggtaggaggatcacctaagaaaggaggtctagactgcagtgagctgtgatcacgccactgcactccagcctgggtggcagaacaagactgtctcaaaaaaaaaaaagttatatggcttaatgttaaagtttccatagcacattaagaccaaaagcaggcacagaacagtatctatggtatgaatgtatttttgtgaaaaatttaaaaattcacatgtatataggcatacaattgaaggttacccaccacattaacatctgtagttcctatttctgagggcaggattatgaagagactttcccttaaacatttatgtactgtttgcatttttaacagtagattttaacaaggaaaaaaccatgaaggtatttcaattttttttctttttttttgagacagagtttcgctctgttgccgaggctagagtgcagtggcacgatctcggctcactgcaaccttcgcctcctgggttcaagcaattctcctgcctcagcctcctgagtagctgggattacagatgagtgccaccacacccagctaattttttgtatttttagtagagacagggtttctccatgttggccaggttgatctcaaactcctgacctcaggtgatctgccctcctctgtcccccaaagtgttgggattacaggcgtgagccaccgcgcccagccggtatttcaaatttgaaataattatttttacaatttcttgaacatggaatcagagtttttatgtctcacatacggtctcattcttttcggacattagcagagcacaaggcatttctttaataatttttcctccatttttctatctaacttcagatgccattaaatctgtacatgagttatgaggagtgtatgcatgtttgtgtacatggtttggcttctggggcacataaatgaggtataaatattatccccattaactcaaggatatcttaacaaaccatggaaaattgaggttattccatctttttgccatatgggattttactggtaacatgatcccaaaactcacattccttgatctttggcacttggcacactcagggaatccgcctgggaattcaccagatcaactccctgccttagattagttacttaggacatagtgctgggaaaatagttttacatttcaagttagccgactaatctttggctgtccctctccatgtgactgacctggggcaaatcttagaatctcagaatattggctatgggagaccactgtatcgattctttccattttgcagatgagaatattctaattcttgatttcctgtaaagtggggaagttaaacgaagatgatttatagattccttctggcttacagctctgtgattcttgtttcctagtcaagatcacacattccatccctgtggatcaggttatttttcagggaagctagagtcctgatttttggccacaaaccacatattcagaatcaaaagaagatgatcttataatagcgtaggctgaacaataaacgtttataatctcactagaaaaaaagcacgtgaatgtgtaacctaatggttgcttagtagtgccagatattgctgcattgtcgcgtgcagtctctgggagcctttactaaggccaggctctgtgggcttcaaggtcacaaacaggagcgctggcctcctggagctccacaaggcgtcacagctgtaattattccatggaatttaggtgagtgttgtgaaggatgagtgccatgaagggacctcagagcttctgcttcatgctgtagcagtttggatcccagacaaggtgactaactgaggaagcaagcaggggctaaaatcgaaactctttccccaagccagcctgtgtttactgaaaagaaaagggcctttaaaaatccaccaacactccctttagctgagcagccacttatagtcccagctactcgggagtttgaggtggaaggatcccttgagcccaggagttccagtccacctgagcaacagaacaagaccccatctctaaaacaaacaaacaaacaaaataaaaaatgccattccatccccctcacctgcagtgccttcccctatgttccagtggctgcctgtaggatgctgtaagagtttgaaacaggggccctgacctagagcgagggttagagaatccctcctaaagaaatgactttcaagttgagacctggaagctgagcatgagttaaccagttgaaaggaggaaaggaaggagagtgagccaagcagaacacagtccaaggctgcaagtcagagaagagctttgaaagaatgtgcttgtggctggggggcagtgagccaatggcagaaggaatgagtgctgtggctggagtgatgggctttttaagccacattaggaattttggactttaagtgcaatgggaagccactggataatttaaaggtgacttggcaggcacagtggctgatgcctgcaatctcagtgctttgggaggccaaagtggattgcttgggaggccgaagaggatcattcgaggttaggcatcgaagacctgcctggacaatgtgaggcctcatttctacaataaataaataaataaataaataagccaggcatggtggtgagcacctgtagtcatacctacttgggaagctgaagcaggaggatcgcttgggcccaggaattcacagttttagtgagctataatccaccactgccactcaggcctgggtgacagagtgagatcttgtctctaaactaaaataaaataagctcacacctgtaatgtcagcactttgagaagctgaggcaggtggatcacttgaacccagcctgggtaccatggcaaaaccccatctctactaaaaatacaaacaactaggctgggagcagtggttcatgcctgtaatcccagcattttgggaggctgaggcgggtggatcactcaggagttcaagactggcctggccagcctggtgaaaccccgtctctactaaaaatacaaaaaattaggtgagcgtggtggtgtgtgcctgtaatcccagctactcgagaggctgaggcaggagaactgcttgaacccaggaggaggaggttgcggtgagccaagatcacgccactgcactccagcctgggcaataagagtgagagtctgtctcaaaaaaaacaaaacaaaacaaaaaaactagctgggcatggtggtgtgcacctgtagtcccagctacttgggaggctgaggtgggagaatcacctgagcctgggaggtcaaggctatagtgagccatgatcacgccactgcactccagcctgggtgacagactgagaccctgtctcaaaagaataaataaataaaataaaataagagagtgacttgagcagcttcaaataaattttattgtttcctcactttatctaatattaattgaaatccttagtcttatgttggggttatcccaataggacgtgggaaagaaagttcaagctttcgccttgatagttctccatgatgctgcttaacataaacaatcgagttttcaaaaaccaaaactcttgatttcattaagtaaggagggtgtaatgtgtagtgcttgggccgttagaggggatgtggtcacaagtggtatatctgaggcttttgaaggagtgcattcaaggaagagccctgcttggtgtcagctactgaaccagagatccgaagaagtggacctcgccagcctcctgctccaccccgctaccagtcttagctggagctcccttttctttgtcatactcagccagttgctcattgctgttttagagtctggcccatgttttgctctttggctgtgcgattggcgtgaatcttctaagcaaatgaatagcttagaggtgaatactgaatcttttgcttcaagtagctcagcatttttgtctttcatttttactaagtgactagattcagtattcgaagatgttttggccaaatgattcattatttatttggctttagaaagagacttcaaaaggataatagaaataaacaacccagaggttttttttttaaattgaagattaataaaagagagacctctgctggctacagtggggtaacaacctagagttggccactgactccacaggaagctataatggctgtgacccaccccatacgcttttacagttgtcagcaaattgatcactatttgttcacttcttcagcaatcaactcaagttcttttggagttcattgaagtgaggtataattcccagtccaatcaccactgtttctgtttcaatctttaggaaaagtattagtcttttatatttctcgaacataatagctttacatatgagcccctgccaaactgagacctgaaataattcctgcatcttaccttctctgtttcctttccccttttttgcctccacctctcctcctccccttctccagtaaaacaaaataaaacaaatctacactcaagagagagtactgatagaaagtgagaaggagggagctgggcgcttatctttggcatatcctcagctgaggatccaagctggggggcccagggttggtgttaactacctgagtagagctgtagttcctactgatgtcttccgtgggatttgttcaaccgtgggaatgtggctgcacgatagtggagcaagattcagtgaatgcttcagaatatggagggtcgttatctagggggaggaaggggactgaatgttctcttgagaccttttgttggcaacaacaataatgagtgcctactatgtgccaggccctggactaagtaccttaaataccttaattctgtttcctgcttttcttctctcttcacagtcttaagaatgtctttctatgagaaaaacattgaatatatgtaaagaacttacaacaaggcctgcataaagtagtagctatgcatgtgttcactattttattattatgtttttactctggaatatgctgccactcctacacatgaggagaggctctccccatactcaccagagcaagcaagtccttttttttttttttttttttaagacacatggagtcttgctctattgcccaggctgcagtgcagtggcatgatcatggctcactgcagcctcgacctcttgggctcaggcagtcctcctgcctcagcctcctgagtagctgggactgcaggtgtatgccaccacacctggctaattttaaattttttagagatggggtctcactatgttgccctggctggtcttgaactcctttgctcaagcagtcctcccaacttagcctcccaaatcattgggatgagaagcatgaaccactgtgcctggttaattacatagatatttacatatctactatcttaaaacggtgtccttttaagaatttcaaatgatgctttatagtttctaatatggtgcactgggtatactgttgatatttaaagttttgtgaatgataaatttccctacttcagtagtgccatagaattaattgattcttgtatctgaaatttaatgagtgcttatgaagtatgctggactgtgctaggttctgacagcatttgaaaagaagtttgacatctgcctgtctgtccccttttggctgcctatgaggtgtgtaagatggctgcaatttgaggaggcatcctttgttcctgaggatagaaggtgcattgtggagtagaaagatacaggaactataggcgatgccacaccaactctgtgccacttatctccagaattcctgtacagaaaagaaaagtacacttttatcttgtttaagccactatgatttctgggctctgttactagctgccaaatgcaaatcttaacagatacagaagtccttgaggatttttgagcaaggaactgactgtaaaactggtggctctgcaagggacagatttggggaggggggtgttctggagaatcctaagagataaagttggcttggtaggtggggacagatagtaggggagactgaatgcggagaatacacatcttgcacaggtcactgaattttgtttctttttcccaggacacctctgctaaactcctatttttaccgtggttatttaaatatgtggttattgaggaatttgtattctgctatcgtcaagtggcctgaaagccagggagatcgagaagatgagtgttctttgtgctttaaaaagaagcaggcaaaagctggaacgggaaagagtatcagtgttacagtgaagtgaagttactatgttttctgaactcctgcaagcattttcaaggaaaggaatgtttgttacaggtgattgtctaatcaagatacatttgaaatgtatcctttactggatagcaactgtaaacaatatttaaaaaatatatctcagagtgacttgcagagtaaagataatttcatatgctaaaatttctaaaaggagaaaaaccttttttattaactttaatgttcatataatcacattgagtaatggctatttttttcctagtgaacttttcattttaggttgggcaggtaattttatacctttaattacatgggtcttaaaaatatgatcctatagccataactgaatattataagcttgggtactttatgtttcatctttcattaaggagtatatttctcagatcctaccagatcctacttttttttttttttttttgagacagagtctcactctgtcacctaggctggagtgcagtggtgctatcttggcttactgtaacctctgcctcccaggttcaagcagttctccagcctcagcctcctgtgtagctgggactacaggtgtgcactgccacatccggctaattttttttttttttttgggatggagactcactctgttgcccaggccagagtacagtggtgtgatctcaggtcactgcaacctctgcctcccaggttcaagcgattctcctgcatcagcctcctgagtagttgggactacaggtgcgtgccactacgcctggctaattttttgtatgtttagtagagatggggtttcaccgtgttagccaggatggtcttgatctcctgacctcgtgatccgcctgcctcagcctcccaaagtgctgggattacaggtgtgagccaccacacccagcctaatttttgtatttttagcagagacggggtttcaccatattggccaggctggtcttgaactcctgacctcaggtgatctgctggccttggcctcccaaggtgctgggattacaggcatgagccactgtacccggccctcagatcttattttctatggacaccctactttgcttcagccctgaggtcccagctgccccattcaacatttttaccttccttttctgcattgtcctaacctttaggaaatctgaaccccagtagttgactgtcttctgaactaggtgaacctaatatcccaatctctctgtttccctaaaaatgggttggcaattctaaagttcctttcaaacctggttggacagataattataagccttaatgcaatgacaaatttcaaggtccctccaggcagtgactttcagccttccctctacacatggaaaggaatgtgcccagtattacctgaaaattcttactaggttttgcctcaaaacgtaatatttggaatctttttttataattttcccactacagactggagacaatccatatattactattaaaattgagttgcggctgggcacggtggctcacgcctgtaatcccagcactttgggaggctgaggcaggaggctattcagtattacctggaaatcagaatgccaattactcaataaccatgtatttaaatagccatgatgaaacaggaatttagcagaggttacctgggaaaaaaacaaacccattaattatgtctctcaaagtccttgtaccttttgtaacttttttgtacctcttaccaagaaaaaaaaaattgtatctccctacctttccctccccatttggaaaaagtaccctagaatgcaagagactgaacatcaggttgtaacctggactatctgttgcaaactgtcatactttttttacgaacttgaaacattttagagatagggtcttgctctgtcgccctggctggagggcagtggcaccatcataggtcactacagtctcaaactcctgggctcaagtgatcctcccatttcagcctcctgagtagctgaggctacaggcatgtgccaccacacccagctaatttagaacatttttctttttttgtagagacaaggtattgttatgttgtctaggctggtcttgaactcctgacctcaagcagtactcctgcctcagcctcccaaagtgctgaattacaggcatgagccattgtgcccggccccaacccagtttttattgcaacgtggattgtctacagtttatagtgtgaaaaagtataaaaaatgattcccaattttaggttttgagttatagctccctgaagttcctgggttgcattttgctacagtctgcacacaagaaaaacaaaacaaaacaagacacacagtctgatacgcagagagatgttctctctgtacagttatataataacaatagctaacatttgtggagcactcagtgtgtgctaagccactcatctacattgtttcctttaatcctgagattaaataaattctgagaagtagctgtaatgataaggaaactgagccttggagctgtagctcaacatcacacaaggcagctgagtctgggctcaaattcaggccttggggctgtcctgtcattcttataaataatctcaacaggaagaaggccagcaggctcagtgtgacactcgatcctaaattattctctttcactttctgcccgattaaaagaccatatggtaattaaatatttctggccagcaatgtcttgccatttattgaaaaataataccacaatatctctaataattgtttcattaaaaacaagaacagagccccagctatgtccggaatggctctaagaacatctttctacttctctgcaccttagtctctcctgaggcaagatggaaagaacaaaattacgaggttgctttggcaaaaaaaaaggaacaatggatattactttattaggactaggagccactttttatggcaggttgcaactgtcaaaggacattttagggtcgagaagcccccttgcaaaggacaaaagatgtccatggtaagaaaagcacggaaggcccaagggaaaagttttaaaatgagctttgcctctaagcctcctttgatgctcacctccatatcgattcaggcatttctcaaaggccaccttcttccaaggtagataagagggccctggtcggccgggcacggtggctcacgcctgtaatcccagcactttgggaggccgaggtgggtggatcacaaggtcaggagttcaagaccagcctggccaagatggtgaaaccctatctctactaaaaattcaaaaattagctgggtgtggtggcaggtgcctgtgatcccagctactcaggaggctgaggcagagaattgcttgaacctgggaggcggaggttccagtgagctgagatcgcgccactgcactccagcctgggcgacagagcaagactccatctaaaaaaaaaaaaaaaggccctggtcagggtctcactctgtcacccaggctggagtgcagtggcatgatctcggcttactgcagccttgacatccagggctcaaatgatcctctcacgtcagccttctgagtagctggaactacaggcatgtgacaccaccctggctaattttttgtagagataaggttttggcatgctgccctggtctcaaactcttgggctcaagtgatcctcccgccttggcctcccaaagtgttgggattacaggcgtgagccaccgcgccccgccatggtcaaaagctttatcttcgttaatcttggttgagctggtttcccacttcctatatcatttgcctgaaaggggagacccagcttactttggaggtaggtgtaggtagataagagccaagtgttgtttgctaatgtattgagtgagggatctcattaaaaggtcattttatttgtgcaatcaaagaactcctttggagcccagtatggtgtcacacacttgtattcctagctactaacgaggctgagatggagaatctcttgagcccagtcaatcactgatgccagcgtgggcaacatagtgagaccccatctttaaaaaaaaaaacaggtgtgattaatgttaagcaccttgagatgaggagagcggtttggattatccaggtgagcccaatctaacaaaataaatccttaaaagcaaaagcagagggcctttccatctgtggtcagaggaataggtgactatggaagagtggttgctccctttcccttgtccctgctttgttttctccacagcacttctcactctgtgggaggcacaagaatgcccccctccaaagagatacacatcctaatccccagagcctattaatatggtatgttatatggcaaaggggggattaaggttgcaaatggaattgtttgctgatttgctgactataaaattgggagagtatcttggattatccaggtggacccaatgtaatcacaagggtcctgaatcttggaagaggaaagcagaagagggattcagagtggtgtgacgtgagggcttagcttgctgttgctggcttcgaggatggaggaaaggggctaggagcccaggaatgcagcagcctccagaagctggaagaggcaaggtaaaggattctcccccagagcctccagaaacaaatgcagccttgctggcaccttgcttttagcccagtgagacccatgttagacttctagcacacagtactgcaagatattaaattgatgatggctgggcgtggtggctcatgcctgtaatcccaacactttgggaggctgaggctggtggatcacttgaggtcaggagtttgagaccagcctggggaacatagcaagactgcgtttctactaataaaaaattagcaaggaacggtgtgcacctgtagtcccagctactcgggaggctgaggcaggaggatcacttgagcctaggagatcaaggctgcagtgagctatgatggcaccactgtactccagcctgggcaatagagccagaccctgcttaaaaaaaaaaaaaaaaaatggctggctgtggtggctcaggtctgtaatcccagcactgtgggcggctgaggtgggcagatcacctgaggtcaggagttcgagaccagcctggctaacatggtgaaaccccatctctactaaaattacaaaaattaactgggcctggtggtgcacacctgtaatcccagctactcaggaggctgaggcaggagaatcgcttgaacctgggaggcggaggttgcagtgaacagagatcgcaccactgcactccatatcaaaaaacaaagaactgcttggtttctgatttctcagctctcaactctaggcaggtgatttatttgtccacttaagagatgggaattggacactgccgctgggatcagttctgatcctgactataaatttccggggtgctctgccttagaacttggtttattgcctattaagctgctttcctgttgcctgtgctcagtgtctgtctggctcctggcctcctcttgccaggtgatttggcctcattctgaacctgttttatgtagagtgtctgtctgcccgacttcatggggcagatcacagaacaagatccctgtgccacgatctgctttcccttcaccaaatatcactatgaacttgtgcctacctggatcccatacttgcttcaccctgacaaagctttttcttctctctacttctggcctgctttgaatttattgttttatgcctgtgtgttagagggaaaaatgtattaaaataatgtactggcaatacctcccttcctgtctaaaaaaagtgaatgctttgtgtactcatctccctagagggcctttgttgaattaagcagggtgattggctgtgaggagaattaaaaggcagagagaagaccaaattgctctacccaacacaaaatgaggagatatttgaaagagaattttacaaggagaagactgaagaaggccgggcgaggtggcacacgcctgtaatcccagtactttgggaagttgaggcgggtggatcacctgaggtcaggagttcgtgaccagcctggccactaaactctactaaaaatacaaaaactagctgggcctggtggcaggtgcttgtaatcctagctactctggaggctgaggctggagaatcggttgaatcagggaggtggaagttgcggtgggccaatatcgtgccactgcgctccagcctatgcaatagagcgagactgtctcagaaaagaaaagactgaagagaagaggaaggagacataagtgagctgtacaatttttgagcaaagaaagaaacccaaagaatattttaatggaaagcttcctatattgcgtgtagtgtaacattctctttgcctctctaagcatccagtacacgttgaatttgtggtagattaggtgtattaagtgctgagattggcctcaaggcaagggcaggatgactcagaatagcacaaatagtttcaggtgggaagggggaggaaaaagggaagcaaaaggcaaggaaaatgccaagtggtcttgcctacagcagatctttcagcccgcatgcttgctctgtacttggaattctctagaaaggttgcaagaagaagctgcactccagagtagtctgagaaagggatcaggaagagggcatttatctgccagctccctcctgtctccattttttgtggctgaggttcacactacttagcagagctaaatcccctgaatgccatgtggtgtcatctggcagctccgtgatcactcaggaaattaattttacgccttgcagtgtggctatttcatccgagtctggaagtgaggagtgaccaagagagaacaaaaggaagggtggtgggaatccaagaaggcttaaaacgtatgtctctgtagttgagaaaaggttttacttaaatcctgttccaggccgggtgcagtggctcacgcctgtaatcccagcacttcgggaagccgaggcgggtgggtcacctgaggtcaggagttcgagaccaacctggccaacatggtgaaaccctgtctctacataaaatacaaacattagctgcgtgtggtggcagatgcctgtaatcccagctactcaggaggctgaggcaggagaatcgcttgaacctgggagacggaggttgcagtgagccgagatcgcaccactgcactccagcctgggcaacaagagtgaaactccatctcaaataaataaataaataaatacataaatacatacatacatattgctccaaatggtgaacatgtgcatgactacgtgtatgaactctgatgtcttcataaagaattttaaaaaactattggaaaacatgggaaaacatgctctaattttttttaaatttcatattcagggaggtacatgcacaggttgtacatgggtatattgcatgatgctgaggcttgggtttctggatgatcctattgcccaagtagtgaacgtagtacctgataggtagcttttcagcccttctctcttcttcttcccccttccctccttctggagtgcccagtgtctattcttatttttatgtctgtgtgtacccaatgtttagcactcgcttataagtgagaatatgtggcatttggttttctgttcctgcgttaatttgcttaggttaatggtccccagctacaccaatgttgctgcaaatgacatgatttcattcttttttatggctgcatattctctaatgttaattgataatgccagataaatcttcagacttctagattataatcatggaaccaggtagcgacttccgccttactttttaagttatttaattacccatgtaataatacatatatatttttttctagagacagtctcgctttgtcacccaggctggagtgcagtggtgccattatagctcactgtagcttcgaattcttggactcaagcaatcctcccacatcggcctcctaaagcactgggattactgtgtgaactaccgtgtctagcccacgtctcttactagttaaaaaaacaaaaaacaaaacctgtcattccaggtgaagggagttgctttagtgtaacacctggcttttctctgccttttcctaactctgctcctgagctgtgatttaattggcaaatttggggaaaataaagtgagcatgctcagcttatcctgtccactttcccctttggaatccagccagcatgaggcctgctgtaggggcaggctgacactctggtcgccagggaggcaagtctactttggaccagaactgctagatctcattccgcagcttggtattgggaagctcttctgactctcagatttaaactgcatcctgcaacccagtcctatcaggaataaactaataatttgatcctctccctccattcctttatcttatttcttagttggctgtaaaatttaaaaaggaggaggggtgctttttattgggcccttcttgcaacatttggttcattggctaaaaaattgaaatgtaagaaaaaaggaaggagcacaattagggagaagcaagtgaacacacatggagtgattgaggcttctggagtggtgagggattggccttggcgctgggtcttgttcttggtatgtgtgccggacatgttaatcttggcagtttgtataggcttatattgggctaggtaggtttttgtggtggtgcattagtgcttaaaagccatggcctggggaaaactttggaaaagtcattcagaggctgtagcagggccttgacaagggcatggggctgtcagagggcctaagtggggactggcaggctgaagagcgttaataagcagtcacagctgatgcaaggattcaattataggaggaaagaaacaatcttttcatatactatccttttagatattaagagagtgaaaaaaatatctgctgtttttaaaccatggagcagctgggttctctatggaccacggagcattagtgagagattggcttccaatgtgttagcacgaggtaatgtaaacaaacagtccaagttttaattcctcttttatgttgttttgcactatccttaagggcaagagagggcaaggtggaggggctaagtttgacttcatgtggctcaagaatcagtccctctacttgttctcaaggttgctagaaactggttgcttagattttctctttctttcttagcatgataaagtatcaaacaatatttttttgtgaatttttaaaaccgatacataatgcttgtggatatttctgggatgcatgtgatattttgatacatgcatacaatgtgtgatgatcagcaccacctcaaacacttatcatttttttgggaacattccaaatctttcttctagctattttgaaatatataattatgggtttttttttttaggcctaaggaattccacagaaaaagataatgggaaaagccactgtggcacaggaaaaaaatgtttacttggtattgtgggagccctcttactaggcagaagttcacttccattgcagcactgcagtgcaggcacctaaagatcaaaggggacgtggaaatataaaggctttgaatatctgggtaagaaagaacagctcctctcaaataagatgtgatgactgaagatattgccatttcatatttctaaactttacaagaaggcagcatcctctcaaatactctgagacaggagaaagtactcagagggggatcttcccagatgtggtaagtgtgaggtgcacagtgctgaaattaacctgtgaccaggagatttctactaactgggtttaaattcacaggccatggggtctgtactcttggcattgatcaagtggcattttggtgaggctgcagtctctgcaacagtctttgggcacccaaagcactgattctgggtatgcgattctgcttgagctacctgctaggaattggcttattttatgaagatggctgggatagagccagtgctatgatcattttacatgttctgttaaatctatagattctttagaaaaaagtacatcccagactaggctgatattgaggcaggagaatagggtctggaaacagggaacctaaggtcatttcacgctaactttctagaactaaatttaaagaaaaaccctaacattccacgcctaagtaacaaaaggaccagaggctactccctttgcaaacccccaccttttctgcccagcagatgggcaattggctgtcagcaaccaatcagactgattgcaggcagagtcttagtttccatagaagtgcaactttgtaacttcaccttaacctctgattggttgctttttgcagccaattagttgtttgcacaggagtgtgacgttggtaacttcagcctctaattggtggctttccgccaccaatcagagcaactgcggaccaccactttatttacatgaggtgaccaccaagtggcccatgggaaacctgtagggggtatttggacccaacagaattctgtaacccgggtttttgagccgctgctcaggccgctcccacactgtggagtgtactttcgttttcaataaatccctgctttcattctttagttgcttcattctttctttgttttgctgggcattttgtccaattatttgttcaaaacgccaagaacttggacaacttgcagtcaagaccctctactagtaacaatattatcattattttttgacttggaggccctgaaggaaatgcccccattccaatgaaatacagcttaagctgtacttgtcaaaagatccctgactgtacccccacactgaaatcccttccggtagagacaaagcataataagaaattgggaaagatggccgggcgcggtggctcacgcctgtaatcccagcattttgcgaggccgaggcgggcggatcacctgaggttgggagttcgagaccggcctgaccaacatggagaaaccctgtctctactaaaaatacaaaattaactgggtgtggtggcacatggcagtaatcccagctacctgggaggctgaggcaggagaatcgcttgaacccgggagacggaggttgcagtgaaccaagatcgggccattgcatttcagcctggtcaacaagagtgagactctgtctcaaaaaaaaaaaaaaaaaaaaaaggaaattggggaagatacattttggacttctttgaattttaacccacacatgtaagataattttattttgaacttcactttcttttatctttaatgtctcatgattttgacttataaggagatggatttcatttcttggacattaatttctccctagaaacttgataaagggaggagatttatgttaaagtatattttttctcaatattattggtattttcttattgagttttttttgcgcatattattggagtgtagtatacttttgtcatgtaatctcattgttgatcctctgatatgtggacagtatggataaacataataaaaattagtaatagaaaaatggagttaagccttggatacagaatgtcactgaaccttttttttttgtttgttttgagacagggtcttactctgtcacccaggctggagtgcaatggcgtgatcacagttcactgcagccttgacctcctgggctgaagcgatcctcccacctcagcctcgcaagtagctgggactataggcatgggctactgcacctggctaattttttttttttttttggttgtcttttggtagagatgggatttcaccatgttgccccagctgttgttgaactcctgggctcaagcaatccacttgccttagcctcccaaattgtcaggatcacaggtgtgagccaccacgcctggcccctgaaatattaatgtgttatagtgaactattttggaaccttatgtgagcaaaatcgccattgcctaccagggttcctggaaaggtacaaagtagggtggtatgagagggaagggtaacgtcatgaaggtggggcaaggatggtcctcacaggctgtcaagatgctgtctggaggatgtcagccacacctctggctggcataggctgaatggttaaaccaatgtcttaagagaaaaaacatcgagagaatattagtgggaaatgattcttttttgttttgagacagagtcttgctctgttaacccaagctagagtgcagtggtgtaaatgtggctcactacaacttctacctcccgagctcaagggatcctcttgccttagcctcccaaatagctgggactacaggggcgttcaaccatgccccactaatttttaaattttcagaagagacaaggcattgctatgttacccaggctggtctgaaactcctggcctcgaatgatccacccaccttggcctaccaaagtgctaggactataggcgtgagccagcacgcccacccaggagtgactcttaggcaacctcgatattaccttctgtgataggctgaataatgggcccccaagtatgttcacatcctaattctcagaatctgtgagtatgttatatggcaaaaggaactttgcagatgtgattaagttgaggatcttgagataagagaggttaccttgtgtgtccaatataatccattgatctctataagaaggacagaggaagagtcagtaaaataaagtgatgtgacggcagaagcagattggaatgatgagctttggagatggaggaagaagccgtaagtcaaggaatacagtccagtagaaactgaaaaggcaagaaaacattctcccctcagaggcttcagaaggaaccagtccctctgacaccttgactttacccctaatgaaatggattttggatttctgacctcaagagctattgagaataaatttgttttctaagcatctatatttgtggtaattttttacagtggaaagaagagaccttctataagaaggaacttgattttatctcctgtgtttttggacagggtaatttaatctgactggtaaattctagaataataaactgaacatgattggcttagtctccttctctttgttctttgggagccagtcaagcccaagaaagcacaagttctacttcttgcagggtaggatgctacccatatgatgagatgtgccccactcagtgctgctggacctgggtggctaattaagttcatgtaactgtggttcagtattagcatttggctttcatgttaagctatattctcctgtagttttaatcagaatacagtgatattttgacctccacagaccacttcttggacttatctctttgctcatcactcaggcatgacaaaatggtgactttgaggataatggattgaacaaaaatgatacaatctcttgtagctcccaatttctataagtagtggagaaaatttaaaaaaaaaatcacaactgcattggaaacaagaaatttccaggaaccagaaactatgacaaatccctaaatgacataggatcaggtgaaggaggtaagccacagttaaaactagaacagtagactattgctgcaaaatatagcggacactaagaatactccttgccccaaagtggtggatagcagtgacaggaagttcaaaggtaactaatagattgactaattcaggtaccacagtaggactatctagatggttcaattgctgcttgctatcccttctctatctgtttagccaggtaatagtgatgagtggtatctatctccactcaagaaaaatgggtaggagggtgatgataagataaggcagtgcccaacccccagtgtctggcaatacctgggaggaggggggtgcactcacgttggaacactagccaccaaggtatgaccagtgctacatcccatcctccctcacaataggctaaaaaaatagatgtgacatacatctaaaaggacattgcctctgtaaagatgagtgacaaatcaagaatggatgaactttaaagaaggctaacatgaaagagagacaagaaactcaatagacgataaaacttccatctgagaaaatgaattaacacagcaagaagattaggtcttttcaataagtatgacttgtatcattaaagaaatgtgaaagggtaatatacatatgtataagaataaattagatattgtggaaatttgaatgattgttgaaataatttaatagaagggggttgggtgtgatggctcatgcccgtaatcccaaaactttgggaggccaaggaaggatagcttgaggctaggagtttgagaccagcctgggcaacatggcgagactacgtcactacaaaaaaataataaaaaaaatttagccaggcatggtggtgtgtgcctgtaatcccagctactccagaggctgaggtgggaggatcgtttgagcccaggaggtcgaggtggtagcagtgagctgtggatcacaccactgcactccagccagggccacagagtgaaaccctgcctcaaaaaagttccagaaagaaagaaatatgagtagggaagagaggcagtgcatttaaataattcgaagaattatttaatctcaggcttagtttctgagatggaaagaaactacaaagtccctacaaatagcacgaaatttgtgaatagaaaagataaagagaaaagccttaaaatcttccagaggaaaaaaccagaaggaaggagaatcaaattgaaatcagacttcttatcagtgatattgtattaaaaaatatcagtgtgagtcaggtgtggtggctcatgcctgtaatcccagcgctttggaaggctgaggtgggcggatcacctgaggtcaggagtttgagaccagcctggccaacatggtgaaactttgtctgtactaaaaatacaaaaattaactgggcgcctgtaatcccagctacttgggaggctgaggcaggaggctcactcgaacccaagaggtggaggctgcagtgagccgagattgtgccactgcactccagcatgggcgacagagtgagactctgtctcaaaaaaaaaaggaaaaagaaaaaaagaaaaaaacatcagtgcaatgaagcaatgaaatgtttgtagttttgagagacagtaactcagcctcccaaagtggtgggattgtcccagcctcccaaagcactgggattacaaacatgagccaccacacctggccaacaataacttttaatttaggattctgttagacccaatcaaatataataaaaagagaagggcctttcctaccagacatctacctttatttttatttatttatttagagacggagtcttgctctgtcacccaggctggagtgcagtggcacaatctcggctcactgcaacctctgcctcctgggctgaagcgattctcctgccacagcctccaagtagctgtgactacctggctaatttttgtatttttagtagagacggggttttaccatgttgtccaggctggtcttgaactcctgacctccagtgatctgcccacctgagcaccccaaagtgctgggattacaggcgtgagtcaccatgcctggccgaaatctatctttaatatgaagttattggctggacatggtggctcacacctgtaatcccaggactttgagaggctgaggagggaacatcgcttgaggccagcagtttgagaccagcctgggaaacatagtgagacctttgtctctcaaaaaaaaaaaaaaaaaaaaattagccaagcatggtggcacacacctgtggtcctagctactcgggaggctgaggtgggaggatcgtttgagcccaggagttcaaggctgcagtgagccatgatcagccactgcactccagtctgggcgacagagtgaggccctctctcaaaaaaacaaaaaatgaagttattgttattaaaacagtgtgatataagtgcaagaatagataattagacatttggaacagaatagggagctcagaaacagactcactcatatatgaaaactttatttgtataaaatcaacactccatacctgtaggaaaaagatacattagtctatcagtagtgctgggacaattcgttatatataatgagatccctagctcacttcatataacaaaaacaaatttcacagaaggattcaaaatgaacagcaatttttagcaaaaaaaaaggataatatttttatggtcttgcgtagggcaaaaggaagccctatacccaaaccgtaaaggaaaagattgataatttcagttatattaagatgaaaaaatgtctgcttattaaaaggcatcataaaaagtgagaagttacaatctgaaagaagatattggtaacaaatataacccacaataattagtatccagattatatgaagaactccaaactgcaacatcagctgggcgtggtggctcacccttgtaatcccagcactttccaaggccaaggcaggtggattgcttaagctcaggagttcaggaccagcctggacaacatggagaaacttcatctctaccaaaaatacaaaaaattagctggacgtggtggcacatgcctgtgtctcagctactccagaggctgagatgggaggatcacttgaggccaagaggtggaggttgcagtgagccgaaattgcgccactgcgctctaaccagggcaaaagagtgagactctgtctcaaaataaacaaacaaaaaacataaaacctaaaaaactgcaacgtcaatccttccctgagtttctagcctgccagcctgctctagacatttcagacttgctcctggcacaattgtgtcagccaattccttaaactaaacctttctctctctatataagtctatatcctattagttctgtttctctggagaaccctgactaatccaagtcagaagaatgaagtctggtagcaactgggagactctgagtggagagaagtgaaaagatccactgtcagatgaaggcagacccgtgggtgaagaatcatattgaagaatcctctgttagatgaaaaagcccacgtgactgcatggattttggtttatgttgttgtgtttttaaccttctgttaatgccagcaatcgatttttccagatttctctttgagttctttttcgagaatagctgctttactgtagagtacagaattagacccgtttgggttttcatcagcagccttcagatctgctgctccgcatgcctctttatgaacgctggcaccttttaaggataattctaggccatcttaatctcttttaatttggttaatcttttcaagaatttttgcattttctttcagtttggtaaattgtatagtgaattccctttccttcctctatggattttttgtattttaaaaaattgtggtaaacataacataaatttattattttactgttttaaccacttttaagcaatttctcattgttgtgcaaccatcaccactatccatttctagaacttttaaaaaatcccaaacagaagcttgtacccattaaacactaggttcctattctcttctcccctgtcccctggaaacctctattctactttctgtctctataaagttgtctagtctaggtacctaatataagtggaaccatataatatttttcctttctatagctgctttttttctttttttttgagatagagtcttgctctattgcccaggctggagtgcaatggcacgatctcggctcactgcaacctccacctaccgggttcaagtgattctcctgcctctgtctccagagtagctgggattacaggcgcccaccaccagggccagctaatttttgtatttttagtagagacagggttttgccattttggccaggctagtctcaaactcctgaccttaggtgatccacccgcctcagcctcccaaagtgctaggattacaggtgtgagccactgtgcctggcctacagctgctttttaactgaagaaaaacttctccaaaacaagaactataaaaaatatccaataactcttgcccttaccatcatctccaaagagatttgaagagattggactcaggctcatgttttcaggccatgatcttgcaggtgtctccaggagaagcctgaagctcagttctgaggcagtcacaatgcttttggtgagcccaagttcaccacagacctgcctctgggggtatcggcccactgaaccacaacagaccacccatctcattccacaatgttcagctaaccccgcatgacagctgggacagcaggctcagggctcagagaggcacattgaagaaccagtccagcccatgctttaaaaagtaataactcattttacttaactttttaaactgaaacataaaacacagattcataaaactatgagataaattattgtaaagagaacatctttgtgactgccaatcagatcaagaactagaacgttgtcagccacccccgaaagcccctctatgtgtcccatccaatttcaaccctcttccatctcccaaaagtaaccgctttcttgccttttttttctttaaaaaaaaaatcattttattgagaggtaattcacgtaacatacaattcacttatttaaggggtacaattcaatggcttttggcttatttacagagttgtgcaacaccctcctgagttttatagcatttccttgtatccactggtatctgtagtttcaggcacccactgaaggtcttggaacatatgcctcatagataagggggaactgctgtaactggtcacttttgaaggatggaaagcaactaaagcaactaattcaatatctttttttttttttttttttttgagacagagtcttgctctgtcgccaggtgcgatcttggctcactgcaacctctgcctcccgggttcaagtgattctcctgcctcagcctcccaagtagctgggactacaggcacccaccaccgtgatgcctggctttttttctttttttttttaattttagtagagacggggtttcactgtgttagccaggatgttctccatctcctgacctcgtgatctgcccaccttggcctcccaaagtgctgggattacaggtgtgaaccaccacgcctgaactaattcaattatcttaaaaactggtaaagtgccgggtgcagtggctcatgcctgtaatcccagcactttgggagcccgaggcaggtggatcacgaggtcaggagttcgagaccagcctggtcaacatggtgaaaccttgtccgtactaaaaatacaaaaattacctgggcctggtggtgcatgcctgtaatcccggctattaaggagtctgaggcaagagaatcgcttgaacctgggaggcggaggttgcagtgagccaagattgcaccactgcactccagcctcagcaacagagcaagactgtctcagaagcaaaacaaaacaaatcaaaacaaaaactcggtaaacaaagggacagagccagcatttttcctgcctttcctattgaatgaacagaaacattcaatttatccatccgtaaatgtgatgccttttccacttcaactaagcacttacgtattgtggccttaacttttgcagtttgagatgcaacagcaaaactagcatgatttctttttccttcttcacagtgtcaccgatagagtcattcttaaccacagatcttagcaatctcggcatatgatttcttttctttccttattgagaaccttcaccttttcatttaaagggaacactttacagcttctctttggcatatatgaattgccagagtcactattcttgtactttggggccattaggaagtaaaatagggtgacttgaatacaagcactgtgatatcgtcacagccaatctgataaccaagaaggttactaagtgactaatgggcagggagcgcctacagtgtggttcagctggacaaaaggaggactcacatcctgtgcgggagggagcaggatggcacgagatttcatcacgctactcaaatggcatgcaatttaaaacttatgaattgtttatttctggaattgtccatttaatattttcagactgtggttgaccgaatgtaactgaaacaacgaaaagggaaaccatagagaaaggggagctgctatagttgttttttttaaaccattatgaacacatggatttaaatatctttgaagggtttcattctatcgtaattattatccttaatgaagctcaagttgtcccatcttggccaaaattgcctcttgtgtccccttggcagaactgtagttgtctttgttagcttccttgctatcttgtatgacaagatgctataaagtatatcactgacttttggtaggatgtgatattgacttaggaatagacaaatatgttgatggaaataaggaatgggataattcataaggttatgcaatagatatctgtttttgttgttgttgttgttgctgctgccggcatttatcgcacttcctacaaggacagtttcacaaaatttatttgagatattactcttcattcatttagccttattgaagtgtgttgaagggactgaccccgtctgcagctcgggctgccttgacgtcagtatatccagttaccctgttgggagtgactagtttataaatgggcatggccagagccaacgggagatgagaagacattcactgggacttctaggaaagacattaggataattggccttccatttggaggaagatgctaaatttctacttcttaccattggcaaatattaatagaagtgaaattaaaaccctagaagagtctatgattattagaagaggcagaaaggcaaaaagccatattgatagattgataatttgattacatgatgtcggaactatacaacaccatgaaaaaaattaagacaagcaactgaatagaagtagacatgttatatacataacaaaaaacttgtgtccagctcatgcctgtcatcccagcacttttggaagccaaggcaggcggatcacttgagcctaggagttcgagaccagcctgggcaacatgacgaaaccccctctttacaaatgatacaaaaattaaccaccacacccacagtcccagttactcaggaggctgagatgggaggatcacttgagcctgggaggcagaggctgcagtgagccatgatcgtgccactgtactccagcctgggtgacacagtgagacccggtctcacaacaaacaaacaaacaaacaaaaaccttggccgggtgcagtggctcacgcctgtaatcccagcagtttgggaggccgaagtgggcagatcacctgagggcaggagttcgagaccagcctgcccaacatgtcaaaaccccgtctttactaaaaatacaaaaaattagccgggcgtggttctgggcgcctataatcccagctacttgggaggctgaggcaggagaatcacttgaaactgggaggcagaggttgcagtgagccgagatagtgccattgcactccagcctgggtgacaaaagcgaaactctgtctcaaaaaaaaaaaaaaaacaaccaacaaccaaacaaccaaacaaacaaaacccttatgtccataccacagtaaaccttctatatgtggataagaaaaaaggcaaatcaatagaaatatgtgcaaaatatatgaatagatcatttacatataaggatctgaaagggcaacccccttccccaacatatgaaagttactctacctctctaatagtcagtaaagcacattttaaaacttggtacatagtaggatataccaaagtttaaccattcccctactggtggaaagttagatcatttaaaacttattattacatacaatgctcattgaagatgtgtcttgcctctttggaacatattcgtgcttttgagatgttaaaccttataacctaaacctagaatgtgatagcaaacatcttggtgtctgcgtcctgaatagaagttatatattatgtgaacatacactaaaatttagcatcagagtgttctttgaattgtatttttaatcatgtgcttaatctaatacacttgggaactactggaacttttgctggtcagattagttcaaacagttagaaattgttctctttccttgaaataaagctgattgaaggattatgttgtctgaatagctgtaggattcagaaactcctttataaagacttactttatttttaggtttaaaaatatccatgatttcttttggattaatggtctaaacatgcttatttgactaaagccttacttttttatttatcatggctatagcttgtttgttgttcattagttgtaagtgtgttccagggagaggaaattgtttaatctctactcagtagggaaagaaaatatttatcaaattcaaaatatgtatgccttttgttcaagcaatttcaatttgaggagtcttccctacagaaatactcataagcatatacacacacacatactcacacacaaggatgttcactgcaccattgtttctaatatataattcagttgaaaatatgataaatgtctatcaacaaaggaatgaattagcaaatcatgacctgtccctaaaatgagtgacagccacatgtatcaccttggaaaaatgtctgtatatgagagggtgctggaagggaacagaactcacccccaaatggtttgaatgaacatatatatatacatgaacatatacatatatgtatatgtatagagagagagagagagagagagagagagagagtcttgctctgtcacccaggcctaagtgcagtggtgtgatcatagctcactgcaaccttcaactcctgagtttaagcaatcctattgacccagcctcccaagtagctgggactacaggtgtgcaccaccaccatgcctggctaattttttgaatttctttttgtagaggtgggatcttgctatgttgcccaggctgcaaatgaagacatttttaaggaagagtttacttacagaggttaggtgccaagcaaacaaagaagggatggtgaagtgcctagagactagcaatggtggaaagtgatgcccattcctaaggcctcaggtacaaaggagagggcatagcacagtaggagcccagtgaaatttggaaccatggaggcagggccacccagggagttatagctaaggatggagacagccactgcaaaagacagagctgatgcaggtaggaaacaaggaaggaataccctgactttttaaaattaattaatttattttttatttttttccgagatggagtcttgctctgccactcagagctagaatgcaatggcactatctcggctcactgcaacctctgcctcccaggttcaagcaattctcctgcctcagcctctcgaggagctgggattatagacgcgcaccaccacacccagctaatttttgtatttttagtagagatggggtttcaccatgttagctaggctggtcttgaactcctgacctcgtgatccatccacctcagcctcccaaagtactgggattacaggtgtgagccaccacgcccagccttaccctgacttttttccttttattctctgatattttgctgcagagacctctgcagtgacctttgattggctgaacccactcggaaacatttggcatgggagcctgagtaaagtggtccactggccagagagaaaggacaaatatggcccatgaagatagagaatgactagcatgatgttttgagggtatttttggttttgaaatcaattagcctgggcgccgtagctcacacctgtaaccccagcactttgggaggctgaggcaagaggatttcttgatctcaggagttgaagaccagcctgggcaacatagtaagaccctgtctctaaaagaaaaattttaaaagccgggtgtagtagtcccagctactccagaggctgagatgggaggattgcttgagcctgagaagcagaggctgcagtgagtcatgatttcactctagtctgggtgacagagcaagaccctgtctcaagaaaaaaaattatttttaattgacaataaaagttgtatatactcattgtgcacagcatgatgtttagatatatgtgtgcattgtgagatggctaaatcaagctaattaacatattcattacctcacatttttttttgtatgcggcgagaacatttaaaaactaccctcttaacaattcctaagtacaattatccccccatatccaagaaaaattggttccgggacaccctgtgaattccaaaatttggggaatgttcaagtaccttattaaaaaaagtgtagtatttgtgtataacctatgcacatcttccaatatatagttggcttttgttatctgtgggttctgcatctgtggattcaaccaaccagaaattgaaaatattgtgtgtggggggggggaaaacaatacaacaataaaaaataatacaaataaaaagcaatgaagtataataactatgtagcatttgcattctatcaggtattataagtaatctggagatgatttaaaggatagggaggatgtacataggttatatgcaaacgctataccattttatatgggactttagcatcctcgcatttctgtatctacagggggtcctggaaccaatcccccacttatatgagggggatgtctatactttaaatcatctctagattacctataataccttatataatatgtgttatataaatggttgttatactatctttttaagtttgtattatttttaagttttttttcccaaatatttttgatatgagattggtagaatcatggatggaaaacctgaggatccagaggactgactatatatagcacattatttttatttatttatttatttatttattgagatggagtttcactctgtcacccaggctggagtgcagtggtgtgatctcggctcactgcaacctctgcctcccgggttcaaacagttctcatgcctcagcctcccaagtagctgggattgcaggtgcctgccaccatgtccggctaatttttgtatttttagtagtgacagggtttcgccatgttgggcagggtagtcttgaactcctggcctcaggtgatccacccatctcggcctcccaaagtgctgggattacaggcatgagccaccgtgtctggctacagtacattattaactatagttaccatgttgtacaaaagatctgttgaatgtattccccctaaatgaaattttatatgctttgaccaatatctccccaattctccctgatgatgtttatgttatgttttttaagtggaaaaaaagttgcatagcaatatataatatgctatttttgtaaaagaaaaccacaaccacatatgtgaaatgcacatggttgtataaacatcagcattatgtaagaacacatagcaaactataaacctcagtattacctctagagggtgaaaacagatggagaaggatttatttctaactttctatattttaatttttataatatattttctatttctactaggtgtgggctttattggttgatttctcggtgagtgcgtttccaagtgtgaagggacccttcctgtagtgtcttatatacaatacagtaggaatgttccttctttgccactcatacacctttatgtgcatctcacatggtgttcttccccaggtggatgtgattctccatgccagtgaagagtaaggaaggccacagcatggtatggggatagaataaactctgctgggctaacaaataaaccctgaactctcaatggcttaatgcaataaagatttgtttcttattcatgctgatgttcctggcctgagagttcaccagagcagctcttctctaagcagcaaattcagggatcagggcttctcccatcctgtgcatctgccatcttggaaccttcatttccagccatgtagaggaagagagaaggagcctgagagactgggagaggagttttatgcaagggagtgctgggaaatgtagtcttcctggttctgcaggctgtataagaggcaaagaccagcatctgcttctgatgaagggctcaggaagcctccaatcatgatggaaggtgaagaggaaccagagaggaaggaatgaaagtttcattttaaaaattagagatgaggtcttgctatgttgcccaggctggactcgaactcctggggtcaagtgatcctcccaccccagcctcctgagtagctggaactacagtctcatatcaccacacccggctcaatatatttttatattatagaaatttgttataagaattatgcattttttgtgattaaatgaataaagataaactatattttgcataaaaagaaagcactgttacacttaaggcgaagacaaaggtaagaaaacccctaaatggttattaaacatttaattcacttaagggcactgcagagaggaaacacttttagaaatctatgttaattctgttaacattaaagccaaagtgtaggctgggcatggtggctcaggcctgtaatcccagcactttgggaggccaaggtgggaggattgcttgagcccaggaattcaagaccagcctgggcaacatggtgaaaccccatctctacaaaaaatcaaaaattagctgggtgtggtggcacaaacctatagtcccagcttctcaggaggctgaggtattaggatctcttgagcctggtaggttgaggctgcagtgagccacgagtgcaccactgtcgtccagtctgagcaacagagtgaggtgctgtctcaaaaacacccaaaaaacaacaagaacaaaatgtcaaagtcaaagagtagatcttctgtgctctagtgttggttaggatcctctgttgcaaagatcagaaatcaagtcactcaaggaataaaaggggagttgaaaaaataggaatatatgaatggctcataaaatggaatgatggcaggaaataaaagttaagactctctgtttgcctctcaggaccttatctcttaattttctccagtaaacaaaacaaactttctctgctcttgggggaatataatgggaataatatggctgcttcacagatcctgagttccatatttcagttccagtcattgagaagactgcctcaactctctttaggtccatattccaaaatcttgaaagaatttgattggcaaatttggtttggatgtctacctttagtccaattagctatagtcagtgggcaggatcatgtaatatagtaccaagatactggaatattttaaatggagataaagagatgttgtcaggttaaggtgggggccataagttcccaagctgcctactacagttgcacaaaggacaaagaatattatagattgatgagctaaaaatcacttttgcattgccccacagctaaaaaatttaaaaagagatttctgagagagccataaaaaggcaatagtaaaacactgatataaaatcagctggggccagacagggtgactgacacctgtaatctcagcactttgagaggctgaggttatctgcctggatcacctaaggtcaggagtttgagaccagcctggccaacatggcgaaaccctgaccctactaaaaatacaaaaattagctgagtgtggtggcacgtgcctgtaatcccaattactcaggaggctgaggcaggagaatcgcttgaacccgggaggtggaggttgcagtgagccaagagcacactccaacctgggtgacagagtgaaactatgtctcaaaaacaaaaaacaacaaaacaaactaaaacaacaaaacaaaacaaataaacagaaaaaaagaattagctggtaaatcagctggcatatactatcagaataataaataagagttggccccctgggctgggtgcagtggctcatgcctgtaatctcagcagtttgggaggccaaggtgggtggatcaccggaggtcaggagttcgagaccagcctaacaaatatggtgaaacctcatctctattaaaaatacaaaaatcagccgggtgtggtggtgcatgcctatagtcccagctactcaggaggctgaggcaggagaattgcttgaatttgggaggtggaggttgcagtgtgccaagaccacgccagtgcactccagcttgggtgacagagcaagattccgtctccacaaaataaataagagttggccctctgtatttgtgagttctgcatttgtgaattaaaccaaccactgattggagttattcagaaaaattaaaaacaaccgtacaataataaaaataatacacattaaaaaattggccaggtgcggtggctcacacctgtaatcccagcactttgggaggccgaggtgggtgggtcacttgaggtcaagaggttgaaagtagcctggccaatggggcaaaacccatctctactaaaaatagaaaaattagatgggtgtgggggcccgcgcctataatttcagctactcgtgaagctgaagcatgagaattgcttgaacccgggaggcggaggttgcagtgagatcgtgccactgcactccagcctgggctacagagggagactatgtctcaaaacaaaacaaaaacaaaaacaaaactagtataacaactatttacatagcacttacattgtattaggtattatatgtaatttatagatgatttaaagtacatgaaaggaggtgagtaggttatacgcaaatcctatgccttttttttttgacggagtctcactctgtcactcgggctggagtgtagtggtgtgatctcggctcactgaaacctccgcctcctgggttcaagtgattcttctgcctcagcctcccgagtagctgggactacaggcacgtgccaccatgactggctaatttttttatttttagtagagacgggggtttcaccatattggtcaggctggtcttgaactcctgacctcgggatctgcctgcctcggcatcccaaagtgctgggattacaggtgtaagccaccgtgcccggcctactatgcaattttatacaaggatcttgaacttctgtggattttggtatctgtggggagtcctcaaaccaaactcccatggatgctgagggacaactgtacaaatattgaacaattgaaaaggtcacagataactagatgtaaaaaatagttactggcttgaaaaaaggtaagaatacctgataattgcaccacattgtgtaggtctcacagggtttccatattccctttccaatataataaataaaaccttgtaaaagcaattgaggctgagtgcagtggctcatgcctgtaatcccagcactttgggaggctgaggcaggaagatcatttgagtccaggagttcgagaccagactgggaaacctagggagtcccaatctctacagaaaattaaaaacaaaacaaaacaaaacaaaaaaaccaaccaggtgtcatgcacctgtggagtcccagctactcaggaggttgagttggaaagattgcttgagaccaggaattcaaggtggcagtaagcgctaatcacgccactgcactccagcctgggcaacacagcaagacctcatctcttaaattaaaaaaaaaaaaaagcaattgagtctcaataagtcaagtcacttgcttgaagtcacacacaaaccacagacttaggactcaaactcctcgttttcactttatgtgcagaggcctaacttatagaaaatgcctcctacctttttcaaaggtagtttacttttttttttttagcattgaaagtaaaggcagaaatgacttttaaagtgctacattttcagggaaaaaaagtggattaggaacattagtttccattctggcatgtaaggagctcagaagtcactactcctggctgggcaccgtagctcatgcctgcaatcccagcactttgggaggctgaggcaaaaggattacttgagcccaggagttcaagaccagctggagcaacgtggcaaaaccccatctttaccaactatacaaaaattagccagtcgtggtggcacatgcctgtagtcccagttacttgggaggctgaggtggaaggatcacttgagcctaggcaattaaggctgcagtgggccatgattataccactgcactacagcctgggcaacagagcaagacctccagctaaaaaaaaaaaaaaaaaaaaaaaagtcaccactccatcttagcaagtaaaaagctgagtaaactgaaaaatcaacagctcttcttagatccataagagatgggaggtcatagagtaaaccccaaattggaaacacaggtgaatgcagataatcacaacttaattactggagcagaaatcttcatgggaatcagtgctggagtgggaaaacctgaactgtaattgacaaattgctggaggcttggtgtggacaagtctgtgagataaaaactttattgggaggctcccacacttttgtagttttacctccaggggctctactaggttctcacagtgaattttgcaaacgatcctctcatgcttccaacaaggggagaggaaaaggaaccatcttgaaatgccctagagcattctgttcttaagaacaaggtcttccctcaggagaaattacttaactggagcctaacctgctggggttttataacagcctaactgatctgggggaagggaaatacccaactccagcctagtctagctatgttgtcccacctaaggagagggggagactgagaagcacctgtgaagttcacagtccagagacataggctcactaaaagactgagacctaattatcggactgtagaatgcttcctttccctccacaccttgccaccacattactaaagtcctatttacagtagtttctttagcccaaaacatcatgcctggctatcaagaaaaaattacaaagtatactaaaaggcaaaaaaacatagtttgaagagacaaagcaagcatcagaaccagatgctctggataaagtagacagcatgcaagaacaggtaggcaatgtaagcagagaaatggaaactataaaaagaaccaaaagaaatgttagagaggccgggggcggtggctcacgtctgtaatcccagcactttgggaggccgaggcgggcagatcacgaagtcagttcaagaccagcctgacaagcatggtgaaacctcgtctgtactaaaaatacaaaaattagccgggcatggtggcacatgcctgtaaccccagctactcaggaggctgaggcaagagaatcgcttgaacccaggaggcagaggttgcactgagccgaaatcgtgcctttgcactacagcctgggtgacagagcgagacttcatctcaaaaacaacaacaaaatgttagagataaaaaacactgcaatagaaatgaaaaatgtctttgacgtgcttattagtatactaaacatgctgaggaaaaaatcgctgtttgaggatatctcaagagaaacctcccaaactgaaaaacaaagagaaaaaaagactgaaaaaaaaaaaaaagcaacaacagaaaagaatatccaggaactgtaggacaactacaaaaggtataagtgtgtaatgagaataccagaaggagaagaaagagaatacagaataaatatttgaaacaatagtgattgagaatttccccaagccagtgtcagacaccaaatcacagatccagaaagctcagagaacaccaataagaatacatgttaaaaaaaaaaaaaactctacacctaggtatatcatatttacactacagaaaatttaagataaagaaaaaatccatatagaaaccagaggtttaaaaaatcttatagagaagaaaagaattacatccaacttctcctcagacagtatgcaagcaagaagagagtggagtcaaatatttaatgtgttgagagaaaaaaatcccaccaacctagaattctgtacgctgtgaaatcatcctttaaaagtggcacagaaataaaggtcttctcagacaaacaaaaattgggggaatttgttgccttgcaagaaatagtaaaagaatttccttagaaaaaagaaagagtatataggtcagaaactcagatatacattaagaaggaaagaacatccgagtcagtgaagataaaattttaaaaactttatttttcttatttttaattgctctaacagataacatttttttttcagagctttgggggaatttattagagcagattttgtgtatgaaaaaggtgctgggcttttatctaccattagcaggtgtcatgcctggtggcccccttatggccatcagtttgttggccagactgcaatggctacaatagccataagcagcaacaaaatcatcattattatcccacaagaggttgactttctgtccaccatgttcaaatgcctggtttcagtgcaaagtttttcatctgtgttttccagcaaattggcagagatgttaattatctcattttgtccatccaattcattcccaatttcctgccccatttgtttttggcaacttatgatggaggaaatggcatcgaggcctgtgtcctgttctttgataattttctgcttgctattgtcagagttcattgaaacccaagcctcttgtctcctctggctcctcaaagagccaagggttgggcacttcctaacagataacagtttgttcaaaataataatagcaataatgttctagattatatattgcatatatatagctatgtatatttatgtataagtgaaacaaatgaccacaatgatacaaaagatgtgagagagaaattaggattatttctttattataaggtactcacactaactgtgaagtggtatggcatattcaaaagtgactcagattcattgtaaatgtatattgcaaactctggggcaatcatttaaaaaggttagaaaaaaaagaagcataactgatatgctaaaaaatgagaaaaaaataatttatatgaaacgctcaattgtaacaacaaaaggcaaaagagaaaaagagtgaaagataaaaataagaacaaagaacaagaacaacaaatagaaaacaataaaaaatatagtagatgttaaccaaaccgtattaacaatcactttgaatgtcagtggtctaaattcaccagttaaaagaaagagattgtcagactggatcaaaaaacaagacccaactatatgttgtatataagaaacccactttaaatataaagacacatataaacgggtagagaaagatacaccctgacaacactaatcaaaagaaagcagaattagctatgcttatgtcagacagaacagacttcagagcaaggaaagtgggaagaaagagggacattacatagtgataaaggggtcaattctccaagaagacataacaatcctttacccagtgtatgcacctaacaacggagtgtcaaaatttgtgaagcaaaaactgacagaactggaaggataaataaatgaatccactattataactggagacttcaacatccctctctcaggaacggacagatccagtaggcagaaaatcagtagggcatagttgaactcaacaccaccatcaatcaactggatgtaattgacatctatagatgactttattaaacagtagcaggttacatgttcttctcaaagtcatataaaacatttacccacatagaccacattctgggctataaaatacaacttaacaacatttaaaagaatgaaaataatgtaatgtctactctcagaccacaatgaaattaaactagatattaataacagaaaggtagttggaaaatcccaatatacttggagattgaacaatacaattttatttgtttattcttctcaagagaaaattaaaatattttaaactaaatgaaaatgaaagccaggcatggtggtgcactcctgtagtgctactcgagaggctgaggtgggaggatcacttgagcccaggagttcgaggttatagtaagttatgatcgcaccactgcactccagcctgagcatcagagtgatatcctgtctctaaaaaagaaaaaaaaattatatgaaaaacacaacttaccaaatttgtgggatgcagtaaaagcagtgcttacagggaaatttttgtagcattgaatgcgtatatttgaaaagaagaaagatctaaaaatcaataatctaagcttccaccttaggaatctagaaaaagaagaacaaattaagtctaaactaagtagaagtggccagttatggtgtctcacacctgtaatcccagcactttgggagggtgaagtgggaagattgcttgaggccaggagttcaagaaccagggtgggcaacatagtgagacttagtctctacaaataaattaaaaaattaaccaggcatgatggtgtatgcctgtagtccagctacctaggaggctgaagtgggagaatcacttgaacccaagagtttgaggttacagtgagctatgattgcatcactgtactccagcctaggtgacagaccgtgtctgttaaataaataaatgaaaagtaggagaaaagattataaaaatcagaggagaaatcaatgaaattaaaaataggaaatcaaaatctggttctttgaaatgattaataaaatcaatgaacctcttcccgacttaatacttcctataaagctacaataatcaagacagtgtggtattggtgaaagactagaaaaacagaccgatagaatagaatggagagccccaaagtgaacccacataaatatagacaattgacctttgacaaaggagcaaaagcaagacaatggcgcaaagatagtctttcaacaaatggtgctggaaacctgacatccacatgcagaaaaaaatgagtctagacacagatcttacactcttcacaaaaatcaacctaaaatgggtcacagacctaagagtaaaacataaaactataaaattcctagaagataacaggaaaaaaatctagatgaccctggacttggtgattacttttcagatacaacatcaaaggcacaatccatgaaagaaagaattggtaaactggactttattaaaattaaaaaatgttactctgcaaaagacactgtgaattgaatgaaaaggcaagccacagactggaagaaaatatttgcaaaagacatatttgataaaggactgttatccaaaatatacaaagaactcttaaaactcaacaataagaagaaaaagaacctggacgggtgtggtggctcatacctgtaatcctagcactttgggaggccgaagagggtgaatcactttgggtcaggagtttgagaccagcctggccaacatggtgaaaccccgtctctaccaaaaactacaaaaattatctgggtatggtggtgtgtgcttgtaatcccagctactcgggaggctgaggcaggagaatggcttgaacccagaaggcagaggttgcagtgagctaagatcacactgctgcactctggcctgggtgacacagcgagactctaactccaaaaaaaaaaaaaaaaaaaaaaaaaaaagaaagaaaagaaaagtaaagaaaagaaaagaaagaaaacaaggaacctgaacaaaaaatgggccaatgaccttaacaggcacctcaccaaagaagatattggtggtaaataaatatatgaaaagacgtcccaaatcatatgtcatcagggaatgcaaatcacaacagcaatgaggtaccattacatattgattagaatggccaaaatctagaactgacgatactaaattccctgatgaggatgtggagcagcagaaactctccttcatttctggtgggaatttgaaatggtatgatgagtttggaagacagtttggcagtttcttacaaaactaaacatactctcgtcataagatccagcagtcatgtgccttggtatttacccaaaggaattgaaaacttatgtccacacaaaaagctacacacagatgcttaccacagctttatttgtgattgccaaacatcagaagcaaccaagatgttcttcagtagctgagtgaataaatggtggcatatccagacaatgggacattattcagtgccaaagagagatgagctatcaagtcacgaaaagatgtggaggaaatttaagtgcatgtctgtaaatgaaagaagccaatctgaaaaggctacatgctgtgattccaactaatgacattctggaaaagataaaactatgaagacagtgatcaaagatcagtggttgccaggggttaggagggagggagggatgaacaggcgaggtgcagaggatttccagggcaggtaaactactctgtatgagacagtaatggtggatacatgtcattaaacatttttcaaacccacagagcgtacaataccaataaggaaccctaatgtaaactgcagactttgggccaatgtaggttcatgaattgtaacataggtactgctctgtgggcactggcaataatgggagaagttatgcatgtgtgagggcagggagcacggggtgtctctgtatgttccactcaattttgttgcaaatctaaaactgctctaaaaaatagtctaacaaagcaagtttggagaggaaaatagattacataaaatcattttcttacctaattcaagagcaaatagagttgaaaactcaccatagaaactacattttttaaaaaacgattgggtacaatggcttatgcctgtaatcccagcacttttggagaccaaggcgagaggattgcttgagaccaggagttcatgaccagcttaggcaacatagtgagacttcattactacaaaattttctttctttaattagctgggtgtgggggtgtgcacctgcagtcccagctacccaggaggctgaggtgagaggattgcttgagcctaggagttcaaagttacagtgagctatgatcatgccactgcactccagcttgggtgacagggtgagacccagtctcaaaaaaaaaaaaaaaaaaaaaaacacaacaaacaaacaaaactaaattaataaaagcaaataaggagaataataatgaccaactttcagggtgttagaagatacaccccttgcttcatcatattgcttaatgtgaaccgactgaattctactaaaaatagactttaaacaaagttagaaaagaaaacaagtatccaacattctctcacctataacaggcatattacaaattaaaccattcaaatagtctaaaagctaagggaaagcttaagatttatgatgcctctgtagatacaaaacaagcaggtgttataatccaggctgcaatactgttgtagatgtctgagaactcggaagataatgactaagcctgagaaagggccagacaaaggtaattgtttcccagtatcctggaagataagagaatctttatggctactggagggatgtggactcagctgcagtctttctggcaccagaagaaaaggcatgtggtaaactagatatttcgtaatagggcccatggggcaaacgattctatattaatgatatagtgtaggtttcacccacaggatcccaggtgttctgtgcaggtgcgcacacctgtggaggaggaagcggagcaaactttaaactgcacacattaggaagcctgggacagttaaagagttcccagcatcagatatgtccaaaagaaaagcaagtaagattagcaaagatacatgcctttttccctcagcaaaaagcaatgaaggttgagtctccctttaaaaataaaaaatcggattatgaagcagtaacattcaaaatcatattatattgaattaaaaacaggtaaactgtttagtggaatagatttcctagaagtagatattaacaatggtaacaaatcaatataagactagccagcaataacacatctatagaaaagtgtattttttaaataaaaaatgatcaaaattatattcatctgaagaagaattagcacccgctatgcactgtatataataaactccaggtgggtcaaattaggctaaaatgtttattgtggatattttctttttagttttatctaaccatcagtttccctttccctgacatagcaatcccattgtaatttcctagtgtgaaacttctccctgagtatatatgtaatgtgggtgggaaggtcaagttcttttaccatctcccacttgaaagctgaaggccattcacccctcttctccctgcccagtgcagacagtagatgggcacttgacctaagctcagccaacccagtggtcactcctggaactttgattcttaaactgatacaaggacaaaaggaaagagtggttggtcagtttcatcacacaggctgttccaattacaaaacgactgatgtcctttcagtttcttggttctttagaactccatggtcctttcccatgttcaagtatgtgttccctcagtctcatagcaataattcgcttatattagccagagcgagatttttactacaagttgagtattccttaaccaaaaggtttgggactagaagtgatttggatttcaattttggcaggattttagaatatttgcattatatgtttaccaattgagcatccctaattaaaaaatctgaaatccgaaatgttccagtgagcatttcctttgagcatcactctaaaatccaaaacttactgagcaccagtgtgacgctcaaaggaaatgctcactgcagcatttcagatttcagatttttgcattagggaaattcaacgtctcaacctgtgtatccagatggagacggcaattccaaagaacaaactgaagaggaagagggtataggaggtggatgatggtgtcacagttcacctggaaatatcttctctacaaggaaaggtgttttttttttttttttttttttttttttttttttttgttgttgttgttttttgagacagggtctcactctatcacccaggctggaatgcagtggtgcagtctcggctcactgcaacctctgcctcctggggctgaagcgatcctcccacctcaggctcctgaatagctgggaccacaggggtgcacaaccacacctggctattttttttattttttatttttttgtggagacaaggttttgccatgttccccaggctggtcttaaactgagctcaagcagtccgccagccttggactcccaaagtgctgggattacaggtgtgagccactgtacttggccaggaaagcatcctgacaatgatctgatggtttacatttcttctgcttgcttctccctgtgggaggcatatacctctctatctttttgcttattttattttacatttttgagacagggtctcagtctgttgcccaggctggagtgcaatggtgtgaccatggctcactgcagcctcgccctcctaggctcaagcactcctcccacctcagcctcccaagtagctgaaactacaggtgcacacctcctcgtgtggctaatttttaatttctttttttttttatagagatgggttctcactgtgttgcccaggctgatctcaaactcctgggctcaagcaatcctcctgcctcggccccccaaagtgctgggattacaggagccagccagtgtgcctagctcctacccctttaatgttgggttggccacaacttgattggccaatagaatgccagtggatgtgatggctaccctgtctgagcagccttaggaatgattagtcaattttgcttccaaaacatattctgtactttatccactccattgcatcctaccaacattagccaaatctgagataatctctgtcaactacttcaataaccttctaactgtctcctggctttagttgtgtacctctgagaaccatccttcacacaactgtcacacaacaatgtcaaattaaccttgtaaggccacagatgaaagccttcaatggctccctctttcccacatggcactggaaagctgtcatgacttgtcttctacctaccccttaagcctcatcctttggccttccctgcttcccactttatgttcagcaacactaaacaccctggacactcctccattcctttgtccattctgttcctttgtccagactgccctcctctctctcctaatttttgtccaaataacttctgtttgactctcaagattcagctcaatatcagtgctcccagaaagtcttccctagtacttcctgggcatgtatttgccctgtgctttcttggtaccagcacacaccccggcacttccccaccttaaatttaaatgatatattctgtctttttctcttccaatagatttgccgtctcctggagggcagggactatatcttatttagcttttggtccccagactctagcctgatgtctggcacacagtaggtgttcaatacacattagtggagctgaaatcgaacaaattaaacattaatataagcaaattctgaaagccttctgcctctattcttacaaaagctggtggcattataaatgggttcttctggaaagcaatatagcactatataacaaaaacgatgaagatggtcattctccttgacttggtattttcccgtttgtgaatactcctcaaagaaataatccaaaggaaaaaaaatgtacacagatgtcctggcaactctagttataacagtgaaaaacctggaagcaatccaagtgtctaacagggaaatgactaagcaaacaatgggattattacatagctattaaaaaatgacagaggtgaggactatgtcaacatagacaagtgtgtatctatctgcaggaacgttaagtagaaaaaagaacacaggctagtgtttaaacactagtgattaaggatgtgtgtgtacattaacaaagattggaggctaatttggaggaatgaaaatggctggagtgcagtacttgttgagtctttattttcctgtgcagttccatgaatttttgacaataatacttgagattccatgcaatatagatatcctagaggtcttctgcagaataagtattctaagttataccaagctgtatagtccaagagaaaattttatgttaaattcttataaaattgttataaaataatgatatttctttaagtgaacaaagcatttttctttagttaaattcaacaagcaactatgagagcttgactatgttctagagcacttacattctggggaaattcaaagaaatcatgggcaaaaatcctcaggtgaatatgtgttattattttaatttgctttttttttttttgagacaatgtctggctctattgcccaggctggagtgcagtggtgtgatctcggctcactgcagcctcacctcccaggctcaaaccatcctcccagcttagcctcccaagtaccaagtagctgggactacaggcacacaccaccgaggcgcctgcctcagcctcccgaagtgctgggattacaggcataagccactgtgcctggccgaatttatttttattttggtgaatgtacatattagaacagatgacaaaggaaagtctgcaagacctttggactaaacctcacatttacaagttgtctcaattttattttttatttcaattttatttatttatttattttgatacagagtctggctctgccacccaggctggagtgcagtggagcaatcttggctcactgcaacctctgcctccggggctcaagcgatcctcccacctccaccttcccagtagctgggactgcaggcacaggccaccacacacagctaatttttgtagtttttgtagagatggggttttgccatgttgcccaggctggtattgtattcctgggctcaagtgattcttccacctcagcctcccaaagtgctgggattgcagggtcaccatgcccggcctgaattttatatttttgatgtctccaaaagaggtcctatatttagtcactgagatatacagttaagtattaaaaggaaaaagtcatcatcacataactttaaacttgtgccacttttccacttggtgcactatgaattaatattttataaatcctgtgactatattgtgaatagcaaaatactgacataagatatattacattgcaattaaaagaaataagccacaattttttatattccattatagaatttcttcatttttaaaaatcaactgagaggctaggcactgtggctcacacctataattccagcactttgggaggccgaggcgtgtggatcacctgaggtcaggagttcaagaccagcctggccaacatgatgaaaccccgtctctactaaaaatacaaaaaattagccaggggtggtggcaggcacttgtaatcccagctacttgggaggctgagacaggagaattgcttgaacctgggaggcggaggttgcagtaggctgagatcgcgtcattgcctaggcaacaagagcgaaactccgtctcaaaaaaataaaaaataaaataactgagagtctcaaaaaatggaggtggcccagtcctctgaaaggccttgagcgtaattatcactttatctttttttttttttttttttgagacggagtctcgctctgtcgcccaggctggagtgcagtggcatgatctctgctcactgcaagctccacctcccgagttcacgccattctcctgcctcagcctcccgaatagctgggactacaggcgcctgccaccatgcccggctaattttttgtatttttggtagagacggggtttcaccatgttagccagaatggtctcgacctcctgacctcatgatctgcctgcctcggcctcccaaagtgctgggattacaggcgtgagccaccgcgcccggcatactttatctttaaaatgtaatagttttaagtaggggcctaaagcaaatgggttgttgataactgtataaacacctcctaacatagtcctttccgctagacttactgtttctgctgccatgtaactggtggtcagaaaactaccagttctggctggccatggtggctcacgcctgtaatcctagcactttgggaggccgaggtgggcagatcacctgaggtcaggagtttgagaccagtttggccaacaatgtgaaaccccatctatactaaagatacaaaaattagctgggcatggtggtgcgtgcctgtaatcccagctacttgggaggctgaggcaggagaatcgtttgaacctggaaggcggaggctgcagtgagccgagatcgcaccactgcactccagcctgggcaacagagcaagactccgtctcaaacaaacaaacaaacaaacaaacaaacaaacaaacactaccagttcctagagcagtggttcacaaacctggctgcaggtaggaatcacctgtattctcccagatcccactccagacctcttgaattagactctccagggctggggcctgaagattcctatgcttaaaaagctctttctcgtccttcctacactgaatttcctcatggttcgaggactcagaattcaaactagtacagctaatgccgcggttcagctgcatcaagagtttaacacagtgacaacttgtctctacaaaaagtcaaaaaataaggcaggaggattgcttgatctcaggaggtcaaggctgcggtgaggcgtgatggtgccattgcactcccacttgagtgacagagtgagaccctgcctcaacaaaacaaaacaaaacaaaaaaagagttgaacagatctgaaggctagtttgaaggccaactaccattttcagtgtagtctctctagggtgatgtgttggaagtgcccaacaaacaatttaaaagagaagtctgaggatgtggtccacagatttttttttgtggaaactgaccacacagaacttttgaacaaaatgccttcatttgttcctaaaatttgttattgtgtctttactatatgaaattaaacaaatgctggctgggcatggtggctcatgcctgtaatcccagcactttgggaggctggggcaggtggatcacccggggtcaggagttcgagaccagcctgtccaacatggcgaaaccccgtctctactaaaaatacaaaaattagccaggtgtagtggtgcacgcctgtaatcccagcttctcgggaggctgaggcaggagaattgcttgaatctgggaggcggagattgcagtgagctgagatcatgccactgtactctagcctgggcgacagactgagacgccgtctcaaaaataaataaataaataaaagtaaacaaatgctgaattgaatcgctaagttcaagtgtcagttcttataaacaaggtgaagtaccagttgggttttttgtttgtttgtttgtttgtttttggagacagagttttactccgttacccaggctggagtgcagcggtgtgatctcggctcactgcaactgctgcctcccaggttcaagtgatcctcctgcctcagtctcctgagtagctgggactacaggagcacgccaccacacacagctgttttttttgtatttttagtagagacggggtcttaccatgttggtcaggctggtctcgaactcctgacctcaggtgatccaccagccttagcctcccaaagtgctgggattacaggggtgagccactgcacccggccccagttggtttttttttgttttttttttttttgctttttttttgagacaaggtctctatcatccaggctgtgttgcagtggtaccattatagctcactgcagccttgacctcctgggtgcaagtgatcctcctgcctcagcgtcctgaatagctaggactacaggtgtgagtcactatgcccggccaatttttaaattttttgtaaagatggggtctcattatgtcaaccaggctggtctcgaactcctgacttcaagcgaccctccctcctctgcctcccaaagtgctgggattataggcatgggccaccatgactggccaaagtaccaggtttttatgggcagtaaaactttagcccaaactgtcaattaactcaattttttttgcctccataaagaggcaaatacaaagaaaatgggctttcaacacagagaaaaacaaattccaagatatgggctgaggtcagtatacacgctgtctattttcctctaccttctggttcttcatcccacctctgtactatgatattgatgctctgaggaagaccctgtatcccagcaatattcctcatctataaaataaagatttaattgtgttcctctaaacccaaaacacacaggatgatgtccagggaagttagaggaacatgtgtcagctgaagaatcagtggtatgttccctcttgtctacctccccaattcgcgctggcccacatcccatttggagtgaccatgtctatggagatagaggaggatattcttccacttctaacctcaaaaggacacactggaggcatctagattgaggttacagctatcctttgaggagctgtaacaagaatatttggaagtggaccaaatctagaataatcaagtttgaaaggactatggttgtcctttctgttgctactgttgttatactgtgttgataaatacaaagtatagtcataaaggtgggggatttaatcatgttccagaatgatacggctgttaaggctttccaggtaagccagagagttgagataatccttattcaagtgagaaacgaatttggccctccttatctggaggagagggttagaaggacgatggatggatttggggacatgtagtaggactgaattcctaggctgagctccaaccacctctgaatgccccagagatatctatgttccatctggtctggtctgcagcaagtccacagaagctacattcacttttctgtgctgaattatcaaaataattgcccttcagcccatgcctcatgaccctgtagacagaatccactcatttccctatcacatgggctacaattgctacttcaaatgaaaacctgggaagccaatgccctattgtggttgaaagtgtacaattagctcctcatgcagcctgaccccactgatttttctgatgcatgtgacctggagtgtgccctttctgagaccgccaatgtcttctccacagctggagatgcccaaaactgcacgcagcacttcctgtgggtgtggccttgcattcttaggactgcagggtacccgctgcatgccaaatgatcccaggctccagccactcacagattcacaacgcttttaaaaatacagcagtggagtatgagcggctatgtcagatatgagggttttccaccccctcccttttcttttaaaatatgattttgtaatggtggcctcaagaaacactataattggtcagcctggggtgcgtttgaaggccttctctatcgcgtcattagctattctcaggaaaggcagggtatcccactgggagaatgacaacacacttgtttcaagttagggaagagcctgtggttctcttcctgcgttcaggggaaagcgaacacacaatgttcgtttcctaaatacgggatgtgctgtgctggcaggtcattttccaccatgtcacgtccttctagatgaaggcagcaggggtcatgacaggaaatggcaaattctcagaatgagacaaggctttcccagggcagccattggttctctggaactataaagcacactcatccagaaacagcctcagattttactttcctggaggcagacagaagtgaatggtaagtggggaaccctgaggcatatattcgggatgactttttctcattttctcttttcacctggaaaattatccctggtgggttggattatggaagcatggaagtaaaattaagtcctgtgaataaggagatgaggattctagactgggctctgtgaagaatcagctgcttctagaatctgatgtctgatgcaggcaattcttccagatgagaatgatttctgccctgatagctcagttttgaaatgctctatttctatggctcatttgccacttttaagaagttcctaataatgaagagtacagtggacatgaaggtgggaatctgcaactaggatgaatatacttttcccccaagatgtacaacttgttcgtatctttgtcagtcatcttcagttggcttcaacgtggtagaagttgttgaacaaaaattttggccactttattttattcaaccattactcatttttaaaagaaaactttcataacaaagagacataatggtattaatttaatgtgacttagtttaaatcaagcacccagcaaagactgatgtttctgaagatccaaggagccctagttagaataaacagtgcaaatctcattttaggcttgattctaagaaaagagcctggaagaatcacaagcagaagagttgcttcaggcaagcatctaacttagatgtttcttctgcttggtagaaaatacgatttttgaggttttggtgaagtctttttcattcattagagagagagaaaagtgtgttgcaaaactcctaggatccaattttcacatgatgaaagggctttgtaaactgtacaacccaccacttacaaagtgttatcttaagtagagcaaaggcctcagtactggagaagccttctaataccacgcccctcccagtttaaatcttatttaacacatagctgatgaagcccatcgttaacgttccctgggagagaagcagaagatagcattattcctatttccatatgcagagataaggtcctgagaacttgtgtggctccccccggattccagaacaggtctttgagaactcgtctcatgatccactggaaacagacccgttcccctagcgtggcagtggctgctccgctgaactcgtgccaagttcccgctggcgtccgggcagcagggcgggagcggcggctggcacggagactccaggctgaccgcgtgtctatgtccccgcagggaatggagaggccggcggcccgggagccgcatgggcccgacgcgctgcggcgcttccagggactgctgctggaccgccgaggccggctgcacggccaggtgctgcgcctgcgcgaggtggcccggcgcctggagcgcctgcgcaggcgctccctcgtagccaacgtggccggcagctcgctgagcgcaacgggcgccctcgccgccatcgtggggctctcgctcagcccggtcaccctggggacctcgctgctggtgtcggccgtggggctgggggtggccacagccggaggggccgtcaccatcacgtccgatctctcgctgatcttctgcaactcccgggagctgcggagggtgcaggagatcgcggccacctgccaggaccagatgcgagagatcctgagctgcctcgagtttttctgccgctggcagggctgcggggaccgccagctgctgcagtgcgggaggaacgcctccatcgccctgtacaattctgtctacttcatcgtcttctttggctcacgtggcttcctcatccccaggcgggcggagggggacaccaaggttagccaggccgtgctgaaggccaagattcagaaactggccgagagcctggagtcctgcaccggggctctggacgaactcagcgagcagctggagtctcgggttcagctctgcaccaagtccagtcgtggccacgacctcaagatctctgctgaccagcgtgcagggctgtttttctgagaacatcctttccccctaatgaccgaggccagcaaatcatcctcatgggatgctccagaatttgtagctcccttaggaaaacaccaagctgggttaggagccgaaggcaaaggatgagaaaaactgtttttgaagtgggcaggtccccaaagcccttcttttcccatcactgtgacatctgcctgggcttgagtgctacggacttttcagtcttcctagtggaaaaatgtgacccaaaaactctttttcctttatcaaaaactttctgtctaaacacagctgggcaggcactcctgttttaaagttatttcggggtccctgaccctgccctggtggcttggcctgagactggagagagtgccatcctctgggtcctctccaagtcctactagtctttgaagtcctcaaaatgtgcgtgaggaaggcgtttgcctctattccagaatttctgatacaaagaactccagaatccagagcaaatcagcccttctctgaacgttgtaggatggttcagaacccagagaggaccctggtgctgatatctcctcctcttccctttcccctcagcttacttactcccagatgcggcctgggtatgaagtaggcctttcctgagtggctcccaatccagtcctccaagtactcagaggggaagcccgtgaagccgtcatctaagtcctgctccctcacatgaagctgagggccagatagatggagcgactgccaacttcatttcccgacatcattgtgttcagaagagagtgatgggttttgagttagacagtcctgggcttgagacaggctttgtcactactgtgtgagtgtagccacctaatctctctgagactgtgtaaaacaaagatgataaaatctcaccctgttgtgagatattaaatgagccaaagtgcctagcatgatggtgctggctcatatagtgtagtccctggaatggcaaattaacatcacccaggaacttgttagaaaggcaaattcttggacacaaccctcctgatttatggaatcagaaactctggctgtggggcccagcaacctgagtttaaacaatttctctgggtggttctgcggcacactaaggtttgaaaatcactgcaacaaatgctaacttctaatccccttgatgagctttcacgaagtctcacggcttctctagggactccatggtcttcagagtcgttcacagatgaccaaggacagactgtgtcccagaagccaaaatgagagagagagagagagagcacgcgtacgtgcaccctggggcagtgtctcaccgtatgaacaagggatgtaacactaaaagcccattagggggcagtgtttcccgcctgttgtagaaactggtacagaaaggaatatgaagttcctgaaactgacctttgtctattattaccttctctgaaaagtgccagtccatgtattttttatttattttaagtttgtaatttaatttttaattattgtttagtgtttgcatttaattttatttaatcaccacatttagaaaataataagagcaagtttctaaatgggagactgctgaggctctttgcaagagatgagattaagtttgagtttctaaggcagggcatgagctggaaatagcattgctttccttgattgtctctctccttcagggagattctttttctctagtgttttaagtgatcctttgaagtaagtgtggagagtcttgaatggcaagaccaggagctgagtttaagcttgtaatggaagcttgcattgtgggatatataactgaggaagcatatttatcctgaaggtattttgccagaaggtatcacttgacctggaaaaggaatctatttagttcaggaaagataaaaagtttagaggtatgtgaaggaagcacttagaacttgcaagcctgatgtcctatcaagttatgtcttctgggtgacagacaaaatcgcttgtcttatggtggtgatgtgttgcattttcactttggggtctgtaagaaactgtcagtgaaaatatgtacaattccttcaatttccattcttaacaactgtaatgttgaaaaataagttgaaaagtctttgggaccatacatgcaaaaacggtgcctctgttacttaattatttaatattctataaatgtacccaatctgtccgcacccttcccagtgatggggcagtatgtctgaggaagtataatttcagtactggggtcggggagaggaggtgatgtttctacatttttattttttctataaattgcaattggtctgtatgctggtttattttgaaatttatattggtttcttttcaagctggtgtcatctcctagactgtttcacccagatgctagcattttttttttttttttgagacagagtctcactctgtcacctaggctggagttgcagtggtttgatctcggctcactgcaacctccgactcctgggttcaagcaattcttctgcctcagcctcctgagtagctgggattacagatgtgcaccagcacacccggctaattttttgtatttttagtagagacagggtttcgccatgttggccaggctggtcttgaactcctggccttatgtgatccgcccaccttggcttcccaaagtgctgggattacaggcatgagccacctcgcctggccagatgctagcattttagatcaaacaattcattttagatgaattgttttgtttcacaatcattttaaatcattttagaatgtacttcacattattagttgtgttatggcataaaggtacaaccattccctaactccatcttttattaatgcttaagtttaaattatattcttccaatgcctaagctattccctagaattaaactgggcacttttggaagcagcaacagtaacagcagcagcaaacttttcctctcatattttgggtgtatcaaaagttctagacttttgaagttatgatttcagtggcccactttatttctaaggaagagtgtctactttggaacgatactttgcacatagtaggaactcaagaaatacatttgaataattataattaactgtttagctatcttaatgagaatttgttgacaacaaaagatcatccatcgccttatgtgtgagtaagattggagcctctatcaagatttagtcaagttcagttagattgattctagaaacaaatatttatttctttcttttacggggatgtgaataaggcttttccttaaggccttcattctttaaacaaacaggttgaaatggtatgttgtaaaagagaagacgggagagaggtatttagatgataagtgtacttcacaaaaatgccaaagtttgaaaaataggtatgtttgttctaaatgtttaagtgcttctctgttaggttctggggcttgcaatcatttgaattgttctgtttcacaataaaggagattcactgggttctgcattttcaggattcaatagaactgctccattaaaaaaataatccttagcaagcattcgaatcctaactgctttgatgcacttgccctcgggcacctgtcatttccaatatggtaggtgtcaaagtcaaaagtatttactgggagaaaaaagagaggagtggttgtagaagtctccctaaatcagacatgtcaagcaatcagccaacgtggtgtatttctcattcaatattttagtgtgaattgagacactgagataaagacatcgtgcagagataaatggggatacagttaaatgtagcaactcttgagttcattttttcccactgtagcaaaattaatgctttctctttattgaaataaattgctcattcctcaaa

SEQ ID NO: 20 - DNA, 7009 bp, Homo Sapiens
gcattactcatactcagcggacaaaggatcactcagcattcaatctcaccacttcaaaacattacagagggaaaacgacacctagaagtaggagtgagattcgctgaagttcccttctgaggaagacccacccctccgcctggagagccggggctggcggtgcctgaggaccccttcggcctggacagcccacgcgggcttggggggcctcgctctgccctcatggggcggccatcggttcccgaagcggcgagtgaaaattcaaatggccagtagggggcgcactcggaagtggccgccccgcatgaggcagttcagcggccccgagagtccggggagggaggtttattctccgcctgcacgagactgtgaaatccgcaaccatgagcaggagaggcggccctggtggggaagaggccaccaacatctggacggcaggtaagttccgacgcttctgcagcgagcgcgggaggagggacctgaggcaccgctaacactcagagaaaactaccggctgagggtccctggtctgaatgcttgggaccggaagagtttcggagttcagatttttgcagattttggaatatctgcaggtacagaatgagaaagctaaatacgaaattcatttgtgtttcatacacaccttatacacactgcctgaaggcaactttataaaaacacttttaacaatttcatgcataaaacaaactttgaactgcctggactgcagcccgccacacgaggtcaggtgtggaattttccacttgtgtcacgacgctccaacagtgtcggactgtggggcactctggatttcagatttccagatgcttaaccagtactcagattcctaagttacttgtcagaaatgcctatttcttgggattacacttctctctgcaaatgtctgtgaaattcctgttaaattctttatggatcatgcacatgctactaagttaattatgaaatttagtgtttaacgcaggtcagttgcaaaaacaagaatattgcttgcttcaacccaggaggacaggttattgcctaaaagatacacaacacctagtatgatgccttcaaacttaaagaaaggtttgtatctgtgggtgaagaaaagcagttaaaccagaaacttccacaaaaacaagtctagtagaactgagctgattgccaaagtgtgggagaaaaagggccagcaaaaaaatggttaacactagccttctgaggaggccgcccagagcctggccagagaggagccagagaggagcggggcggagggggcctataaagccctgtgccaaggggcagactcactggctcagagggaggacgcacccgccagccagccgggaaccttccctcgcgggctcccagggcgggtctcttcctctctctagccctgctcaggcattcggcaggtccagcagaggtacacctcctgcagcgggttccaagtgcacctccagcctgatgggcctgaccaaggaggcttccaggagcacagaaggggctgcaacccaggtaggactcagcctcggcctggcggtgccataccactgactaggggagcgggtgggtggtgccacccaggccgctgtcctgttatgggaacagctgaacacagaccagacacctcaccccctggtgagagcagcacccagcttcccaaactcaaggcacagacccctctcccccggagctccggtggtctcagcgtgaccgcagcaggggctttgcctggacggcctttctaactcgtgctgaaagcaggacccagtattccgtcacgttctgtcccagcaagaacgtgtctcacttcaagaaaatgagggtgcccactctgccctgccctgcggtgccccagtcactctcaccaaccctgaagccctgggagggccacacgccttttgacagatgcagacttaatacagctgactaaagtgtggctttatttctctatgacaagcagaggaaatctgaaatgaggtattgcactgtttataactccatggccacctccagtgaggacgtggggccagtggtgaatggcacactaggttcctctcacccaggaccacatcagacactaggacacatcagacaccaggtcccgtatcttctcggtgtctggcaacgatcaaaagactcaatttacatgggaaagaaatgaatgactcgtttttaaactatttttcccttggagttcatttaacaaaattaggaaagaaaataaacgttaagttgagggttctgcccacctttaaacttcctgccacgccacggtctaatacgttccaaaatttctacatttaaagagcaaaacaagtcctctgtgccgtttttaagaaattaaatacagaggcgaaatgcggagtctttcaaccttcccgacagagcctgagagcagaggcatttatgctgttcaatggtattatctactaaagatgaatcaagagtgcaaaataaccaaaatcaaattcaccagccccagctaagtgaaggttattcagtacttttagaataactgacacagaggcagtgattcatcttgtcttccccacccgcctgtttttgagatggggcctcactgcagtagctcaggctcgagtgcagtggtgtgatctcggctgaggctcgagtgcagtggtgtgatctcggctgaggctcgagtgcagtggtgtgatcttggctcactgcaacctctacctgccaggctcaggcgatcctcctgcctcagcctcccgagtagctgggactacaggcgcacaccactatgcccagctactttttttgtctttttttagtagagacagggtttcgccatgttacccaggctggtctcgaactcctgaacttgagcaatcctcccacctcatcttcctgaagtgctgggattataggccagccttttttttttttttttttttaagtaagtattttcaagcaataggtcaacaaatctctagtctggttttgcagcacttcaaaacaataacccctggcccggcgcggtggatcacacctgtaatcccagcaccgtgggaggccaaggcgggcagatcactacaggtcagaagttcgatacaagcctgggcaacatggtaaaaccccatctctactaaaaatataaaacattagccaggcgtggtggtgcacacctataatcccagatactcaggaggctgaggcaggagaaccactctaacccgggaggcggcagttgcagtgagccgagattgtgccactgcactccaacctgggtgaccaaaaaaaaaaaacattcaaaacaataactcctaatgatttcaaaaggtaaaatgaaaattcccaaaggaaaaacaactcaaacccattttgaagtgttagtttactccagggcaccagcaccatctgggccaggtaattctctgctgggcttgggcacctgtcctaggcactgtagggagctgagcggcagccctggccccaccagcacccccctgtgactgcccccgcatccccagagactgccagtgtctgcaggctgagacccccgtggcccgctgcatagagaacttccaggagcacagtgacacggggcaggtgacgggaccctccccactggcggcagagccggggtgacacggggcaggtgacaggacctccccactcgcagcagggccagggtgacacggggtgggtgatgggaccctccccactggcggcagagccggggtgacacagggcaggtgatgggaccctacccactggcggcagagccggggtgacacggggcgggtgacgggacctctccactggcggcagagccagggtgacacggggtgggtgacgggaccctccccactggcggcagagcccgggcaccgccgtgggcggacagcccacttctccctctctgcagaggataagctcgggagggactctctccctggagtttcttcctaggttacaaacagcattgcaaaaacatattaggttttacaataatttgttaaaacatgaaataaaaacgtacatattatttcccaaaacaatgacccctttcactctatattacgaaaataagtttatttttggtacctagaacacagaactagcatgaggaaaccgctgaacttctgttttatcgtaagagaagattctgctctgatgtccagctttctggacccactctctctctctcagaaacactggctttcccttcctatcttacttctccatcagctgctgaaatgcattttcccctctcctcacaaatgccgttgtcctggggcggccgtgcccataccttcattgcttcctgggcctgctctgtggctataaagggaaaaacacccctgcctgtgggagtgactcacgtccagcctccagctgcagctgagcagccgtgggacctgcaggaaagaaggccatgtacttcccacaggcgactcttccacctcagctcaaccacagccacctcccgagctcataaagctgaggttctggccctccccagtgctcctgacacacccagactctacagacacccggccaggggagccaggccttgtcccaaagctggggccactcgatgagacttcatcctctcctgttgcttctccaggtacccagagagtgagcagctccacgcgggactgtgcacggtggccgacacccgcagggacgcccgccggacgagcacgcggagggccctcgcctccacggatgcaccatgccggtgtgaggagcatctgttcttcccactctctgcagttaacaaacccaacccaaaccaccacaggtgctcctcctggggagtttcctgtctgacaaatgccaggctcacttcaaggagaatcacgcttctttctaaagatggattcaccatttaaaacagagctctgggagcctttcggcaaatcttgaaagctgcacggtgcagagacatggatgtgacttcccaagcccggggcgtgggcctggagatgtacccaggcaccgcgcagcctgcggcccccaacaccacctcccccgagctcaacctgtcccacccgctcctgggcaccgccctggccaatgggacaggtgagctctcggagcaccagcagtacgtgatcggcctgttcctctcgtgcctctacaccatcttcctcttccccatcggctttgtgggcaacatcctgatcctggtggtgaacatcagcttccgcgagaagatgaccatccccgacctgtacttcatcaacctggcggtggcggacctcatcctggtggccgactccctcattgaggtgttcaacctgcacgagcggtactacgacatcgccgtcctgtgcaccttcatgtcgctcttcctgcaggtcaacatgtacagcagcgtcttcttcctcacctggatgagcttcgaccgctacatcgccctggccagggccatgcgctgcagcctgttccgcaccaagcaccacgcccggctgagctgtggcctcatctggatggcatccgtgtcagccacgctggtgcccttcaccgccgtgcacctgcagcacaccgacgaggcctgcttctgtttcgcggatgtccgggaggtgcagtggctcgaggtcacgctgggcttcatcgtgcccttcgccatcatcggcctgtgctactccctcattgtccgggtgctggtcagggcgcaccggcaccgtgggctgcggccccggcggcagaaggcgctccgcatgatcctcgcggtggtgctggtcttcttcgtctgctggctgccggagaacgtcttcatcagcgtgcacctcctgcagcggacgcagcctggggccgctccctgcaagcagtctttccgccatgcccaccccctcacgggccacattgtcaacctcgccgccttctccaacagctgcctaaaccccctcatctacagctttctcggggagaccttcagggacaagctgaggctgtacattgagcagaaaacaaatttgccggccctgaaccgcttctgtcacgctgccctgaaggccgtcattccagacagcaccgagcagtcggatgtgaggttcagcagtgccgtgtagacagccttggccgcataggcccagccagggtgtgactcgggagctgcacacacctgggtggacacaaggcacggccacgtcatgtctctaaactgcggtcagatgtggcttctggctcctcggggcctcgcgagggtcacgcttgcctggtcaccctggggctgcttaggaaacctcacgactggtcaccttgcactcctcacacagaattgctacaatcccaaagcgctcgccccgcagggtccaaaggccagcggtgaccagcctgtcacccagctcctccccgccaaccctgcctgccgctgcacctgcctgccgctgcaggaaacatttctgacaccgtcgaccaggaaagccacacggagaggccactgtgggtgaagcgcctcagttacacaggaaccctaaagcaaatctgccaccgtgggggaactgacgctggagatgcaaggtgctggtgggtctgagctggacgtcgcggtgtgtcctctgtgcccacggtctgagctagctagcgcaccgccgagttaaagaggagaaggaaaacatgctgctctggtgcacgcctgagcgtcctccatcttccaggatggcagcaatggcgctgtgcggcctcaccaggcccacgaggagcagcagcgctcggcccggagcagcaggaaggcccctctgtggagcgcccgccgtctgctccggggtggttcagtcactgcttgttgacatcaacatggcaattgcactcatgtggactgggaccgtgcgagctgccgtgtgggttagtcgggtgccaggacaatgaaatactccagcacctgtggctgacgaatttgtttctacagaaataacagctggggacaactgcggtgatgatgtaaaaaccttcccataaaatgtaagaaaagctgatgaggctggtgacgttcagcctttgtcaataaacctgtcatgtgcggatcctt

SEQ ID NO: 21 - DNA, 33362 bp, Homo Sapiens
cacaacaagcgccgtgcgccccgccccccatcgggggcaaccattgttccgccggtcgcgccggagctgggttgctcctgctcccgtctccaagtcctggtacctccttcaagctgggagagggctctagtccctggttctgaacactctggggttctcgggtgcaggccgccatgagcaaacggaaggcgccgcaggagactctcaacgggggaatcaccgacatgctcacaggttagcaccgggccgggccccgctggctttcttctttccttccagcctcttcccctgccttccttctctcccacaccgacagtccagtgggtagggtaggttccttgcagcgggtcgtcttccgtggggatctccctccggcgcccctggctggttgtcagtcctgccggctacacctgggccatcgcttgggctgcttttggtctggcccttggaggaaacgggtggtcactgtctcttagaggctgccatatccccttccagaaaacagttctcgtttgtttactcgtggttcttgttcacccgagccttctgttgcctttcagaactcgcaaactttgagaagaacgtgagccaagctatccacaagtacaatgcttacaggtgggacagtgcagcattctcgggtagcatacgttctgggataccctgtttagtgtggcaattaacaggactgagggcccagtggatatttggtccatctgcaagagcgggaaaaagcaagaatcgaggctggtaccttactatttcttgaagaatgtgggcagtgcgttataggatcagttcagataagttcccaattctgattgcagatagctgtagcctgatacgtattttgtcatcatcaaacatgaattactagaaatgcggtgtaattttaaccgtaatgaaagacagcggatgaagtccatactgtgaaatatatgtggttcaaggaatcacattttttcttttggttggtctaaagttgatcctgtgggatcctgatcctgatccttgttccttgttcatgggatcctgtccttgttcatctcaccaggggccttatcctattcattctttccacatccacctgcttctactccttagcctatatttatttatttatttatttttatttgagacggggtctcgctgtggtatgatcatggctcattgcagcttcaaccttccagcctcaagtgatcttcccatctcagcctcctgagtggctgggactactacaggcgcacgccaccacacccagctaatttttttttctttctttttttttctttttttttttgtagagaccgggttttgctatgttgcccaggctgatctccaactcctaaactcaaatggtccacacaccttggtctcccagagtgctgggattccaggcatcagcctcggtgtcagctctccttagcctataaatatgtgcaagtccctcagctcttaaaagcaaaaccaaaacaatcttaacttccctctagctagcaccttccctcttttctcactttatggtgaatcttcttgaaaaatcttcattccttgcctggacttcttaatacctaatcatttactcaagaagtcccagtccttgcctggacctaccagtgctctgaaaatccgctcacctacgtctcatcttattggactctctgtggcattcacccctggctcatgctgtgaatatctcttgacttctgtaatggcactctttctggtctttcatctcttcttctgtcttaccttttaatgttggtataggttgagcatccctaatctgaaaatttgaaatgctctaaaatctggatgattgccgacatgatgacacaagtggaaaattccacatccgatctcatgtagtaggtggcagtcaaaatggtcaaaactttgtttcatgcacaaaattattaaaacgactatataagattaccttcagggtatgtgcgtaaggtgtgtgagaaatatgactgaattttgtatttagacttgtatctcccatatccctaagatatcttattatgtatacgcaaatattccaaaccctgaaaaaaattcaaaatctgaaacaatgctggtcccaggcatttcagataagggatagttaacctgtggttccggggagtctgcctgcccttagccctcttttcttacttctgtagtttccctggcaatcttgccattcttgactttgaaatgccacttatgtcagtgactccaaatctgtgtatcactggacttttttccacatttttagccctatactgtctttatcccaagtcagctcccttcttccattcccactccacacagttcagagctgattgtgctccctcctttccttacttctgtgacttcctctgtaaagtaaaataattgtattatcatccatacatttgatgattcaaaattacagagatattcaactttgtattctatttggatcacagcaggtctcagaaaggaggtgtttagtttgaagaagctcatcgggataagtgagagggccagcagtctagacaaataaaatgtgccaaagcattgagacatgaagggtataacgttttctggaagtcagatgttcagtttgcttaacgggtatggtatgagtgggaaataagtctggaaaagcaggtgattccctaccactcctgcatgctcctccctaccccagtagacatttctgttgattgtggccaaagtattcttttgaaaatagttatctgatcttgtcagtcaaataattaaataatattttctctttaccttgataaaacccaaatacatcatagcatacaaaaggcctttcatctgattcttcttcccttttaggctttgcctcacagtgccaatgacctggaactacttgcctttcctgaaatgatcccctccataaactgtgtttgcctgctcctttacttataaatatgtcttttcagattcatcatcagtcatgtgcttagagagaagttcaaatccaaatataaagggttatttgtgctataacagaatgcaaatccaaggttccaaagactatccagtgtttatgcttttgacttagctgtactgtcacttctcatcagcatcaactctgaattacattttgcattgaaattatagacagaataccgtcagcgagctcccagggtgtatccaatctgtcaccagattaacaaactggatatgtgtggaggtgggcaagaattacaggtcaccgctttatgctgaactgcagtgggaacaattttttttttctgtccataagtttattgtctttatctgaaaaatcctcgtagaaaattgtttggtttagctctctgcagccccctcctgagccgtggggaagcttgccttcttttgagctatgcgatctttcttctgagcaagggacattttgggatggttccacctctttttaacttctttcttgagcttcttttcatagactggattctctcctatagcagcatgagctttcatctccttcatcatgtctgaagttatgctattctttatgtattgagagaactgtttcttgtaagcatctttatcttccattaagtagtgcatgtaatctgcaacattctggcctatgttgtgcttctggtgtaattctgcattgaattccttgctttcagaatcataaccagggaatcatttggtactttgagggatagacaagcctccatccaggtcaccaaaaactttattgccagtggtagttctggcaaggcctgcatccaaatagcaggtgaaagcacctggctgaccatcaatgctttctacattgtattatcgccagtcacctccacttggccttcatagatcttgtccatgccaaacctattgagaagcctgtgggccagcagcaggccagtacaatatgttgcagcataatttgtcaggccaaccttcacaccatattttggcagttcgtgtgcatatgctgcgcagactatcatatccccctctatacgggcataagcaatctgacaattgatatctctgtttgttatatgaactatcatcctctatttgggtgtgttgtatttatttttatcctgtattaccaagcgtttctgagcatagtaatcagttttaccatcttgtcatctttaagtttcatttggtatctcttaaagtaggccttattcttaacaactttaacaaagtccatcctgtggaacagagacctgcaggcccagcagcactagggggtggaaaggcgggagcaatttttaaaaactgatgtaggggccaggcacagtggctcacgtctgtaatcccaccactttgggatgccaaggcgggtggatggcatgaacccaggagttcaagaccaacctgggcaacatagcaacatcccatctgcattaaaaaaaaataaattgatatagggacataagggaatgcagtttgaaactatgaattttaaaatagctatccaagggctgcgtgtggtggctcatgcctgtaatcctagcactttgggagaccgaggcaggtggatcatttgaggtcaggagttggaaaccagcctggccaacatggtgaagacctgtctctactaaaaatataaaattggctgggcgcagtggctaacgcctgtaatcccagcactttgggaggccaaggcaggcagatcacgaggtcaggagatcgagaccatcctggctaacatggtgaaaccccgtctttactaaaaatgcaaaaaattagccaggcgtggtggcgggtgcctgtagtcccagctactcaggaggctgaggcaggagaatggcatgaacccgggaggcggagcttgcagtgagccgagattgcgccactgcactccagtctgggagacagagcaagactgcgtctcaaaaaaaaaaaaaaaaaaaaaaaaatatatatatatatatatatatatacacaaaattagccaggtgtggtagcatacacctgttatcccagctactcaggaggctaaggcaggataattgcttgaacctgggaggcagaggctacagtgagtcaagatggcgccactgcactccagcctgggtgactccatctcaaaaaaaaagtaacataggtatccataagcagatctggtgtctaataattcacatgtggcacatttttatgaggaagttatgaacaatttctaaaaactagctattttaaaaaagggggcccaatgatgatttctacttactcccaaagaaagacagctggtctccccatcccttgagtattatgtatacagtttaaatcactttgttactcagcacaaatcaaaacaaatcactttgttactcagtacaaatcatactctttgacgtatagagtttaaattcagttattctcaaatgtggagcttttcaagatactttaaaagttagacgtaggccaggcgtggtggctcacgcctgtaacccagaacttttggaggccaaggtgggcagatcacaaggtcaggagttcgggatgagcctggccaacatggtgaaaccctgtctgtactaaaaatacaaaaaaattagccagatgtggtggcgcatgcctgtaatcccagctactcaggaggctgaggtaggaggattgcttaaacctgggaagcggaggtgacagtgagctgagatcacgccactgcactccagactgggcgacagactgggcgagactccgtctcaaaaaaaaaaaaaaaaaaaaaaaaagtggccgggagtggtggttcacgcctgtaatcctagctggttcacacctgtaatcctagctttctttgggaggctgaggcgggtggatcacctgaggtcagagtttgagaccagcctggccaacatggagaaaccctgtctctactaaaaatgcaaaaaattagccaggcatggtggcgggtacctataatcccagcaacttgggaagctaaggcaggagaatcgcttgaaccccagaggcggaggttgtggtgagccgagattgcgccattgcactccagcctgggcaacaagagcaaaactccatctcaaaaaaaaaaaaaaagttagacatatattaggtggtctgtcagctcatctgatttttaagttccatatggaggtagaaaattaggccaggcgcagtggctcactcctgtaatccccgcactttgggaggccaaggcaggtggatcacgaggtcaggagatcgagaccatcctggccaacatggtgaaacatcatctccactaaaatacaagaaggcgcgcctgtagtcccagctactcgggaggctgaggcaagggaatcacttgaacccgggaggcggaggttccagtgagctgagatcgcgctgctgcactccagcctggcaacagagggagactgtctcaaaaaaaacaaaaaaaaagaaaattagttatcttggtgaaagcataagcatagatatttgcttgtatatgtattccagtttaagaaaaattaaggccttgatggatttctaattggttttccttttcttctttccttatagaaaagcagcatctgttatagcaaaatacccacacaaaataaagagtggagctgaagctaagaaattggtaagtttagttagcatgttgatcgaagagttcacacgtgtccaaatttggtgggttcccaccaaaccaaacttgcctgtctgaagcagccttgacccacacaggctgatttcactactcctgatttcttggaataacattcatgctgtttcatacacactttttcaagctcaaaatgttttcatttgggagaagatgggttaaaatttttaaaaatatatgtaattacagttttctttctctctgttacaatatatacatgtactcacgttgaatttcaacttgagtgttggtttttaagaagagtgaccaagtggcactagcatatctggtcccacctatttttctctgatccccaggtgtaggaacctatgtgagttagtgggagtgcgtgttccccagagagatcttactaataagcacatgattaagacccttttgttttatggcatttagccctgttctctgtaatttccacgaagccttgtgtactgtgtcacagtttctagagggtcacatgcctcgttaatttgtaatataataccccttatctgaaatgcttgggaacagattattttggattttggattttttttttgaatatttgtatttggttgaatattcctaacccaaaaatccgaaatccaaaatgctccaatgagcatttccttttgagtgtcatgtcagcactcaaaatgcttcagattttggacattctggaatgtggatttttggattagtgatactcaacctgtaatatcactgagaatatcctgagatggtctatctattgacaatcagattgttgtctcatctaaatcttactaaatgattcaaagttccttaaatttaaggaccatatcttattcatcttttgtgaaagatgtcaaattatcatggcttttttgtttgttggttttgagacggagtctcaccctgttgctcaggctggagtgcagtggcacgatcttgggtcactgcagcctccgcctccagggttcaggtgattctcctgcctcagcctcccgagtagctgggactacaggcatgcgccaccatgcccagctgatttttgtatttttgatagagacagggtttcactgtgttggccaggctggtctcaaactcctgacttcaggtgatccactgccttgagcctcccaaagtgctgggattatagtcgtgagccactgcacccagcctgagatgccttttgagtagtccaggtcctgatagttatcacctccttttgttctttacctattaatgtttcacaaatgtcctctggaatttaagaattaatatttgattatcttttaaccttctcaggagatgagccataattgcccttttttttcttttttctttttttttttttgagacaggattttgctctgtcactcaggctggagtgcagtggtggcataatcacagcttactgctgcagccttgaccctcccagccaagcaatcctcccacctcagcctcctgagtagctgggactacaggcatgctccatcacactcagatattttttttttaatttatttcttttgtagagattggatcttgttatgttgcccaggctagtcttgaactcttgggctcaagtgatcctcctgcctcagcctcccaaagtgctgggattacaagtgtgagccaccatgactggaccataactgccgttatatttttgcccttcagagtcataacattaccataaatcttggacattgtgtgatttagtgacagattgtccacattcaacatgtgccacatcttaaccttgacttcgctactcagtacaaatcatgctctgatatataggctttaaatccttgtggcatagacagttctcagcatcagtatatcctccttaaatagactagccaagtaagttataaatacattagactttaattctgagtttctgtcttggtgaactgacccattgatagtctcaggaactactcctgcttccattcacttcctcttttatccctacagtacttccttttttatgtttattgcaaatagcctgctcatttcttagagaaaaactgaaaagctctgatacacttcatctcaaatctgcgcttatggtatattcctaaaaagaatacaaaggtatccaaaattccttttgcataagactggttgtaaaaatctcatcattattccttttcacaattattgaagaatcacagagttgctatctagcccatttctggaattactcctcagtaattctagaaattattctagaattactcctcagtaattctagaaattattctagaattactcctcagtaattctagaaattattctagaattactcctcagtaattctagaaattattctagaattactcctcagtaattctagaaattattctagaattactcctcagtaattctagaaattattctagattatctaatctattccttcttagtaacggaagtaatagattcttcttagattatctaatctgttacttctcagtaattctagaaatctgaaatttccagaatgagtagtttgtcttttattccttaatgtttggtatagaaagtagcttgggtctgaattgcttgaggtcagtatgttattgagtaaaattattgtagcactatgtgtaaagggaaaaataattaccctttaaaaaaatattgtgatacaggaaatgagcctgagcagtttcctttttctaatctattctgcttcctaaatcttttgttcatttctatctggtaattgctgttttccaaacttgaatatgctttcagtaatttggggacatttattaaacattaaataaattaagaatattgatgagtgaacctaggcctgagaggcagtagagataactggcacacctgttattaagcatgctgaatgtttaactaaaaaggacaggacatttttcaatacacatgaaaaaaagttcaattttactgataccaaagttgcaaattaaacaagacactatatagtgcccatcaaatacatgcagtgtggagaaagatgtgaaaaaaaggaccctcatttactacccatgaaagtgttggttgttacagcctttctgaaggctgctttgtcagaatgtatatatcgtttgacctagcaattccactttgacgtatgtttcctaaggaaggtaatagagatatgtatctactaggattcattaattcataatttttgatcacctgtatgccagtcactagggataaaaaaatgaaaagacaggatctctgctctcccaaaacttagattctagagaagtgctgcccaatacagcaaccacaagccacatttggccattgagttcttgaaacgtggatgttgtgactgaagaatggaattttaaattgtaattaatctaaacttaaattgtcatatgtggctagtgtaccatgttggaatgtgcagttccagagcagcgcttcttagaacaaggtgtctaggccagcagcatcagcgtcccctgagaacttaggcatattcttggccctactccagacatggtgaatgagaaactctagggtgggacttacattctgtgttttaagaagtgcccccatgtgatgctgatgtatgcaggagcttgacaacctctgttctaaaggaagtttatgaatattattatactgtcaaataattggaaacaatctacatgtttacctgtagggtatttgctaattaaattattatgcatttatacaatgatatactgtgtagccataaaacaaaagttaattttaaataagatataattattttctcagagtttcccttttgtcattcatgtaagcattctgtcttcgggagaatttattttcactggggttcaattttctgtgtcctttatttcaaaccttatcacatggtattcatttgtttttcattttctgctttttactttatcttttagtgatttggtaagcattatattcatatgacttttatatttctaattttccatgtagcctggagtaggaacaaaaattgctgaaaagattgatgagtttttagcaactggaaaattacgtaaactggaaaaggtaaaattttaacttgtttacttcattaattatagtatctgcctttatggccactatgtagcgtcattgcagggtgaccaatgtcattcactgtagtgagactcacaggaaatgaggtgagtgaagttgatggctttaactttttgaatgttatttccataaaatgttcacttgttttatgtggcatttaagagactattaacacccgtaatagagttggctcatcgttttcagtactattcagaaaagagattataaactttgactgaaagatcgttatcttttagaatttctttatttctttatttatgtttttgagatggagtcttgctctgtcgcccaggctggagtgcagtggcgcgatctcggctcactgcaagctccgcctcctgggttcatgccattctcctgcctcagcctcctgagtagctgggactacaggcgcccgccaccacacccagctaattttttgcatttttagtagagacggggtttcaccatgttagccagtatggtctcgatctcctgacctcgtgatctgcccgcctcggcctcccaaagtgctgggattacaggcatgagccaccatacccggccatcttttagaatttctatgtttacactctcccaagcatttttatggttttatttcaccccatgatagtaattatatcacttctgatctgttaagaatagaccttttaaaagtattggataacttagagatgagacatcttcagttactctgttattcacctattactccttaggttacttgtgaataattttgtgtgggtcacccaggcaaatgtaaatagctcttcatgtcttttagcagactggtatgtttccaataagatcatttaagtcctcaaagcattcctaaatcattgttagacttttttttttcttaaagattcggcaggatgatacgagttcatccatcaatttcctgactcgagttagtggcattgggtaagaactattttttaagcagacacaatcgtcagttagtttatttttcctgttagccaaagtaaattacatgctgtttctcaaaacctgtacttcaccacctctgtaccttagccatacagttcacccttccatagcttatgatctgaggccgattcttcagatagtgtctctactgtaaggtccccatccaaggcagatgttacctccttcatgaaaccagtttggttacccaggcagaaagaacctctccctcctctgaactccactaccatttcctccgtgtgcatctatttcctgctccagcttggcctcttttgtttctctgagcatgatatttatcatagcacctcatgaatttggaacaagccctcaagctttttttaaattattttttgagacagggttgctatgttgcccatgctggtcttgaactcctgggcttaagtgattcttcctcctcagcatcccgagtagcttggattataggtgcacgcccccttgcccagcttcaagcatttttaaatgaagggattattatcttaaaatttgagctggtaccaaggtgggcttttttgacactggctgaagtaaagattaacattgaaatattaaggctttagtgctctcatctttatggcatggggcattcctttaaatataatgatttgttctttaaatggcagcattttcggtgaaagttattctaaaacatattaaattcttaaacctagtatgttgaaaatgaaaatgactgcttggggactcaaggccattataaaattttcattggaagaattacaaaaatttttttttttttttagagatagtgtcttattctgctatctaggctagagtgcagtggtgctattatagctcactgtaaccttgaactcttggggtaaagtgactctcctgccttagtactccttttgagtagctgagactacaggcttgcgcaaccatgtgtggccaatttttgtatcttttgtagagaagaggtctccctatgttgcctaggctggtcttgaactcctggcctcaagccttcctcccacttaagcctcccagagtgctaggattataggtgtgaaccacaaggtgttttagagagcatctattatcctttttttctaggcaagagaactgaaagttgaatatagaacatgagtaaccatggcagagccagatttgaacccatatcttctgactccgagttcagttctgtttcttctatgctgcattgccttcctaacatcagtatcagtttctatatcacaatataatgtgatgatatttgcatagcttactgaatgatacaggtttatttgtcccgaaacactgtggccccagactattgtgcttgtatgtttatatgtgtgtgtatgcatttctttctgttcaccgctcctgctttattatgctgtaaactggtatggtgagaagagagtcaggaaatctggataatggtctagagctagcaccagctagatttgtgaccttagcaaatcgcttcatctttctaggtttcagtgtccttccttatgaaataagagagaaatttggttaatcagtaagcttccttctgtccccatcctataagagcatcttcagtcatttctgacattctgatttatttatatgaataaagtgatattttagaaacctaaatcagattttatcattgctttgtgcagtgtcctctaatagctttccattgcactcagaataaaatccaaacctatcaccatggctctaaaagcacagtagagtgtaacacctgcgtactgttccatagcacctcataccgtcacttacatcactctatgcatcctagtttttctcttctcttgaacaggccaagctcatgccagccttagggcccttgcactaattgtttccttttcccgaaacgtttttctctttgatcccctagatagctggttctttagtcattcaaacctcagcttagataccatctcagagaccttctaccactcagtctaaagtaggacccagccattctgtcatattctattttaatttatccatctgattttttcttgtttatgtaactaactattgtctctatctacccacttacattcttattcctgctacattttcagcacccaggaaagtatctgacacataatggccctcagtaaatcttagttcaatgaatgaacagttttcaagtgccatctgtacatgggcactatgacagcagctgcttagacatcctttttatgtctgaattcatagttgtcttcctaatgattgaagcttcaataattcgtacttcggatacagttgaacattaccaaagtagccatgcaacattttagcaggtcttgtttagcttaatagcagctcttcttactattaagacatggttgttacaaggatcccaagtttcacccaatgttgagataatgcttttgtttttgtagtccatctgctgcaaggaagtttgtagatgaaggaattaaaacactagaaggtgagtatgactgtaggtcactaattccagattaaatatggtcctgaaggaccattagtgctctaacaaacttcaacttgaaaaacccattctcaatcagtagatacaaaagataagattttctttttaactctgtagtacagtagatatagggtatagtttatattaccatcataaacatttttaggtttgtaactaactcagagaaaactaagaagaccaagaaccagggccaggcgcggtgcctcatgcctgtagtcccagcactttgggaggcgggtggatcacttgaggtcaggggttcgagaccagtctggccaacatggtgaaaccccatctctactaaaaatacaaaattagccgggtgtggtggcaggcacctgtaatcccagctactcaggaggctgaggcaggagaattgcttgaacccgggaggcagaggttgcattgagccgaggtggtgccactgcactccagcctgggtgacagagtaagactctgtctcaaaaaaaaaaagaagaagaccaagaaccaacctcttgacttaaaagcaatgaaatagttatcgtttgcaaatttttcaaatatctaaattgcctttatttctttttttttttttttgctctgcctcccaggttcatgccattctcctgcctcagcctcccaagtatctgggactacaggctcccaccaccacacccggctaatttttttttgtatttttaatagagacggggtttcactgtgttagccaggatggtctcggtctgaccttgtgatctgcccacctcggcctcccaaagtgctgggattacaggcgtgagccaccgcgcctggccccctttatttctttaataaaattttaggcaataaaatcttagattaaaagctaagttatatattactgaaaaagattctgtaagagatttgtaatggttattaaaggaatttttgctttcaaagaaaagataaaaatagaacctaacaagtaattataaaacgttttccttaaatatagtaatcctttacatgtaatttatctctttatacttttcatgggtgtatgtatacatatggattcattacagcatatccatggcatttgggatttagtatttgtgagtatttgcaagcagcccagtggttaggtaggcaggttttggagactgacctggctttgaatcccacctccactactttattagagtgggatgaccttattgcgtcagtttcacacctacaaaatgggtatttctgcttcgtacaattaaatgcaataatatatgtaaagcacttagcagagtgcttggtacctagtactacttaaaaatggtaaccaactcttatgaggcatgattagtagtattactaagttaagaatttgtgtgagccacattgctagagaatgaactctacatgtgcatctcatacagggtttatgctttgatgcctgtggtatagacagcttatatgagagaattgattggctaaaggggtcaagaatctgtgggtttcttggaggtattgagttgcatctcttgggagtgtcaaggatctactgttgtggtttttatatttcacaattcacacataaggaatacaactgttgatatctataactatatctgtctaacatactcagtatttccacttcttcagttttagtcgtatactttagcgttttctgtgtgcacataaccataggaaatattaagtgctctatatttcataaagatgcttatttttctcgattttatatctccagagggaatgtgtatatttgtggctataagggggcttgtaggaattgcttttgaagcatgcttatcttgctgtttctttaacaaggctcacagctggattcatgcccagtaaagggacacctgaatggaactgagtcacttttagacttaatatgggatgttatgacaattcttaagttaaaaaatgcaggtacagtaataattttcctttcaatggaatttttttttgttttgagacacagtcttgctctgtctgcccagaagtacagtggcgcaatcttggttcactgcaacctccgccacctgggttcaagtgattctcctgcctcagcctcctgagtagctgggattacaggcgcgcaccaccatgcctggctaatttttgaagttttagtggagacagagtttcaccatgttggtcaggctggtctcgaactcctgacctcatgatcctcccacctcagcctcccaaaatgctgggattacagtcatgagccactgtgcccggctcaacaggattttgagcacaatgactgcacaaatctactactcagtgctaatggaatgaaagagtgaaagaacaaataaactatgaataaacctagttaatcagaaaacattcagaagttatggttactactgttgctcttaacaataaattaaaccactatagtcagtaaaatttggtgtgattctgtttttttttgttgtcgttgttgtttttcgagacggggtcttgctctgttgcccaggctggattgcagtggcgcaatctcggctcactgcagcttccacctcccaggttcaagcgattctcttgcctcagcctcccaagtagctgggattacaggggcacaccaccatgcctcgctaattttttgcatttttagtagagatggggtttcaccatgttggccaggctggtctcgaactcctgaccttgtgatccgcccgcctcggcctcccaaagtgctgggattacaggtgtgagccaccacgcctggccctgaagagtcacttttatctagctcttcatatctgaaatttttgtctcattgtgttttcagtcatttcaatgtatttgttccccaggtggttctttataaaaagggtcattgagtttagcattttccccccaaaaagcatttaaattaacatgtcaactttatttatcttctatacagatctcagaaaaaatgaagataaattgaaccatcatcagcgaattgggctgaagtaagatggcagattttcttttgacacttgagatataaaagtaaattttttatagacattcttttatacaccagaaggactcttcaaacttagctaaaccacaaccattttcctattcagaagtgctaagatttgtggactcttacagagtatctgcctgtgttcacacagtgctttcacttttgctttctagtttacttgttttgaggatttcccttattcttttgactttagcagggaacttcctcttaaaatacctaggactgagtgtatcaggcagtcagcgggtgtttatttcatgctcacattgtacaaagcactacactaggtctagggtaaagatacagagaggttgagtgtagcttttaagaagtttatagtctacccgagaaggtaggacatgaatatgaaaaactaaatttaaaaaaaggacaaacctcatacctaaataaccatataggaataactactaggcatgtttctatatcagcatcaataattattttgtgtgccagatatagtctgggaaccccttttctaattatttacagttatagtgcataagcactatatgtatctcttctggcattatatagtgttgtgagtgattcagtcctaattaccttttgaattttcctgttgatgctttaccataatattttaaacttatactcccattccaaaatcttgagccagtgagagacctggatggtatggttcttgctctcctggcatttctgtagtaaatggaggtgttctgaagaactggtttgctgagaattggctgtgaataggtgcttcatcatgctgaagcatatgcttagttgctgtttcacactgaatttcctaacagccttattgagatgtaattcatatgtcctgtaattcatccatttaaaatatacaattcagtgacttttagtatattcacagagttgtgcacagtgtaggaaccatcactacagtcagttttaggacatttttgttatctcagaaagaaccctgtacctattactagtcattcccccattgcctccccttacccccacctcagacctaggcagctgctcatctactttctgtctctacggatttgcctattctggacacttaatgtaaatgaagtcatacagtatgtggtcttttgtgactgacttcttccacttagcatattgttgtctgagtttatgttgcaggatagtatttgaaaatataattttgcaggatataagagcggtaaactgtaaccccttgccttgtcagtagacagcagtttactttgaaaataatgccctaacttaaatatatttatttactcttgttacatgaacacatagtttatttacaaataagtttagatggagcctttgaaatattacaaagaatgacacttaaggatttttatccagtttaggaataaacctccccccattcactccacccccaattttgctgttgtcatctcagtgaattcattctagccttgatttgtgagaatgatctgctggtatggcacggacaattgttataaaaggcaatttaatttttaaggagatttaaattttacgaaaatcttttgtctacttattctgtctttatagatattttggggactttgaaaaaagaattcctcgtgaagagatgttacaaatgcaagtaagatgtgtcaaattatattctttgattagaattgagagtgtcacttggtgaaaagccattttgggaatactgacttaatttttcttctattaggatattgtactaaatgaagttaaaaaagtggattctgaatacattgctacagtctgtggcagtttcagaagaggtaacatacttcctaatcttgggttatttttgccctgatgttaaaattgcctaatatatgggaagaatttggattaaaaagatgtaatttgtggtacttcatagactcactaagacctagtagtattagttaagggtatttgtttatagatgggaatatgtaactaggggaaattcatcctgattttattataggatgatattttaatgactagttttaacgacgtttattaaatgactttaagtatattgaaatgctagtaatggttgtctttggccttttggctggatgatagtgaagttgtgggtagttttgttaatttacctttctttttcctttttttttttttttttgagacagagtctcactctctcgccacgctggagtgcagtggcaccatctcggctcactgcaacctccgcctcccgggttcaagtgattctcctgcctcagcctcctgagtagctgggactacaggcgtgtgccaccatgcccagctaatttttgtatttttagtagaaacggggtttcaccatgtttgccaggatggtctcaatctcttggcctcgtgatccacccacctcgacctcccaaagtgctgggattacaggcgtgagccactgtgcccaactgcccaagttttctataagagagctaagaataatgtcttagaagtaccagttcaaaaccaattcttacaacaaccgggttcatcagaagagttctgcttagtgtgtgaatgtgagcaaagtaagaaccatataatcctggtgtcttactggtttaaaatattgaaaagctcatacatgcttaaaaatattaacttttggccaggcgcggtggctcacgcctataatcccagcactttgggaggccgagccgggcggatcacaaggtcaggagatcgagactatcctggctaacacggtgaaaccccatctctactaaaaatacaaaaaattagccaagcgtagtggtgggcacctgtagtcccagctcctcgggcggctgaggcaggagaatggcatgaacctgggaggcggagcttgcagtgagccgagatcaagccgctgcactccagcctgggcgacagagcgagactccatctccaaaaaaaaaagaaattaacttttaaaattggaatagaaaaaccttatttaaaacattttagagtatgttagagtagatagagtagatacctgaactgaatctctggccacctgtggagttttgtctaggaagtaggtgatggcctatcaggaatactctgggtagctgctgtaagaatctagagttggagagagaaaactaaatccatactcactgatcagtagaaagaacattggactggggtcaaaagacctggggtctgaggccaaatctaccactattatgtctctcctgatcttagattccatactcgcaaaatgagagaactgaagttaaccagattttcaagtatgtctgcatcagaaatacctaggacttaaaaaaaaatacatattgttgtacccttctgcaaataagaatctccttaggtgggaactgggattctgtattttcaaaatgtagatttggaagcacagcaagccaaatgcatgctatgttggctatgacagccttcctggatttatttatttctattttaattttacttttttggggtatgttgtatggttatatgctttcacataaaaaggtatactctaagacatctcacttccacagtccctatgcactctttcctactccttctaagtcccattaagaaccacttccctatggattcttgtaacgtttcttcatgaaaatacaactaaatactagtataccatctttatttctttcttctctccctttctttcataaagttacataatatatatacaatactataccttgcttttttcacttacaaataacatcctagagatttttccatatcaatatatagaaaacttccttatttatttattttttgagatagggtccctctctgtcacccaggctggagtgtagtggcgtgatctcggctcactgcaacctccgcctcccgggctgaagtgatcctcccacttcagcctccagagtagctgggaccacaggcacgtgccaccacacccggctaatttttttttttttttttttttttggtagggacatggttttactatgttgcctgggctggtctcaaactcttggctcaagtgatccacccaccttagcctcccacagtgctgatattacaggcatgaaccaccatgcccggccccttattcttttttgtagctgtgtaacattcagttgcatgcatgtatcatacttcatttgtttatccagtccgctattaatggacccttgggttgtttctctttctttgctcatacactttgtttttgttttttttttaataaagtgaaacatttttgttggtaggcggacagtgaaagacatccagcttttaggaggaggaaatgagaacaagagaaggcaatagaattttcttgattaaaatagtttccatggatgtccagtacacattcagtctagtcttctttttttcttttttttttgaggcagagtctcgctttgtcgcccaggctggagtgcagtggtgtgatctcagctcactgcaacttccacttcccaggttcaagcaattctcctgcctcaacctcctgagtagctgaggttacaggcaaacaccaccatgcccggctaatttttgtattttttttttttttagtagaaaaggggtttcaccatgttggccaggctggtcttgacctcctgacctcaagtgatccgcccaccttggcctcccaaagtgctaggattacacgtgtgagccaccttgcccggcctggccttctttatatttaaatatttggttaaggcactgtggctcatgcttgtaatcccagcactttgggaggctgaagtgggaggatcgcaaagacactgcaagctctttagttaccaaaagggtgtttggcctctgttgtacttatcaaaatgaaagggaggagatagattggattcttttatgctgtataccaggcactatagtggatgcttttacatatgttcttatttacttacacaatagcatatgaagtagtttttagtagtttacatataagaaaactgaggtctagaggaatgaagagtcctcacttgcaacactgaaaaaaaagtaaaatgaaaaaattccatctcagtggagacagaatttcatagaatataggaaaagaaaggtttaaatagctgtatataacttgcctgaagctatgtggttgtagagtatagacctattaattgagttcaaccataagaattgaaatgagttttctttttaaaaaaaaaaaaaagagagtgcctggatctctctgtgttgactgggttggtctcaaactcctgggctcagcgatcctctggcctcagcctctcaaagtgctgggattacaggcatgagccaccgtgcccggctgaaatgagttttctgattaacctttatagagttagagtatattgtttaatttgagatttttacatatagagttgttcataggtgtattttaaagctattttaaaatattgtttttattcattattgagtagttacttaggtgcatttttaatacattaaattaactcgttgtatgcaatgtatatctaatgccaattactgttgtcatcacagattctgctgtctacatcaatacacctgaatagttggacagaaaattgaaatcttttaactaattctaactatgaagcacagtgaaatagaaagttaggctgtaagaagtaaggctcttctgtgtgtcatcagcttggttccatttgcccaattgatacatttacatggacaatctcatatgtgtcttctgtcatcacaggtgcagagtccagtggtgacatggatgttctcctgacccatcccagcttcacttcagaatcaaccaaacaggtgcctcagagtttataatcaatggtgatcagtcttacacaacagtgaatttcactttttaagtgatagttgggtattttcagaataagttttgttttcgccttcctgaaaagtctgaagagctttgtactgattgaattctgcgaaaggcaaatttctcgaaaaggatacctattattcttccatgagttgctgggaggacagtctaacatttgaaagagaaaacattgaatacaatagttttagaacgatttactgtctgtgataaatactttagaaatactataatcagattttcattaaattttatcttaaaaaatgaaatattgagaaaccttctattagaaaacctgtgaaggcaaaacattttttattttagaatatatgcctttggaaggtgaaacagctgactctttgattgcttttttttcccatgagccatttcaagaacaggaaaactctttgatttaaggaaacagataaatacaactgatcattgtttttacaatcgtaataccttaaacagtggtttctaaaaatatgtttcatttgataagatgaattttctattagagggaaaaagtacttgctcagaacattagaaaacatagagatggccgggcacggtggctcatgcctgtaatcacaacactttgggaggccaaggcaggtggatcacgaggtcaggagatcaagaccatcctgcccaacatggtgaaaccccgtctccactaaaaatacaaaattaaccaggcgtggtggtgcgcgcctgtagtcccagctactcgggaggctgaggcaggagaatcgcttgaacccaggaggcaaaggttgcagtgagccgagatcgtgccactgcactccagcctggcaacagaacgagactccatctaaaaataaaataaaataaaataaaataaaataaaataaaatagagatttctccataaataattagaaaactcatgttaaaaatgttttcttcccgggctcgattccctgccaaaaaaaaaaaaagttttcttattcaggcatgatgttgttcctggtactctggatgctgaggtgggaggatcacttgagtccaggagttcaaggctatagtttgccatgattgtacctgtgaatagcacagtctccagcctgtgcaatatagcaagactgtgtctctaaaaatattgttaaatattttcttgccattacaaagtaattactctttttcttattccctaattatgattctacagccaaaactgttacatcaggttgtggagcagttacaaaaggttcattttatcacagataccctgtcaaagggtgagacaaagttcatggtaagtacttgttagagttagcacatctaaaaaaaaacttggagactgttcagtagccattctgagtgtgtgacttcatggtagctttgaattacagtcaccaaatagagtatccatgagactttaaagaaaaataatagcaggggccgggcgcggtggctcacgcctgtgatcccagccctttgggaggccgaggcgggtggatcgcctgaggtcgggagctcaagaccatgctgaccaacatggagaaaccccgtctctgctaaaaacacaaaattggccgggcgtggtggcgcatgcctgtaatcctagctactcaggaggatgaggcgggaaaatcacttgaacccaggagacggaggtgcggtgagcatagatcgtgccactgcacttcagcctgggccacaagagagaaactccgccaaaaaaaaaaaaagaaagaaaaataatcagcaggatgcctgattctcatagctactctcagaatattttaggaaagaattttcttttaattctccacttgtaaataacacgtgtcatcagaatagttaattaggcctgggcatggtggtgtagtcccagctctttgggaggccgaggtcagcggattacaaggtcaggtgatcaagaccatcctggccaacacggtgaaactccgtctctactaaaaatacaaaaaattagctgggcgtggtggtgtgcgcctgtagtcccagcttttcgggaggctgaggcgggagaatcacttgaacccgggaggcagaggttgcactgagccgagatcgcaccactgcactccagcctgggtgacagaccgagactctgtctcaaaaaaaaaaaaaaaaaaaaaaaaaaaaagaatgggttaattaggcataatctgctttttgaaaataccagtaatgactttgacacacagtaagtttttccctaaaatagcaaatggttctcatcttctctgattcagaattcttcaataagtaacgtagttagaattgattgaaaaatattaatctatttcaacaccaaagaaagaaaagtcatcagggtctgtgatagaacactcaggggaagaaacgttacatggaatgataatgaggaaagttgattgggggggaattaagacttaataattcaagatgaatggctagtggattaaaagcagattaataaatgattctgtataaacaccaacaggaaggcagatagaaatctagaattacgattctttttttttttttttttgaaaaggagtttcactcttgtcacccgggctggagtgcaggagggcgatctcggctcactgtaacctccacctcccgggttcaagcagttctcctgcctcaccctcccgagtagctggaatttcaggtgcctgccaccacgcccagctaatttttgtatttttagtagagaccaggtttcaccatgttggctgggctggtctcaaactcctgacctcaggtgatccgcctgcctcagcctcccaaagtactgggattgcaggcatgaaccaccgtgcccagcctagaattaagattcttagttcctttttttttgaaacagggtcttgctctgtcacccaggctgtagtgcagtggcgaaacatggctcactgcagcctcaccttccagggttcaagcaatcctcccacctagtagctgggactgcaggtgcgcaccaccatacctggctaatttttgtattttttgtagaggtggggtttcaccatgttgctcagactggtctcgaactcctcagctcaagtgatccaccctccttggcctcccaaagtactgggattacatgtatgagccactgtgcccgggcctcttctttcttaaggtgacatttagtgttctgtcacttatatacatcattcgagtccattttctcaacaccccacttttcccgggtgatatgactgaaaggaaagagactgtgcttttggagagtggatgtgctaaaattagtaagagtctcagtgcatagatttgacaagagttttagccaaaactagaagatagttgagaaagataattaaattgtcatgtcattcagaaagtagagtggtgtttgccagggcctggaaggagggggtaatagggagttcctgtttaaatggcacagagtttcagttggggaagatgaaaacattctggagatggatggcggtgatggttgcacaacagtgtgaatgtacttaatgccacagaatggtacacttaaaaatggttaaaatagtaggcacagtggctcatgtctataatcccagtgacttgggaggctaaggtgggagaatggcttgagcccaggagttcgagggtatagtgagccatgatcgcactactgcactccagcctgggtgacagagcaagaccccatctcaaaaaagaaaaaaaaaatagatggccaatagatggtaaattgtatgttgtgtatatttaacccacacacatacaaaaaatcatgtcattaagttcagcatggtgatattagtgggctgtgaaagtgtattttctaaggtggtcacactttaacaatgcttccaaacgaactttggaaagataaaagtaaaggttctagtcagtcttggaaattaaatctctgatttgttctcttgactctgtcaagttttgaagtcttactctgttcccaaaagtatatacatacatgagatggtattaaaaatagggcttgtgtatgccccatgaacagccttttcaaatttaggtggattttaattcactcaaaatgaatgtgcatgaatcttacatttaagaatattcagtcagataaaatcctaaaaacagtatctgctagacaagttggatgttgtgcacagtagaaaagtatcttgctacgtctgggcatattttggggacctctctggcctaaatcttcctcaagtatcatccctgtgaaagtcactagaaatccttactgggaagtgtgccaactgttttcagagttaatgaccaggaaggtagttccacactaccatggcagaagctgtttttttataatcttaatggtgttctgctgtgctcgaagagagatccagaggaaaaaccaacagaagctataggaatccagctagcaagaatacaaggtaaaagggccaggcatggtggctcacgcctgtaatcccagcactttgggaggctgaggcaggtgaatcacctgaggtcaggagttcaagaccagcctggccaacatggtgaaaccccatctctactaaaaatacaaaaattagctgggcgtggtggcgggcgcctgtagtcccagctactggggaggctgaggtggaaggatcgcttgaaccaggaaggcagtggttgcagtgagctgagattgtgccagtgcattccagccctggcgacagagcaagactccctcccaaaggaaaaaaaaaaaaggaaaaagtataatctagtgggctggatgtaacctgaaaaggaaaggtgggtagccaagtctttgtgatcttgttgatagtgttggacttgggttatcccagtacatgtgccacaggaaagaatactaaggccactcacccatcctaggatagaccctatcttgacttccctgtctttcaatcatacatctggcagcacatctactggtattgccaggaaaggcatcccccagacatatttccagaagaaaacaggctaaaaaacaagaagactgggtctgtttatttgtttttaaagtatagaagattcaggtgacaataagaacaagaaactaaggcctttatgttgcgacataggaatccatctcagtgggtggtttttgacaaagtttggatgttatacctgtggttcatagtccctggaacttaaaaaaataccgtagttgagcatgctgttttgacatttgtaatcattgttaggaagagaagcactcgaggtcaactttcaaatcaattttagagacaggtaagaggtggtttgtatctttcattatagaagaataaatttggatacagaagatagagggtcttattctggctccattactaatactctgtatggcattgggaaggtggatttacttctaaaaggcctgagttttatctttaaaattgatatttgccctacgtcagaagaccgttatgcagatcaaaattaaatagtatatgtggaaactttgaagagtttgtacaaatatttgatgtacaaataagaatttgcacaacttcaaagataatggatcttccaagagttgtacaaagagagctgcacaaatataagatgtcatctgtgtggaaatgggtcagtagaggcaggtgacctggtaagggttagattggggaacaaaagaagggatagaaagagagaggatggtgccatgaaaggagaacagaatgaggagagtgagcacccccagggcagcagttgtattcagtcagttcagcaaatacatacaagcatgtcctccattccaggcactgttctcgaagcttgggatgtatccatgaatttaagtaaaactcatatttgaggactgtgggaagggactgatagttaacaatgaacataataaatatgtgaattatataataggttgggtagtaagtgttattttttaaaaaggaagaacagggtctaggggagaggagagtgcaggaggcagtattaaatagtgtggttggaggcagcctcattgagaacatgagacttagggaatgacatagggagttagctaagccggtatctgagggaagagatagccaggcaggagtccgagcaccaagcctatgggaatgagcatgagcaagatatctaatgaagatgagagctctaggcttctaaaaggaaattggctgcaaaatgaattcaacttaggtagtgaaataaaccattctcattccatatcccctttttttgcaaaacctcttcttgctatcaccacttactagtcttaaaggtatgcctcttcatgtgtttttcaagttatattcaagacacaaattcctttaagctaatagtaatcaaaccttaggaaagccatggttattccagatcatcttgtgcaatcatagtctttagataattgagctatactatattcctgtgaatatagtaacactcagaagaaaaaaagtttcctctgcattcaactattggttttatatacggtgagtgccattcagatttcagtattttgtgcaagtttggccttgggtgattttctgtgaaatatctgcagtaagaattcaagggacaataggagataccatggctaccccgaggaaatgaaagaggttttatttccgacactcagtatgaagctacccaaatgaaatgccaaacaaagctaatccactcaatctaatacagaatttacagtaaaacagagaaattctttaatattagcacttcagaaaaagtgcaggaaataaaattagccttgaggaaaggaacaaagccatgagataaaatcctattactgatgtgacaaacaggaacatcattccctgtggtatctagacatccgcatccgcaaggtaatacctcctggtaattccaggtggaaatgacttctgatccacttgaaggtggaagttgagttggaacttgttagtgcctaagaaggtaggtttcatattttgaaggtaaacatatttcattaatctttcttccataggaacagctaaagaattagtttagattttaatttttctattttgctgagtgaaaaagtatggcttttagtggcatgtgttaacttgaccactcttgaggaccagaagcttgtcacttgtgtatttttcttagaatgtagcatttgatacttttaattggaaatttggtggtgcttatatcttgttttacatatgtatgggttgctgaccagtccagattttttgtccatttttcaggaaagggaaaagataaaacagacttggataacttttgtttggaaattgtagaagtataatgaaaaattacctgtgaaggaagaaagtgatcccctcattttctgatctcatatttttcttattttccgtgtctttctcccttctagtgtctgagagatttcttcaatttcaaactcttttacttctgctacctatcattttaaattttgatttaaacctttccctgagggttttctatagtattctgttcttacttcatggatagagtatcttctgttattactggaagcttttttgtttgagactatactggtagcttttttgtttgttttcttcttcctgcataatcatcgtttcttccacgttgctctcttctgtttattttgatgtctgtgtttcgtgttcagggttttctttgattagtttcttgcttagaatcacacaaagaccaaatcctcataatgagaatccttatttgcagttttgtgtagttctctaattatcgtgaagtgtaatagaaaggtagggatagtgtattgctcacagaagctgctaagttaaaagtgctcagaattctagagctgctaacattaaaaacaaaaatggccttgtgttttacttgattaaaattaagccttaagtttagaacatctttaaacttggtttaaaatgttcattttagggtgtttgccagcttcccagtaaaaatgatgaaaaagaatatccacacagaagaattgatatcaggtattgttcagactttgttgctgacctgttaacttttccaaacttgtctcgttttctccctccctgtttgtatcttggagttcacattcatatctagagcctttttttactcccaagagccatatgttcttgccaaatgcaatgtttagctccaaagtatgtaaagaataatgactgtctacagactccaatttattttctctagatttgcacctcaccatgatgccttccacagctcaaaagtcatttcctgcctgggctaagttagttgtaataggtgataatgcaatttcatttctccacatctctttcagaacaaagttcacagaaacctaaacaaattacaaggttggggtgatttgagcagtctacctcatgatagtcttctcttcaaattattagaccacttaggcttatctttggtattttgttccttattgattttaggagtcctatatttgctaaacttgaaatgcatggtaaaaaaatgtatctactgtccattttttttaggttgatacccaaagatcagtattactgtggtgttctctatttcactgggagtgatattttcaataagaatatgagggctcatgccctagaaaagggtttcacaatcaatgagtacaccatccgtcccttgggagtcactggtgagtgtccatgtgtgtattagagatcatctctcatctggagagaaggttattttcaaagatactttggtttagcaaaccttctaataactatgccagttagtgtagtttctttgtatttttagtccttcaggcaacgagagaggatttaatgcataacatgctcctaggccctcagttgaaggccatcaaggcaagcgttagttccagctttgttaaaatggattaaatccttgcatgctcagtaaaatatcttattcatctaaaagggtttttttttttttttttttttttttgctgttgtttaatgtacctctaggacccctgaaaaactcaagtatcattgttttcagtgccacatactttgcttttagtgccatggtatctttggccccatgcttttaaagtttaaagaataaggattgctgaatctatgcttaatgggttctgttaacatttcacagtatactatgtggtttactgttctctactaggagaatgaatttttgtcattttgtcctcaaagtataaaatactttgtcctcaaagtataaaatacctcatccctggtagactagggcagtgcttctcacaattcagtgtgcataccagcaacatgggggcctcactaaattcagattctaattcctttggcttgcagtggggctcaggattctgcatttctagtaagcttctagatcagaggttaccaatcttttagcttccctgggtcacattggaagaagaataattgtcttgggctacacataaaatacactaacactcacgatagctgatgagctttaaagaaaaaaatcataaaaacatctcatcgtgttttaagacagtttacgaatttgtgttgggccacattcaaagtggagctgggccgcatgcagctggcgggccatggttggataagcttgttctagataatgccagtgctgctagtccaagaaccgagttgcaaaggaactcactagagtatataatacatagtggctccagcagaaaggacaatcatgagtgaggatgacttgagtggccctagctgggatccccaggttccctttgtggcactgatgactcacgagatgaagctccagcacagcctcctgggagaggatagaggtagtcagtgtctttttttttgaaatggagtttcgctcttgttgcccaggctggagtgcaatggcacattctcggctcactgcaacctctgcctcccaggttcaagcgattctcctgcctcaacctcccgagtagctgggattacaggcatgagctaccacgcctggctaattttgtatttttagtagagatggggtttctccatgttggtcaggctggtctcaaactcctgacctcaggtgatctacctgcctcggcctcccaaattgctgggattacaggcgtgagctaccacatccgccggtctttttttttttagtgacttggttaccattttcttttttcttctgaaagcaagtcccacacagctcttaatcttgaaccctctataactaaactataaaactggttcttacaataagtttttctctctgtacttgcaggagttgcaggagaacccctgccagtggatagtgaaaaagacatctttgattacatccagtggaaataccgggaacccaaggaccggagcgaatgaggcctgtatcctccctggcagacacaacccaataggagtcttaatttatttcttaacctttgctatgtaagggtctttggtgtttttaaatgattgtttcttcttcatgcttttgcttgcaatgtagtcaataaaacctcatgtactattattgga

SEQ ID NO: 22 - DNA, 110078 bp, Homo Sapiens
aggcgcgggcactctctagcaggtggccgcagccatggaggagatctctgccgccgctgtcaaggtcgtgccgggcccggagcgcccgagccctttcagccagctagtctataccagcaacgactcctacatcgtccactctggggatcttagaaagatccataaagctgcctcccggggacaagtccggaagctggagaagatgacaaagaggaagaagaccatcaaccttaatatacaagacgcccagaagaggtaccaggccctgcctgagccggggctgcaggaggaggtgggggcggtgggaggatcgccccttcagagtcgggggctggggggcctggggaagaagggagcaggtggaggagtaacgggcagcggggcagccatcctgggccctcgggtctaggccttcttcctgggcaggcccccaggcttgggatgcggggtccctgcagggcggagggcccatgccaccttaaaatcaaccccaaactttagctgctttctccttcactcccacttcctctcacagaggactgtgtagagaattttaaagtgatttaactcacaaaattaagtacatacagggttttacatttaatgtacaggttttaaaagataatgttagatacattatgaaatggtgcgtaatgaaataattcccataatatatgtacttcttggctaaaaattatctggatagagtccaatatccattttgatatcaatgaatgtctatgtaaatatgttctttgctgagggaccttagaaggaaacttcgaggtgggaagatggtttatgttcttgaatttaagaagactcatttttctcaggatgcgagttctttatcagttttacataaaccaaataaagttatcaacgttttaacattttttaaattacacaggctgtcttttactattgtgatgacattttaaatattttgtaatggagtaaaaaagtcttgcccttctagatatcaaaatgtggtattaatttgcacaagatgagccgggagtggtggctcacgcctgtgatcccaacactttgggctgcggaggcaggtggatcatctgaggtcaggagttcaagatcagcctggccaatatggtgaaacgccgtctctacaaaaatacaaaaattagccgggcatgatgtcgggtgcctgtaatcccagctactggggaggctgaggcgggagaatcgcttgaacccggtaggcggagattgcagagagccgagatcccaccactgcaattcagcctaggtgatagagtgaaactctgtctcaaaaaaaaaaaaaaaaaaaaaaaaaaaaaaaaaaaaaaatcacaaattgttcgctaacagctgaaaagacaggtaaataaatacaacagaatagaaaatccacaaacacccaaatatatgtaagaatttagaacttggtaatggtcacactttatactagcaggaaaagaattagtttcctaagtgaaatgcctgctttttggagaaaactagatttttgtgccacaaaataagttcctgatggaatatagattaaaagtttttaatgtacaaaatgataaaaataccggaagaaaatataaatgcctatttacacagatacatttttatcttgacaaaacctttttaagaagctcagaagcaagcactctgaagggcaatttagtaaaacagaaattaagtcaccctgcatatgagaaaaaataaagggcagcatacttgtaaaaatatttactacatatgtatgtgtgtgtgtgtatacatattagatttaaaaatcttcgctttatagagaattcactcaaatcaacaaaaaaccctctaatttaaaattgggaaatttaaattagagatctaaattgcagatctaaaaattgggcaaagtccttttttaagatctgcaactgacctatgcacacaggaaataatatttagtgttcctggttagagaaggcatttaagttaaaaaaggaatcaaatactgttttctatccacaaagtttgtgaggataaaaagcagtgatatttatagtactccttaaagtttaagttgcagatgacttttcaaatagacaatttgatggtaagtaccatatttaaaaaattgtatatgcccattagtgatcaattctattatactaaaatatttttagaaaataatgaaacatacatgcaatttcttttctgagcacttcttaaaatatcagtgtattaaaaagaatccatttaatggcttttataaatacatttcagtgagtttacagcatgggataatagttgaccactcaaggtagaaatatatacagaagtatgttgacatttgaaaatgtattttggtgtaccaactgagggtaaagttcagtttgactatacatacacatagactatggtcttgtgttatctgaaattatgtacaaaatataaaatttgttatttgaggacatttgttttaatataaaatgtttttcctttttattatctttgatttatgcattgagcatgtacaatgctattagtaaaagtttattgttaataaaataatttttgggaagatcagcaatgtgaaatttgcacagataaaaatagtttctcactttctatgttttaatttttattttttgtggattagtatattctgtgaacttttagcatcttcagaagagaatctttttatctgtgcttattgatttacatgtacattttattagacacatatttttattatatatagatttattacatatacgtcaataactacagattaatcattttagtgtagttttattattagaaaaataaaagagcaaatataagtgctttatttatagcagtgttttaagatattgaacttctcaactgtattgatccattcttttaatccatttaccacatgtaagctgaatgcctattgtgtaaaagatacattctattaactctcaggaccctttcattcttaaaaatttcacatttacttgctcagcctgagcaaagtgagagatttaaaattggagtattaggactgaatctcaatggaaacttttcctctcatctttcaaaaaaaagcacttctgaagtgaaaaactagtaaaatataactaccaaccgtgattttggaaatttataatagctttgaatagtaatattaatcattggaaatacctaatttacatgcattctataaatctaaatatgaatttacatacattctgtaaatctaaatacggaataagatgagccatacctatttatttgaatcccaagttttctttggcttgaagctttaaaaatattaaagaagtactttgttttaataatttgttgtctttatttcaactctccttttgcgtagtactcttaaaagctaacatttctttcagtgttaatcctgtgactaggactgcctcgtcctgttgtatataccatattccacttcttggaaggcactgtgaattgtgtgatgcctccttattttatgcaccaataaaagattgtttaaatttctgccaaatatagttgtaataaataatgaactataagtggcatttcaatgtcagaaatgttaaaatatgagaaattgagcatcttagaatcattaaaatacagtgttatctctaacctttaaaacacaccacaatgtagtcataattgtaccattttacttaaaatgctgtctttgttaagtagtagtaataattataatacctaacaattactgagctgttacatgtgctaggaactcttcaaaatactttgcatagattcccattgaggcatcatagtgataacctgtgagataactgctgtgttcatcttcattttgttgatgagaaaattgaggtgcagaaagtttaagtgacagctagaaagtgaaagaccttaaagtaatattcaagcccgagttgaactgaatccaaaggccaagctctttctattcaaataggccactctttctttaatgtagtgagtaatgagagcaaatgaatgttgtactttcttcaggagaatattaagtatttgttttgaaggcagagaaagagcgtggtatttaatgtttacagttacataactcattgtatgttttgggacagtggactaaactttgccaaaaagtcctctcactctcgtaggactgctctacactgggcctgtgtcaatggccatgaggaagtagtaacatttctggtagacagaaagtgccagcttgacgtccttgatggcgaacacaggacacctctgatgaaggtaaatagtagccagatttttcagcaggagatggatttggtttaaatacatagaataaaaatgaatttatctcattgaaatacaactagttttgaaacctgtggaatatttattttgatttcctataatttataatttataataatttatattataaattatacagtttacaataattcttgctttaatactgacaggctctacaatgccatcaggaggcttgtgcaaatattctgatagattctggtgccgatataaatctcgtagatgtgtatggcaacacggctctccattatgctgtttatagtgagattttgtcagtggtggcaaaactgctgtcccatggtgcagtcatcgaagtgcacaacaaggtagacactaaccaatgttattttcaaaatatttgaaatccatttgttttaacattaacatatgtaaggttttttatatttggaagctcaaacattccttgaatgaaaatagtttgaaagaacttaattgtctaagattttactttaaatattaatgtttttacaagaactattagagagtatggattttctctgcatttatgataaatatttgaatgtgttaaaggtaaaaacttcttcaaatattctttcccatccaagtttttttttctttccaattagtgtaaaactagaggaaagcaaaaattgcctgcataaattgagtcaacatgtaaaatttaggagacatgcagaaatctggatttcctcttaaaggattgaatctggtgtctccagcccatatgactgtttggtatgctaagaagacattctagctttacacaaagcatatgtttccagtttgctactgtgcccacctagttacaacacttactcagcttacctcttttgcctctgtaaatacttcagttatcaattcctctctcatagtatattttggtaaagatttcaaggtattcaagacagttgataggtatttataatatatagtttatattttacattaattcattaataatggggttgacttctagaatttagaggactttttaaacaatgatttttctgtatataaactataaataatcatcttctattagaatgcctttaagcctttttagattaatcatggttatatttgaaaggttatgcatgttgcagataatattatatccttctcagaattgtcccttaaaattcaagtgttttagtggcttttattatgctaatgcatatagatgagttagaactttcattaataagccattttattaatatttttgatattttgccaaaaattaaatagcaattacaatagaaaccagaataaaaatggattactgcattttaagaagtagatatgcattagaattttaggattatcattataattgagaataaacttttatactgaatttctaatagctgagataaaattctattgtcttgtaataggagaaaccccatggaccatttaataataagcaatcaaagttcacttgaagccaatctcttttaatttggagttgcttccttagtgacccatgtagaacaggagtgcctgacattggcatctgggatcttgggattattgatagaagagaatcaagcgagtttgtatcacccagaggaaacctccatttttcttgggaagctttcagagttgtatccctgaaattctaatttgtcaaatgttaatgtctgctgcaaaaatatattgtcaaataaggaatagtcaaagttcaagtcatttattgaatactggacatttaattcacagttttataatatttcttgaacatagataatggtagaatatgttggggtacagtgcttctggtaaggtaattattctttggaatatagtttaagaaacactaaattagaatactactttagtcaaaaacaaagtatttactactatgtcttagggtttaaggatatagagataaaagatacagcccttgccctcaagaagctcttggtttagatgggaaaccataaaatcattacaatataatgatttttggagataaccagagttatgtggtgatgcagaggctgaatatttacagcggaaggtgcagtgcatgggaaagcacagaaaagggagaaagaagggactgctattgatttactttctattttatgtgtttaagttcataagatattatataaggtattcagttcagctgagaaatatgtaatttcatgaattataaattgttttgctattttacaggctagcctcacaccacttttactatccataacgaaaagaagtgagcaaattgtggaatttttgctgataaaaaatgcaaatgcgaatgcagttaataagtataaatggtatagtagttctttttttattaaaaaacacttgagtagtgttctagagtaataacactcaagtcagaaatatttaataacatttacttaaaattgttagattatgtgaaaatatcaatacagattatcagaagaaaagcaattatttggactggtcaacataaagaacagtatatagtaggacttctcttattatattgactgattcctatgtgtaatctgatgtttttggttgcattatcttctaaagtggttctgtattagttttaagaagtatgaacttttttagtttactttataaatgattaacacttttatagtatttttctaacctctgttttttatacactttttaaaaaatgcaatatttgctgggcacggtagctgttgcatgttatcccaccactttgggaggccaaggtggttggatcacttgaggccaggagtttgagaccagcctaaccaacatggtgaaaccccatttctactaaaaatacaaaaattagctgggcatgatggcacatgcctgtagtcccagctactctgtggggggctgaggcacgagaatcgcttgaacttggaggcagaggttgcagtgagctgagatcatgccaccacactccagcctgggtaatagagcgagattctgtctcaaagaaaaaaaaaaagaaaaattaaatagaaataggagtttaaaatcattttgtctttaggatgactgtttgcttgttttctttgaagaatattaattttaggttatccctacgtgactattaattgctatcaccagatactgtgaatttattattatttttccttttttattcatagtgtatttttatttttaatttgtatgggtagaggaagaaagacatctttaattggattaaaattttagttaattaagttaagccataggtgagtaataaagaggaaagagataggcttttgattcacacaagactgagtttaatttctagcttcctcacttgataggtgtgaccttgcaaacgttacttaataccaagtatgattttctatatgaaaaggagaataataatatgtcctttaaggactattgtgttgaagtaacattatgaatgtcaacagcatttaattcagggtctcatacattcttatcagcatcattaactaaacttagcatgactactactaatatcattattcctaatattgttttaagccttcagattgctgtcacttgtctgacttctagctgattttgaagtataaactattatgtcagactaaggaagaaatagataatttttcatttaaatctttgcctcttttagattagtgaacagagcataatttcttgcctctcaaaggactttatattagccaattctagtgtgccatatccccgtgggacatgaatctttttgctccttccttttagccttggtggtgatttacaaggataaacacttgagcactcaagatacttatgtttgttggtacatgtaaatggttaattctacaatgacaggcacatattaaattggttctgctcataataatgaagttatctctttgttattttagcacagccctcatgcttgctgtatgtcatggatcatcagagatagttggcatgcttcttcagcaaaatgttgacgtctttgctgcagatatatgtggagtaactgcagaacattatgctgttacttgtggatttcatcagtaagtgtttacgtttagaggctaggtgagattttatagtttgtttcaggtagtttttgaattacagtgagttcacttcatcagccagaaactaggcaaaaagctagactagttagaaggagtattgggtccaggattctttattttaggactttcaacaactttatccctagggatcctaatgttgtctacttgatttttctaattagttatttgggtcttgaagtgtccactttagcagaaaacctgatagtgtcctctgggggctgtcttccatatctaaatacttgaattttttaaaaaaaatctaaggagttccctaagtccaaggaagacattctttttgtgtaagtcaaaaggattgggggcagaaatcaccattctctttattttgttgtttccattgattctgttgttgcattgttgccactgaaactgcccctgcagtctagtaatgattgacctttgtgaccaggatgcccttactaacacagatccctcagtcttcatggtgatccatatgtagatttcaaagttattacagttttttaaagttcacatacatattctcagccattgtttccaaagtaccagcaccctgctctggcagctagaacttttagctttagccacacacgtagtgagcaaattgaccctgctcctccactcaaaacctgatgtgaaacccacatcttagcctggacttggcctagaccttcagggtaagttatcctttgaatgacttttttctattttctcttgcaaatattaattgtgatagtttaaaactgtaagtcaggttgaagtaatgttataggaagaaattagagacccatttttattttgttaccagatctatatccctggcactttatatcctgtgtagtgccattttgtaagtagcagaaggtcttatcttattccgtaagatcccttgtcatctttccaaatttgtagtgggttccaacttgtggttataccctcaagtgattcttttttcctaaaagtaaaaatctcccatgctacttgcatctctatctcaagtttttaaaatattttcaaattctgcattaccatgaagccattcaatagacttcactctatctcaagtaagttggttagatttaacagagctaagcctcatccatcattgatcagtcttcaggtataaaagtagggatttgtgctggcttcagtggtacatatactaaaattgaaacaatgttgagaagatcagcatcgtccctgcacaaggatgacacacaaatctgtgaagtgttgcatatttcttgcagtccccaaaaggacatttgactactttctaactagctccaaggaaatgatgtgtcaaagcaaaatgtgtgacaccaagtattgcaattgtgattttcatacaaaaaatatttatgtaaggtgatgtatgaaatgagatttggtgagtaacacataggatcttgtgtgcagtatgctgttagtaggcatctcagaaatgagaaaataccaacttgcatcttctttgtggaacttacaaaaaacagtggtgggttttgtcttccacagcagctggaaatgatcatagttactaagcatcattctatcaaagatttgttagttcaggtttaaggaggtaaataaagagtagcaatagtccaagccagatgctgacatctattagttttctgcccttggtgtgattgatgagctcagtaatagaggataatcaggttatccaatttgatgaattaatatatttataaataaatttcattacaaattataaaatagcttagatgccttgaattacatgccacaaagaatagaacatctaataaccaaaagtaggaattaataacagaaaactgcaacatttgaacattataacctatgaagaaacactttttttaaaaaattaattttttgtagagacagggtctccctatgttgcccagggttgtcatgaacttctgggctcaagcaattctcctgtctcagcatcccaaagtgcttgcatcacaggcgtcaggcactgcaccaggccaacacattgggttttattgggattttaaaacagtttcagcaattaggttcaagaacaaattatttcattgcttcactatttctttgagcatttttaaaatgttatcttgttagatctttataatagtctagtgaaatagggctctaaaatcctcatttttagaagacattgagcctaagagaagcaacttgttcaagaaaaaatacccgttggtaaccatgctaggactttttctgagttagggagattttccattaagccaagctaactctagttaatttactgagttatactgccctaaatgcatgagtatttcatcttactttatttcttctttaattagaagcttaataagttcatagagcttacaaacttaaagtctatggaataagtaatgttctgatgttagttctgatattgtctgaaatgctctaagaacttaataaatttggtaaatgttttttataaagtcagtgttaaaatggtaattttatttatcacatttttatacatagcattcatgaacaaattatggaatatatacgaaaattatctaaaaatcatcaaaataccaatccaggtaagacttctgatagtaaactacccttggtggtgctatcataagattatggaagtgttgatcacaaaaaggtaattcaaaaagcaatgtgtaaatagcatgtgtttacatatatacatatatgtgggtgtgggtgtgtgtatgtgtgtgtgtgtgtgtgtatatatatatatatatatagctttgatttgattttttggtttataattcagaattagttaagaatttagttgtaggcagtttataatctcaaaaaatgttacctgaaaaaatatttgtttaattatggtccctaaatcctatataatacttttgtataaataacgcaagttttaagtttgtatattttatgtttcctcaactgtcctaacaacttaggcttgttataaaatgtataacccttggggtgattgatgagctcagtaacaggggatgatcaggttatccaatttaatgaattaatatatttataaataaattttattacaaattataaagtagcttacatgccctgaattacaagccacaaataattgaacatctaatcatgaaaagtaggaattaataacagaagccaagatggctgaataggaacagctccagtctacagctcccagcgtgagcaacgcagaaagggatgggtgatttctgcatttccaactgaggtacccggttcatctcactggacagtgttggaaagtgggcgcaggacagtgggtgcagcgcactgagcatgagccgaagcagggcgaggcattgcctcacctgggaagcgcaaggggtcagggaattccctttcctagtcaaagaaaggggtgacagacggcacctggaaaatcgggtcactcccaccttaatactgtgcttttccaatggtcttagcaaacggcacaccaggagattatatcccgagcatggctcagagggtcctacccccatggaaccttgctcattgctagcacagcagtctgagatcaaactgtaaggtgacagtgaggttgggggagggacgcttaccattgccgaggcttgagtaggtaaacaaagaggctgggaagctcgaactgggtggagcccaccgcagctcaaggaggcctgcctgcctctgtagactccacctctgggggcagggcattgccaaacaaaaggcagcagaatctgcagacttaaatgtccctgtctgacagctttgaagagagtagtggttctcgcagcacccagcacgcagctggagatctgagaacggacagactgcctcctcaagtgggtcccagaccctcgagtagcctaactgggaggcacccccaagtaggggcagactgacacctcacacgcccgggtactcctctgagacaaaacttccacaggaatgatcaggcagcaacatttgctgttcaccaatatccgctcttctgcagcctccactgctgatacccaggcaaacagggtctggagtggacctccagcaaactccaacagacgtgcagctgaggatcctgactgttagaaggaaaactaacaaacagaaaggacatccacaccaaaaccccatctgtacgtcaccatcatcaaagaccaaaggtagataaaaccacaaagatggggaaaaaacagagcagaaaaactggaaactctaaaaatcagagggcctctcctcctccaaaggaacgcagctcctcaccagcaacagaacaaagctgatggagaatgactttggtgagttgagagaagaaggcttcagacgatcaaactactctgagctaaaggaggaagttcgaacccatggcaaagaagttaaaaaccttgaaaaaaaattagatgaatggctaactagaataaccaatgcagagaagtccttaaaggacctgatggagctgaaaaccaaggcacgagaactatgtgacgaatgcacaagcctcagtagccgattcgatcaactggaagaaagggtatcagtgattgaagatcaaatgaatgaaatgaagtgagaagagaagtttagaggaaaaagaataaaaagaaatgaacaaagcctccaagacatatggggctatgtgaaaagaccaaatctacatctgattggtgtacctgaaagtgacggggagaatggaaccaagttggaaaacactttgcaggatattatccaggagaacttccccaatctagcaaggcaggccaacattcaaattcaggaaatacagagaacgctgcaaagatactccttgagaagagcaactccaagacacataattggcagattcaccaaagttgaaatgaggaaaaaatgtcaagggcagccagagagaaaggtcgggttacccacaaagggaagcccatcagactaacagctgatgtctcggcagaaacgctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaacaacatttgaatattataacctgcaggggtctgtcctgcagatggttgagacacataaccagatactgatattcagtgaaagagcagcaaggattccgagctgattacagacaccaaggaagatgctgtaaagagtcagcagccacagccctggctagctggccctgtgggcatttattagtaaagttttaatgacaaaagctttgagtcaacacacccgtgggtaattaacctggtcatccccaccctggagagccatcctgcccatgggtgatcaaaggttagtcttaagaccacataagtaaacaagctatttagataaactactctaccttcctttgtatccactttaagctatttatgcaaggtaagaattaggctgctttcagccataaccatatcttgagacttttacaaaaccctctggccttccaagaagatttgtgtctatgtcctataacttcatattaaaatgtttctcaccagcctgactgaactcccacaataacctatgaagaaacatggttttattgattgattgattgattgattgtagagacatggtctccttattttgcccaggttgatattgaacctctggtctctatttaatttttacaataaatggtttgcatttagtaaatgagaattaattacagttgagtcttgagcaatatgagagttagggtgctgatcccccatgcagctgaaaatctgcttcatatgaaaatctctttcttttgactcctccaaaactttactagtagtccactgttgacctgtagccttcctgaaagcacaaacagtcaattaactcatagtttctattttatatgtactatatagtgtattcttacaataaagtgagctggaggaaagaaacttttataagaaggaaaaatatattcacttttgagtggaagtgaattattatacataaagatcttaattcttattgccttcatgttgagtagtctgataaggaggaagcagaggagagatttgtcttgctatcttgcagtggcaaaggaaaagaaaaatctgtctgttagtgggctcctacagtgaaaacccatattcaagcatcaactgtgtgacatagtgactcgtgtcactaaaaaagtaactatctttagaatttgaaaacttaataatgctttcctggtgccataaacaaatgtcaacaagaattacaaaacttagccagggtgcctcagtaccaataggaaattattttccaaagatacctactgaatgcagaagtcagaaaagcaattatttgttgagaagcgcaggttatgttacatagtcttgtaccaacaaggtctcactattatcaacttcatttcctccaagttgaaaccaaataagatatatttacttcattaaaacaagatatgttgttctatctgctggataattagggtgttaatagtaatttgttacaacaagatactctgtttctaatagccaaaatattatcattataaatattcaaatagcttaactctaggctcaacaaattataatgaagttagaaaaatttttcataataacaaaaatgctactatgatacctaaatgtgacataatgcattgtacaatatgaattatatgggcatatctttattatatatttattaaaggacctctgtaagttaggttttgcaagttgcaggagacaaggatagaatacatatagtttgggtctttaaggtgctcataaaacagtagagctgtccttattgaatttctgcatttttccaacagaatttcgtaaaaaatgtttttttattcatttatccacttgtccacttaacaaataattgttaggtatctttaaggtactaagcatcttccttgttattatataattggtcattttatattatttactactttattaaggtattaagcatttttcttgttattattgtctttttttattatttgttactttatttagtgcttactctgtgccagaacccctttggaagcttataattattacttattatgtcatgtcgttactgtattcagcatgtgtcagaccttttatatccaaggtgaagaattaaagctttaaaaagtttggtagtgtccaggcacagtggctcactcctgtagtcctagcactctgggaggccaaggcagatgtattgcttgagctcaggagtttgagaccagcctgactaacatggtgaaacccgtctctactaaatatgaaaaattagctgggtgatatggcccacgtctgtaatcccagctacttgggagactgaggtaggagaatcgcttgaggtaggagaattgcttgaattgcattgagctgagatcacaccactgcactccagcatgggtgactgagtgagactctgtctcaaaaaaaaaaaaaaaaaaaaagagaaaagaaaagtttggtagtatttaaggaaagcatacagaatgagtagaagtttgccaggtgaagagtcaggaggatgatatttagtagaaggaaaatttaaccagattgtgtgtttggcagaaggaacatctgcaggaacacctgatgaggctgcacccttggcggaaagaacacctgacacagctgaaagcttggtggaaaaaacacctgatgaggctgcacccttggtggaaagaacacctgacacggctgaaagcttggtggaaaaaacacctgatgaggctgcatccttggtggagggaacatctgacaaaattcaatgtttggagaaagcgacatctggaaagttcgaacagtcagcagaagaaacacctagggaaattacgagtcctgcaaaagaaacatctgagaaatttacgtggccagcaaaaggaagacctaggaagatcgcatgggagaaaaaagaagacacacctagggaaattatgagtcccgcaaaagaaacatctgagaaatttacgtgggcagcaaaaggaagacctaggaagatcgcatgggagaaaaaagaaacacctgtaaagactggatgcgtggcaagagtaacatctaataaaactaaagttttggaaaaaggaagatctaagatgattgcatgtcctacaaaagaatcatctacaaaagcaagtgccaatggtaagatgctagagcgaactttgtaaggtttattggcacttcaggttccctagtgaaaaaagtgtgatatgggagtagttgggaatgacttgaatatctaaataaggcgagcttaggcaacactttttaatagtataggaataagtagctcttattctgtaggtcctggaaaaattctcacaattcttctggccgtaaatgctagatgaactaactaacaatggctaaaaccataggaaccaaagttgtttggtggtacagggatatcataggatcacacttttttttttttttttttttttttttttttgtgagacagagtctcgaactgtcccctgggctggagtgcaatggcacgagtgatctcggctgactacaacctccgcctcccaggttcatgtgattatcctgccttagcctcccaagtagctaggattacacgtgcccaccaccacacctggataattttttgtatttttagtagagatagggtttcactatattgaccagactcaaactcctgacctcatgatatgcctgccttggcctccaaaagtgctgggaattcaggtgtgaaccactgtgcccagccaggatcccacttatggttggctagttagcaacagctccaataatcatgctctctcaagacaatatttaaaggctggaagggctgcttttgttcacatgtttcttttaaatagggagaaaacttggaagcttgcagtaatcttcctgtaacattttattggctggattacaccacatgcccatatctaaaccagtcactaggaaagcaaatgtaattactgtgattagcttagaataatgatttctctttttgagatgggattggggtaatggaatactgaatatctaaagaaacttgtgtttctgcagcaagaaagaaaaaataatgcttatgcataggaagccagcaatgttttctgcagggattcattggaaaattttgagcaggggagtcacaagattagatttgagtatcagggcatactggttatggtataaggcagagattggcaaacttttcctgtaaagtgacagatagggaatatgttaggccgctgggcatggtggctcacacctgtaatcccagcactttgggaggctgaagcatgcggatcaccaggtcaggagttcgagaacagtctggccaacatggtgaaacctcatctttactaaaaatacagaaagtagccaggtgtggcggcatgcacctgtaatcccagctacctaggaggctgaggcaggagaatcacttgaacccaggaggcagaggttgcagtgagctgagatcgtaccactacactctagcctgtgtgacagagcaacattccatctaaaaaaagaaaaaaaaatgttaggccatgtggtctctataacagctattgaactctgcattgtagggtgaaagcagtcatagataatgtgtgagcaaacaggcaagattgtattccaataaaactttgtataaaaagccatttggtaagctgaatttggcctgtggcctatagtttgctggcccttcatatagaagaaagatggagggtaattacataaaaagatttaaagacgaaacttttgtagtagttcatgctatagtcttttttttttttttttgtcaccaatctgtggcctagtatcaatctattatgaaagtttgacccatccagggtaaaaagagtcaagttcagaagctcaatttacacatttaaatacgtaggtctttctttgccgttattttattttgatttcttttactgaattttttttaacttaaaaataaccgtagtaattggtagggtttctttgtccctgtgaaagccatcagttaaggggctgtgtctaactaggaaatttgagtgaattcacttcagaagaatttagaatatttctgttatatatttgttttctgtctcatggctgtcagtattccttgggccttgcatggaccttgatttaattctatgaaatgtgggaaatttagttacttaaggcaattgtttttcctataaatttttaatgtttctccaaggaggcacaagttgattctgaaggtattgttgcattaaggaaagactatctcattgtaattaaagcagtttttaatttatatgcaatacaagttctttaagcttatttatctaaaacacatacacaccaaatatactgtcatggcatattgaaatttaaaagggttggacatatattttgctaatatcaaaaagttaatattttgaagcatcttatttattgataaataatcttttttgaagaaccatataataaagattagtcaatcaaactacataatactaaaaaataaaagaaagtaatgagagctgacaggtaattaaagttatctgagtgaacagcaaatatctgacatagtatgcttcacgggagaagaggataggacttcttttgtgaagaaataattaatacaaattaatcaaatttttaatttttttgcattctaatgaatataaaattaatttttacatttttaagattgcagctctaaccatttgactatagaagtggttgtggttatctaccaatagaatatacaggctatagaagtaagtccacagattcatgaatgaaaatagatttgtatatgttttaaaaatttataataagaaatgttatcatgaatatatctgtgattaactttttatagatcagaggttcccatcagaatccaaacaagaggaagatgaagaatattcttgtgattctcgggtattgtgtattattgatgttattctctaaaaatattaatattgagtgatgtgaaaatataaagtcagaggctttgacttggttttcttaccactgcctatgctcagaagaaattctgatatttctaaaaacatacttggctgggcacggtgactcatgcctgtaatcccagcacttcggaaggcccgaggtgggaggatcacctgagttcaggagtttgagaccagcctggctaatatggtgaaaccctgtctgtactaaaaatacaaaattagttgggtgtggtggcatacccctgtaatcccagctactgaggaggctgaggcaggagaatcacttgaacccgggaggtggaggttgcagtgagctgagatcgtgccattgcactcagatcgggccattgcactccagtctgggtgacagagtgagactctgtctccaaaaaaagaaatacttaaaaaaaaatgtgtgctgagtagattactgcttggtagtgaaattctgctaattttcagaattagtttcagacacttgtgtagtacagtgtaaaaaataaggcttagaattcaccagtaattcacatgagttctgaggtgaaatttgatcaaaagctaaagaattactccgagttcatctttgggcaattatatgactcagtggtatatctagacgtacaaaaattttaattggattcatagaaaaacagtttaagctgcagttttgtacaacttgaaacataaaagataatgcttggattggaaattattgacgtatctgtattgtccagtatagatctgaaggaacatttcaggagacaaacatgcataaagaataggaaaccagtgggactataataacaacaatttggttgagtagtattttaaaaagtagaaattatttttacagatagaactctttgagtccgtttgtggtagccatgcttatagcaacataagtatcaaataatagtgatatagtccaaggtcacaactgtggaaagacacaggaagtgcctgacctcttagatccaagcccctgctgcacagtggtaacagaaatgagatgacaacagacaagcagactttatctaatttgtccatagacaaaaaaagactttctaatacttgattgctttcatttaaacataacataaatataagttttccttactactttttcattttattcaagtactttttccatcagcagatattttatcaaaaacatgttgattattttaagcccatttacctaaataaagcagcttctacaatgttctgagtgcactttatatgacttattcttaacattcttttcatgccatgcatcatttttaacactaaataattctattatcatgaataatttcagtgtttaatgcagtatgtatttgcggcagcgctcctctggagggggcaccagctgcagggagtctgtcccttgcagacccctgacccggggacagatgaataaagtacattgacacacagatattcttctctgccagtccagctgagggcgtctgagtggcttacagactccctgttgagttctgtaaacagttgtgactatggccctgatcagctagtcagactcgcatttattcagtatgattaattaacaaaagcttgagtcaatacccttagagggtaattgacattgtggacttcctggggtagtcctgagtaaaaagcacttaagcacctgtggtacatcaaaggtgagtcttaagattatatgagtaaacaagctagctaggtaagctactctgccttcctttatgactactttaatttgtttaactaaaggtaaagatcaggttgccttcaaccatatctattaccaaagttatgcaaacttctcggccttccaagaagatttgtgtctatttatataactacctctaatattttttccaccagtctgattgaaccccaacatgtgttatggcaggtagcaagtgtattgtacttgtttgatgtgccttcttgatttttggtgaggaagataaagtaagatatttttaagtgagctactttttgaaatatgcagatgagtgaaaatttttgtcaatgttatttatttttcatgctcagtaaccgagtcaatagctgcatgaagataacagataagttttgatatagatagcatgtgtgagggtttctatcaaaatgtcatgattttcaatatgtgcctatcctcaaatcaaattgcctttgaagtcagaaattgagtttaaaaaatattttaattaggaattttcatgcttatgattttaaaactgaaattatctattgatactacttttaacagagtctctttgagagttctgcaaagattcaagtgtgtatacctgagtctatatatcaaaaagtaatggagataaatagagaagtagaaggtaagaacgattttttatttgaaaagtcttttaaccatatgtttgtctaaatgcatgatgactgatatactctaatagccaaataaaattacccactaaatacataacatcgaaaagagaggagtaaaatgataagttatgtatcttttcaggtgttggcaacaggaatatgtagagagtgcaaaaaaaacaaccgaattatttgtttgaatccaagatactctaggacatgacgaaagtcaggaaacaagtaagggaaaaggagtaaaaagggaatgaagactaaagaaggcagagagagtacagggagttcatgaaggaacaagaagcaggtttatataatggaggtggcaaaataaaatattttttagaaaagatagaccatgcttagaaagatggcaagaatataaaatgatcttccagtaccaaaacttgtccgaaaattatagctaaagttttctcacttttcctgtctttctcactactgggaaggcattaggaatggaattatctgagcatgcagaattgtgttttatttgcaataggtgagtattaacaaaaatgcataggtgtgcatctataaaatttatcatatacactcagtatagacaaatacttatgaaacattagaaaatcagctgaataccttgttaatacacagtatcattcagcataattgagtttctaaattttaataagttctcaggcgatgctgataccagtggtacttggagctcattctgagtagcaagaggagaggccattcatgggaaaaatgtggaagaagagcaattggataaaaggataagacaaaacagggtcaagagaaagcattatattccttttatttctgagtatgcttttagccagagaagaagaataaaaagataaagaaacaaattataaatttaagttactgtcactaaacaaggagaaaggaagtgatggaaaaataaatttgaaacagtgttggatggaaaaaatcagttctaggaagttagagtttttttaaatttttttaaaaatttttttagcagaggcattctaggcaggtaacgggacaaacaagagagaaggtaggtaggtaattttggagactctgagaaggacagttcagtgaactcgcttcagatgtgtttagattatttgcactccagaaagtaaattatggacactccagagactaccagaagcaggagtcttactagaattggagaaaccaaagtgactcattaggtttctatgttacaatcaggcatgacaaatatatatttggttgatgttagctattcaagtgagatatatttgaaactaagaacattggctttatattttaagaaagtgagttgttttggtaaaattgtcattccacaaaaatttattatagactaatgatacgccaaatcagatgaattgtaggagctaaaaaaatactgaatttatacttgaataataagattgctttttaaaataaatattgtggtgactttataatataaaaagttatttatgtttaatacatctattgcaattaatttttatatacatatgtcaatattgaaagcttattatagattatttccatgatgagttttatacatcatcttgcatgagtggatcaagaagcattcagatgtataaactggaggatacagaaatgtaggcatattattacaccatatggttatggaaaacaatgaatatttatatttagtattatgaactaagtatatatccaagctgatcaattcataacacttcactgatgagatgtcaattctacattcagctgaactctcatcataactatgtacttttccaaagataggccatattaaagaacatgatgaatagaataacataaatgattctaatatgtttcattaagtacgtggtgtagcattccatgttcagctttgacatttattttctcatatcaaccctttttacacgtgaaacacaatctcgctttgaagtcttaactgcacgatctatgaaacctatatttatattttcttcagtgtattcctgtcgtgtgtgtgtcctaaacaaaccaaaagaaaactttccaaatctaaagtattcgttctcaaagtcgaccaagaggaatcagttacatactatgactgcattcatttggttggcattgtcatacttacttatgattgatgataaatctcttttgctttttagagcctcctaagaagccatctgccttcaaggtatttagttttattatttcattttgaatgacttattaattatgtatttgtgaagtatacattctttattaatcattttgcttccaaccccatttagcctgccattgaaatgcaaaactctgttccaaataaagcctttgaattgaagaatgaacaaacattgagagcaggtaaatttttcaatttaactatgcaaagacgaatatttcaatattggacattttgatggtctttctatccccaatgctttatttttttcaactttgatgaaaacatttgatctagataatgccaatactggtattgatgtttgaaaacctgatattacaagaacagtaatttttaatatattttttaaaaatgtagccttaatctcagatgtttctacttttgtatcccgaaactgtaatgtttactattttgaacttctgtaattcttaaagattcaagtaggtgaattttgaaactcttaacttcttttagttcttcgaagcttgattcaaattccactgtttacttcggggatcacgtcttttactgatataacacttgtgttttaatattaattaccttgtttccagtgttgtcactttgggaatcctaagaaaatcagtaactcggattagtgaactctgtgtgtttgtgtgtgtgtgtgtctgcgtgtgttcctgtgtgtgtctgtttatgtgtttggtacctttaccttgtaaagatgaggaaagtaattagtcatttctttgtgaatatttgataagcacactttttcctaaaactgtaattctgaagcatttgggtttagagtctttttacactaacctactttttaaaactattcttatgcatgtttaaacattttacaacatgtgtgcgtggtcatatttaatatgtacaatttttttcaacttctaatgcatacatggttgtacggtgtaatgttcagaaacattcttttttgatcagcatcataatttttagtgacatccataaaggacacaattaactgtgttttttaatattaggttgtttataaaattccattgtatgacagtaccatagttaattgcacaatttttatgctgataagtaataaataaaaatgaaaacattcagatttcagactctttcaaaagttagtgttatctgctgattttttaggtattagaaactaaaagtaaaatatttaaagtatttccttgtgcaatcatacactccactaagaatttgaactgtgccccacagcttcttagagctatggtgtggcaacacgttagatctctgaaacgatccagggtacgcttctaaaaatgagtgaacatggtgacttaccaaagtgtgatttgagtttcttgtaccctctgcatgaaatgtgaacattagggatgctaagatcagaagttaaacttacttttgaaaaccaggtatacagttgatggatgtcaaatgagaaacgtatgcatagtgatgaaacggtcttttaagttttagttgtgcatgtttgctttttttcctcaacctgattcaaatagttgtaatttgtactttgtactgataaagaaaactggacattatttttggtataaattcattttctgtctcatgttcctgagaactcgtcaagtcttgagtgggccttgattttatcctataacatgtgggaacgttagattacttaaggcaattatattttcctatacatttctgatgtttctccaaggtgtcacaaactgactctgaagatattgttgcattagggaagaagtatgtcattgtaattgaagcagttgttaatttatattcaataaaagtttttaagcttatcttcctaaaacatatacacacccaaaacacacccaatacactgtcatagaatattgaaatgtaaaaggattggacatatagttgactaacatcaaaaagttaatactcctaaaaaatcttattcattgataaatcatctttgtggaagaactgtgtaatagagattgctgagtcaatcaaactaagtaatactaccaaatataaatttacaaagaaaagagagatgataggtaattaaagttttctgaatgaacagcaaatataggacatactgtgtttcagaggagaagaggatatgactgctttatgaagaaataatccatacaagttaatcaaatttctatttttctgcattgtaatgaaataatgttaattttcagactttttagatttcaattctaatggaatgactatagaagtagttattgtaatcgacaaaaagaatatacgggccacagaggaaaaaccacagattcgtgaatgaaagtagatttgtatatgtttttaaaatttatagtagagaaatgttgtcatgaatgtttctgtgattaaccttttatagatccgatgttcccaccagaatccaaacaaaaggactatgaagaaaattcttgggattctgaggtactatgtgttattgatttttttttaatattagtattgcatgatatgaaaacataaaggcagaggcttaggctttattttctcgcctcttcatatgtcaccccgaaattatttttgatatttttcagaatatgcttaatggagaatctatgtgctaagtagattactgcttcatagtgaaattctgggaatttgtacgattaatttaagaagccaaagtggtatagtgtaaaaactaaggcttagaattcactagaaattcacatgggatctgaagtacatttgtctaaaagtgaaagaattacactgattccagctatgggcaaatatatgattctgtcttacatctagatgtacaaaagttctaattggatgcatagagagacattttaaactgcagtattgtaaaagctgggacctgaaaagttaatgcctgggacttgaatgtattgacatatgtttattgttcagtatagatctgaaggaacatttcagcagaaagaaaagcatgaggaataggaaaccttgtgggagtataataacaagagtattggttgagtagtcttttgaaaaatataaattatattttcacaaatagaactccttgagtcctcttatggcagtcaagctgcagcagcatgagcgtcaaataatagtgatgtattttaaggtcacaactgtggaaagacatgggaagtatctgacctcttagaaacaagcagctgctgcctggtggtaacagcaaaaggtggaagtcaataggtagattttatctgatattttattagacaaaaagactttaacacttgtttgctttcatttagatgtgacgtaatttttttcttactgcatttacattctattcaagcactttttctatcaccataaattttgtctaaaacatgttgcttattttaagcccctgtttaccgaaaggaagcagctttttcatattctgtgcatacattctgtgacagactctaaaagttctcttcatgacatgcatcatttttaacactaaacagttctgtgatcatgaatattttaaatgtttaatgctgtatgtgtcctggcaagtagcaaatgtgttgtattttgtttgaaatgtcttatttatttttgatgaggactagaacataagttagatatttttaagagagatactttttgaaatatgcacgagtgaatttttttatcaaggtgatttgtttttcctgctcagtcactgagttaatggccacatgaatgtaaagatcagcttgatgtagagagggttgtgtgaggttttctatcaaaatgtgttggttttctatatgtatctgcacttaagtcgaattgtttgcaaaggaggaaattgtgtttttaaaaaagaatttaattaggaaattttgatactcttcattactaggatttatccattgaaattatttattgctattacttttaacagagtctctgtgagactgtttcacagaaggatgtgtgtttacccaaggctacacatcaaaaagaaatagataaaataaatggaaaattagaaggtaagaaccgttttttatttaaaaatcagttgaccgaatatttctctaaactgatgaggagggatatcctctagtagctgaagaaaattacctcctaaatgcaaaccatggaaaaaaagagaagtgcaatggtcgtaagttgtatgtctcatcaggtgttggcaacagactatattgagagtgctgaaaaggagctgaattattagtttgaattcaagatattgcaagacctgaggaaaatgagaaaataagaaagaagaatgtagtaatagagtaactgaagactgagaaagacagaacgtacagagagtacatgaaggaacaagaagcaggtttatatagtggaggatgataaaatgaaatgattctttaggaaaagattgggtattgttagaaatttgggaagaatataaagtgaccttctagtatcaaaatttaccagagaattacagcaaaaatattctgactcttaatgtctttctcactggtgggaagccattagggatggaagcacctgaccatggagagctgtgttctatttgcaataggtgagaataagcatatctgcatggccacacatgtatataatttgtcatatacactccgtatagaccagaagttttcaaactttagaaaatcagctgaaaaccttgttaacaattcacactgagattcagccgacttgggattctgcatttttaaaaagttctcaggtgatgctgatgctggtggtccttggaccttgctctgggtagcaagaggagaggccttttgtgggaaaaatgtggaagaacaattggatagaaggtcaagacagaaaagggtcaggagagagcagtatggtgttctcaattttgaggatgtttttagtcaggggagaagaagaaaggggcaatgcaatagaaattatagatggaagatactaccactaaacaaaaggaaagagtgggaaaaaaattttcacaggtgttgaatgggaagaaccaagagcacaagtctagagattatttttgctaaagcagagagattgtgaggcaggaagcaggggacaagagagaagccagctagatgattttggattttctatgaatgaaaatggagtgagctcacttcagaagcatttagaaaagttttactgcagaatgctagagtgtgggtgctctggagactactggaatcatgaggattactagaattggactaaacctcagtgactcattaattttctttattactatgaggcatcaaatatatttatgtatatatgtatgtatgtatgttgttgatattcacaatttgaataagatatacttgaatgtaagaaccttggctttatttttaaggaagcaaattgtgttggtaaaattgccattttataaaacctcattagcaaataacatgatacacgaaaccagactaattttaaaaaccataaaattctgaatttatgacttgaatacttaaattgttgttattcataggtattttactgattttaacatagaaaatgttattaatatttaaaagtctattgcaactaaatttaaatgaaatacagcaatattgaaagcttattaaatttgctattcctgatgaagtttgtacatcttcctccatgagtggatcaagaaatattgagatggctaagctggaaattacaaaaatgttggcatactattatagcatatggttataaaaatcaatgaatatttatatttagtattatgctttaagtatatatccaagctgatcaattaattacactttcactgatgagatgtcaattctacatttagctgaactctcatctgaactgtgtggcttctcaatgacaggacatattaaagaacatgatgaatgtttgtaatgtaatgatataaattattataatgtgttgcattaaagacacatggtgtagcattctacgttcagcttttgcatttattttctcagtgtcatgatttgctcctgtgattccagatcagttttctccttatcagtcagcatatacatattggtattaacactttttgcaaaaatcatatataaatggttgtagaatgttgttgtcattctacagcaactgtttagtttttgttcagcgattagcttgtttttcatttattttaagatttcaggccagtcgtggtggctcacgcctgtaattccagcactttgggagggcgacgcgggcggatcacaaggttaggagatccagaccatcctggccaatacggtgaaaccccatctctactaaaaatacaaaaaattagccgggcgtggtggtgggtgcctgtagtcccagctactctggaggctgaggcaggaaaatggcgtgaacttgggaggcggagcttgtagcgagccaagatctcgccagtgcactccagtctgggcaacagagtgatacgctatcaaaaaaaaaaaaaaatcatagtgtgcatttttactttacaccacctttaattagacgctattcatggtgactaaagagcaacataaatataattacggatgtcaacaagcctttgtttaagtgtatgtcctacttcatgctatactagaaattaaaagtgaagtactgaaaatccaagtacgtacagccatacatttcaatagccattacaaatgcggctcatgaatctttcgagctatgccatgtgacctgtcctgattctaaacaactccagtgtacccctttataaaaataaaagtaataaaaaaaaactaaggtggtattttcctacccggttcctctgcatgaattttgaacttcagggatgatcagatcacaatttagaaccagagttttcaaccttacataggattcttaagtgccaagtgataaatggttccttgatgatgagctcacctttactgtttcatctctgcgtgttttgcttttttatcttgtcttagaaaatttaatgccagttattttctttataaaggaaaatattttggttacatattcatttcctgtctcatgacactctgctttctttgcacttagtgaggatgtgtatttctcacagttttacctaaaacaagcagatgaattcatggtatcatttcttatatatgaattttggaggtttcttcagtgcttcagaagtaacttttaaagatattaatgaatagagaatgaccttctcattgtaattaaagcaggtttttatttaaagcgtattgaatacaaatttaagcactttttttctaacacacatacatgcaatatggtcatgcatatttagccttaaaatggttagacataaattttgtgtgttttagagagtttatgtccctgaagtgtcttcattattgatcaatgatctctcaagggaaacaacatatatagttgatatttctaaatatattaaagcatgtcatatggaaatatttgaggagtagagaaaaatgagtgattaaacatgtttgattaatattatttgaagacatgagatctatttctatctcaatgaaatgtctgtgattttcttgaagctaagttttttataagagcttattcataacaatagtttaacacctggcacggtgtaacaaatagaattagttttagaaacaaaactattgtaggattcattccttgaacactaaaactgttattttgaataagcattattgtaacattgaaatatgcaggtgaatgatatgtaaaaagtctctagaagtttgcttcttgtttgtaatacatccatataagatgttttctcgctctgtcatccaggctggagtgcagtggcatgatcttggctcattgcaacatctgcctcctgggttcaagtgattctggtacctcaggcacccaagtagctgggtttacaggcatgtaccaccatacctggctgatttttgtaattttagtggagacagtgtttccaaaatagtgattttggccaggctggtttggaactcctggcctccagagatccgccctcctcagccttccaaattgctggaattacaggcatgagccactgcacctggcctgtattggtttgttgatgggtacgcttggacctttttgtataagtggatcaggaaattttaagaggactaaactagagaaccctatgaatgtgaaaatactcgtatttcacagaggtacaaaaatgaatatatttattaacttttattctataagtagatatgctgctaaatttagaaccttctctgcaatgataagtacattgtacctttgaactctcatcacaactttgcaattcctaaactccaggacaaattgaagaacataatagctacatgtatatattgacataagtgattctgacgtgtttccttaacaatatgccatagcattctcccattagcttagtcatttattctgttttggtggggtgtggcatgacttggtcatcttattaaatacaacttctttccttatacggccgctttctcttactgatagtaggatatttctgctttagttattgtcaccttaaatatattttcaatgttgaaatcctcacagcatgtttgatgaaatctagttttcaaattttcttaggtatatttctgtcacgttggcatgataacaaatacaataacccaaaagaccccaaaacatagtgtaatccgttttgcaatccaagcatgaggattcatcttcatgttcacactgtgtgaatgttcggtaggctttgtcaggcttgcatataatcaattatgtatgtcccttttcttatagagtctcctaataaagatggtcttctgaaggtaataacttttatatttttgtcttgagtatcaactacatattttatgaagtatacattgtatattaattgttttgtttccaaacccatttaggctacctgcggaatgaaagtttctattccaactaaagccttagaattgaaggacatgcaaactttcaaagcaggtaaattttgtaattttaattttactctggaaaggagaatattaaaatatttgaaatgctgtgagacttttcattcccaatgttgttttctattcaaaatttgatgggatattttgatacaataatgccaatgtgagtatttctgtttgagaaaatgccatttacaagcataagatttagagatttagaaaaaaaattctgctttacctcatgtggttctactttaatatcctgatagtgtaaagtttccagtttgcaatttctgtacgtgcttggttttaaggcaggtgaattttgagactgaaatatttgcagtggttcaaaggctgattggaattccgatctttacttagaagaaagtttcacttgctgacatgacagttgtgagtgttgccactcagagaatattaagaaaatcagctttttttttgattagctgactgtgtgtgtgacttttaattttaaaaaatcagtcaagcaatcattacttgatgactctttgctagacatagtgttttagaagagtgactataaagcatttggccttggtgtcttttaatgctactgtaatgaattgcctagagatacaaaacagcctgaattagtttttgctgtcattcccatgcacgtttaaaacattttacaacaggctgtgcatggtgacacgtgcctgtaatcctagcattttgggagacaaaggcgggcagataagttaaggtcaggagtcccagaccagcctggtcaaattagtgaaaccccatctctactaaatataacaaaaaatagccggttgtgatggtgggtgcctgtcatctcagctactctggaggctgaggtgggagaatcgcttgaaactaggaggcaaaagttgcagtgagccgtccttttgccactttagcttgagtgacagagtgagactccatctgaaaaagcaaagaaataaaaaaacaaaaactcacaacatgtatgtggttatagaccatgtgtacaatttgttttcatgtcttatacgctgtgtgtagaatttgttttcatgtcttataggctatatgtagaatttgttttcatgtcttaaattttcttctatttttgtttgtatttttttcttcagtttttttgttttgttttgtttttgtttttttgagatcacccaggctggagtgccatggcgcgatctcggctcacgcaagctctgcctcccgggttcacgccattctcctgcctcagcctcccgagtagctgggactccaggcgcctgccaccatgcccggctaatgttttgtgtttttagtagagacagggtttcagtgtgttagccaggatggtctgatccggatctcctgaccttgtgatccgcccacctcggcctcccaaagtactggaattacaggcgtgaggcaccgtgcccggccgatgtctgaaattttcaataaatggttgtacactgtacatattgtcctggaacttccttgtttgcttatcgaatattttagatggacccaatacaattagctctgctttgatttaaggcctcatagtttgccatgttaattctaaaacacatttaattagaccgtcttttctagccactaaaagtcgacattaaatggcagctgatatcacagagcttttactgaagtgggggtatttactgcttcatccactgttagaaattaaaatgaaaatatttaaaatacacgaattggaaaagtcctacttttcaatacgcattacaactgttactcattaaccatgaaaattatgacattgtgacatgtcatgagtctgaaaaattttagtttacactttttagaaaatatcagtaaataggagaaataggaaaaacattatgtgaactattaggcccccggtgtatttgttgaacttcagagatgctcagatcagaagttagaacaaaaattttcaaaaatgcataaggttctaaagtgccaaataacaaatgggctcttgtatatgaaataatgtctgaagttgcacctctgagtcttttttctctttctcttttttttaaaaaaatataaatcaaacaaaatcaaaattttgtttataatgaaaagaattggttacagattcattctgtgtctcatggcactgtgctctctttttccctagagaggatctagacttttcatctgtttacatgggaagaagtagttcagtttatggtctcatttctcatataaattgtgaaaattctccacggcttcacatgctagttcagaagatattgatgccttgagaataaagcatctggttgtaactccagcagttttatatttaaagtatacctaatataattgtcaaccacattactttagaaaacataaacaaaagatagttacacatatttattttaaaaatggtgactgggtgcggtggctcacgcctgtaatcccagcacgttgggaggccgtgactggcagatcacgaggttaggagatcgagaccatcctgactaacaaggcgaaaccctgtctctactaaaaatacaaaaaaattagtcggacgtggtggcacgcatttctaataagttctcaggtgatgctgatgctggtggtccttggagcttgctctgagtagcaaaaggagaggcctttcatgggaaaatagtggaagaagagcagttggatagaaggtcaagacataacatggtcaggagaatgcattatattgcttttatttctgggtatgcttttagccagagaagaagaagaaaaagataaacagaaattatagatttaagatactatcactaaacaaagagaaaggaagtgttgaacaaataaatttgaaacagtgttgtatgggaagaattctacagagttagaggtttttttttattttctgtttttattttttatttatttatttttttagttgaagcattctaggcaggtgacaggggacaaacaagaaagaatgtaggcaggtaattctggagactctgagaagaacagttgagtgaactcacttcagttgcatttagattatttgtactccagaatgtagactgtgggcactccagagactaccggaagcaggagtcctactagaattgggggaaccacagtgactcattaggtttctctgttacaatcagggaagacaaatatatattttgttgctgttcgctatacaaatgacacatattgaaaactaagaacattggctttatgtttaaggaagtgtgttgttttggtaaaattgccattccacaaaaaatttattatagactaatgatacaccgaaccagacgaattgtaggaactgagaaaatactgaatttatacttgaataataagattgctttttaagataaatattgtggtgacttaacaatataaaaaagttatttatgtttaattcatctattgcaataaatttttatataaatatgtcaatattgaaagcttattatagattatttccatgatgagttttacacatcttcttgcatgagtggatccagaagcattcagacagctaaagtagaggatacagaaatataggcatatgattacaccatatggttatggaaaaaaacaaatattcatatttagtgttatgacctaagtgtatatccaagctgaacaattcataacatttcagagacaagatgtcagttctacattcagctgaactttcatcataactatgtacctttccgaagataggctatattaaagaacaggatgaatggaataatataagtgattctaatgtgtttcattaagtacgtggcgtagcattccatgttcagctttgacatttattttctcatatcaaccctttatacacatgaaacacaatctcgcttttgaagtcttaactgcatgatctgagaaacctgtatttatattttcttcagtgtattcttgtcgtgtgtgtgtcctaaacaaaccaaaagaaaactttccaaatctaaagtattcattctccaattggagcaagaggagtcagttaaatactatcacggcattcatttgtggttggcttgtcatatttacatatgattgatgataaatctcttttgctttttagagcctccggggaagccatctgccttcgaggtatttagttttatgatttcattttgaatgacttattatctatgtattttgtgaagtatacattctttattaatcattttgcttccaaccccatttagcctgccactgaaatgcaaaagtctgtcccaaataaagccttggaattgaaaaatgaacaaacattgagagcaggtaaatttttcaatgtaactatggaaagaccaatatttcaatattggacattttgatggtctttctgtacccaatggtttatttttttcaactttgatgaaaagatttgatctagataatgccaatactggtattgatgtttgaaaagctggtattacaagcacagtaattttcaatatattttttaaaaaaatgtagccttaatctcagatgtttctacttttgtatcctgaaactgtaatgttttctattttgaacttctgtatttcttaaggattcaagaaggtgaatgttgaaactccaatttctttttttagctcttcgaagcttgattcaaattccacggtttacttcggggatcccatctcttactgatataacccttgtgttttaacatgaattaccttgtttccggtgttgtcactttgagaatcctaagaaaatcagtaactcggactagtgaactctgtgtgtttatgtgtgtgtgtgtctgcgtgtgtgcctgcgtgtgcctgtgtgtgtgtggtacctttaccttgtaaagatgaggaaaggaattattcatttctttgtgaatatttgataaacacactttttcatgaaactgtgattctgaagcatttggctttagagtccttttacgctagtaccatttattgcctggaagtaaccaatattctaaactgtttttagaaactcttcttatgcatgtttaaacattttacaacatgtgtgcgtggtcatatttaatatgtacgatttttttcaacttctaatgtgtacatggttgtagagtgtagtgttcggcaacattcttttttgatcagcattataatttttagagacatccgtaaaggacacaattaattgtgtttttaaatattaggttatttataaaattccattgtatgacagtaccatagttaattgcacaatttttatgccgagaagtaataaataaaactgaaaacatgcaaatttgggagtctttaaaaagttagttttatctgctgatttcttagtcattagaaattaaaagtaacatatttaaagtatttccttgtgcaatcatagactccactaagaatttgaactgtgccccacagcttcttagagctatggtgtggcaacacgttagatctctgaaacgatccagggtacgcttctaaaaatgagtgaacatggtgacttaccaaagtgtgatttgagtttcctggaccctctgcatgaattgtgaacatgagctatgctgagatcacaagttaaatttacttttgaaaccaggtatacagttgatggatgtcaaatgataaacgtatgcatagtgatgaaacggtcttttaagttttaggtgtgcatgtttgcttttttcctgaacctgattcaaatagttgtaatttgtactttgtgctgataaagaaaactggacgttatttttggtataaattctttttctgtcttatgcccctgagaactcgtcaagtcttgagtgggccttgattttatcctattacacgtgggaacattagattacttaaggcaattatattttcctatacatttctgatgtttctccaaggtgtcacaagctgactctgaagatattgttgcattagggaagaagtgtgtcattgtaaatgaagcagttcttaatttatatgcaataaaatttttaaagcttatcttcctaaagcatatacacacgcaaaacacacccaatacactgtcatagcatacggaaatgtaaaagggttggaaatatagttgactgacatcaaaaagttaatattcctaaaacatcttattcattgataaatcatcttttttgaagaactgtgtaagagagattgctgagtcaatcaacgtaagtaatactaccaagtaaaaagtaacaaagaaatgagagatgataggtaattacagttttctgaatgaacaggaaacctagggcatactgtgtttcacaggagaataggatatgactgctttgtgaagaaataattcatacaagttagtcaaatttctatttttctgcattctaatgacataatgttaattgtcagagtttttagatttcaattcttttggaatgactatagaagtagtcattgtaatcaacaaaaagaacatatgggccacagaggaaaatccacagattcgtgaatgaaagtagatttgtatatgtttttaaaatttttagtagagaactgtgctcatgaatgtatctgtgattaaccttttatagatgagatactcccatcagaatccaaacaaaaggactatgaagaaaattcttgggatactgaggtactgtgtgttgttgatttttttaaatattagtattgcatgatatgaaaacataaaatcagatgcttagtctttattttctcacctctgcatgtgtcaccctcaaattatttttgatgtttttcagtatatgcttaatggagaatctatgtgctaagtagattcctgcttcacagtgaaattctgggaatttgtacgattaatttaagaagccaaagtggtatagtgtaaaaactaaggcttagaattcactagaaattcacatgggatctggagtacgtttgtctaaaagcaaaagaattacactgagtcgagctatgggcaaatatatgattctgtcttatatctagaggtagaaaagttctaattgtattcatagagagacactttaaactgcaatattgtaaaagttgggacctgaaaatttaatgcctgggacttgaacatattgacatatctttattgttcagtatagatctgaaggaacatttcagcagaaagaaaagcatgaggaataggaaaccttgtgggagtataataacaagagtattggttgagtagtcttttgaaaaatataaattatattttcacaaatagaactccttgagtccccttatggcagtcaagctacagcagcatgagcgtcaaatcatagtgatgtattttaaggtcacaacggcggaaagacatagaaagtatctgacctcttagaaacaagcagctgctgcctgatggtaacagcaaagggtggaagtcaataggtagattttatctgatattttattagacaaaaagacgttaatacttgttttctttcatttagatgtgacataacttttttcttactgcatttacattctattcaagcactttttctctcaccaaaaattttgtcagaaacatgttgcttattttaagcccctgtttaccgaaagaaagcagctttttcaaattctgtacatacattctatgacagactctaaaagttctcatcatgacatgcatgatttttaacactaaacagttctatgatcgtgaatattttaaatgtttactgctgtatgtgtccaggcaagtagcaaatgcgttgtattttgtttgaaatgtcttatttatttttgatgaggactagaacataagttagatatttttaagagagttactttttgaaatatgcacgagtgaatttttttgtgaaggtgatttgtttttcctgctcagtcaccgagttaatggccacgtgaacgtaaagatgagcttgatgtagagagggttatgtgaggttttctatcaaaatgtgtttgttttctacatgtatctgctcttaagtcgaattgtttgcaaaggaggaaattgtgtttttaaaaaagaatttaattaggaaattttgatactcttcattactaggatttatccattgaaattatttattgctattacttttaacagagtctctgtgagactgtttcacagaaggatgtgtgtttacccaaggctgcgcatcaaaaagaaatagataaaataaatggaaaattagaaggtaagaaccgttttttatttaaaaatcatttgaccaaatatttctctaaactgatgaggaaggatatcctctagtagctgaagaaaattacctcctaaatgcaaaccatggaaaaaaagagaagtgcaatggtcataagttatgtgtctcatcaggtgatggcaacagactatattgtgagtgctgaagcggagctgaattactagtttgaattcaagatattccaagacgtgaggaaaatgagaaaataagaaagaagaaagtagtaatagagtaaatgaagactgagaaagacagagcatacagagagtacatgaaggaacaagaagcaggtttatgtaatggaggatgataaaatgaaatgattgtttaggaaagatcggatgcaggggacaagagagaagccagctagatgattttggattttctatgaaggaaaatggagtgagctcacttcggaagcatttagaaaagttttactgcagaatgttagagtgtgggtgctctggagactactggaatcatgaggattactagaattggactaaacctcagtgactcattaattttctttattactatgaggcgtcaaatatatatatatatagatgtgtgcatgtatgtatgtttttgatgttcacaatttgaataagatatacttgaatgtaagaaccttggctttatttttaaggaagcaaattgtgttggtaaaattgccattttataaaacctcattagcaaataacatgatacacgaaaccagactaattttgaaaaccataaaactctgaatttatgacttgaatacctaaattgttgttattcgtaggtattttactgattttaacatagaaaatgttattaatatttaaaaatctgatgcaactaaatttaaatgaaatacatcaatattgaaagcttattaaatttgccattcctgatgagatttgtacatcttcctgcatgagtggattaagagatattgagatgactaagctagaaattacaaaaatgttggcatactattccagtatatgggtatgaaaatcaaggaatatttatatttaatattatgctctaagtatatatccaagctgatcaattcataacactttttctgatgagatgtcaattctacattcagctgaactcttatccgaactgtgtggcttctcaatgacaggacatattaaagaacatgatgaatgtttgtaatgcaatgatataaattattataatgtgttgccttaaagacacatggtgtagcattctacgttcagcttttgcatttattttctcagtgtcatgatttgctcctgtgattccagatcagttgtctccttatcagtcagcatatacttattggtattaacactttttgcaaaaatcatatataaatggttgtacaatgttgttgtcattctacagcaactttttaatttttgttcagcgattagcttgtttttcatttattttaagatttcaggccaggtgtggtggctcacgcctgtaatcccagcactttggtaggccaaggtgggtggatcacgaggtcaggagatccagaccatcctggctaacatggtgaaacctcacctctactagaaatacaaaaaatcagccgggcgtggtggtgggtgcctgtagtcccagctactccggaggctgaggcaagagaatggcgtgaacccgcgaggcggagcttgtggtgagccgatattacattattgtaacattgaaatatgcaggtgaatgatatataaaaagcctctggaagtttacttctagtttttgatactttcacgttacgtgttttttcttttttagagacagagtctcgctctgtcatccaggctggagtgcaatggcatgatcttggctcactgccacctccagctcctgggttcaagtgattctggtacctcagtcacccaagtagctgagattacaggcatgtgccaccatacctggctgatttttgtaattttagtggggacagtgtttctaaaatagtgattttggccaggctggtttggaactcctggcctccagagatccgccctcctcagccttccaaagtgctggaattacaggcatgagccactgcacctggcctgtattggtttgttgatgggtacgcttggacctttttgtataagtggatcaggaaattttaagaggactaaactagagaaccctatgaatgtgaaaatactcgtatttcacagaggtacaaaaatgaatatatttattaacttttattctataggtagatatgctgctgaatttagaacattctctgcaatgataagtacgttgtacctttgaactctcatcacaactttgcaattcctaaactccaggacaaattgaaggacataatagctacatgtatatattgacataagtgattctgacgtgtttccttaacaatatgccatagcattctcccattagcttagtcatttattctgttttggtggggtgtggcatgacttggtcatcttattaaatacaacttctttcctaatacggccgctttctcttactgatagtaggatatttctgctttagttattgtcaccttaaatatattttcaatgttgaaatcctcacagcatgtttgatgaaatctagttttcaaattttcttaggtatatttctgtcacgttggcatgataacaaatgcaataacccaaaagaccccaaaagctagtgtaatcccttttgcaatccaagcatgaggattcatcttcatgttgacagtgcgtgaatgttcggtaggctttgtcaagcttgcatacaataaattatatatgtcccttttcttttagggtctcctgttaaagatggtcttctgaaggtaataacttttatatttttatcttgagtattaactacatattttatgaagtatacattgtatattaattgttttctttccaaacccatttaggctaactgcggaatgaaagtttctattccaactaaagccttagaattgatggacatgcaaactttcaaagcaggtaaattttgtaattttaattttactctggaaagaagaatattaaaatatttgaaatgctgtgagacttttcattcccaatgttgttttctattcataatttgatgggaaatttcgatacaaataatgccaatgtgagtatttctgtttgagaaaatgccatttacaagcataagatttagagatttagaaaaaaaattctgctttacctcatgtggttctactttaatgtcctgatcggataaagtttccaatttgcaatttctgtacgcgcttggttttaaggtaggtgaattttgagactgtgaaatatttgcagtggttcgaaggctgattggaattctgatgtttactcagaagaaagtttcacttgctgacatgacagttgtgagtgttaccactctgagaatcttaagaaaatcagttttttttttaatagatgactgtgtgtgtgtgtgacttataattttaaaaaatcagtcaagcaatcattacttgatgactctttgctaggcaccgcattttagaagagtgaccccaaagcatttggccttggtgtgttttaatgctactgtaatgaattgcctagagatacaaaagagcctgaagtagtttttgtcattcccgtgaacgtttacaacattttacaacaggccttgcacggtggcacatgcctggaatcctagcagtttgggagacaaaggcgggcagataagttaaggtcaggagtcccagaccagcctggtcaaactagtgaaaccccatctctactaaacataacaaaaaatagccggttgtggtggtgggtgcctgtcatctcagctactctggaggctgaggcaggagaatggcttgaacctaggacgcagaagttgcatgagccgagcttgtgccactttagcctgagtgacagagtgagactccatctgaaaaggtaaagaaataaaaacacaaaactcacaacatatgtgtggttatagactatgtgtagaatttgttttcatgtcttataggctgtgtgtagaatttgttttcatgtcttaaattttctttttttttgtttgtatttttttcttcagtttttttgtttggttttgtttttgtttttttgagatcacccaggctggagtgccatggcgccatctcggctcacgcaagctctgcctcccgggttcacgccattctcctgcctcagcctcctgagtagctgagactccaggtgcctgccaccacgcccggctaatgttttgtatctttagtagagacagggtttcagtgtgttagccaggatggtctgatccggatctcctgaccttgtggtccgcccgtctcggcctcccaaagtactggaattacaggcatgaggcaccgtgcccggccgatgtctgaaattttcaataaatagttgtacgctgtacatattgtcctggaacttccttgtttgcttatcgaatattttagatggacccaatacaattagctctgctttgatttaaggcctcatagtttgccatgttaactctaaaacacatttaattagactgtgtttcctagccactaaaagtcgacattaaatggcagctgatatcacagagcttttactgaagtgggagtatttactgcttcattcactgttagaaattaaaatgaaaatatttaaaatacacgaattggaaaagtcctactttccaatacgcattacaactgttactcattaaccatgaaaattatgacattgtgacatgtcatgagtctgaaaaattttagtttacactttttagaaaatatcagtaaataggagaaataggaaaaacattatggcccccggtgtatttgttgaacttcagagatgctcagatcagaagctagaacaagaattttcaaaaatgcataaggttttaaagtgccaaataacaaatgggctcttgtatatgaaataatgtctgaagttgcacctctgagtcttttttctctttttcttttttaaaaagatataaatcaaacaaaatcaaacttttgtttataatgaaaagagttggttacagattcattctgtgtctcatggcactgtgctctctttttccctagagaggatctagacttttcatctgtttacatgggaagaagtagttcagtttatggtctcatttctcatataaactgtgaaaattctccacggcttcacatgctagttcagaagatattgatgccttgagaataaagcatctggttgtcactccagcagttttatatttaaagtatacctaatatagttgtcaaccacattactttagaaaacataaacaaaagatagttacacttatttatttaaaaaatggtgaccgggtgcggtggctcacgtctgtaatgccagcacgttgggaggccgtgactggcagatcacgaggtgaggagagcgagaccatcctgactaacgcggtgaaaccctgtctctactaaaaatacaaaaaattagccggacgtggtggcacgcacttctaataatttctcaggcgatgctgctgctggtggtccttggagcttggtctgagtagcaaaaggagaggcctttcatgggaaaatagtggaagaagagcagttggatagaaggtcaagacataacagggtcaagagaatgcattatattgcttttatttctgggtatgcttttagccagagaagaagaagaaaaagataaacagaaattatagatttaagatactatcactaaacaaagagaaaggaaatgttgaacaaataaatttgaaacagtgttgtatgggaagaattctacagagttagaggtttttttttaatttctttttttttttttttttttttttagtagaagcattcaagtcaggtaacgggacaaacaagaaagaatgtaggcaggtaattctggagactctgagaagaacagttgagtgaactcacttcagatgcatgtagattatttgcactccagaatgtagactgtgggcactccagagactaccagaattgggggaaccacagtgactcattaggtttctctgttacaatcaggcatgagaaatatatatattttgttgatgttagctattgaaatgagatatattggaaactgagaacattggctttatgtttaaggaagtgtgttgttttggtaaaattgccattccacaaaaatttattatagactaatgatacaccaaaccaggcgaattgtaggatctgaaaaaatactgaatttatacttgaataataagattgctttttaagataaatattgtggtgacttaacaatataaaaaaagttacttatgtttatttaatctattgcaataaatttttatataaatatgtcaatattgaaagcttagtatagattatttccatgatgagttttacacatcttgcatgagtggatcgagaagcattcagatggataaagtagaggatacagaatcataggcatatgattacaccctatggttatggaaaaaaacgaatattcatatttagtattatgacctaagtgtatatccaagctgatcaattcataacacttcagtgatgagatgtcagttgtacattcggctgaactctcatcataactatgtacctttccaaagataggctatattaaagaacaggatgaatggaataatataagtgattctaatgtgtttcattaagtacgtggcgtagcattccatgttcagctttgacatttattttctcatatcaaccctttttacacgtgaaacacaatctcgctcttgaagtcttaactgcatgatctgtgaaacctgtatttatattttcttcagtgtattcttgtcgtgtgtgtgtcctaaacaaaccaaaagaaaactttccaaatctaaagtattcattctccaattggagcaagaggagtcagttagatactatcacggcattcatttgtggctggcttgtcatatttacttatgattgataataaatctattttgctttttagagcctcccgagaagccatctgccttcgaggtatttagtttcatgatttcattttgaatgacttattaactatgtattttgtgaagtatacattctttattaatcattttgcttccaaccccatttagcctgccattgaaatgcaaaagtctgttccaaataaagccttggaattgaagaatgaacaaacattgagagcaggtaaattttttaatggaactatgcaaagaccaatatttcaatattggacattttgatggtccttctatccccaatgctttatttttttcaactttgatgaaaagatttgatctaggtaatgccaatactggtattgatgtttgaaaagctggtattacaagcacagtaattttcaatatctttttttaaaaatgtaggcttaatctcagatgtttctacttttgtatcctgaaactgtaatgttttctattttgaacttctgtatttcttaaggattcaagaaggtgaatgttgaaactccaatttctttttttagctcttcgaagcttgattcaaattccacggtttacttcggggatcccatctcttactgatataacccttgtgttttaacatgaattaccttgtttccggtgttgtcactttgagaatcctaagaaaatcagtaactcggactagtgaactctgtgtgtttatgtgtgtgtgtgtctgcgtgtgtgcctgcgtgtgcctgtgtgtgtgtggtacctttaccttgtaaagatgaggaaaggaattattcatttctttgtgaatatttgataaacacactttttcatgaaactgtgattctgaagcatttggctttagagtccttttacgctagtaccatttattgcctggaagtaaccaatattctaaactgtttttagaaactcttcttatgcatgtttaaacattttacaacatgtgtgcgtggtcatatttaatatgtacgatttttttcaacttctaatgtgtacatggttgtagagtgtagtgttcggcaacattcttttttgatcagcattataatttttagagacatccgtaaaggacacaattaattgtgtttttaaatattaggttatttataaaattccattgtatgacagtaccatagttaattgcacaatttttatgccgagaagtaataaataaaactgaaaacatgcaaatttgggagtctttaaaaagttagttttatctgctgatttcttagtcattagaaattaaaagtaacatatttaaagtatttccttgtgcaatcatacactccactaagaatttgaactgtgccccacagcttcttagagctatggtgtggcaacacgttagatctctgaaacgatccagggtacgcttctaaaaatgagtgaacatggtgacttaccaaagtgtgatttgagtttcctggaccctctgcatgaaatgtgaacatgagctatgctgagatcacaagttaaatttacttttgaaaccaggtatacagttgatggatgtcaaatgataaacgtatgcatagtgatgaaacggtcttttaagttttaggtgtgcatgtttgcttttttcctgaacctgattcaaatagttgtaatttgtactttgtgctgataaagaaaactggacgttatttttggtataaattctttttctgtcttatgtccctgagaactcgtcaagtcttgagtgggccttgattttatcctattacacgtgggaacattagattacttaaggcaattatattttcctatacatttctgatgtttctccaaggtgtcacaagctgactctgaagatattgttgcattagggaagaagtgtgtcattgtaaatgaagcagttcttaatttatacgcaataaaagttttttaagcttatcttcctaaagcttatacacacgcaaaacacacccaatacactgtcatagcatactgaaatgtaaaagggttggacatatagttgactgacatcaaaaagttaatatttctaaaacatcttattcattgataaatcatcttttttgaagaactgtgtaagagagattgctgagtcaatcaatgtaagtaatactaccaaataaaaagtaacaaagaaatgagagatgataggtaattccagttttctgaatgaacaggaaacctagggcatactgcgcttcacaggagaataggatatgactgctttgtgaagagataattcatacaagttagttaaatttctatttttctgcattctaatgaaataatgttaattttcagactttttagatttcagttctattggaatgactatagaagtagtcattgcaatcaacaaaaagaatatacgggctacagaggaaaaacctcagattcgtgaatgaaagtagatttgtatatgtttttaaaatttttagtagagaactgtgctcatgaatgtatctgtgattaaccttttatagatgagatactcccatcagaatccaaacaaaaggactatgaagaaagttcttgggattctgaggtactatgtgttattgattttttaaatattagtattgcatgatatgaaaacataaaatcagatgcttagactttatgttctcacctctgcatgtgtcacccccaaattatttttgatatttttcagtatatgcttaacggagaatctgtgtgctaagtagattcctgcttcacagtgaaattctgggaatttgtacgattaatttaagaagccaaagtggtatagtgtaaaaactaaggcttagaattcactagaaattcacatgggatctggagtacttttgtctaaaaggaaaagaattacactgagtccagctatgggcaaatatatgattctgtcttatatctagaggtagaaaagttctaattgtattcatagagagacactttaaactgcaatattgtaaaagttgggacctgaaaatttaatgcctgggacttgaacgtattgacatatctttattgttcagtatagatctgaaggaacatttcagcagaaaggaaagcatgaggaataggaaaccttgtgggagtataataacaagagtattggttgagtagtcttttgaaaaatataaattatattttcgcaaatagaactccttgagtccccttatggcagtcaagctgaagcagcatgagcgtcatatcatagtgatgtattttaaggtcacaacggcggaaagacatagaaagtatctgacctcttagaaacaagcagctgctgcctggtggtaacagcaaagggtggaagtcaataggtagattttatctgatattttattagacagaaagactttaacacttgtttgctttcatttagatgtgacataatttttttcttactgcatttacattctattcaaacactttttctatcaccaaaaattttgtcaaaaacatgttgcttattttaagcccctgtttaccgaaagaaagcagctttttcaaattctgtacatacattctatgacagactctaaaagttctcttcgtgacatgcatgatttttaacagtaaacagttctatgatcgtgaatattttaaatgtttactgctgtatgtgtcccggcaagtagcaaatgtgttgtattttgtttgaaatgtcttatttatttttgatgaggactagaacgtaagttagatatttttaagagagatactttttgaaatatgcacgagtgaattttttgtgaaggtgatttgtttttcctgctcagtcaccgagttaatggccacgtgaacgtaaagatgagcttgatgtagagagggttatgtgaggttttctatcaaaatgtgtttgttttctacatgtatctgctcttaagtcgaattgtttgcaaaggaggaaattgtgtttttaaaaaagaatttaattaggaaattttgatactcttcattactaggatttatccattgaaattatttattgctattacttttaacagagtctctgtgagactgtttcacagaaggatgtgtgtttacccaaggctgcgcatcaaaaagaaatagataaaataaatggaaaattagaaggtaagaaccgttttttatttaaaaatcatttgaccaaatatttctctaaattgatgaggaaggatatcctctagtagctgaagaaaattacctcctaaatgcaaaccatggaaaaaaagagaagtgcaatggtcataagctatgtgtctcatcaggcattggcaacagactatattgtgagtgctgaagaggagctgaattactagtttaaattcaagatattccaagacgtgaggaaaatgagaaaataagaaagaagaaagtagtaatagagtaaatgaagactgagaaagacagagcgtacagagagtacatgaaggaacaagaaacaggtttatgtaatggaggatgataaaatgaaatgattgtttaggaaaagatcgggtatggttagaaatttgggaagaatataatgtgaccttctagaatcaaaatttaccagagaattacagcaaaaatattctgactcttaatgtctttctcactggtgggaagccattagggatggaagcacctgaccatggagagctgtgttctatttgcaataggtgagaataagcatatctgcacggccacacatgtatataaattgtcatatacactccgtatagaccagaggttttcaaactttagaaagtcagctgaaaaccttgttaacaattcacactgagattcagccgacctgggattctgcatttttaaaaagttctcaggtgatgctgatgctggtggtccttggacgttgctctgggtagcaagaggagaggccttttgtgggaaaaatgtggaagcagagcaactggatagaaggtcaggacagaaaaggtcaggagaaaacatcatggtcctcttaattttgaggatgtttttagtcaggggagaagaagaaaggagcaatgcaatagaaattatagatggaaggtactaccactcctcaaagtaaaaggaaagagtgggaaaaaataattttaacaggtgtcgaatgggaagaatcaagagcacaagtctagtgattatttttgctaaagcagagagattgtgaggcaggaagcaggggacaagagagaagccagctagatgattttggattttctatgaaggaaaatggagtgagctcacttcggaagcatttagaaaagttttactgcagaatgttagagtgtgggtgctctggagactactggaatcatgaggattactagaattggactaaacctcagtgactcattaattttctttattactatgaggcgtcaaatatatatatatatatatatatatatatatatatatatatatatatatatagatgtgtgcatgtatgtatgtttttgacgttcacaatttgaataagatatacttgaatgtaagaaccttggctttatttttaaggaagcaaattgtgttggtaaaattgccattttataaaacctcattagtaaataacatgctacacgaaaccagactaattttgaaaaccataaaactctgaatttatgacttgaatacctaaattgttgttattcgtaggtattttactgattttaacgtagaaaatgttattaatatttaaaagtctgttgtaactaaatttaaatgaaatacatcaatattgaaagcttattaaatttgctattcctgatgagatttgtacatcttcctgcatgagtggattaagagatattgagatgactaagctagaaattacaaaaatgttggcatactattcctacattatgggaatgaatacccatattccaagtatatgggtatgaaaatcaaggaatatttatatttaatattatgctctaagtatatatccaagctgatcaattcataacactttttctgatgagatgtcaattctacattcagctgaactcttatccgaactgtgtggcttctcaatgacaggacatattaaagaacatgatgaatgtttgtaatgcaatgatataaattattataatgtgttgccttaaagacacatggtgtagcattctacgttcagcttttgcatttattttctcagtgtcatgatttgctcctgtgattccagatcagttgtctccttatcagtcagcatatacttattggtattaacactttttgcaaaaatcatatataaatggttgtacaatgttgttgtcattctacagcaactttttaatttttgttcagcgattagcttgtttttcatttattttaagatttcaggccaggtgtggtggctcacgcctgtaatcccagcactttggtaggccaaggtgggtggatcacgaggtcaggagatccagaccatcctggctaacatggtgaaacctcacctctactagaaatacaaaaaatcagccgggcgtggtggtgggtgcctgtagtcccagctactccggaggctgaggcaagagaatggcgtgaacccgcgaggcggagcttgtggtgagccgatattacattattgtaacattgaaatatgcaggtgaatgatatataaaaagcctctggaagtttacttctagtttttgatactttcacgttacgtgttttttcttttttagagacagagtctcgctctgtcatccaggctggagtgcaatggcatgatcttggctcactgccacctccagctcctgggttcaagtgattctggtacctcagtcacccaagtagctgagattacaggcatgtgccaccatacctggctgatttttgtaattttagtggggacagtgtttctaaaatagtgattttggccaggctggtttggaactcctggcctccagagatccgccctcctcagccttccaaagtgctggaattacaggcatgagccactgcacctggcctgtattggtttgttgatgggtacgcttggacctttttgtataagtggatcaggaaattttaagaggactaaactagagaaccctatgaatgtgaaaatactcgtatttcacagaggtacaaaaatgaatatatttattaacttttattctataggtagatatgctgctgaatttagaacattctctgcaatgataagtacgttgtacctttgaactctcatcacaactttgcaattcctaaactccaggacaaattgaaggacataatagctacatgtatatattgacataagtgattctgacgtgtttccttaacaatatgccatagcattctcccattagcttagtcatttattctgttttggtggggtgtggcatgacttggtcatcttattaaatacaacttctttcctaatacggccgctttctcttactgatagtaggatatttctgctttagttattgtcaccttaaatatattttcaatgttgaaatcctcacagcatgtttgatgaaatctagttttcaaattttcttaggtatatttctgtcacgttggcatgataacaaatgcaataacccaaaagaccccaaaagctagtgtaatcccttttgcaatccaagcatgaggattcatcttcatgttgacagtgcgtgaatgttcggtaggctttgtcaagcttgcatacaataaattatatatgtcccttttcttttagggtctcctgttaaagatggtcttctgaaggtaataacttttatatttttatcttgagtattaactacatattttatgaagtatacattgtatattaattgttttctttccaaacccatttaggctaactgcggaatgaaagtttctattccaactaaagccttagaattgatggacatgcaaactttcaaagcaggtaaattttgtaattttaattttactctggaaagaagaatattaaaatatttgaaatgctgtgagacttttcattcccaatgttgttttctattcataatttgatgggaaatttcgatacaaataatgccaatgtgagtatttctgtttgagaaaatgccatttacaagcataagatttagagatttagaaaaaaaattctgctttacctcatgtggttctactttaatgtcctgatcggataaagtttccaatttgcaatttctgtacgcgcttggttttaaggtaggtgaattttgagactgtgaaatatttgcagtggttcgaaggctgattggaattctgatgtttactcagaagaaagtttcacttgctgacatgacagttgtgagtgttaccactctgagaatcttaagaaaatcagttttttttttaatagatgactgtgtgtgtgtgtgacttataattttaaaaaatcagtcaagcaatcattacttgatgactctttgctaggcaccgcattttagaagagtgaccccaaagcatttggccttggtgtgttttaatgctactgtaatgaattgcctagagatacaaaagagcctgaagtagtttttgtcattcccgtgaacgtttacaacattttacaacaggccttgcacggtggcacatgcctggaatcctagcagtttgggagacaaaggcgggcagataagttaaggtcaggagtcccagaccagcctggtcaaactagtgaaaccccatctctactaaacataacaaaaaatagccggttgtggtggtgggtgcctgtcatctcagctactctggaggctgaggcaggagaatggcttgaacctaggacgcagaagttgcatgagccgagcttgtgccactttagcctgagtgacagagtgagactccatctgaaaaggtaaagaaataaaaacacaaaactcacaacatatgtgtggttatagactatgtgtagaatttgttttcatgtcttataggctgtgtgtagaatttgttttcatgtcttaaattttctttttttttgtttgtatttttttcttcagtttttttgtttggttttgtttttgtttttttgagatcacccaggctggagtgccatggcgccatctcggctcacgcaagctctgcctcccgggttcacgccattctcctgcctcagcctcctgagtagctgagactccaggtgcctgccaccacgcccggctaatgttttgtatctttagtagagacagggtttcagtgtgttagccaggatggtctgatccggatctcctgaccttgtggtccgcccgtctcggcctcccaaagtactggaattacaggcatgaggcaccgtgcccggccgatgtctgaaattttcaataaatagttgtacactgtacatattgtcctggaacttccttgtttgcttatcgaatattttagatggacccaatacaattagctctgctttgatttaaggcctcatagtttgccatgttaactctaaaacacatttaattagactgtgtttcctagccactaaaagtcgacattaaatggcagctgatatcacagagcttttactgaagtgggagtatttactgcttcatccactgttagaaattaaaatgaaaatatttaaaatacacgaattggaaaagtcctactttccaatacgcattacaactgttactcattaaccatgaaaattatgacattgtgacatgtcatgagtctgaaaaattttagtttacactttttagaaaatatcagtaaataggagaaataggaaaaacattatgtgaactattaggcccccggtgtatttgttgaacttcagagatgctcagatcagaagctagaacaagaattttcaaaaatgcataaggttttaaagtgccaaataacaaatgggctcttgtatatgaaataatgtctgaagttgcacctctgagtcttttctctctttttcttttttaaaaagatataaatcaaacaaaatcaaaattttgtttataatgaaaagagttggttacagattcattctgtgtctcatggcactgtgctctctttttccctagagaggatctagacttttcatctgtttacatgggaagaagtagttcagtttatggtctcatttctcatataaactgtgaaaattctccacggcttcacatgctagttcagaagatattgatgccttgagaataaagcatctggttgtaactccagcagttttatatttaaagtatacctaatataattgtcaaccacattactttagaaaacataaacaaaagatagttacacttatttatttaaaaaatggtgaccgggtgcggtggctcacgtctgtaacgccagcacgttgggaggccgtgactggcagatcacgaggttaggagatcgagaccatcctgactaacacggtgaaaccctgtctctactaaaaatacaaaaaattagccggacgtggtggcacgcatttctaataatttctcaggcgatgctgctgctggtggtccttggagcttggtctgagtagcaaaaggagaggcctttcatgggaaaatagtggaagaagagcagttggatagaaggtcaagacataacagggtcaagagaatgcattatattgcttttatttctgggtatgcttttagccagagaagaagaagaaaaagataaacagaaattatagatttaagatactatcactaaacaaagagaaaggaaatgttgaacaaataaatttgaaacagtgttgtatgggaagaattctacagagttagaggtttttttttaatttctttttttttttttttttttttagtagaagcattcaagtcaggtaacgggacaaacaagaaagaatgtaggcaggtaattctggagactctgagaagaacagttgagtgaactcacttcagatgcatgtagattatttgcactccagaatgtagactgtgggcactccagagactaccagaattgggggaaccacagtgactcattaggtttctctgttacaatcaggcatgagaaatatatatattttgttgatgttagctattgaaatgagatatattggaaactgagaacattggctttatgtttaaggaagtgtgttgttttggtaaaattgccattccacaaaaatttattatagactaatgatacaccaaaccaggcgaattgtaggatctgaaaaaatactgaatttatacttgaataataagattgctttttaagataaatattgtggtgacttaacaatgtaaaaaaagttacttatgtttatttaatctattgcaataaatttttatataaatatgtcaatattgaaagcttagtatagattatttccatgatgagttttacacatcttgcatgagtggatcgagaagcattcagatggataaagtagaggatacagaatcataggcatatgattacaccctatggttatggaaaaaaacgaatattcatatttagtattatgacctaagtgtatatccaagctgatcaattcataacacttcagtgatgagatgtcagttgtacattcggctgaactctcatcataactatgtacctttccaaagataggctatattaaagaacaggatgaatggaataatataagtgattctaatgtgtttcattaagtacgtggcgtagcattccatgttcagctttgacatttattttctcatatcaaccctttttacacgtgaaacacaatctcgctcttgaagtcttaactgcatgatctgtgaaacctgtatttatattttcttcagtgtattcttgtcgtgtgtgtgtcctaaacaaaccaaaagaaaactttccaaatctaaagtattcattctccaattggagcaagaggagtcagttagatactatcacggcattcatttgtggctggcttgtcatatttacttatgattgataataaatctattttgctttttagagcctcccgagaagccatctgccttcgaggtatttagtttcatgatttcattttgaatgacttattaactatgtattttgtgaagtatacattctttattaatcattttgcttccaaccccatttagcctgccattgaaatgcaaaagtctgttccaaataaagccttggaattgaagaatgaacaaacattgagagcaggtaaattttttaatggaactatgcaaagaccaatatttcaatattggacattttgatggtccttctatccccaatgctttatttttttcaactttgatgaaaagatttgatctaggtaatgccaatactggtattgatgtttgaaaagctggtattacaagcacagtaattttcaatatctttttttaaaaatgtaggcttaatctcagatgtttctacttttgtatcctgaaactgtaatgttttctattttgaacttctgtatttcttaaggattcaagaaggtgaatgttgaaactccaatttctttttttagctcttcgaagcttgattcaaattccacggtttacttcggggatcccatctcttactgatataacccttgtgttttaacatgaattaccttgtttccggtgttgtcactttgagaatcctaagaaaatcagtaactcggactagtgaactctgtgtgtttatgtgtgtgtgtgtctgcgtgtgtgcctgcgtgtgcctgtgtgtgtgtggtacctttaccttgtaaagatgaggaaaggaattattcatttctttgtgaatatttgataaacacactttttcatgaaactgtgattctgaagcatttggctttagagtccttttacgctagtaccatttattgcctggaagtaaccaatattctaaactgtttttagaaactcttcttatgcatgtttaaacattttacaacatgtgtgcgtggtcatatttaatatgtacgatttttttcaacttctaatgtgtacatggttgtagagtgtagtgttcggcaacattcttttttgatcagcattataatttttagagacatccgtaaaggacacaattaattgtgtttttaaatattaggttatttataaaattccattgtatgacagtaccatagttaattgcacaatttttatgccgagaagtaataaataaaactgaaaacatgcaaatttgggagtctttaaaaagttagttttatctgctgatttcttagtcattagaaattaaaagtaacatatttaaagtatttccttgtgcaatcatacactccactaagaatttgaactgtgccccacagcttcttagagctatggtgtggcaacacgttagatctctgaaacgatccagggtacgcttctaaaaatgagtgaacatggtgacttaccaaagtgtgatttgagtttcctggaccctctgcatgaaatgtgaacatgagctatgctgagatcacaagttaaatttacttttgaaaccaggtatacagttgatggatgtcaaatgataaacgtatgcatagtgatgaaacggtcttttaagttttaggtgtgcatgtttgcttttttcctgaacctgattcaaatagttgtaatttgtactttgtgctgataaagaaaactggacgttatttttggtataaattctttttctgtcttatgtccctgagaactcgtcaagtcttgagtgggccttgattttatcctattacacgtgggaacattagattacttaaggcaattatattttcctatacatttctgatgtttctccaaggtgtcacaagctgactctgaagatattgttgcattagggaagaagtgtgtcattgtaaatgaagcagttcttaatttatacgcaataaaagttttttaagcttatcttcctaaagcttatacacacgcaaaacacacccaatacactgtcatagcatactgaaatgtaaaagggttggacatatagttgactgacatcaaaaagttaatatttctaaaacatcttattcattgataaatcatcttttttgaagaactgtgtaagagagattgctgagtcaatcaatgtaagtaatactaccaaataaaaagtaacaaagaaatgagagatgataggtaattccagttttctgaatgaacaggaaacctagggcatactgcgcttcacaggagaataggatatgactgctttgtgaagagataattcatacaagttagttaaatttctatttttctgcattctaatgaaataatgttaattttcagactttttagatttcagttctattggaatgactatagaagtagtcattgcaatcaacaaaaagaatatacgggctacagaggaaaaacctcagattcgtgaatgaaagtagatttgtatatgtttttaaaatttttagtagagaactgtgctcatgaatgtatctgtgattaaccttttatagatgagatactcccatcagaatccaaacaaaaggactatgaagaaagttcttgggattctgaggtactatgtgttattgattttttaaatattagtattgcatgatatgaaaacataaaatcagatgcttagactttatgttctcacctctgcatgtgtcacccccaaattatttttgatatttttcagtatatgcttaacggagaatctgtgtgctaagtagattcctgcttcacagtgaaattctgggaatttgtacgattaatttaagaagccaaagtggtatagtgtaaaaactaaggcttagaattcactagaaattcacatgggatctggagtacttttgtctaaaaggaaaagaattacactgagtccagctatgggcaaatatatgattctgtcttatatctagaggtagaaaagttctaattgtattcatagagagacactttaaactgcaatattgtaaaagttgggacctgaaaatttaatgcctgggacttgaacgtattgacatatctttattgttcagtatagatctgaaggaacatttcagcagaaaggaaagcatgaggaataggaaaccttgtgggagtataataacaagagtattggttgagtagtcttttgaaaaatataaattatattttcgcaaatagaactccttgagtccccttatggcagtcaagctgaagcagcatgagcgtcatatcatagtgatgtattttaaggtcacaacggcggaaagacatagaaagtatctgacctcttagaaacaagcagctgctgcctggtggtaacagcaaagggtggaagtcaataggtagattttatctgatattttattagacagaaagactttaacacttgtttgctttcatttagatgtgacataatttttttcttactgcatttacattctattcaaacactttttctatcaccaaaaattttgtcaaaaacatgttgcttattttaagcccctgtttaccgaaagaaagcagctttttcaaattctgtacatacattctatgacagactctaaaagttctcttcgtgacatgcatgatttttaacagtaaacagttctatgatcgtgaatattttaaatgtttactgctgtatgtgtcccggcaagtagcaaatgtgttgtattttgtttgaaatttcttatttatttttgatgaggactagaacgtaagttagatatttttaagagagatactttttgaaatatgcacgagtgaattttttgtgaaggtgatttgtttttcctgctcagtcaccgagttaatggccacgtgaacgtaaagatgagcttgatgtagagagggttatgtgaggttttctatcaaaatgtgtttgttttctacatgtatctgctcttaagtcgaattgtttgcaaaggaggaaattgtgtttttaaaaaagaatttaattaggaaattttgatactcttcattactaggatttatccattgaaattatttattgctattacttttaacagagtctctgtgagactgtttcacagaaggatgtgtgtttacccaaggctacgcatcaaaaagaaatagataaaataaatggaaaattagaaggtaagaaccgttttttatttaaaaatcatttgaccaaatatttctctaaattgatgaggaaggatatcctctagtagctgaagaaaattacctcctaaatgcaaaccatggaaaaaaagagaagtgcaatggtcataagctatgtgtctcatcaggcattggcaacagactatattgtgagtgctgaagaggagctgaattactagtttaaattcaagatattccaagacgtgaggaaaatgagaaaataagaaagaagaaagtagtaatagagtaaatgaagactgagaaagacagagcgtacagagagtatatgaaggaacaagaagcaggtttatgtaatggaggatgataaaatgaaatgattgcttaggaaaagatcgggtatggttagaaatttgggaagaatataaagtgaccttctagaaccaaaatttaccagagaattacagcaaaaatattctgactcttaatgtctttctcacttgtgggaagccattagggatggaagcacctgaccatggagagctgtgttctatttgcaataggtgagaataagcatatctgcatggccacacatgtatataaattgtcatatacactctgtatagaccagaggttttcaaactttagaaagtcagctgaaaaccttgttaacaattcacactgagattcagccgacttgggattctgcatttttaaaaagttctcaggtgatgctgatgctggtggtccttggacgttgctctgggttgcaagaggagaggccttttgtgggaataatgtggaagcagagcaactggatagaaggtcaggacagaaaaggtcaggagaaagcatcatggtgctcttaattttgaggatgtttttagtcaggggagaagaagaaaggagcaatgcaatagaaattatagatggaagatactaccactcctcaaagtaaaaggaaagagttggaaaaaataatgttaacaggtgtcgaatgggaagaatcaagagcagaagtctagtgattatttttgctaaagcagagagattgtgaggcaggaagcaggggacaagagagaatccagctagatgattttggattttctatgaaggaaaatggagtgagctcacttcggaagcatttagaaaagttttactgcagagtgctagagtgtgggtgctctggagactactggaatcatgaggattactagaattggactaaacctcagtgactcattaataatctttattaatatgaagcatcaatatatagatatatatatatagatgtatgtatgtatgtatgtttttgacgttcacaatttgaataagatatacttgaatgtaagaaccttggctttatttttaaggaagcaaattgtgttggtaaaattgccattttatgaaacctcattagcaaataacatgctacacgaaaccagactaattttaaaaaccataaaactctgaatttatgacttgaatacctaaattgttgttattcgtaggtattttactgattttaacatagaaaatgttattaatatttaaaagtctgttgcaactaaatttaaatgaaatacatcaatattgaaagcttattaaatttgctattccttgatgagatttgtacatcttcctccatgagtggattaagagatattgagatgagtaagctagaaattacaaaaatgttggcatactattccagtatatgggtatgaaaatcaaggaatatttatatttaatattatgctctaaatatatatccaagctgatcaattcataacactttttctgatgagatgtcaattctacattcagctgaactctcatccgaactgtgtggcttctcaatgacaggacatattaaagaacatgatgaatgtttgtaatgcaatgatataaattattataatgtgttgccttaaagacacatggtgtagcattctacgttcagcttttgcatttattttctcagtgtcatgatttgctcctgtgattccagatcagttttctccttatcagtcagcatatacatattggtattaacactttttgcaaaaatcatatataaatggttgtacaatgttgttgtcattctacagcaactttttaatttttgttcagcgattagcttgtttttcatttattttaagatttcaggccaggtgtggtggctcacgcctgtaatcccagcactttgggaggcaaaggtgggtggatcacgaggtcaggagatccagaccatcctggctaacatggtgaaaccccacctctactagtaatacaaaaaatcagccgggcgtggtggtgggtgcctgtagtcccagctactccggaggctgagacaaaagaatggcgtgaacccgcgaggcggagcttgtggtgagccgatattacattattgtaacattgaaatatgcaggtgaatgatatataaaaagcctctggaagtttacttctagtttttgatactttcacattacatgttttttcttttttagagacagagtctcgctctgtcatccaggctggagtgcaatggcatgatcttggctcactgcaacctccacctcctgggttcaagtgattctggcacctcaggcacccaagtagctgagattacaggcctgtgccaccatacctggctgatttttgtaattttagtggggacagtgtttctaaaatagtgattttggccaggctggtttggaactcctggcctccagagatccgccctcctcggccttccaaattgctggaattacaggcatgagccactgcacctggcctgtattggtttgttgatgggtatgcttggacctttttgtataagtggatcaggaaattttaagaggactaaactagagaaccctatgaatgtgaaaatactcgtatttctcagaggtacaaaaatgaatatatttattaacttttattctataagtagaaatgctgctaaatttagaacattctctgcaatgataagtacatttgtacctttgaactctcatcacaactttgcaattcctaaactccaggacaaattgaagaacataatagcaacatgtatatattgacatcagtgattctgacgtgtttccttaacaatatgccatagcattctcccattagcttagtcatttattctgttttggtggggtgtggcatgacttggtcatcttattaaatacaacttctttccttatacggccgctttctcttactgatagtaggatatttctgctttagttattgtcaccttaaatatattttcaatgttgaaatcctcacagcatgtttgatgaaatctagttttcaaattgtcttaggtatatttctgtcacgttggcatgataacaaatacagtaacccaaaagaccccaaaagctagtgtaatcccttttgcaatccaagcatgaggattcatcttcatgttgacagtgcgtgaatgttcggtaggctttgtcaagcttgcatacaataaattatatatgtcccttttcttttagagtctcctgataatgatggttttctgaaggtaataacttttatatttttatcttgagtattaactacatattttatgaagtatacattgtatattaattgttttgtttctaaacccatttaggctccctgcagaatgaaagtttctattccaactaaagccttagaattgatggacatgcaaactttcaaagcaggtaaattttgtaattttaattttactctggaaagaagaatattaaaatatttgaaatgctgtgagacttttcattcccaatgttgttttctattcataatttgatgggaaatttcgatacaaataatgccaatgtgagtatttctgtttgagaaaatgccatttataagcctaagatttagagatttagaaaaaaaattctgctttacctcatgtggttctactttaatgtcctgatcggataaagtttccaatttgcaatttctgtacgcgcttggttttaaggtaggtgaattttgagactgtgaaatatttgcagtggttcaaaggctgattggaattctgatgtttacttagaagaaagttccacttgctgacatgacagttgtgagtgttaccactctgagaatcttaagaaaatcagttttttttttattagatgactgtgtgtttgtgtgacttataattttaaaaaatcagtcaagcaatcattacttgatgactcttgtctagacacggtgttttagaagagtgaccccaaagcatttggccttggtgtcttttaatgctactgtaatgaattgcctagaggtacaaaagagcctgaattagttcttgttgtcattcccgtgaacgtttacaacattttacaataggccgtgcacggtggcacgtgcctgtaatgatagcagtttgggagagaaaggcagacagataagttaaggtcaggagtcccagaccagcctggtcaaattagtgaaaccccatctctactaaacataacaaaaagtagccggttgtggtggtgggtgcctgtcatctcagctactctggaggctgaggcaggagaatggcttgaacgtaggaggcagaagttgcatgagccgagcttgtgccactttagcctgagtgacagagtgagactccatctgaaaaagcaaagaaataaaaacacaaaagctcacaacatatgtgtggttatagactatgtgtagaatttgttttcatgtcttataggctatgtgtagaatttgttttcatgtcttcaattttcttccttttttttgtttgcatttctttcttcagtttttttgttttgttttgtttttgtttttttgagctcgaccaggctggagtgccatggcgccatctcggctcatgcaagctctgcctcccgggttcacgccattctcctgcctcagcctcccgagtagctgggactccaggcgcgtgccaccacgcctggctaatgttttgtatttttagtagagacagggtttcagtgtgttagccaggatggtctgatccggatctcctgaccttgtgatgcgcccgtctcggcctcccaaagtactggaattacaggcgtgaggcaccgtgcccggccgatgtctgaaattttcaataaatagttgtacactgtacgtattgtcctggaacttccttgtttgcttatcgaatattttagatggacccaatacaattagctctgctttgatttaagacctcatagtttgccatgttaactctaaaacacatttaattagaccgtcttttctagccactaaaagtcgaaattaaatggcagctgatatcacagagcttttactgaagtgggagtatttactgcttcatccactgttagaaattaaaatgaaaatatttaaaatacacgaattggaaaagtcctactttccaatatgcattacaactgttagttgttaaccatgaaaattatgacattgtgacatgtcatgagtctgaaaaattttagtttacacttcttagaaaatatcagtaaatagaagaaataggaaaaacattatgtgaactattaggcccccggtgtatttgttgaacttcagagatgctcagatcagaagttagaacaagaattttcaaaaatgcataaggttttaaagtgccaaataacaaatgggctcttgtatatgaaataatgtctgaagttgcacgtctgagtcttttttctctttttctttttcaaaaagatataaatcaaacaaaatcaaaattttgtttataatgaaaagagttggttacagattcattctgtgtctcatggcgctgtgctctcttccctagagaggatctagacttttcatctgtttacatgggaagaagtagttcagtttatggtctcatttctcatataaactgtgaaaattctccacggcttcacatgctagttcagaagatattgatgccttgagaataaagcatctggttgtaactccagcagttttatatttaaagtatacctaatataattgtcaaccacattactttagaaaacataaacaaaagatagttacacatatttatttaaaaaatggtgaccgggtgcggtggctcacgcctgtaatgccagcacgttgggaggccgtgactgacagatcactaggtgaggagatcgagaccatcctgactaacacagtgaaaccctgtctctactaaaaatacaaaaaattagccggacgtggtggcacgcatttctaataatttctcaggcgatgctgctgctggtggtccttggagcttgctctgagttgcaaaaggagaggcctttgatgggaaaaattggaagaagagcagttggatagaaggtcaagacataacagggtcaagagaatgcattatattgcttttatttctgggtatgcttttagccagagaagaagaaggaaaagataaacagaaattatagatttaagatactatcactaaacaaagagaaaggaagtgttgaacaaataaatttgaaacagtgttgtatgggaagaattctacagagttagaggtttttttatattttctatttttttttttttttttttgtagtagaagcattctaggcaggtaacaggggacaaacaagaaagaatgtaggcaggtaattctggagactctgagcaaaacagttgagtgaactcacttcagatgcatgtagattatttgcactccagaatgtagactgtgggcactccagagactaccggaagcaggagtcctactagaattgggggaaccacagtgacacattaggtttttctgttacaatgaggcatgacaaatatatatattttgttgatgttagctattgaaatgagatatattggaaactaagaacattgggtttatgtttaaggaagtgtgttgttttggtaaaattgccattccataaaaatttattatagactaatgatacactgaaccagacgaattgtaggaactgtaaaaatactgaatttatacttcaaaaataagattgctttttaagataaatattgtggtgacttaacaattaaaaaagttatttatgtttaattcatctattgcaataaatttttatagaaatatgtcaatattgaaagcttagtgtagattatttccatgatgagttttacacatcttcttgcatgagtggatcaagaagcattcagatgaataaagcagaggatacagaaatataggcatatgattacaccctatggttatggaaaaaaatgaatattcattttaagtattatgacctaagtgtatatccaagctgatcaattcaaaacacttcagtgacgagatgtcagttgtacattcagctgaactctcatcataaccatgtacctttccgaagataggctatgttaaagaacaggatgaatggaataatataagtgattctaatgtgtttcattaagtacgtggcgtagcattccatgttcagctttgacatttattttctcatatcaaccctgtttacacgtgaaacacaatctcgctcttgaagtcttaactgcatgatctgtgaaacctgtatttatattttcttcagtgtattcttgtcgtgtgtgtgtcctaaacaaaccaaaagaaaactttccaaatctaaagtattcattctccaattggagcaagaggagtcagttagatactatcacggcattcatttgtggctggcttgtcatatttacttatgattgatgataaatctcttttgctttttagagcctcccgagaagccatctgccttcgaggtatttagttttatgatttcattttgaatgacttattaactatgtattttgtgaagtatacattctttattaatcattttgcttccaaccccatttagcctgccattgaaatgcaaaagtctgttccaaataaagccttggaattgaagaatgaacaaacattgagagcaggtacatttttcaatgtaactatgcgaagaccaatatttcaatattgaacattttgatggtctttctatccccaatgctttatttttttcaactttgatgataagttttgatctaggtaatgccaatactggtattgatgtttgaaaagctggtattacaagcacagtaattttcaatattttttttaaaaaatgtagccttaatctcagatgtttctacttttgtatcctgaaactgtaatgttttctattttgaacttctgtatttcttaaagattcaagaaggtgaatgttgaaactccaatttctttttttagttcttcgaagcttgattcaaattccacggtttatttcggggatcccatcttttactgatataacactcgtgttttaacttgaattacctcgtttccagtgttgtcactttgagaatcctaagaaaatcagtaactcggattagtgaactctgtgtgtttatgtgtgtgtgtctgcgtgtgtgcctgtgtgtgcctgtgtatgtgtgtggtaactttaccttgtgaagatgaggaaaagaattattcatttctttgtgaatatttgataaacacactttttcatgaaactgtgattctgaagtgtttggctttagagtctttttacactagtaccatttattgcccagaagtaaccaatattctaaactgttttttaaaactattcttatgcatgtttaaacattttacaacatgtgtgcgtggtcatatttaatatgtacaatttttttcaacttctaatatgtagatggttgtgcagtgtaatgttcggcaacattcgtttttgatcagcattataatttttagaaacatccgtataggacacagttaactgtgtttttaatattaggttatttataaaattccattttatgacagtaccatagttaactgcacaatttttatgctgataagtaataaataaaaatgaaaacatgcagatttctgcatctttaaaaggttagttttatctgctgattttttggttattagaaattaaaagtaaaatatttaagatatttccttgttcaatcatgcattccaccaagaatttgaactgtgccccagagcttcttagagatatggtgttgcaacacgttgtatctctgaaactatccagggttcacttccaaaaatgagtgaaaacggtggcttaccaaagtatgatttaagtttcttcgacactctgcatgaaatatgaacgttagctatgctgtgatcacaagttaaatttacttttgaaaatcaggtatacaattgatggatgtcaaatgatatacgtacccttaatgatgaaatggtcttttaagttttagttgtgcatgtttgcttttttctttaacctgattcaaatagttgtaatttgtactttgtgctgataaagaaacttcaacgttatttttggtataaattcattttctgtctcatgttcctgagaactcctcaagtcttgagtgggccttgattttatcctataacatgtgggaacgttggattacttaaggcaattattttttcctatacatttctcatgtttctccaaggtgtcacaagctgactctgaaggcattgttgcattagggaagaagtatgtcattgtaattaaagcagttcttaattcatatgcaataaaagttttttaagcttatcttcctaaaacatatacatacccaaaccacacccaatacactgtcatagcatattgaaatgtaaaagggttggacatatagttgactgacatcaaaaagttaatattcctaaaaaatcttattcattgataaatcatcttttttgaagaactgcgtaatagagattgctgagtcaatcaacgtaagtaatactaccaaataaaaatttacaaagaaatgagagatggtaggtaattaaagttttctgaatgaacaggaaatataggatataccttgtttcagagtagaagagtatgtgactgctttgtgaagaaataattcatagaagttagtcaaatttatatttttgtgcattctaatgaaataatgttaattttcagacttttcagatttcaattctaacggattgactataggaagtagtcattgtaatcaacaaaaagaatatacgggctacagaggaggaaccacagattcgtgaatgaaagtagatttgtatatgtttttaaaatgtatagtagagaaatgttctcatgaatgtatctgtgattaaccttttatagatcagatgttcccttcagaatcaaaacaaaagaaggttgaagaaaattcttgggattctgaggtactatgtgttattgatttttttaaatattagtattgcatgatatgaaaacataaaatcagatgcttagactttattttctcacctctgcatatgtcacccgcaaattatttttgatatttttcagaatatgcttaatagagaatctatgtgctaagtagattactgcttcacagtgatattgtgtgaatttgtaggattaatttaagaagcccgtgtggtacagtggaaataataagagttagaattcactagaaattcacatgggatctgaagtacgtttgtctaaaagcaaaagaattacactgagtccagctctgggcaaatatatgattctgtcttatatctagatgtacaaaagttctaattggattcatagagagacagtttaagctgcagtattgtaaaagttgggacctgaaaagttaatgcctgggacttgaacgtattgacatatctttattgttcagtatagatctgaaggaacatttcagcagaaagaaaagcatgaggaataggaaaccttgtgggagtataataacaagagtattggttgagtagtcttttgaaaaatataaattatattttcacaaatggaactccttgagtccctttatgacagtcaagctgcagcagcatgagcgtcaaataatagtgatgtattttaaggtcacaacggcggaaagacatagaaagtatctgacctcttagaaacaagcagctgctgcctggtggtaacagcaaagggtggaagtcaatagacaggtagattttatctgatttgtaattggacaaaaagactttaatacttatttgcttttatttagacatgacataatttttttcttactgcatttgcattctattcaagcacttttttatcaccataaattttgtcaaaaacttgttgctgattttaagcccttgtttatcaaaataaagcagctttttcaacattctgtacatacattctatgacagactctaaaagttctcttcatgacaggcatcatttttaacattagacaattgtatgatcatgcatattttacatgtttaatgcagtatctgttatggcaagtagcaagagtattgtattttgtttgaaatgtcatatttattgttgttgaggacgacaacatgttagatatttttaagagagatacgttttgaaatatgcacgattgaattttttcgtgtatatgatttgtttttcctgctcagtcaccgagttaatggccacatggacataaagatcagcttgatgtagagagggttatgtgaggttttctattaaaatgtttttttttatacgtgtctgctcttaagttgaattgcttgcaaaataggacttttttttaaaaaaagattttaattaggaaattttgataatcttcattattaggatttttccattgaaattatttattgatattacttttaacagagtctccgtgagactgtttcacagaaggatgtgtgtgtacccaaggctacacatcaaaaagaaatggataaaataagtggaaaattagaaggtaagaaccatcttttatttaaaaggtcatttgaccaagtatttctctaaaatgatgaggaaggatatgctctaatagctgaagaaaattacctcctaaatgcaaaccatggaaaaaaagagaagtgcaatggtcataagttatatgtctcatcaggtgttggcaaaagactatattgagagtgctgagaaggaggtgaattattagtttgaattcaagatattccaagacctgaggacaatgagaaaataagaaagaagaaagtagtaaaagaggaaatgaagactgagaaagacagagcgtacagagagtacatgaaggaacaagaatcaggtttatataatggaggatgatgaaatgattgtttaggaaaagattgggtgtggttagaaatttgggaagaatataaagtgaccttctagtaccaaaatttaccagagaattacagcaaaagtattctgactcttaatgtctttctcactggtgggaagccattagggatggaagcacctgaccatggagagctgtgttctatttgccataggtgagaataagcatgtctgcatggccacacatgtatataatttgtcatatacactccgtatagaccagaaattttcatagaaaatcagcgggaaacctagttaacaattcacactgtgattcagctgacttgggattctgcatttttaaaaagttctcaggtgatgctgatgctggtggtccttgtaccttgatctgagtagctgaggagaggccttttgtgggaaaaatgtggaagaatagcaattgaatagaaggtcaggacagaaaagggtcagaagaaagcattatgttacttttatttttgagtatgtttttagccagcggagaagaagaaaggggcaacgcaatagaaattgtagatggaagtaaagcagtcctcagcaaatgtaaaagaacagaaattatcacaaactgtctctcagaccacagtgcaataaaactagaactcaggattaagaacctcactcaaaaccacttaactacatggaaactgaacaacctcctccagaatgactactgggtacataacgaaatcaaggcagaaataaatatgttctttgaaaccgatgagaacaaaggcaccacataccagaatctgtgggacacatttaaagcagtgtgtagagggaaatttatagcactaaatgcccacaagagaaagcaggaaagatctaaaattgatacactaacatcacaattaaaagaactagagaagcaagagcaaacacattcaaaagctagcagaaggcaagaaataactaaaatcagagcagaattgaaggagatagagacacaaaaaatccttcaaaaaatcaatgaatccaggagctggttttttgaaaagattaacaaatatgatagactgctagcaagactaataaagaagaaaagtgagaagaatcaaatagacacaataaaaaatgataaaggggatatcaccaccgatcccacagaaatacaaactaccatcagagaatactataaacacctctatgcaaataaactggagaatctagaaaaaatggataaattcctggacagctacaccctcccaagactaaaccaggaaggagaatccccgaatagaccaataacaggctctgtaattgaggcaataattaatagcctaccaaccaagaaaagtccaggactggacagattcccagccaaattctaccagaggtacaaggaggagctgataccattccttctgaaatgattccaatcaatagaaaaagagggaatcctccctaactcattttatgaggccagcatcatcctgataccaaagcctggcagagacacaacaaaaaaacagaattttagaccagtatccctgatgaacatcaatgcaaaaatcctcaataaaatactggcaaaccgaatccagcagcacatcagaaagcttatccaccatgatcaagttggcttcatccctgggatgcaaggctggttcaagatatgcaaatcaataaatataattcatcatataaacagaaccaaaaacaaaaaccacatgattatctcaatagatgcagaaaaggcctttgacaaaattcaacagcacttcatgctaaaaactctcaataaactaggtattgatgggatgtatctcaaaataataagatctatttatgacaaacccacagccagtatcataccgaatgggcaaaaactggaagcattccctttgaaaactggcacaagacagggatgccctctctcaccactgctattcaacatagtgttggaagttctggccagggcaatcacacaggagaaagaaatgaatggtattcaataaggaatagaggaagtcaaattttccctgtttgcagatgacatgattgtatatttagaaaaccccattgtctcagcccgaaatcttcttaagctgatataagcagcatcagcaaagtctcaggatacataataaatgtgcaaaaatcacaagcactcttatacaccaataacagacaaacagagaaccaaatcatgagtgaactcccattcacaattgcttcaaagagaataaaatatctaggaatccaacttacaagggatgtgaaggacctcttcaaggagaactatacaccactgcttaacgaaataaaagaggacacaaacaaatggaagagcattccatgcttatggataggaagaatcaatatcgtgaaaatggccatactgcccaaggtaatttatggattcaatgccatccccattaagctaccaatgactttcttcacagaattggaaaaactactttaaagttcatatggaaccaaaaaagagcctgcagtgccaagacgatcctaagccaaaataacaaagctggaggcatcacactacctgacttcaaactatactacaaggctacagtaaccaaaacagcatggtattagtaccaaaacagagatatagatgaatggaacagaaccacacatctacaaccatctgatctttgatgaaccagacaaaaacaagaaatggggaaaggattccctatttaataaatggtgctgggaaaactggctagccatatgtagaaagctgaaactggatcccttccttacaacttatacaaaaattaattcaagatggattaaagacttaaatgttagacctaaaaccataaaaaccctagaagaaaacctaggcaataccattcaggacaaaggcatgggcaaagtcttcatgactaaaacaccaaaagcaatggcaacaaaagccaaaattgacaaatgggatctaattaaactaaagagcttcttctgcacagcaaaagaaactaccatgagaatgaacaggcaacctttttgcaatctacccatctgacaaagggctaatatccagaatctacaaaaacttaagtttacaagaaaaaatcaaacaccccatgaaaaagtgggcaaaggatatgaacagacacttctcaaaagaagatatttatgcagacaacagacacatgaaaaaatcctcatcatcacctgtcatcagagaaatgcaaatcaaaaccatgatgagatatcatctcacaccagttagaatggcgatcattaaaaagtcaggaaacaacaggtgctggagaggatgtggagaaataggaacgcttttacactgttggtgggagtgtaaactagttcaaccattgtggaagacagtgtggtgattcctgaaggatctagaactagaaataccatttgacccagggatcccattactggttatatacccaaaggattataaatcgtgctactgtaaagacacatgcacacatatgtttattgcagcactcttcacaatagcaaagacttggaactaacccaaatatacatcaatgatagactggattaagaaaatgtggcacatatacaccatggaattctctgcagccataaaaaaggatgtgttcatatcctttgtagggacatggatgaagctggaaaccatcattctgagcaaactatcgcaaggacagaaaaccaaacatcacatgttctcacccataggtgggaattgaacaatgagaacacttggacacaggaagtgcaacatcacacacgggggcctgtcatggggtggggggaggtgggagggatagcattaagagaaatacctaatgtaaatgacgagttaatgggtgcagtgcaccaatatggcacatgtatacatatgtaaaaaacctgcacgttgtgcagatgtactctagaacttaatgtataataacaacaaaaaaaatttccacccgtacttacacgcttgtggaagacattggagatggaattacctgactatgtgaagctgtgttttatctattattggtgaatataagcatatatgagcagccacacatgtatatattttttcagtattgtctagaaggtttcaaactttaagaaatgagctataaaacttgttaacagtgcacattctgattcagcagacttgaggtcatgcaattttaataaattctctgatgatgctgatgctggtggttcttggactgtacactgagtagcgaaggtatagagttttcattgaaataatttggaagaagagcaattggatagaatgtcaagacataacagagtcaagggaaagcattattttgattttatatctgagtatgtttttagccagaagaggagaagaaagaggttaaaaagcaaaaacagaatttatagatgcacgatattacttctgaacaagagaaagaaactggtaggaaaatttattttaaaaagtgttgaagggaaagaatcaagaccacagatccagatccggagattattttgctaaagaatagcaattgtgaggcatgaagtgggaggggggaagaagctatgaacttaattttgaggtttctgagaaggaaacttgagtgaattcacttcagatgcatttggaatgtttgcactccagaagatgagattgtgtgtgctctggagagtattggaagaaggaggtattactagatttggcgactcccacagtgactcattactcttctctgttactttcaggattcatagagatatgttttgttgatattatttatttaagtgagataaatttgaatatgaatccattggcttttttttgtaaaatttctgctttataaaatctgttagaaggctgggcccggtggctcatgcctgtaatcccagcactttgggaggccaaggcgggcagatcacttggggtcagcagttcgagaccagcctggccaacatggtgaaacccagtctctactaaaaatacaaaaattaattagctgggcttggtagcacatgcctgtaaacccagctactcaggaggctgaggcaggagaattgcttgaacccagggggcagagactgcagtgagctgagattgctccactgcactccagcctgggtggcagagtgagactcccatctcaaaaaaaataaaaatgaaaaaataaaaatttcttagagactaacatgataaatcagactgattttagaaacaaacaaaaaatgctaaatttattacttgaatactaaaactgatttttacataaatattatactgatttcaaaataaaaatggttatacttaattaatatttaacaattaagttgttgaatacatatttcaatattgaaagttttttatacattattttctttatgagttttatatgccctcttacatgaggggatcaaaaaacattcagatggataagtgagaggatgcaaaaaaatgtaggcataaaattacaccatgtgtatggaaaacaatgaatattttatttaccattattttctaatatacatccatactcataaattcattatactttcgttgatgagacatcaattttacattcagctaaactctcattgtaactgtgtaccttctcaattataagataaattaaagaatatgatgaatgtttgtagtttactgatataagtgattctgaagtgtatcttgtacttcagaaactctcacaatttataaccagtatatgttagccatgtgtgagattcatagatgccatatgataaatgggctctaaatgattaaatggcttgtaaaattttccttgtgtgttctttgcttttttcttttgtcacttaaaaattttaaactcaatgtttttgtttatgaaggaaaatagttacatacttactttttgtcacctgggactctgcacacttttgatatagtttgaacctagacttttttttttaacttgtgaaaaattaggtcacttatggctattatttttatataaatttctaatatatttatccaaaatttcacaagtacattcttaatatattggtgcattagaaagagactatatcattatcattataatagttttttgaaaatatattcaataaagtgttttaaagtccatgtctgtataattcattgacagaatagtctcatacctctttaaactttaaatgactagacataaatttcattgatagaaaagtatatatatctttgaagaatcttattgatgaataatttatcctggaaaacaaactatgtcataaagtttgctgagtcaattaaagaaagtaatagtaaaatattaattcctgaaagaaaatgagggttgatatttaattaaacatatctgggtaaatggtgactatcagacatagtgtgttttttgtggggaaaggaagacaagagactgctttttagaagaaaaaaaaattcatacgagctctttatgagtcttaggtcagggttttgataaggaagcagagccattcatgaccactcaggacatagaactgatgctgcattttctctttcctctgggagcctctttgcaattcactaagagcttttcctgagacccttgtcttggctggtgtctgtgcccctcattagggtatccaaacatcaagccagttttgtcagtccagtccagcttgtcagtgtagttttgctcagcttcgtccttctttctggagctgagtagagaattcagggcactgggcattacacagacttgccgataacctgaggtaacagagagttcctaccggtaaaacaaagacaaagcatattcttatccgcttctgccacagtacattctaacctgtggtcaccatttgttggctgggaggttgcactgcacaccccattacaaaatttgctgactcaagtgtggatagggaaatgatgtaggcttcttgagacctccactttctcatttctgcagcaaattgagggccttctcacctgcccagtatgctgccatgagaactagcatttgggaaaaccaccatactaagtttacatataaccaaaagaatcatacagaggctgactcccctgacagcactcagaaacaaattgcattcttcagcatatgttaaagccacaccctccaaggtgataacatgtctcaagcaagtgaaagtaaacttaaatagaagaagtgactctcttttcagattggaaagatgagccaaaagtctgaaagctgaaaaaacacaggatatcagcacacgactttattcctcaaccctttggcaaccactgatctttttactctatctatacataattttgttttctggataatgtcatttttagaaatatgcatttaagtcttttcatgtcttttcatagcttgatagttcatctcttttgagtccttagtaatattccattgtatgactatagcacagtttatacactcatctttctaaggttatcattattgcctcacaaattggttgaatttttgcaatcatgttcataaggcagttctcttgtttgtaataatatcatctggttttgatttagagtaatgctagcattatacaatgagttaaaatgtactgtgtattaggctatttgtgcattgctatagagaaatacctgagattgggtaatttatgaggaaatagatttcattggcgcacagttctacaggttgtacaggaagcataacgtggggctctgcttctggggaggcctgtggaagcttacaattatggtggaacgtgaggaagaacttgcacatcacatggccagagcaggagcaagagagagaggtgggaggtgccatgcatgtttaaatgaccaatattcatgaggatcactattgtgagtacagcaccaaaggcacggtgctaaattatttgtgagaaatcttccctcatgatgcattcacctctcaccaagctttactgccaacattggagatgacatttcaatgggagattttggtggggacacacatccaaactatgtcatactttcttttattttaggagtagagtttgtttagaattatacctctttttttctaaaatatttggtagaactcaccagtgtaggattcttttcctggacttttcaatgtaggaagacttttaactatgacttaatcttcttttatatatttagggcaatgcaggttaactattttttcttgagatattatattttttttgacactgactagatcttattttcctattgttgacatcatttatattttggcaaaagagagttggatcttttacataaaaatttcctttgaacctttgccagaatcagtatactgtcattcctagttaaaaaggttttcttatattataatttaagttctaggttacatgtgcagaacatgtgggtttgttacataggtatacacattccatggtggtttgctgtacccatcaacccatcatctacattaggtatttctcctaatgctacccctcccccagcccctcatccccaacagtccctggtgtgtgatgttcccctccctgtgtccatatgttctcattgttcaactcccacttatgagtgagaacatgcagtgtttggttttctgttcttgtgctagtttgctgagaatgatggtttccagcttcatccatgtccctgcaaaggacatgaattcatatccttttttatcactgcatagtattttatggtgtatatgtgccacattttctttatccaatgtctatcattgatggacatttgagttggttccaagtctttgctattgagaatactcccccaataaacctatgtatgcatgtgtctttataatagaatgatttataatcctttgggtatataaccagtaatgggatcgctgggtcaaatggtatttctggttctagatccttgaggaatcgccacactctcttctacaatggttgaactaattttcactcccaccaacagtgtaaaaacgattctatttctccacatcctctccagcatctgttgtttcctgactttttaatgattgccattctaactggcgtgagatgatatcttattgtggttttgatttgcatttctctaatgatcagtgatgatgagctttttttcatatgtttgttggctgcataaatgtgatctttgaagaagtatctgttcatatcctttgctcactttatgatggggttgtttgttttttccttgtaaatttgtttaagttcttgtacattctggatattagccctgtgtcagatggatagattgcaaaaattttctcccattctgtaggttgcctgttcattttgatgttagttgcttttgctgtgccgaagctctttagttgaattaagtcccatttgtcaattttggcttttgttgccattgcttttagtgttttagtcatgaagtctttcccatgcctatgtcctgaatgatattgcctaggttttcttctaggctttttatggttttaggtcttatgtttaagtgtttaatccatctttttttttatctagaattttttttattattatactttaagttttagggtacatgtgcataacatgcaggttagttacatatgtatacatgtgccatattggtgtgctgcacccattggctcatcatttaacattaggtatatctcctaatgctatccctcccccaccccacaacaggccctggtgtgtgatgttccccttcctgtgtccatgtgttctcattgttcaattcccacctatgagtgagaacatgtggtgtttggttttctgttcttgtgctagtttgctgagaatgatggtttccagcttcatccatgtccctacaaaggacatgaactcatcattttttatggctgcatagtattccatggtgtatatgtgccacattttcttaatccagtctatcattgttggacatttgtgttggttccaagtctttgctattgtgaatagtgctgcaataaacatatgtgtgcatgtgtctttatagcagcatgttttataatcctttgggtatataaccagtaatgggatggctgggtcaaatggtatttctagttctagatccctgaggaatcaccacactgacttccacaatggttgaactaatttacagtcccaccaacagtgtaaaagcattcctatttctctacatcctctccagcacctgttgtttcctgactttttaatgatcgccattctaactggtgtgagatggtatctcattgtggttttgatttgcatttctctgatggccagtgatgatgagcattttttcatgtgtcttttggctgcataaatgtcttcttttgagaagtgtctgttcatatcctttgcccaatttttgatggttcaccactcctattcaacatagtgttggaagttctggccagggcaatcatgcaggagaaggaaataaagggtattcaattagggaaagaggaagttgaattgtccctttttacagacgacatgattgtatatctagaaaaccccatcgtctcagcccaaaatcttctcaagctgataggcaacctcagcaaagtctcaggatacaaaatcaatgtgcaaaaatcacaagcattgttatacaccaataacagacaaacagacagccaaatcatgagtgaactcccattcacaattgcttcaaagagagtaaaatacctaggaatccaacttacaagggatgtgaaggacctcttcaaggagaactacaaaccactgcccaatgaaataaaagaggatacaaacaaatggaagaacattccacgcttatgggtaggaagaatcaatgtcgtaaaaatggccatactgcccaaggtaatttatcgattcaatgccatccccatcaagctaccaatgaccttcttcacagaattggaaaaactactttaaagttcatatggaaccaaaaaagagcccgcattgtcaagtcaatcctaagccaaaagaacaaagctgcaggcatcacgctacctgacttcaaactataccacaaggctacagtaaccaaaacagcatggtactggtaccaaaacagagatatagaccaatggaatagaacagagtcctcagaaataacgtctttaatccatgttgagttaatttttgtgtaaggtgtaaggaaggggtcgagtttcagttttctgcatatggccagctagctttcccaacaccatttattaaatagggaattatttccccattgctttttttttcagttttgtcaaagatcagatggtaattttcacatttcaatgaatttgtcaattttgtctaagttgtcatgtttattcacataaattttatattattaccatgtatttttaagtatctgtagaatcttaaagaatgtcacattaactcattttcaaacttggtaatttgtagtttttgttttcaagagctagtttggctagatagacttttgcttttattgatcctctcaaagtgtttggtgttgttcaagttttctatcatttttgcgttttattcgttccatctctgatgttttagttctctttgcctattatttaaaaaatctgtagttgggagcttatcggcaacataaattgaattctcaccattgtggaagctgcacagttcaagatcaaggtatcatcagatttgatgtctgaataggtaccacttcatgattcatcgatgcactgtttttccctgtgtcttcacatggcagaaagggtaaagaggctctctggggttatttctatcagggcattaatccatttatgaagggttggccctcatgacctaattacatcccaaaactcctacctcctaataacatcacctctatgatttgattttagcatacgaaaattgcaaggacaaaaacattcaaaccagtacagatattcatcatttcctttcctctgcttccactgagtttacttttttcttcttcttctttttttttttttttttggtttcttaaggtaaaagtcaaagttatttatttgagagtcttctaatgtagacattcagtgctgaaaattttaatttaagtgctgttgtagatgcattttacaatatctaatgtgttgtgttttcatttgaaattagttcaaaatactttctaattttcctttttattatttttgaaccaacccagggttatttggatgtatgttacttaatttccaatagttgagttgtttcaggtacttttttattattgatttttaatttgattgcttttgggtcaggtaacatgttttgtatgacttaaatccttcttaatccttttattaagatatgatctagaatatagtctttgagtacttctgaagaatggtgttaagtctatcacattcttgccgattttctgcctctcattttaccacttgagtaaggggtttagaaattttagaccacacttgggcatttgtccatttcttttgcagttctatctttgtatcatgtattttgaaggatttatgttattatgcacataaatatttaggactgttatgttttcttgattaagtgaaccctttgtcactataaaatgactttgtttattgctggtaatatttttgctatgaaatgtactttggtattaatacaaccacccttcctcagccttcttttgtcaagtgttagtgtggtatatgttgtttcatctttaatcaatttttgtctttatatttaaagtttatttcttataggcattacacaggtagatcttacttttatatccattctgacaatctgcttttgagcagaggtttttagaccactttaatttataatgtaattattgatatgataaaagtttgctgtcatcatgctgtttgatttctattagttccagatcttctttgctttgcttttgttctttttctgcttccttcagactagtttagtaatttttatgatttagttttataggtatatatatatatatatatatgtataacttttttagttattgatctagttttatatttctttatgatttagtcatatctttttgtggtataagtttatttggttattaggtataactctttgctttgctgtcttagtggtttttttaggatttatagtgtatggatttacctcatcacaacccatcttcaagtaatattatatcatatcatagatggtataagaaattacaattgtgtattttcatttcttctcttccagccagatcccagcctggatctgtgggattgtagctttcattaagtttagaatgtatttagccaatttttcctcaaatgtttttttctgtctctcctcctacctgtttggagacttatatattacctgctgggagtttgctcatagttctctagtgtctcaaatttgtgaatcttttctttcctgatggcaaatcaatctatgctcatatctactcagtgtagctttcatctccggcattgtaacttgtatctctacaagtgcaatttagtttttaaaagtatattctattgctctacttatcttcttgatttttattgtagaatagagttgagttacttataaacagcttgatctttttcatttttgctttttatggtatgagctaactccccacacctgaggggcaaggcctttctgactattcattttcctgtgaagtctgagtcttccaggtaaatctataaaaatagacactcttcttgccactatgtgagaaccaggtgtgattttctctaattttgtaagacccccccgacccagcttggtcttaggtagttttctgactcacatgcaatctttattattttgctaaatagtaggaggggtttccaggggtttcttgctattgcttctgtatctctctcccctcctcagtgttttgttctgtaatgtctgtctgctttggttttaccagactctaagcttcatcactgtaaccaagagagtctgataggttccacctcagttttttcttcctgtgtcacgtcttggaatctctgtcaaagcaggaagctgaaacattcataaggtttgctttccattttttttctgtttttcagggattatcatcttctttgcctaatgtccactgtctaaaaaaattgtttaatgtattttgtgtgttttctttttagttattttagctaagaagaaaaatcaatacccattgttctcttttggctggggtcagactacactagagcttcagcacatgccacacactggctaaaatgcttttcttccccctttgctcaactgcttccttttcaatctttattccacagtgtagccatacattcctcaggggaattttctgtgggcctagtatatatcttattcttagcaatctgttttcttacagtatctatctgaatttataattgtcacttttctggggctttgcttttcagtatattttaagctaaacaagaggagaggttttttttttttctgtttaatctgcagagcttagtataatgccttccacgtggtaggcaatcaatatatatttgttcagtgtataagtgattgttaaaatatgcagccctttatatcccaaaagtactaatatattttatttgtatctcctccttgagacagattcaactagcctatcaaaaatcttggatacagttcattcttgtgaaagagcaagggaacttcaaaaagatcactgtgaacaacgtacaggaaaaatggaacaaatgaaaaagaagttttgtgtactgaaaaagaaactgtcagaagcaaaagaaataaaatcacagttagagaaccaaaaagttaaatgggaacaagagctctgcagtgtgaggtgtgatttcctagttttaaataaatatttcagctatttatactaaaactacgtaggatactttttgtaatagctgacttaccttctgaggttttactggagaaaaaaatgtctgtcttgtagagtgtcaaattctttaaataatacaagttcttaaatgtgaatacttctgctgataattaaatgcatatttatttaaatcacagttttaatggctatatagaaggccattatttggaaatcccattacttacttaacaaattaagttttttgatttttaactttctgtattataaatgctgcaaggcataactgcatgtaaaactttttctacttttctaattattgacttgaaataaattcttcaatataaaaatatttggttaagttataggaagtttttaagaagttatttgttcattacttctaaattgttctcaagaaaatgtatattcattacagttcaacaaagagagcgtgaaatggccattcttctttccccaagactcgatttctttcaattatacacttttaatcttaatgtgcatggaatataaagaaaatgtataataatttattagtttattcaacatctcttgctgtcctacataaaatgaattcagagttctatgttaaaaatgcatactatttttattctttaattaaatattatattctgtcttgttctaaaagagatttaaaatttgttgataaaatatataataatcaacaaggtacgtttaaagcattactcaaaaaagaaacaaaaggcatatgggataacagatattagactctttaacctaatctgagattttaatattaaaattatttttagggatacttgccatattttagaagtatgaatatttatgtctaacagatctgtaaacttgttcataaaaagtaatcagttaactttaatcagtcactttaatcagttaactctaaataatctgtcctcattgaggagtaattttgactgcgtgagatttttaaaaaataattttcaacttataaatttactggatagcttccaatattcttttctataacagtcgttgcagttaatagtagcagaaactttctaactggaagatgttcttttctcgctatttttcaagtatgtatgtcatttggaagagtttggagtaataaatagctgagaactaggaagaaaaaaattcaagaatataggaattttattggactaataacccaatataggaagaaatagatctcaaaatgaattctattttctaacaaaatgaattttaagataagtatgtttaatggcagattgactttaaaccaagaagaagagaagagaagaaatgccgatatattaaatgaaaaaattagggaagaattaggaagaatcgaagagcagcataggaaagagttagaagtgaaacaacaacttgaacaggctctcagaatacaagatatagaattgaagagtgtagaaagtaatttgaatcaggtaaatcaatctctgataaaaattttatatttctaactttatttcatcaatattacttttaatatccctttgatttagtatgtattattcaggtctaaatcaaacaaaaatgttgtcttaaaattaactatcacatttgtagctacagttatttattataagttatgacatccaagtagtatcttatttcagtacaaagagcttttgaaaacaatgataatccctaccatatagttagtgataatttattggtaagtagtttgttcctagcaacatagtttagtgtttttcctagttaacatttaatactgactcaaacattatcaagaggaagcaaaagttacagccatagtaaataagctcatggttttctatgtagggctctctagattttatcttctttcttttgttttgaaatagaagacttcttttatatttacatatttacccagtagaatgaactgagatttggtgaagtcctggatgtagactcagaagactgggagaaaatcctacaacttgtttatatttttaatcttttcctttcagaattgtgataactaaaagtgcttgttacaatgtctcaacttatcaaacattcataaatataattcttaaaattaactatattttttaaaaagatagaatatctagagaatattatcaggaaaaaggaactgaaagagctctgggaaattttatctgtctaaatatatgcagcactaagattcttagtatatgttagacatcagagtgtaaacccaattttcgtatgtagtcaaattgatttatcttttattttatgcttttgagcttgttgtaattcagggaaagttttttttttcaattccgaggttcttaaaaactctctagtcatttcttttgtactttcatgaattcgttgtcttcaaataaatgtttgaactttggggaatttatgctctatagcatttaaagttttgattcagtggttcttcaactgatacctacttataaaaaccctttcattgtataaatgtacaagttattctttagtttcagaggaaccatgatatgccattttattgagtgctagctaaaagtttattttgttttatttaggtttctcacactcatgaaaatgaaaattatctcttacatgaaaattgcatgttgaaaaaggaaattgccatgctaaaactggaaatagccacactgaaacaccaataccaggaaaaggaaaataaatactttgaggacattaagattttaaaagaaaagaatgctgaacttcagatgaccctaaaactgaaagaggaatcattaactaaaagggcatctcaatatagtgggcagcttaaagttctgatagctgagaacacaatgctcacttctaaattgaaggaaaaacaagacaaagaaatactagaggcagaaattgaatcacaccatcctagactggcttctgctgtacaagaccatgatcaaattgtgacatcaagaaaaagtcaagaacctgctttccacattgcaggagatgcttgtttgcaaagaaaaatgaatgttgatgtgagtagtacgatatataacaatgaggtgctccatcaaccactttctgaagctcaaaggaaatccaaaagcctaaaaattaatctcaattatgcaggagatgctctaagagaaaatacattggtttcagaacatgcacaaagagaccaacgtgaaacacagtgtcaaatgaaggaagctgaacacatgtatcaaaacgaacaagataatgtgaacaaacacactgaacagcaggagtctctagatcagaaattatttcaactacaaagcaaaaatatgtggcttcaacagcaattagttcatgcacataagaaagctgacaacaaaagcaagataacaattgatattcattttcttgagaggaaaatgcaacatcatctcctaaaagagaaaaatgaggagatatttaattacaataaccatttaaaaaaccgtatatatcaatatgaaaaagagaaagcagaaacagaagtaagtatcaaaaaatataaatacttgtcaaacttcctgaaagaaagtttaaagtcatatttggccttggctaaatgctgaatctagttgaatatatatatatatatatatatatatatatatatatatataatatatgtatgtataaatagatgataaatgcacttactatatcagcttagaaacatgcctcatttccaccaaatgaaagttaaagctgagagacgttttactttgagtaaagacattgtgtcactgatgaaattttaagagtttaagatttttaatagattaacattaatgacattggcttttactgttgaaataaaggttttaatgtctctttgtggccacattttatgaccacaatgaagcagatgaatgggaatgcccgtatcagcaattagtattttgaaattaagattcaatttagcaatttactttgacagttaattctaaattttccagaggaactgaagtgtatttgaagtatacatttctgcgtcttgtaataatactttttttcagtagctttttatgtattttagttgatagaattttattttcatttatgtcaatttgacttaaatctgaacatatttgaatctcaaattatgtattgttataacctcaattttttaaaggcatctgtgttttattaaataataccttaggacaaatgtagtgaattttagcaatatcaaatttgatttaatcaccccactggtatttataatttattttgaatattgttacaaataatttgctcataatttctatttgaaggctcaaagattatcatgtcccagagaaagatcattgtagctctctgtgatttattagctttgcattgggtccccattttacaattcatgaggggtggcagggttcatgtatagtacaaaagaagtgagtagagaagagaaacacagcagctgaggtcaggagggatgcagagaccaggttacctaaggcctctaaagcctttgaaataaaaatacttttattctgagatagaaatctattggaaaaatttcagcatgtgattgaatatgtgaggaactttgatgttgatttgtgcttctaatacagaagaaggagaaagcattccactgtgtagaatttaccaccattagtccttcccacattttttttttttttttttgagacttcagtaggttgtgaagcattacagattcattagcggacaaatgactagtgggatgaatctggtgtctagtaagagagtaccagtttggcaggaagataacatcttcttgtctccttaagtggattcagtaataagcagcaatgggtacaaatgaagaaaataagctgaatcaatatatttggggatatttttgaaagtaaatattgttaatttgataagatgatttacaaaatcaataacaaacatgtcttgtcaggtcattgtgagacaacttcaaaaaaacttggctgatctcaataaacagtgtgtgtctgaggcttcactagaggttacatcacattatcacattaatctcaaagatgagatacaggatttaatgaagaaatgatttcaaatcaaaagtcaagtatgcattaaatgtaacatgccaacagtgaatctatagctggttaaataatataaattgttttatgatactaacttccatgggaagacttcttttatatgtcattatagttagttttgttacaattttattatctttaaaatgtgcttatttttaaaactgtggctgtcattctgtaatgtttttcttataattacatatttttctcataatatttacccttaagaagattaagaattatacattgtttagcccacaggttgggagactattcttcagataaacagtgtttttcagtgatttatgttaccatggcgaggcaagccatatttaatcagagaagaatgtataatggaatattccagaaaattatcttatttcttagctccacttttgtgagtggatgccaaggacattatactgttctccaaaatggagatgtttaggttaatatacacagtattagaatagctaggcaattcttttattttttgtttttaattatattgtataaacataaacatttagatcatgtatagtatgcattcaaacattcaaaatagaaaatagaggaaattatcttgatactgccattggatgtttaaaaaggaactttattgggataaaattcacatatcatatagttcacacatttaaattgtacaactcagcatctcttaatatattcacaaagttgtataaccatcaccacagtcattttcagaacattttcatcaccctaaagagaaacttcacatctcttagtcatcaccaccgcccacctccatgtttcttcaccttccccagtcctaggcaaccatcgtctagtttttgtctttatagatttgcctgttctgaacatttcatagaaatggagtcatacaatttgtggtgtttaatgagtggcttctcttacttagcatagtgtttttaagtttcatctattttgtagtacatatcagtacttcatttctatttattgtcaaataatattctattgcatggctacagcagctattcattcatcagttgatagatgtttaggttgcttctgcttgtggccattatgaataacgctgctgtaagcattcacttacaagttattgtgtgggcctatatttttatttctctgccactggattttatatttagttaattgggccgatttccatatctctctgccttcctcatgctgttcctccattttcagtttttgttcatctatcctcattcattcagacttggtggacacattttccattttcataaagctttctctgactgttctgactctcattgaccttatgcttcaggatgtgttttctagttggtgcagaacaatttaactttcaattgtacattgctttattttttcatgagacataatcatgtcttattataaatttgcctaagcaggggataatatctgacatacatgctacctgttattgtgtaaattgaaaatattctatcttaccagttgttacaattaaatatattatactgataatttattttttcagacattgacataataaagttttatttgaaatatatcttaatcaataaatataaaacagaaaccactctaatagaggacaattgttctagtcaatactcatatttgttctgactattgagaaaaattatgtctgcattttaaaagtttcaaattttgaagcttcagattttagaatagggattttcaacccacggtactgggtctcctcagtttacagtggcattacgtcttgataaacccattataagttgagaatattgagaatgagaaacatagaaaacacatacactttatctaaagaaaaatggttaatagaaaaagaaaaagaaaaaaaaactataaaagaatgcttacagagaatgagcgtagttaccttatcctgaagttaggtgagaatcagaaatgttatggggaacaaatgagagctttcaaaaaattatcttacttagatctgaatgaacaaacctggaatattgtgaactattgatgacaatgctttgagggcatctttggaaaccaaaatgtaaatataactaattattttttcacttattgttagcatttagtattttatgcataaaaacttttttaccaaataaattttggaagtttaaattccacaaatgatactaatgaaagtataaatcattttgggttgttttttaaaaaattatgtttcaatctgtcattattggaataaagtgtataaactgcatgttataaaacggctttacacatatataactcatgaactcaagagaaataatatttttaggaaagaagagtatctctagatttttaataataattaaatttctttaaaagactgaagatagaaaagagaaattaaacatatgtattgacttaatgcaatctctggaggataatttggatcaagaaataaagaaaaaatgaattaggaaaagaaataactgggtaatatttcaatattttagaactttaaaaatattaactataatttcaatatatttattaaaactgagatacaagtttgacctatatctgcattttgataattaaacaaattattctattttaatgttttttcagagtcacagcacaaactgaaactttttttgaatacctaaatatcacacttattctttaatgattttgaaaacaataatgacaatgcctttggcatataatgtcaactgctcttttcattatctactttgaatttttatttctgaagatatttttgtttgtatttggtaatcttcttcttggtagtatgcatatctgctattctttaatatctaaaaatatgtctttgttatttttaaacatcatcaaaaattatcttgattaacgtttcttttagtctctttgattttttttagttttaaaatatattatggatatttacttattttctactggtatctcccatgcatatgtgagctacatatatatatcactaaacttctgttgtttttgatacacacacacacacgtgtatatatacacatatattatatgtatatacatatatatgttataataaaaaatatgtatgacctaaaaaagagtaaatgagtaattgtgtttttgccactcagattaaaaatagaactttcctcagtgcctttgaagcccccaagacggctgcttttcaatttgctgagaactttaatttgttctctgattccaattaatatttttctctcattatctttctctgcatggttttggatgcctttcactttgttagcactgtgctagcaaagatctttagatctcttcctacaacagtcgtgaagtcttcacatgatctctcttttcatttcttttcttctaaaactgcctgtttccttttccctcctcaactcagaatgttttctttctatttttctactttgaataatctttgtgataatttatgtgtgtgtgttcttttcttctacagactgtggtcaaaaggtataaaaaatgtattgtgtcttttgcaaacattcatatataaatatgcttttcccctttgatgctgatctctgagtaaaaattcgtatttaataatacgctagtgttttatattaacatattaggttgatgcaaaagtaatcatggttcaaaaaccatgattacttctcccccaatgaaatactaaaataaatattaatagtttatatataaaaactatatatatggttataatatcaatcctttatctgtcatatatgctgtacatttttcttcatattacttacataaagttaaattttgttagaatgttttcaaactatgttacgtcgaaaccaatgagagagggtcataatttattgacttgtttctttgtaggttagaacatgtttgtttaagaaattattaaatattagtctgaaacattttgacttagtcattgtgtacattcctgcagatataagaagcttttagaaattacagaaaagaagttaaaggaatgttaaaatggaaagctaaatttccatggagattttaaaaccagtctacttgaaatggatatttagatgaataagctaacacatgaagtactttttaactagtttgaggaccaaaagaactacccacatactttggggaagtaaaaatctgtcagtgctttgagcagtgaaagagatttttaaaaaaatttttttgggcttgattctaatggaaagaatacatttttaatatgttctttttctataaggcgggcatactgctcattccatgtcttgaacactggccaatgatacaaaagcaagcagtacgccatcctatgatgacttcaagtcactagtatcaaattgattttctcggtaacaattttagtgagatataattaacatgccatgcaattcactctttgcagtagcttttagtattttcacagaattatacaatcgtcaccacaatctattctagaatatttttatcagtctaaaaaaaaattcggcattctttgtcacctaccagtttcccattccttgctcagttctagggaaccaccgatctactgtgtttgtatatatttgtctgttctggaagctttatcttgttcaaatcacagtacatggccttttgtgactggattctttcacttagcataacattttctttttatttatatatatatatataattttactttaagttctagggtacatgtgcacaacatgcaggtttgttacatatgtatacatgtgccatgttggtgtgctgcacccattaactcgtcatttacattaggtatatctcctaatgctatccctcccccctccccccaccccacaacaggccccggtgtgtgatgttccccttcctgtgtatccaagtgttctcattgttcagttcccacctatgagtgagaacatgcggcgtttggttttttgtccttgcaatagtttgctgagaatgatggtttccagcttcatccatggcaaattggataaagagtcaagacccatcagtgtggaaacccatctcacatgcagatgctatagcataacattttcaaggtcctctgttgcagcaagtatcagcacttaatttcttcttactgctgagtatatttcattgtctagatacatcaaacattttatttacccactcatcagttgatagatctttaggttgtttccattttgggctaatattaatagtgctgctatgaacttttaggtataagtttttgtgtttgcatatgttttcatgtctcttgggtgtatacttatgagtggaattgctgagtcatatggtagtctatgtttaacttttggaggaaatgccagtacattttccaaagcagctataccatttttcattagcagtatgagggttctaatttctccacatttttaccaggaaagattccatcctagtggtgggaagtggcacccctctgtggttttatttgcattccctaatgactgataattttaaggatgttttaattaaaacatgcatcttagccatgtgtatatcttctttggagaaatgtctctttccatcctttgcccattttctaattgggccatcttgtttctttctgaatggtaagtgttctttatatatcctaaatataaattttctatcagaaatacagttatcaaatattttctcctactcagtgcttgcctttttactttactgttagtatattttcaagcatagcagttttaaattctaatgttaatccatattttgagttgttatatctaagaagccactgccaaatgtagtcacaaagatttattcctgtcttttctttgaagaaacttatagttttagctcttaaatttagctattttattttgagataatttttaaatacagtatttggtgggactccaacttttttcttttgcatatggatatccatttgtcccagaaccattggttgaaaatactattcttttcccatgtagtcattttgttatccttgctgaaaatcaattgaccatacatgtgcaggtctgtttttggattctaaattctaaaacattgatctctctattcttatgccagtaccaaatcaacttatatgagaactctttttcaatcatgttgcatattaccagttatatattatcatacatgataaaagttcagtatagagaaacatctttactttttgtttcttgaaagagcccatggccagcttatgcactgctgactccatgacttgatgggaagtcaagcttacaaagacaagagtccattcctttgtttctctattcaaacctttagtctctcattgactgcctctctcttgagtcccatttctatcaaatcttggtcacatcatctgacagtctactatttcatgcattaggttctattaactcattgtaatttgtacaatcatctgtagatgttatccatcctgggaagagaagagtcagtccagactgtaagcttttcttattggaaatggagctaattcatcatcttgcagttcacaggtagatcctcttttgacctggcacctgattcttgtgtataacacctgggatgatcttttcttggtacagttcctgcattcccagaagtcaccattctctgtaattacttccctctgcttaaataggtcaagatgcacagctatattttatagcttcatacatattttttggaataaatattttatgctattcaaagaaaaagtttcagaagtgcagcactaaaaaatcaggttatgtttaggcaatttataagagacaaataatagtgaaattagttgtttgaatttcaaaatatcaaagctaattttgttgtatgatatgaagaagcattgtggtacaacataaagattaaatggttaacttcttcatatagacaaacttgaagtacagtgaaggagaaattgtatttaatttattaacattcaaacccactacatttattttacttctgagatgattaaaaatgattctacaatgttctctttattttctcattgaagaaaggaaaatgaatagtgaatgccagattgattaataaatactcaatactgcttagctttctgaagattttacttctatgaaatcagataacatctgattttgattgttaaaccaaatatttttaattttccagctgttgcgcttcacaacttgcctctttgcttccctgtcttactgatttcctaacttgaggggaaatcctaaagaagcacacttgcctagtaataagaatttttaattaaaaggaattttaggaaatctttctcctcagtagctcttatgtctgtctgctacttttctactgcttctcattagcattgtttgtcatgaataaattaatatcaacctctattagattgtactttaaaggtgactaatttctactgtgtaagttttctattgtcattttttaaatcaaattttctttttattgtttcctaacaattgcccacaatttagtgggttaaaacaacaacatttgttttactaattaatctgccatttgggaaaagctcggccaggacagcttgtcactgttcctcttaacttgcctggggacagctcaaagactgggaaactacagtaatctgaaggtttgctcagctatatgtcttgttgttaatgctggccattgcctagaatgttggctgtggcaggcagccagatcacctacattggagcttctaggcattcataaatggcacttgctttgaaaaaaatggaatatggtaagaggtataccgtgagatttgcaacattagtttagaaaaggctctctatctcaaactgcttgcccttggtacccccttctcctgttttgagtgaggatggtcaggccacattctattcattagcagtaagtcactaagtttggcccatgttattatttttttaatgagatgaattgttttatatttttagttgacatgtacatacacgtttatgggatgtagagtaacaatgatatctcctctatatatgtatgcaatgtgtaatgctcaaatcaagataactaatatattcaacacctcaaacatttattatttatttctgttgggaacatttccaatcctctcttctaggttttggaagcatatcataaattatagttaactgtattcactctacaatgccacagaacaccagaactcatcctcctatctagttattagctattatcaatttagtaaacattgctgataagtatttcaagcttcagcttctttttcacgtatttaaaattgctttctgaatcactgacttataaggaaacaaatatacaataattatgcagcttataattaccttaaaatgtacccttttgatttgttttctttttaattttaatttttgtgggtacacagtagggtgtgtatatatatatccatatatgtatgtatgggttacatgagatattttaatacaggcatcagatgcataataatcacattagggtaaatggggtattcgtcacctcaagcttttatccaatgtgttacaaacaaattcattttactcttttagttatttttaaatgtacaattaaattgtttgttactgtacttttaatttgtttagacacaagcagaaactcaagaaaacctatagcacttaagagagcatgatattgtttcaataaataagatggaggtgatagttaaagatctgcaatctgaactctccaaaatgaaaactgtagaagactttaataaaacagaatcagaaaaatataaacacctctatttagaggaattaaaatttagggatttgttgtcaaatgaactaaacaagtcagtcaaaatataattatagaaagtaaattaagctcattaatttgcctcaaaagtttaatttttagtgagacaggttcacaacatcagtgggaagtggaagttaactagataatataattatggaaacatgatgttagtaaatgaactgaccttcaaagtgtttgtccaggagagtttatgtctcttccgcatttgttggttttatatggcttttttccccttcagattcacactagtcaacctgatctgttagcctttcagctaagtatttttgaagcatttaatttgacagtagtattgtcattaaatggcttttcagcatgtccccaaatagaaatactaataagtttaactattgtttagaggattaaaattgagaccaaaatggtcatgtacaattactactacatttcactttctgacacttggtaaattaactttctttgatagtggtcttgggtattatcattagacagcaccctgagaaaacaccctgtatagtttttttcattctttataaaagcatccttgtgaaatggggaattaataatacagagattaagggatgtacaattcacaaaatggttaaaaataacaccttggttagcctgaaggtttgtgtggaagacagaaggcacaggccccacctccgatgccttggtcacaatgttagtagctaattgtctttgaagctgctttagttctttttgatctctcactcagctatctttgtctcccctaggagttgtttgtctgaattacttctcagtgtcaaatgcttaatggatcccaaataatgagtgaaaatgtacaagaaatgttaaatgcctgaaaatatctttgagggataatatttaaaaatctttaaactggtttaataaacacatatttatagcttttttaattttagttttttaattgcacatattcaagaaatacaacatgatgttttgatatatttctacatagtgaaatagtcatggcggcaaaaaaaaaactttttgttagaaatcctcctaaaaatatttgtactttttaagaacaatttaaaacctataattgcatacactaggcatgctctcacacatcttcattgttaaagcacggcttaatgggaaatgttatttattcttatagaagggttttctttttaaatacaagtccttttctaattatgtaggaaaaaataaaatactaagcattttccttttgcaatcttcacagaactcatgagagacaagcagtaagaaacttcttttggagaaacaacagaccagatctttactcacaactcatgctaggaggccagtcctagcatcaccttatgttgaaaatcttaccaatagtctgtgtcaacagaatacttattttagaagaaaaattcatgatttcttcctgaagcctacagacataaaataacagtgtgaagaattacttgttcacggttagttatattatctgtcttcctttgtttttcagatttctgatgcaattcttgtttttaagtaggtgaaatactgagttaattgactcacgtgtgttaaataatggtcaacattacctgcgttaacaaagaaagaaaacagaaattttacaattttctaaaagtccctggagctctcattttcatgaaatacccatttgttaacttcattcaataaacttaaaataacacattttgaattgctttaaaaactgcatttaagttacattttagaaagggaatattatttcctagtaactaaatatatactttgagatgttttggcttattttctgattggtttgagtttggctgtgcttcataacacttctaatgttttcctgtaccatctcaagttttgcacccctaatcagaagtgaatgtttgacatccaaacacttaatcacatgtagatgttcattatttaaagtaatctaaaataaatacatttatgaagtaaataaacatggaacacttaaatgattcatttttgttttgttttaaagctaaaagtcttgttttttttttaacacaagactggatctttaattgccactatacctacatcactttttccctcagtttttgtaaagtgtctattattgctgtgcaattttacaatagcttgaaaatagctaaatcaactctttgaatttttaaaatgatgttcacttatgtatgtctatcacttgaattattgatgactaatacggcgatgatattgagtcttttaatagcaactacaaccacacataagccattatcttctttctacccagaattgcataaagctgcacaggattcccatctaccctgatgatgcagcagacatcattcaatccaaccaggtgattttactcatagtaagaatcaatttctggagatcccaaaatgatgccagcaatgacaagatgtataaattgaagcattggttttatatatatatatatatatatatatatatatatatatataaatagagagagagagagagagagattccattttttgtctggggtaaaaattttaaaactatatgcagtcatcctagctacttaggaggctgagtaggcaaaagagtcacttgagcccaagatttcaaggctgtagtgtatcataatcacagctatgaatagccaatgccctccagcctgggcaacatagcccctgttaaaaaaaaaaaaaaaacaaaataaattatttaaaaacccagaattttttggactaaaataaataggtagcaaatagttttcactgtgtatcactgtcactaaaatacccatttcaatcaatgcacattggcttatagttttgatggtgatttcataatctctttaatgcagagaaaaatagtgtatgcttatgttaaatgaaatgttttttctttacctggcttcatattctaaaaaattctagaggagcaaatctaagctttctcagacagcattgctgccaaatgggaacaattaaatgattgttttaatacataaatttgatgatcccagctagctgagtttttaattattttgatagcttagttttatttttctggaaaaagagtgatatggtcagggtctaagtgcttcagggtcataaaactgcacttctgtgtacaaaaagaggaagaatgttaaatactactgtgaagtgttagtcatgatgcacatatgaattttcttatctgtttttttccagaataatcagctcatgtattattttacaagataatgaaaacatgtataaatacaaatgcagtgcaggcaaagatttttgagaaaatattttctcttagtttttagcgggcaaagtgctatttatttttagtatttccggatatgttgaaagacagttcattttaaacttcattagtacttccaaggagtgcagggtttctttgtgcacaattggtttgccaaatcatgttcgacttaataattctatgaagattcagtgacatgttttcataccttctttatgtaattgtttacaaaattcttagagatacagaaagaagatgcctactagagttgctaaaatttaattatttctactagaaaaacatctaatactactttgagaggtggcacagattatctaaaataatacaaaaggtgggtttttggagggagcattacaaacaagaagacatttagacatttttggctataattctagaaagcaaaatgttaaaatatctaatctaacataaaatatgttaaaatagcattgatactgaatttatcttctttatttgcaaggttgtaatatttgggaatattgttaatttgaaggactatcttatacagcttttttaactataaagaaactgattataatacatcatttttgttgcatgtgattgaagttgtgctggatgtcaaagccagtgttctctatgttgatgtcatttgccagttcttgcacctgtcaccaacacatgaagtttagccttaccacttaacactattatagctatcatagataactacgtatactttttccaaacttttactttgtttttttatttgaattctgagatgctttgttctatatatgagaaggaattttataatttgattggttctttaaaaaattatattataaaattcaaaaattaaaattagcttcaaaaatacatcagtcattggatccttttgcatacagaatgtttttgtaataaatgaaatcataaagatttattccacattaatgaaagataagacttagctggtttaaagtttttttttaggtttgaaagttatatagtacctgtgtgtctaagacaattcatggcacccagtagtcacttggtacatgttttttaaatgtttgagatggatgtctaaatgtcttcttgtttgtaatgctccctccaaaaattgtattattttagataatctgtgccacctctcatagtattattagatgtttgagataggaagactcatttctacattgattggttttggacttctggtgcattactgactcaaaaattttctaataatttatttaagtaacttttctatttctcaaatgttcattcagtttagcaacttcttttctaaatgtagttatatagatatgtccaagctaaaaccgtattcctaagactgtaactttttacatggtggaacattgtgtcacatggtggaaagttgtgccacatggtggaactttgtgtcacatggtggaacattgtgtcatatcagaatgttgaactgcgctttttccacagtgttgagttgcagtttttcccaaacaaaatagtcctgtttgcatcaccaaggaagcgcctgtctaccctgaattttaactctaatcaaactataataatagttatggcaatcattcataaggcaaatacagagtttgagaaacttactacaacagttttaggctctatataatttctcctgtctccacttttttatctacttagccaaatgcaaattcctcattttatcctaagaattgtttcagatagtttctcaaattcttctaattcttcttttattcatttttcccccacaaggtctttaaatatatgtgtggatctatgcttaatctatcagctctttggtcaattaagtgttgcccagtttctttctctgtgacacagtgcacgtatttaatactcacaaaccaccaagtataattgccttcagacattaaactattgatatttttatcttgaattgcagtggtttgaatgtgcaaacttatttgattatgctacatgggagtgcatgattactgtcataaaacttgagtactccttaaaatagagaatggtattacattttactttaaaaacatggttacttgaaaatatattaattatggaaaagtatgtgtgtgatgtatatgtatttatcaaattggtctcaaaaagacaaaagacaatacagcaatattttaaacttataatatcaagtataatgtaacagtagcctgtcactaagttattgttgtgttgttgaaatagtgaatattgtatttgttgggctttactattgtgattgatttcactatatttcattctcttttttttttttttttttttttgaggcagaatctcgctctgtcactcaggctggagtgcagtggcg

SEQ ID NO: 23 - DNA, 186588 bp, Homo Sapiens
cgagatcccggggagccagcttgctgggagagcgggacggtccggagcaagcccagaggcagaggaggcgacagagggaaaaagggccgagctagccgctccagtgctgtacaggagccgaagggacgcaccacgccagccccagcccggctccagcgacagccaacgcctcttgcagcgcggcggcttcgaagccgccgcccggagctgccctttcctcttcggtgaagtttttaaaagctgctaaagactcggaggaagcaaggaaagtgcctggtaggactgacggctgcctttgtcctcctcctctccaccccgcctccccccaccctgccttccccccctcccccgtcttctctcccgcagctgcctcagtcggctactctcagccaacccccctcaccacccttctccccacccgcccccccgcccccgtcggcccagcgctgccagcccgagtttgcagagaggtaactccctttggctgcgagcgggcgagctagctgcacattgcaaagaaggctcttaggagccaggcgactggggagcggcttcagcactgcagccacgacccgcctggttaggctgcacgcggagagaaccctctgttttcccccactctctctccacctcctcctgccttccccaccccgagtgcggagccagagatcaaaagatgaaaaggcagtcaggtcttcagtagccaaaaaacaaaacaaacaaaaacaaaaaagccgaaataaaagaaaaagataataactcagttcttatttgcacctacttcagtggacactgaatttggaaggtggaggattttgtttttttcttttaagatctgggcatcttttgaatctacccttcaagtattaagagacagactgtgagcctagcagggcagatcttgtccaccgtgtgtcttcttctgcacgagactttgaggctgtcagagcgctttttgcgtggttgctcccgcaagtttccttctctggagcttcccgcaggtgggcagctagctgcagcgactaccgcatcatcacagcctgttgaactcttctgagcaagagaaggggaggcggggtaagggaagtaggtggaagattcagccaagctcaaggatggaagtgcagttagggctgggaagggtctaccctcggccgccgtccaagacctaccgaggagctttccagaatctgttccagagcgtgcgcgaagtgatccagaacccgggccccaggcacccagaggccgcgagcgcagcacctcccggcgccagtttgctgctgctgcagcagcagcagcagcagcagcagcagcagcagcagcagcagcagcagcagcagcagcagcagcagcaagagactagccccaggcagcagcagcagcagcagggtgaggatggttctccccaagcccatcgtagaggccccacaggctacctggtcctggatgaggaacagcaaccttcacagccgcagtcggccctggagtgccaccccgagagaggttgcgtcccagagcctggagccgccgtggccgccagcaaggggctgccgcagcagctgccagcacctccggacgaggatgactcagctgccccatccacgttgtccctgctgggccccactttccccggcttaagcagctgctccgctgaccttaaagacatcctgagcgaggccagcaccatgcaactccttcagcaacagcagcaggaagcagtatccgaaggcagcagcagcgggagagcgagggaggcctcgggggctcccacttcctccaaggacaattacttagggggcacttcgaccatttctgacaacgccaaggagttgtgtaaggcagtgtcggtgtccatgggcctgggtgtggaggcgttggagcatctgagtccaggggaacagcttcggggggattgcatgtacgccccacttttgggagttccacccgctgtgcgtcccactccttgtgccccattggccgaatgcaaaggttctctgctagacgacagcgcaggcaagagcactgaagatactgctgagtattcccctttcaagggaggttacaccaaagggctagaaggcgagagcctaggctgctctggcagcgctgcagcagggagctccgggacacttgaactgccgtctaccctgtctctctacaagtccggagcactggacgaggcagctgcgtaccagagtcgcgactactacaactttccactggctctggccggaccgccgccccctccgccgcctccccatccccacgctcgcatcaagctggagaacccgctggactacggcagcgcctgggcggctgcggcggcgcagtgccgctatggggacctggcgagcctgcatggcgcgggtgcagcgggacccggttctgggtcaccctcagccgccgcttcctcatcctggcacactctcttcacagccgaagaaggccagttgtatggaccgtgtggtggtggtgggggtggtggcggcggcggcggcggcggcggcggcggcggcggcggcggcggcggcggcgaggcgggagctgtagccccctacggctacactcggccccctcaggggctggcgggccaggaaagcgacttcaccgcacctgatgtgtggtaccctggcggcatggtgagcagagtgccctatcccagtcccacttgtgtcaaaagcgaaatgggcccctggatggatagctactccggaccttacggggacatgcggtaagtttttccttccagaaatgtcgcctttcggcccagggcagagtcactctgtgttctggggtatctagcggctcctacctgcgcgaacactcagattgcccctgggagagctcagcagggtaaacctagagctctcccgtggactcccggcctgccagaggtttaacctgagctctcctaatttctgctgcgtgccctgggtgctgattcctgccctcccagattcttcaactcccccaaccgccccaaattctcactacctcctggtactcgaggtcccaaacagaaatcctattgcacgggccaccttcagagataaagctcccaagccctccactcttcctttcctcctgtcctcaaagtctgagaacctcaacaggaatttgggcaatttctcctcttcaggtctgttaggatttcactttcagcctgcgcagattagagtcaaaaagaccggcccaatagcttctcagcgggtatcctccagagaggtaaagtgaaattctcggttagggaaagaaagtggtctctgggtgctgaggtctgctgtgtgaaagggtgaacttctttctcctgaagcaactggggacttgctccagggctggaggtcagtagagataatccaaaccgtcatgtttagagtaggcagaggggcaactttcttggtaaagacttcacaggatttgcactcacagtttctcaacgttggttgactatgttgaaagtagttgcttgggtcggttttctcttgtaaagtgtttattttctctgtggattataacagatccacagccccctacttcaggtttgcatcagatctataaagaggagaatattcttttaatgtacaatttaattaggcttgactctgacttacaaaactgttggaaaacatttttttgtaaagcatttcctgctatttcagtgtgctccaaaatctccactggggagggtggagtgaggttttttattatattcctttatttttaggacatgtttgcattttagaatatgtgcagttagctctaacaaattgagtaagaactcttaatgacctatgagccgtaatcttaccccaaagttttaattagcatatgagaaaagtggcaggcaattgcatcgtgcttattaaaaattattcctcaccgcagttgttgagcttcttggagaccatgctgaagattttctcccccagcaaattaagatattagtttatctgctgagggaggacagactgaattggggaattaactcctcaggtaggccaggtgctgatgtccctgtggacttttgtcttattctttgtttctatggctgttttcttttacctgtgacttctccgaaatttctttgttagccttaacatctttgtttggggacttaaatccagcaatttgccttctttcactgatgctttccttcttacaaggtagatagcacagtgttagtaaagaaagaaagaggagggtaggatttcatattatttcgtgggctgttgaagaaacagcttcttaccaggctttacattccattaggtttttaatgtttgacttacaagattttcagagggttcatttgatattgtcaaagtcttttccagttaatttagactcttcatttttgtaatgggtttatgctatgggacaaaaaaagtattcttcattttataagaacaaatttacttggtagggttaattttttttctagggctgtcactagacggtggagcccctcttctactgtaaacttttcttgggggaaaatgtctaaggtgcattttgacctgccatgatactaaacccagacactggaaccttccatcttctgcatgcctcccccacaacttacttacttaacagggaaaaaactgatggttccacatatttgctaaaaaatgtgtgccttcaaagacaaaaccaaaatttttagggaataactatagagagcaaaagttactcccatcaagtagacaacgagcttggtgattttatttcaggtcttaatgaaaaaagcttctttatgaggaaggttatcatatcttggtgcctccttgacagtccgcttaaattaatgacataaactaatgagaatttagcagttcctgcagaaagtacaagtttattttttttttctggtttgtgattgctgcactgaatatgaggagtctagttaaagggacaactggtgttcctgtcttgtgagttgacgaagactttccatttctaggatatagaaaatccttaagccggtttattgaaaattaatcaatttaatcagaatgcaatcaattccaatacaaaagttagtattttctttctttttattgaaaattaatttaatcagaatacaatcaattccaatccaaaagttgatattttcttactttctctttttttccctcattttgtagggatacaatttggtgaaaggcaagagatttcttaagccaaagcaagagtgtcttccctctctgtgttgcatgcattatgtgccatgtttgagctaaaaatctcaaaattgggcaggcttccaatgacctgttgggtccctccctttaccattcatgtgtgtgtttatgtacataattttgtggaggggtttttttaaaccttagtaacatctgcactcactctgtgttcttatacatttacagtgtttctgctgagaggagggaagatgcaaaggtggtctcttttacttaatttagcatgtggtttgaacagaaggaaaaataaaaagtgatggggcttgtgtgcaaccctgatgatattttatggagctgtctgtcttctctctgagatcaaacaggactacaactttgttaattgaccactggctcccttggcaaaagtagggcttcttatattccagcaagcagcacaataatatgacaaaaatttattcttgggagttgggttctaagagagtgcatgccagaattagagtttggggtttagagaaattatccagatgccaaaagaacattttaatttttctcttggtaatttgttctggtctccatagtaggtagtattttagtagtgctttgatattgacaagtcttgctccctttctctattagatttttcaaaataaggcattttattaattcctctttccttctcctctctcctctcagttatcaagcatttttatgactatcttacaagcaacagtttgtcttgtaaagcagaattttcctttgaaaccaagacagattatttctgcccataggcttcaggaaccaatattttggcaagaagcatcttttctttgtggtcagcaaataggtggtgagttctgtctggatcccaacaatcaacacctgaggaccaaatagccacactgggtggcaccccattcggaagtatacacaggaagtagccctcttgcttgttcacagctcaagtcagccaaagattaacactggtgagagatattttcaaagaagtttgcaggcttccaattgcagggtcattttggggtgctttcttgcctgtactaattttatctcatcaagcttccattctttgagctgtaaactttgaaataatatactggatttgctggtacgtttaattttctttgttaagtgttttcattcccatagtaatttttcatctagtgtacatatatgcatttaaaacaaaaattctttggtctccttatgcgtatatgcactgcggcttgtacacgtacaagctacttggtgggattatgtgaactggagttagaaatgtggacaattttattatgattatttttaatggtgatatcaagatcaccagtttcattcggaaccttgcataagcagggagcagaatgcggactgggtgtggcaaagcaagggcttattttatagccaaacctgaaatcacaactctgaaaaataaaaaaaaaaaaaaccaaacaaaaaaatcaagttttgtgagcttggtcagagaaggaaaaggaaatctctccctaccccccacctccaccattttctctttgtctgcagcttcctcaagtgctgcctgtccccgattttcttttattccactcctttcatgtttttgacattgaaatacagactcttctttccacttctcagggtatttttcttattacacctgtggcatgctcctaaagaatttcttttttaaaaaaaatctgtagagtagtagattagattaaccccagtatctctcccttaagactagatgacatgaggggattgcaaaatgaatagctgggtttttttttttttttttttttttaccttgaggttaaagcctggttcaacagttgctgagagagttaactagattgcttgaggacttggcaatttcataaagtattttgtcttatgctgtctctgtctctgtcttgatctctgtctctctctgtctactgtaatgttggctactttctctcagagcctgagagacagctctgagacacttcccaggtctgttcggttcagacctcagtagctggatcacaagcagtacccaatatgcatatgagggtgcgtgctgcaagtgtccggctgggctaatctgcttaagcttcataaaaattaatcatttgaaaacaaagaaagatattaaagaaattattctatctccgacttcccctatcagcattccatcaagttctgggatgttaaattcagagaaagttaaccttatcttaaacacaaagttgacttttaaacaaaattgcttataaagttctgtacagttaccagcattggttgccctttgtcgtacggaagagaattatgaaatctcatatttacatagcattcttccaaaaaaagagacggtgttttccagtttattcactgcattcgtgtaagtgtgagtaggccaggaggggtgcttagtgattacccttttgctaggtaacaaagtagaaagttagattttctatgatatttgtttaccacgtaggggaacctctctagagcaatactcccaagctttttcttcttgaaatttcccacctgacagataatactttagattgttgctcttaaggacttctctcagtagctgctacatagagatgattgtccgtgaattattgcttgcacactcatgggtgatgctactccctctctctcatggcaattcttgctgccaacctgcaggccacaccaggattgagggcagctcatctcgataaatttatagcattaaagtgctgggtcatttgagaatgttgtcaatttaggttacttagtacctaagttttattctttaaataacagctttattgagacgtaatttacaatccatacaattcactcatctaaagtgtacagtttcatgctttttagaatattcagagttgtgcaaccattattgcaatcaattttagaacattttaatcacccccaaaggaaaccctatgcacctttgtgttcatccccctatattccctcagtccttagcaaccaataatctacttctatctatggatgtgcttattctaacattttgtatgaatgaaatcatgtaatatgtggtcttttgtgactagcttctttcacataaaatatgttttcaaggtcatccatgttgaagcacatatcagtacttcactattttttatagcctaataatgttccactatatggatataccacattctatctatccatttatcaggtgatgagcattacggttgtttccaccttttggctattatgaataatactgctgtgaacattcacgtgcaagtttattgtggacatattcagtccacatattttggacattttcagttcttttggatacatacataggattgaaatctctgagtcatatgatacctctgtgtttatccttttgaagaactgtcaaactgttttctaaagtgtctgcactgttttacaatcccatcagcaacctatgggggtccatttcttccacatccttgccaacacttgttattctctgtctttttcattatagctatattagtgggtgtgaagtggtacctcattgtggcttttatttccatttccctaataacaaataatgttcagtatccatgttcttattggccatttgtatatcttcttttttgagaaatatctatttggatcctttgctcagtttttagttgggttttttattattgagttttaagatttttaaaaaatatattctggatacatgtcctttaatagattgtgatttgtagatattttttcacattctgtgagttgtcttttttactttccttttttttctttttacgttcttaatggtatctagattgaagcacaaaaatgtttttaagtttgatgaagtccaattcatctatttattttctgttttggcttatgattttggcgtcgtatctaagaagtctttgcctaatccaagatcacaaagatttacatatgtttccttctaagagttttatagttttcgctatttacatttaggtctttcatcagttttgatgtaatgtttatatatgactgaggtaggggtccaacttcattcttttgcatgtagatattcagttctcacaatattgttgttgaatctttcctcacttaactgtcttggcaccctttgtgtaaaatcagttgaccgtaaatgtgagggtttaattgtggactctcaactatattcagttgatctatatgtttattcctatgccggtaccacgttatcttgattattgtaggtttttagtgagttttgaaattaggaattttgaactcttcaactttggtcttctttttcaagattgctttggctcttgtgggtcccttgaattttcaaatgaattgggataagcttgtcaatttctacgaagaagtcagctaggattctcacaggaactatattaaatctgtaaaccaatttggggagcattgtcatctcaacaacgttaagttattttcatccataaatatgcgatgtcttcccatttatttaggtcttccttttgtcaacaatttttattgttttcagattataagttttgcagttctttttaaaatttattcctaagtgatttattttttgatactataaattgaactgtcttattgattttattttcagattattcgctgccaatgtatggaaatataattgttttgtatattgatcttgtatcctgcaaccttgctgaaaatacctgagttttgaatgcttctgggacttatggggaagagggcttctgctgctgcactgaaagttaaagcttacttcatttcatcctgtatgaaggctgcatggggacattcttctcagttttactcagctataaattcgaactggtaatcccatcccctttcgggatgaataggagagtgtttttaaatgttcatctctttagagaacagcaggaaagaagcctagtaaggtttgggtagtttataatcccttttttagaatttggatttgggaactattagcaaggcagtgagtaataataataatttctatatagaaaactaacatgtagaggtgacaaatgaaatcactagctatattaggcttatgtttaggttatcgtaagcagctaaaatcataattttatgtttttatatgttgtcctttggacaaagtaaattccagtactccttctgatgtgcatttctagatggggaaaggattcatttactctcatataatttaagcttctttttagggatgtactccatagccatgaagcaaagataaaattcatctatacacagactgaactttgtcttcattaacactctaggctaagggtcatagctaatcagctacaactgtaatgtcctgataattgtgaattaactgcagggcacccagcaaaaggtttagttataatctaatagctgtctgtagagattagcctaataaagggattttttaaaaaagaatctggccgggcatggtggctcaatcctgtaatcccagcactttgggaggccgaggtgggtggatcacctgagatcgggagtccaagaccagcctggccaacatggtgaaaccccatgtctactaaaaatacaaaaattatccaggcgttttggtgagcacccacaatcccagctacttgtgaggctgaggcaggaggatcacttaagcctaagaggcagaggttgcagtgagccgagatcatgccactgcactccaggctccgtcaaaaaaaaaaaaaaaaaagaatctatcaatcaaccacttttcattaagcacctgctatgtgcccagcatgtgctaggaagagataaggtgaaaggggacacaattcagacagaatcttcttgaggtaactgcttacgaggagcttatagccactaaaaacaaaaacaaacaaaaaccaaacaaccaaaaaccaaacagaaatgcagtatcatcatgccatgatgcctgtatgagatcctggattgtacggtatggatttcttaaaatgtagatattttaaaaaaaaagaggaatgaatcaatagaggctgaagtggtcagcaatgttacctgtggctgcttttaatccttcgtggaagtaagtaggagcatgtctaaactcaagcaatagattaaagatcttgatgtatattttaaataacagaagttagtaccactggaaagaatgaactggaggaatgggttgaaatctatttctgcttattcaatagtgcaccccagtcaagttagttgccaatttcttcttcagtttctttggctatatcattgcacttggtgggtacatgtttatgatgtctttatctgaacaagtcagcaataatatgagtaataaattaaaattgaaggtgattaatggctctgaatttgacataagagttgttttcctgccttctaagtttccattgatcctgatgaattgcacaaaccaaacaattcggggagtaagggggcacatgatgatcttataagagctttgctgtattagacaacgtaacattctgaaatggcctaccacctaacatgggctctgttctctgcaggttgagtaggttccttgcttgtggaactgtagtcccgctatttggccgctagggggactgcaagtgccccgtggcaggatttccctgggaatggtgagcctccattgatggtttcaacacacagccaaggccctatcgcaggataacttgaaccagaactgcctagcaccagacaataaataagctactatggtacttactgtttcatttgggatgttgtttctcgaagtggcaagcattttttagtaatattttgactttttaatacctttctttgcatatggagcagaaaacagtgacactggatatattcaagtagcactgtccagtttatagagaagtttcatattccattattgcatttcattcttgtttctaccttttacaagtaactagagtttggagtattataatagtattcatactattacagtactattattcccattataaaaattgtgcaaagagtggttaagttacatgtttacaatcaaacagcttcaaagtgactgatctggaatttcagtcccattctttcttctccagatcatgtgttccctgcttttatctcacagctctttttaccttatagatgggaaacatgagagtcagagaggcaaaagaaccacaagtggtatcaatactagaaatttatgaatttcttaaggcttctaggtttgttacccatccaccagactgatggatttggttgtgtgagagttctgggtgccaataaccttgccattctactttacagactgcatatattcaataaatgcttattaagcatctactatatgccaaattctgtactaggcaccaatgatgtagtggtgaacagaacagacaaaaatctcttcgtggagcagacagtttaatgagaggagacatgtagtgtacatctgagcatgaaaagtgccatgcagaataacttcacagagtgtagggtatagagattgatggtgagagggaatattttatatttgctggccagggaaaaccttactggaaaagtaaattttgagtagtgacctgaaggaaattaggaaatgagctgctatttggacatctggagttagaatattccaggcccagggaaccacaggcgcaaagggcctgaggcaggagcacacttgctgtgatggaggacaaagaggcccatatggctggtttaaataagtgaaggatggtagacaatgagatcagagttaatgaggttgcatggtaggtcttccttaggactttgaattttactcctaagcaggttgtattggacggttttgagcagggtaacatgacctgacttacattttaacaggctccctcctcttcataacatctgtcactctgatatattatacgtttgtttgtttacttactgtatgtggggggaagagactgtgggagcaaggggggaagcagggaaacaagtacactgcagtgatctgggtgagaggtgaccgtgtctcagactaaggtggtattggtggagaaggtaggaagtggctgaattctggatgagttttgatggtatagccaacagcatttactgacagattggatattcactgtgaaaaaaatagagatgaggatgattgccaagtttttggtctgagtaactggaaaaatgagattgccatttactgaaatggtgaagactgtatgtagagcaggtgcatgggcagggtagaaatcaagagtttgatttttgacttataaagtttgaattatctgatgaacatcctgatggcttcttctcagttagttctcatgcagtgccttcagctttgctgttcttcaagaaaattaaaaaggaacttagagatcgcctaggctgtaggtaccctctcccctctttccttttactttatagaggtctatagaagggtagggacttatccaaggtgaaacagtgagctggcgacagaactagggcacaaacccagttctcttgaattctgaatcagtagattttctttttttagtgtgattctgaggactcatttgggcaagagtgagttttttgttattgttttttgtttgtttctttgcccaaacctaaaaccaggtaattaaactaaatagtgaataaaactgggaaactatacaaattggttgctctccccaatcacactgaaatattattatttttactgaaccacataccaaaatatttttcctgtaaaaacacagtaagtgaacttttaaaggcaattgagcttttaacaaagctagaatctacagaggacctggacagaaatggccttaaatcctaggaaattagagttcatggaacctgggagaccatcttgtccagctagctcattttatgggtgaggtgcctgaggcaccaagatggaaagggacctggctaagctcatacagcaagctagtgcctgagcctagtcagagcctgttttaagggttagtcgtatgttgttttcttgaaaaaagttacattggaaaagtgaaaattctttggtccatactgagaacaaagaattatacataatcatatataataataatgatagcacttcctgaatgtttgctgtgtaaactttggcaccttgcatgaattgattcatttaattctcatgtcaactttaggaagcaggcctagagaggttaaggaacatgtccaagggtcacacagctaggaagtagcagaacttgtgtgcactcccaggaagtctggcttctaaccacaaggttctaactactgtgcaataccaggagcttctcagattacccttcacctttaccaacccaaatgactggtgacgtaggtgacttcattatgctctgcccctattatagtccactgatcctcaccaaataggtgggtggcctagaggttaaagtagaggcagagtgatggaaaggggtggttagaagaagttgatgactcatgatagggattggaaaacaggactacaggaattattgaaaagggcctagagatcccaaggaggttgatctccgactgctacaaacctgggcaattcaatgcctgcttaaataggagagttaagataagaaaaataaaattgccaatttttacagtcagacattgttttatttattttacatgtattaattcatttaatcctcaaaatactccatgaggtagctacaattatcatttctatgttgtagatgaagaaacaggcacagagcaattaaataacatgcacaagattagagaacaagtaagtggaagtgccaatattagaatctaggtagttcagctccacaacttatgttattttccactatatttatggaatgaggtaattttcttataacagaaagtttttaaaatgcaaaaacattgtgcctgaacttcaaacactgaacaactcatatccttaatatgcaccagtttcttttaagcactcttagaaggaaggatacttaacctaatgtcacatggtgagtaagtagcagaaccggaacttgaatttgagactccggactgccagacctctttccactctatcacttgggctcccttctaacattgacttgtctccctccattcctcctccgtattgttctgcccttcaccttttaattacctgtctccatcaacaagattggacagagaattgggagagtgagcagagtccatttccttccagagactggacaaaaggaacaaaatgttaggaaaaaatgtcagcatgtgggatttgtgggatttacactaaataagaagggacacttcccaggactgacaagatgctacctccgtccctctaggccccaatgtgttgtgcaggatcccataggaagtcatgaatgtggttgtcagataacctttttgttactgtggaaatggaagcaggctactgcaaaaatctgtctctccaggttttcttttaaagaaggtagtcttgctaaatgataactatttcagcatttatttgaaaatgggcagtgcaggagagaaagaatttttccaagcttgtcacattgggccacctctctgaagcattgtccaacttctaattagatgaggagactgcataaaccaagagttgagagtaaagatggaaacacttgatgtttggtgtttgggtgcagaaaggattccagaacatgttttgggtctctttactctgtccatccctccttccctttcatctttgtttaaaaaccacagttagcaaatgtgtagtctgtttgcaattgttcatctgaaaaatttgtttgatcagccttttgaataaaaaagaccaaattagactgagatatttcagtcaccaactatctaataatagaccaaaaattttaaccatgctcatactttcatatggtatgtagtttgctttagacattttctgggcttcagtgaggtgctagattgactcaaaatatggcaggtcagatgtgggattgagcagggtggactcttctctacccttcccaattcagagttccccatcaaagatgatctcatagtgtttgaaaaaccaagctgaaggctttgggaattagggtgctgaagggatatgctgtttcccaaagccttctcagtcattccttctccccccagttcagattcttaacacctctttccaggattagtgcagtgatcccacgtcctttctctctagctctctctgctactctctaattcctattgtatttgtgccaccagatctttccaaagtttagctccaatcttgtctgtatactgctttaaatgtctattagtctttaagctccttaagggtgggagtcctgtcttattttttccctattcttcgtgcttaatgcaaaggaagccttgctgtatagttgtgtaatgcatgattacaatttcagcttctccccattggcttatgggttaaagtccaaattatttaaatctggtgttcaagtccttttatgatctgcttatttttccagcctgaattcctggagttcccttacaaaactcttaaaacccagccaaaaggatctagtcactgtcactttaaaccatcctcactctcttgttttttgaacatgttatttttcttataatccctttgaccttgaaggctatcccaatttcaatactatccattcttctatgacagccccctacaaaatgaatattctcaacctcccaacccaaggagaagtgatctatatgacacaatatggttgaaagaatgttggcttcacttctttatctgtaaaccaggggctagaaatctctagtttataagattttgtggagaggggatcatatgtgattatggatgttaggcacaagtcaagagtgcataagaccttttggatttatcccttttttctttctccatcaatatggtacttagtcccttaaatcagaagtacttgtgttaatgtctgataacgtccttctaaatatacctctaaacatctgtctctctttagggcaaaggttggatatatctgcaaagattctctttggatataagatatccacagcacataacttaacagtggtgtacacagtaggtattccataagtatttctttatgaaatgattcagagtcaatagtagtaagtaactgccaaaaacaactgatggattgtaagttccattaacataaatacagtcagccctccatatccatggattccatatccacagatttaagcaactgcagatggaaaatatattttagagacacagtaaaaataacaattcgacagtaaaaaaatacaaataaaattatgtaaaacaactatttacataacattgtattagctattacaagtaatctagatataaatgaaatatatgggggatgtatataggttaaatacaaatatgacaccattttatatgttttagttaaggaacatgaatatttttggattttggtattcatgggagtgggggaatggaaccatgccccttcaaataccaagggactattatatgggacacagaataaaggagttgattgtcttgctctgttaaattctggtcagacacatttgcaatgtattgttcagccccagtattcatggagcatctccttttgtaaagcatggaggagctgtgagagagacatggagcagtgaacataactattgtttcaacgtacctgaaggattatcatggaataaagaagttagatgtttttctgtagtaccccaaagggcaaaagcaatgaggacagattacagttcagtaaacgaaagaggtttttttttttttttttttttttttttgagatgggagtcttcactcttgtcgcccaggctggagtgcaatggcgcaatcttggctcactgcaacctcgcctcccgggttcaagtgattctcctgccttagcctctggagtagctgggattacaggtgtataccaccactcctgggtaattttatttattatttatttatttctttatttattttagtagagacggagatttcatcatgttggccaagctggtctcaaactcctgactgcaggtgatccgcctgcctcggcctcccaaattgttgagattacaggcgtgaatcaatgtgcccagcctgaaagatattttcttagaatagcttctttcacccttcatcagaagttgtcaacatggaccatatgagttttgtttggtctatatggtgtatatgtgtgtgtgtgtgtgtgtgtgtgtgtgtgtgtgtgtgtatgtgtgtgtgtttattgaattacttgctaacattttacttcaaaattcagatttccaccatagggaatgaagatctggcaatacaggactttcattcctacatggtaatgaccagctgtaggtgaaaagcagctgatcctctggatgggccatgcactttgcagtttgcccaggcagcactgatccgctttattcatttaagttacctgcttgactcttctagtcattcgagtatgtcatccccatcagatcagagacctaagcaaatcttgggtcccttgcttactccaagggctttcactcctcgtataggaggagctaaagaaatgtacaagcagcaccacaataggatcagacctggctttcaattctagcacggccacataacatagttggatgacctcaggacagtaacataacccctctgagcctctagatcttcattatctgtagagcactcttcttatagagttattataagaatgaaataaaacaactaggataaagggcatggcacttagtaggtgctgaaatattagttcccttcttctaattcaccacaccatatctgtctatctattggctgaatcacataaatagtaaattcacattcactgaagacattcaagaagagtctggaccctttgggaaccatgtatagggcaaaggtttgaactcatagtagatgatttttacagtcactttttaacaatttaaaagcctatagatgactccaaaatgcccatttggatgatatgaggcatactttgtgtagttaaggattttaaatacataacagagaggctgaagggccttcgggaaagaagctggggtaagagtcaaagtgtagtatgttgaccgatgttcaggaataggctttggcatctgacagattttgttttaaatactggctctgggtcttactagcttccagttctgggctgcttcacctctcttgagtttcagtttcttcatttctaaaatgaagatactaatgcttcctttgttgggtttttgtgaatataagtgagataataaatgtaaatatctagcccagggcctggtgcatagtacaagcttcataaattgtacctattattattagtagtagtagtagtccagacaaacagagcttgggaaaacgctagactctggctgacatacatgggcttttccccaggccactgctgcctggcttccccttccacaaagctttgagtctccaaaatgctttggctggaatgtaagcgtgaggtcattgcagataacaggggagcatgatttgcttcggtaatgcaagttattaagttacttccctcagcccagctgaaatctcttattggttgatgtgtgcttcaaagtgtgagacagagctagtctgaggagagagggagagtgagaagattcctcttcttggccagaggtcatggtcttccacaaggaacagaatgactcaatgcaaattatgggacctctttgagtttggggcccctacatttaaactagtaactccgttgcacatattggcacccttcccccaacaaaattactgggcaggaattttcttgaatccttccgtggcctggaatgatctcccttctcatccttgtgatccacacagctggcaaatggcaggcagcagaacaaaaacaagcctcttagcatatagggagagaaagagtcacagcagtactgaatttgcttgggaacctaatgttaacaaaggaccttcctctcaacaccccaaacagattaaaacatttttttaacagcaagttgtgtctcggagcagctctttgcttgggtatatttaaagatctgctgagtcatttaagagcaggctggcatatcctaagaggcaaggactataccccagtctatgggggagtaagttgagaggtgaaatctgtttggctttctcccatggaaacaaacaaggtgatccacttccatctcccacgactctggagagcatctactaagccttcttattctatcaactttgaactcctcagtgtataatagagtaagggtgagagggaaggagcagtcgtaccagtgtcattattggtatgttcaggagttcaatttcttcctgattcagtcttggcgggatgtatttgtttgggaatttatccattttttctagatttttctagtttgtgtgcatagaggtgttcataataccttctgatagttatttttatttctgtggtgtcagtggtaataacccctgctgtctgaaattgtaatggccctgctattggtagctgagagtagcatggaagtgtcaggttgatgggttcatttaattcttttcttttcagtttcagtcacatgcattgttaccatggcatatgacagttgctagaaagtgaaataattttttttctactttattctccactgcacttctaaatttattagtggagaaattagcagttaccaactgttcattataggtacacattggggtttccttagagccaattttccccctggttttcatcttgtaaatctgtaatcctaaaaattagcaaaacctagagcttctctttggtcctggcctgtttgaaccctgttccacagaccccaatcttctttcttgtttgaggcaactatccttctctttgcccaccgccattttccttcatctacttttcccttctctagcacctcagactgtcttcccacagtggcacagcctcccactccactttcactgtgccatctccttgccatcaaaaccatcctcacagacccttctgaaaccacttctaggaagggaaatcacaatggatccatgaaggatgctttctggatgactttaaaagattggtattaagatattttatcagtggtagcaacactgacttattcaggcagccatgccccggatctataagaaatcaggtaagctaaaagttgcttgagctggcaggagacctagttctcttttttcctttccctcttgcattttgtttatcgatggttttcaaaggacttagaggctggctttgttatagttagttggtaagagaaatggtggaggaccggaaaatgggagtggaacgaatgagcatgtttgagactaagttattacaattcctaggatgtataaattgcttgaaatctaccaagtactttcagacacattatcttttttactcttcaaaatcaacttggaggtaggcacaacagggatcaaatccttagttcacagatgagtaaactgagactggaggaaattaaaggagattccaaggtaactcagacaataagcaacagaaccaggatttggtgaattttttggggggtgggaggtacagagtctcactcaggctggagtgcagtggcaaggtctcgtctcactgcaacctctgcctcctgagttcaagtgattctcgtgcctcaacctcctgagtagctgggattacagacatgtgctacaatgcctggctaatttttgtatttttagtagagatgaggttttgtcatgttgcccaggccggtcctgaattcttggtctcaagtgatccacctccattggccttccaaagtgcagggattataagcatgagccactgctcccagccccagaccattaatttttgacagtaagtccaacttttttcaagttcacagctcagatttgctattgaatgaatgagtatatatgtcatttgggaacattctttccaacttttggttgaagatttgttttatcacttgtgaaaattttttttcattcttagcaatgtcagtttagttaaatgagcatttcatttgcgaattcactaattaattattttattcatcaatacatttcctgagtaccaactttctatcaaaccctgtgctggattctgaggctacaaagagaaataagataccatctcaggcctctaaaatctcacagactggggactgacatctcagtagtaaacatatgaacagcaacttgtgaaacgccattagcaaaatctcaagttatattcttcagtgactatggccatcctaaaaatggggtgtcttttatttggggtaaatgaagatgaagccttatgagaaattgcattttaatctaatcttgtcttgctaagaacagaagtggaatgtttcagcctctgtgtgtgtatttgtgtgtgtgaaggttgagtgtgtgatgatggatggggctgcgagattgttaagtaggatctatggggggccttaaatggtcctggtgagtcccaactttctggttatgtatttgagtagagtatgggggtgacaaagattgttgtttaagagttgattttagattttttccaagtaaatggtcagctgacttggagcatcatcattccacttgctttgaaaacctgccacttaaggctccttccagtcataggttaactctttctggtcaagtattactctttttgagcatttacctgtcagtgacaggtacaatgttagatgttgtctctctgttttcttgtttaatctttactttgatcctaggtagctcttattagttccactttataggtaagaaactgaatttcagagacttgaatgacttgttcaagatcacatagtatagtaacttggtagtttgggacttgaattttgattgttcagttttttgtttgtttgtttcctggcctccctgctgttttcactattccacaccacttcagctttatttttcatagaggccattaaatgtaccctccatcagccaaagcctcttgcctcccttcaacgtaactcttctctagcgtcctcttaataatcttctgaaaaggttttacagcctttctgggtactgggacccagagtcttaatccaggctcttaagtgccttatttaactgtaatatggaaaatcaaagtcacagctaattcaggaaaaatgagtttgggatgtgaatttcctaggcaacttgtcatctcttttttacttccttagcttcataaacttacccacaatgttccctgaggactaagagtaatggagggtgatgaggaaaggctttcctcccttcctttccgagagtcctttagccaaatgccacacctcctcctgtttccctagtctccgtgcagagatggaagtgggagatagacatgggttcctttcagccctgagttcatgccagggttttctttccctctagctggactgaggtaggaggagaggttgaagtccaccaataagaccatgagtgaagaagactaaagtacttgaaagagcagcagacctacgcttaaaatactagggtttgtgtccagactttgtgggttactatctgtataattttgggcaagtcaacagttctgagtcagagttcccttatcagcagattggaagataaattctaattatatagatgaaacattaagtctagaagtaatttgtaaattcagaaagggcttatagatttaaagtgtagccgttttgattaccacaaactaaatcctatacttcagggataaaatcttctcctgttttttctaaaagcctgtgcatgtgtggtgtaaggggtgggttttcccttgtaccagcaacttagcaattgtagtaacggggctgagggcagtggcatgcttcttcattgagcaagtgtgaaaagagggttatgcattcaggggtcagcagatggcaggcagagtagcccctccaaatctccctcccataccacaaagccctcttatttattcaaacttaacattagaagctcatttcaagtaggcacgtctgtgtctgggcgtctattttccttctttgtatatagcaggcatttgtcaacttggtgaaaagcattactcttctttccatttctgaggactaattgtgcttcttcgctagacacgagttcaaaacagtgggttgaaagagggcaagtttatgccaaagaatcagaaatagtcataatttagagagaattctagaggtcagttccctttcgtatggactgggcaactgaaacccagacagggaagggaattagaccaagttcacaagcacaaacactttactggcacattcagattggaaatcgagggcttctgctcccaggtcagaactaaatgccctttctagctagggtgttctttgatctcagtgattttgactctttctactgcactctggggacagtgggttctgcggtaccaactccaattaaagtgggaatatgtaccagcccctccccttggtttttatttttcagaggcctggcagtcagagggattctgatctctatatgcaatattttcacactactgtacttattgaaatcacatttgaatcttggcaattaacaaggcagtaattggcatcaggagggtatgttagtttgcttatctgcgccgtccctcctcttcccaacccactgtgtattgcagaatgttttatcagctctgatttgccaagttgctctcttctccagtaggtgctgcgagcagagagggattcctcggaggtcatctgttccatcttcttgcctatgcaaatgcctgcctgaagctgctggaggctggctttgtaccggactttgtacagggaaccagggaaacgaatgcagagtgctcctgacattgcctgtcactttttcccatgatactctggcttcacaggtgggaggttcttcaattgaaaacttagaactcagtttctagggtagtgagtgttgtaaggtttggactgtgacctaatattacgcagccatgacattatctattaggcatctagactagcttgcttgaatatcttagcatgttgactaatttggggcagaatatagtgtgggtgggggattttgtgtgtgggggggggttgggggttgagcaattcattattattaaaatgcaaaaagcacttaattcgctatgataagattgcctttttcatgcatactggcctacctgcaagacccctagagacagtaagcagcatacatggtgtcttccagttttcagcctttgtgcaaggaacaactgtgggtttctgcacatgtgttgtggtttgatgtttgtatgtgattgtgtaccagggtatgtgtgtctgttattgtgagttcatttctgagcagttgtgacacacagagatccagaaacagtgtcttaccctgtgtgctttgctagtgggaacgtgtcttttcttttgtgctcgtatctctgtgtaatcgagtgtcttgctaagtcaatgtgcctctgtctctttttaccagttctgtctttgtgtctctgtgccttcatgtattttttcccctgagtttgcacgtctctgtctatgtggatatctctcactccaggccactgtatcactgtgtctgtattacagctgtttatttctgtcggtgtgtggatttctatgtctgttttcatcttaatttgtgtgtctaagcaagactgttttggggtgactatttcagtttatgtcatagccattctttgtgtgactgcttctaggtatgtctttttctatgcccctattgtccccatctccatgtgtctctgtgtgtatatgttctaatgtatctgcctacttatcttagtttgtatttctctgggtgtatatccctctcttgcagttctgggcctttgcagtttttggcttatgtttttgtatatatccactagaattggcttcttatcttttttgtgcatgttttagtttgtatgagtgagcatatccaactctgtctttgagaagcagaactgtctgtgtttgcagtcagttgtgttggctgtccctgtgtttgtccctgtgtgtgcatttcattgtatgtgtacgcatccatgtatctttctgcttctctgtgaccagatatttctgtgtagctgtctatgtatattggcttctgtctgtgtctgtgttgttggctctacgtctgtgcatatgcacccaccgggttcataaaaagctcacctgctctccaaggaatctaccagattattttgtgaaataactcacgtttcgtttttttacttgccagctgctatggtacttaaaagtgtgttggtacgtaggtgtgcataatttattcatgtaggatgtcaaaagagtcagttaaaaattatgcacagtgtgtctttattaacaggacacttgtgtgtagagaatccttgagaaatgagtggttagatgataaatcttttcatattaatttcatgatgtcagtgaagtaaatttgcaagatatgggctgcataagaactatgttctttttaaaactcagcatattgatggtggagaaagcatttatttgtactgcaaagtcttatttctgataagacatcacaaataagaattattgtgatgagacttatcacaaataagaattattgtgataattcttatttgtgataagaattactgggttagaaggtgttacttttctggttttgtttgggtttttgttttgaagtgttactacagatggtgtcttagggacaaagagctctgaggttgacttagaacacatggagtacagataaaaaggagaatgaaaagtaacagagagatgggcatattccttgtttgaatggagtcatccaggggctcaggatggagtgcacaggaaatggagaggtgaaggtcatagagagaagtttagcaggaccagatctttccttgtcctgggctgctgtgaccatataaggaaggcagtaaggggaggggtagggatgaggaagagaccagctctcctctttctttctgatggaaggttaccacctctatttaaaacttctgttcttttggtttctctttctttctttgattatattattttctggacttgttctgccaaagcaagaaggaaattccacatgtggctcactcatttattatacttgtttctttgcacgatattaaagacagcttgttaagtgtcactgcaaacatcatacacactgatccactgatatgggcagggggttctttatgccagttctgctctcttcccagtgtatctgtggtgcttaatgggcgcaaccatgatttttctgatgtcagtctgtgatgtcagttgtccagtgtgtatgcaggctgcttaagagtacatacagttccttcacaattatggtagtccctgagaaggaagtggtcattaataaaagactaggttcagtagaaacatgtaagttgtctaggtgttggaaattaatacagtactgtgctaagggaacatatatctagaagttaactgaattatgctcaataaaaagagtacaaatgtttcataaatattttgacctaatcctcctgtaagattaggagagggatatttccgatattcaaataatttttttaattggcaaacaccttagacatactatttacataaaattgacatgacaaaattaagtcattgtgtctgttttatgataaaacaggctcttttgatttagttagaattattgaatgtaaaataatgaaaattaaaaaaaaaacaaggaggaggaatctatcctattttataattcagaccgttgaattgagtttttcttttgttgtattgatttaaatgcagagaagtctatgatgctggattccagtcagaagataaacatttgtatgtgggctctacattgcagccaaccttgataatttcaaacctcgattttctcatctgtataatggtaataataaagcctgtctcagtagctaccaaatgattgcatatgacaaacttctcacttatttaagggaaaaaataagaaaaagaaggacaatagggtggatttttcatatagtaaaatttattcagttagggtaatattctgagattgtcttctgaagcaaaccctgcaaaccctggccattctgttttgtttaggaaagaattcatcagttctgattctgccttttctggggagggaggctgagtattggattgaagaggagtcactacttttctgagatgatatatccgtggtaaaaattattaatgctttgcacatgcaacatagagtgttcaattttgttagtcaacaaatatttaagtggcagctgttatgacctcaggggtgtagtgacttccttattgtcctttaattattaaaaaagaaatctatatcagaatatcaggtaaactcttattacatcaaatattataataaagatactttttatattctctaaacaaagtagagatctcagatgttggttcatttatcaatataatattagatttgaaaattccagtatacaaaaggaaaaggacagcttcttaaagtttatagtgattttctatgaactatcaattccgtttttttctgttttactggtatgatggaaactaaatttcgagttgtaagtagtagataattagactgcagggtaagccttgagattacttcttttcaggtaggaaactctactgtgtatttggctagttcaacctatcatgggtagtcaaaaatagttacatatacaagtcagcattttttaaattgttcagttgtgcttaagattggtcctttccaggaacaatccagctttatcaaaaaattattgcgtacatgtaaagtgttctgacattttaatgctcacaatagccgaatgacgtgggtaagaatcttcgtcttcattttatagatgaagaaatgaagacacagagacataaattaactgggccagggtcctaccactagaatgtgatagatgataatttgagctcagcacatagttatttccctataatatttgttttatgattgtatagatgtctgctgaccaaccttaatctctgctccctaagattaaccattctacaaagcagaaactggaggtcattcaaatgaaagctctacacttttagagggccattaacaatgctcaagttaaagaaaagcaatcaaagacaactaaaatactggtaccttcaaacagtacttatgaattatttaaccttagataatttggctttgagttagaaagatagagtaagatggaggaaccaattcttccctgggttgatatttatttatcttgctcttttgaagtctaggccaatcatcctatttattctgaatggcccgttaacgtttatccatttagggacagcaggtttggcacaaatggattggttttctgaggtcttatgtagagggctgcactgactgacttctgaaagtcccccctaacccttcaaatctcagggtcatctggtctcaagccttcaattatgaatacatttctattgcctttttgagtaacagcacaacactgcaagctgacccactgggtggatggaatggggctcttgccctaccaccctttggcaaacaatttgagggtggcattgtcactacctcattgtatatagggtctcttgaggcccagaatggcaaaataattttcccagtgtcacacagcgagttattgtcagagtaaatatcaattttgaatttgtagaccacgtggttttacctcatcatttctgtttgttatgaaagttttacaaataattagaagtagaaataatgattaaaataaagcataactactaaaaaatagtttattgcagcaccacctaaattcatctcaccactctaccagtagcatacatttcacaattgggttaacattgctctggatcttatagctgttgaagaagacaaaattctttccattctccagcttatattttccccatttgtaaaacataatggaagtgtacggaaaataggagttgataatttttaaggcccttgccagcacattagtacataggattcttgcaagtggtggtttacttcacttcaactatagaaggcctatgcgacaccacccatagagggtagtttgaaagaaaatgctagtgactacgtgtgtttccttcctgacatattttatagaaggtgatgagttccagcattttttcagacttggatctggctttcattccccttctcctcccaccctctaaaacaacagaggcagcaaccatttacacactttccagaagtaagtaagtaagactgtattccagaaacaccctatatcaaaatggaaatatactcaagtgccccaatgacccattgggctagtttgaacgtgtgcagtctctgtgctccccgttttagcttaagcctactccctaacctgtcatatgtcacccagccatggagcctagggcaatgactgccatcatatctgactttatggcctctcagctttcaatgactagctttgtagcagaagtttagcctctcatccccataactttggaagtagtgttgagataaagaaacgttgaattgaaggttgtgttttctagatttctttcaattgctccttaggctttagaagataaattctcctaaaagagaggtgctacaattaatccaagcaaagggaaagatgtcagtaaaactgccccttttcatagaggtgtggcaactgctgggaaggaagaaattagcctgaggccatgtgattactaataaactcaaagcggcatttttttacttctcaatatgaggttgaaactataagcttaaattgctgactttctggcagcaccaaacagtaaggaaaccacaaagataaacccaaataatagagccaattttctttttttccgggggggatgacttctaactagtgatatgaggaaggataagaaaatgtttctttgtaggacatatgatctttgctaagtgcactgaatgtatgtagaggagacaagtctgctgagggtatgagaattgggccaagatttaacacattttcaaagctccatgaagaagcctactgagcagtgggagtggagcaggttggggatagtgaagtatttgtaattcatttttaaaaaggagagggagagagaaaaggaaaaactgggccacccatcctttgaaaagaaaccttgaaagaggtccaaatatccttagaaatccttgacttcttaaaagtgatgtttgttttttccccctgacaattatagaggtcagagagtttttcttttctattacaaaacattgagagtgtgtagaaataattgtaggtagcttagccttggctgtagtcagaacttttgtactgtgactttaggatctgtatggaatcgtatgatatgcggatacaccaaaaactctatgggttatcaaaatgggatagcattaaaagaaatagtgcttttgtttagaagaagaaatgaaatgcttgtgtccagatgcttaaaggaaggcagtgcagactttcagaaactagactttaagagctgtactcagatactgagaagggctgatggctgaaggaggaacaatttaaaagaataaccgtctctcctctccctgtatattggacataaaagaatatcccattcttttcagaaatgtaatacaacagtttagcttgctagtaacttcacatgctatttcctttacctcttatatttgaggtgtctatttggagtgggctgtgtttctagctattctgtttatctggtttgtttttgttggtgtaggaaactggtataaattttatttgggtaaatatcacctcaattttcaactaaagctttatttaagtttcacatgaaaaagacaaatgaggcaaaggaagagaaaaatgcattgtcagaatcagaattatgagaaaaaaagtcaaacaaacatatttgaaatgtccagaaaacctgtgagtttttatgtatactatacaggaaagatattctgtcatctggttgccaaactatggagggtgggagacttcgaatttttgtcaaaaagtattctttcattagaaagatacatgggtgtgcttccatgtcagcaacatgactgcagaccaggaagtcctcacggagagctggaatatgggtattttggactctctggttagatgcagcttttacttcacatcctcagtggtactactgtaaattttcattttcctgtggaataccctatttggttccattgtatatagttgacaactagaattcgttcgctgttgcttgagcccaactataacttcttggcactatacctatcttctgatgtgcctgtggaagagctaccataatgaatgtgtacatggacaaaaaaaaagagagagagagagagaattaaatcatgagtttgtgccttgggagctacagtttaaacatttgctgtttttctcacttaatgaaaaatttatttgaaaataacagcacagaaaggaagaaagacaggctggcaagcatcctcctcctaatacacttatccacgtttggataccttggtctcagcctcagaggtcatatttttagtaaaatggccaccagaaataaaggattttattttccagactttggtgtttggagctggtgtgctgagagctagcagagaaagccctactcaggtagatgtaccagagcaggatggttgctggtggatatggtggaataccttttatgtggttatctcctccttgtaactcttggctgcataacccttattttcttttctatttttattctctctcttggaaaaaaaattggtggtaaattttcatgtgagccatattgtctttttaaatagttttattaatataaaatgtacgtaccataaagcatacccatttaaactgtaaatgtcaatgggtttctctctctctctctctttttttttttttttttggatgctcagagttgtgcaacaattatcaaaatcaattttggaacaatttcattgccccaaaaggaaaccctctgcccattagcagttactccccatttcccccaccccctgacccttcaaccctaggcaagcacaaatgtactttctgtctctatagatttagccattctggacatttcatgtaaacagaatcatgcaatatgtcaccctttgtatctggcttctttcacttagcatgatgtttccaaggttcatctgcattgtagcatctgccaatacttcattccttatttatggctgaataatattccattgtattaatgtatcatatttgttttttccaatcatcagttgatggacatttgggttgttttcatcctttttttagctattttaaataatgctgctatgaacgttcgtgtacaagtttttgtatgaacatctgtttttatttctccttggtatacacctaggagtggaattgctgggtaatatggtagcttaacatttaatcttttgaggaactgccagatttttccaaagcagcagaatcattttacattttgaccagaagtatatgagagttttagtttctccacatcctcaacaacactcattattgtcattgtccttttcagcttttttgataatagtaatctcaatgggtgtgaattgggaccccatcatgcttttgatttgcatttccttgaagagtaaggatattgatcatcttttcatgtgcttattggccgtttgtatattttttgatcctttgctcatttccaaattgggttatttgtctttgcattattgagttgtaagatcttacaatatattttggatgtttgtcattttagggatgatacttcacagttatatgatgttttctagcaagcatttgcgttgttctactggtgttacatatcttagctgcattagccactttgctgggtatgaatgccagcagaatctaagtgaccttggcttcactactgagaatgcaacccaagaacagaaatttgtcagaaatttagcactgaagccccccacttcccaaacttatctgggacaaggagaatctacatttaaagctctatactttgtgttgtgttttttttactttagcttggttggatttaggatcttttctttttgttttgccttatgcatacctaagcagaggcaagggaggaaagggatatgaacctggtagaaaagtaagtaagctttattcagattggcatatccatcttaatatggttcaattggctgaagaagtatctcaactaaaactctggaatactttgaagtaccagcaatatgtaccaaatgtactttttatttatgtttggtctctatgtacttgtgtgtgaaacaatgagcacaaataataccctccttgtttttaagcaatttatattggtgatttaaaaataaaataaactcaagtgggaaatcatgaaaccccatgtaaaaacaataagagcatgttttaaaatcccacagactttagtttcaaatagtggttttgctatttcttagctgtgtgtcactgtgcaagttactttgtttctctgagtctttattggtgatatatgtaaaaacccaccttctcaaattattgtgaggacaaaatgaagtaattaacataaagttcctggtgtataataagtgttcatattttgtatttgagcacagggcaactgggtttttgaaactgcacattactgttgcagtcaaatctggcatgaaattagtgcatagacagaatgggctgggaaaatgaaaggactttgaacatttatattctgctttatttaggcataagtgcttaataattattgatagtttcttctggttatctgacattttgaagatactattacctagcagaaatttcttgtaataataatctcttacacttatatactgttttgtgcctttagaagtacttaatgctctttatttcactatctgttcataaacattctctgaagcaagcatacagtcagtatgaattccatttttcagatgagacagctgaggctgaaagacatagagttacttgtctcaattcacaaagtaaagtgccagagtttgaaccagagcccaggtcttctctctcaacgtagctctttttctccttcattatatcaggcatagtagcaacgtattcttttactagctttttatcttgaatatccttttagcgacttgcctttggtgttagtgtgcctataacattgtcgttgaatatcttaatacatttagtggtcttggcaagcagttttgtcttcagaaggacactgaaatctgtggaaaggactgcagaagattgggtgggcagacacctatcactttcggggctggtagactttctattgaagcaatttgcaaggctactttgtattgtctaaaagcactacttcagaaaagggttgtgatgtcaaaataggcactttgagtgaagaaagggctgtaagcatgggtggaaaatgtggtagatgattgtcttgagttattttctttaatgtcaaacaggcagtccttggaatgctacttcaaaaagtgttgtataatgttgaagatacagttacagatttccaacacgaaactcataaatatgcaattccctgtcctcctaggcacatgaaggaaaatttatgagcttcaggtttctatgcagctattaaagcatatttaatctgctttgagctcaagctcactctcgttggctctcttcgtttcttcctcttacatgagcaaactgcctttctttttgtttaaaaatagtaagtaggtttgttttcctccaggtgtcatgaatgcaaacattgtaatttctcatctgttcagcctttttgcacaacaaaatggcagcacccaggaggttgaaagggttaaattgttccttctctgagtagtaccataagttgttagtctgctactctttctcccagttggcacatgaccctaacatccaatcgctagtggtgtggccattttttggtcttattttggcctttcctcagccaccactcatcagttctcatgcgtatttgtcagatcctgctccccaactccacagttcttagttcatcttaagcatatggctgtctgtcttttctctaaagatcctcaagggaaaaaaaaaaaagcatctccagggggaatttactgcctcatagccctgacagagatttctgaccaaaccctaacgaaaaaatttcttccctccatttgtcttttattgtttttacaggggagatatgtaacataataacaattatattgcacataataattacttctacaaataataatctgttgtcaaaaatatacacagctttggatttccttattatggcccttcattaagttgtggtttaagaatagctatgattattacttttgtgataattataatccataatatggaaacttataaaattacctttaaagtgttactattattctggccacaggatggaaagttgttcgctagttactcatttataacctgaatgtactttttactgaatctaaaggtatcatctttgcttggcaattcccatgacttgtctttctgactcttcagatctcagcttaaaagctctcccttcaaagaagccttccctgaccactctggttttttcttctttttttacctctactccttttcccattacttgctgtcatagcattctgtttgtttcctttgaagtgcctattccaatttgtcattatgaatgagtttttttgttctgttgcttattatccattttccccactagattgtcaactctgtgagggcagagaccatgatactctgttcactcctatatacattcccagcactatcagactttttggcacatagaagatactcagtaaatatttgttgaatgaataagtcataaagaagagtttatattttaactcttagttgaataatctaagccaagaattatcaacctgggttggacgtgagaatcattaatgaatctttaaaacaatgacaaggcaatctatttattaattatctccaggtctaaactttagcacgtatatacattttaaaagcccataagtgattcttacgtatagccagtgctatctgtctcttctcctgtcctttcccctcctctccttactcctctctcatagttttaggattagcatggccccacaacaaatctttaattcacatggcaatttctaggatttatcatggaaaatgagccaaattgccttcaagaagtttttacgtacctcttatatagaatgtgatgttttatatgtacctcttatagaatgtgagcttttaagaggcatatcttattgcaagaaatttcaatgttgaaaaaaatattgaatatttataaagtcaaaaatgcaaacttttatatgattttcaaacctatgaagttatatcatgttcaggccttctttccagcatgtggctctcagccctggtactgtccttaaccataaacctcatctttgccctctatagggagaggtttatggttataattactcattttaaatagtgtatattagtaatgtacactatttgtatatttgttgactgcctcctatatgccaaccactatgctagaaattttgtaatattcttcacgatattcaagatattaacatatccgcattttataaatgaggaaactgctctcaaagaggttagtttacacagccagtaagccgctaagcctagattggatggaaggtatgtgagaaaaaagcagcatccataaggttttcattctcctaccctgtacgacagaggtaatagaaattattagttaaagaaataatagaattttacaagactctaggaagggagaatgtgaaggatacagttctcagttactggaatgagtgccagagtaccagtacatggcttgccttggggtttggactacctatcttaactcctttgctcctcccaatcttgatctcatttgtttgaaagatcatctgcccaacataaaaatgcatttctaattctgtaatttaagtcagtggcaagatcagattcagttaaagtttactttcctgacagctttttagtatcatatctattttgcaaaactctagtgataaatgtatgcacatttacacatacagcatctcttctgattctgactaagatattactgggttgtgtagaagtgatgggctctttagaagaaaggtttgatatactactaatctaaggactgaattttctcatctttgtctttgccccttttgactgatgaccagagcaggagcacataacattcttttgtgctaacagtatctctgcatcacattgatcaggagaattggcatctccagagccctgggatggtaacttctctgttgattttcaggaaagattaggtgatattttctccatgggaagaggatgtttgatgtgtgttggctttagcaaaaggaagcttgtggagtcaactgtaagtagacagaattgcctttgacttaatctgtttcagtcgttgttcatactcaggtcctccagaggacctttaagcatttttattgactttgtggtctattacacgaaactaaagatactgattctcagtcatgagtctgctccaaaattgcctagggaatcaaaaataattgtaccagttcctattcctggacattatgattcatttggtctggtatgaaggccaggaatctgtatttttaaaattcactcaagcaattttcatatatagctataattgaaaatctgtggctgaacttctccactcccgtatccatcgcaatacttccccaaggtggcatttaagatgggcctagagggttatataagatttcaatattaaaacatggattaaaagtgaagacttttcacatggagataatttggaagaaaaacttgcaaaaatgtgagagcattgagaacttttctttcccaaggaaagaagtggcagcttcatttttggtcattgcaaacagcagtgccatacatgaaaggaaagtggtggtgctcatcaactttgaataactttgtacagaacccttgagactcctctctgcttataaagaaaaagtgtcaactgtaaagttgatttatttatgaaccataggctactatgaaatctctgttcccagctagaggcctgggagagtaagataactacttgtttattccacggagccacttattagctttttctatagcacatacctcaaatgaagcatttcaataaaagaaccacattctattcacatgcttcattttattctgatttatgtaaaaattcccaaactcctcaagcagtgtttctttgtaaggcaataatcttcagttctgttgcaaaggtcaggagtgatagaatgaaaatggtactagatacaacagctctttggtatttgcatggccattacattgccatggggctgcaagacttgtgagtgcttgatattttgcttgttgatgaatgagtctgtgtttgtgctaatggagtgatttgagaggtagttctccactgtcagtcaagaggttggttttgaaagctgattgccaatggtcattctgctaaccactctggttctcctttagatagagacttattcagattcaagtcttcatgtactttgtggcataaacattgtacacaccagatgtattcaacaaccataaaaaaaaacaattaggactcaagtagtatgtcagagtgtagtcactgatgatatataattctccactaccaagaagatggaagcacactgttgagtagctacatcctacatatgttggccagaatttaggaatacacatgtgatctatacattttgaggtattgtctgacccctagaaaatcctggtgaagtttttctggtgtcagtttggtcttaatgtttaggaaatgcccacagactactcctgctttctgcttattcacatagtaaacgcaaagcacaggactagtttgtcatctggatcaaggagaaatgagttagcagatataaaataaatcagaaaggaggtagttctcaaatatttactccatgaatagttgctggatgttcattaactctatagcatttgttactacttattggggatcctggaaagaaaatatattgtctatatccactgttcactgaggccctctccctacccagaaactccctgtctccatcactcactctccacattcattgacccaggggaacagttcatggatgagtgaacttgagctctatcttaaaggatggagttcgatttcaaggcaagaggtataagagaaagttcagagacaacactggctatggtctttgtgaagaaaagtgaattgaataggctcctgtggagatcttaagtaagtacttctggagataaggttgaggaaaagtaggtttgaatcttcatccagaggtagcccctaaatgtgttgagtttattgaaagagtacttgacttggattcagacagatctgcatttgactcctgttttgccatttataagaatttgagtaattattgtttctaaataagagtttattgagccaagcactcagtaaatgtttgaatgggaaaattaactgccctgtttttctattgtcagatggtcctcttcgttggataacttggtaactgttgataaccttttctcaggaatcagaaggtagaaaggttgggaaaatataagaaacaaaaaggcatattcctatttttattttcatattgtcttccaactctcccaggcttctttgtttgcaaggctgacttttataatactttttgggtagagcaggtccttctttggtttggggttaaaccgtgagtaaccttattttctaggtctcagccaactttgaagggcatgaactcacagtagcctcactaggatcacttcagcagtgagaatttatctttcttgtataaaagtgtaagagttgatggcggccaggcgcagtggctcacgactgtaatcccagcactttaggaggttgagatgggtggatcacctgaggtcaggagttcaagaccagcctgaccaacatggtgaaaccccatgtctactaaaaatacaaaaattagttgggtgtggtggcacatgcctgtaatcccagctactcaggaggctgagacagaagaattgcttgaacctggaaagcagaggttggagattgcagtgagccgagattgcaccactgcactccagcctgggtgacagagtgagactgtcaaaaaaaaaaaaaaaaaagagttgatagcaaaataactatctgtagcataaacctcagtattctttatcattcagtatcaacattattactgaaaacaataagcaatatggactgagtttctgtggggtggaaatgtgaagtggatcatagcatgatataacttgtcatttggcttcctttataaacattatcaactacctcagctctatcaatcacttggcagtccgtagtgaacattataactcaaatgactagtcaggtctgttcattgcccatgtaaaggcatatacctgaagtgagaagtctgaggtaacttagcaataagcttgcagtacagtgtttagtgaagccgaggaattcaaggatttgagtcatgccagattgctccataaccatagcctatctttgtcacaagtaagaaggtttaaaaatcaccataccattattggtcacaacgtttggagatagggaagagtttgtggatggatcatggcagtgcatggacagtgattagcccataacacaaccagtgaacactgttgtacccaaagcacataaatcaccacatatactattaatatatttatggatgacaacagacactataattttatgtcagtgctttctgctgtgaaaaacaaagaaagttaagggtaccttttttatatttgcatcatatctccagaccttttcctttatctccttcttgcaagttcttctttctttcagctgactatctgctgttcctgctatggctcccagtggcttttcaagagggtacttgttttttaagagaagacccttgaaggacagagagagcctgaatcattcaaaataatgaattactcaggatgaaatttcaataatttgcaagtgtgtggagatagatattttgaggaagcataattttctatgtacccctcaaatcgtggctggagatgacagcctcttccacctccatataagaccatttcatttccttctacttttttctccctccttcccccaaacacacaaacatacacatatcctgtgcttcagtcacacagaacttcttactatttcatttcaattctctatggctttgcatgttctgctccttctgcctagaatgctcctttccttttttcacctggaaacatcccaattcaaatgtcacctcccttatttataccaactttgtctgtaactcctttatcacacttcttcctgtgattagtcaattcacttgtctgctgttacacctctatgagagatgaaaattccttctccatctctggaactcatgcccttcgcatatagtaggcaatctgtaaatgtttgaaggttgagtgaattaatgaatgaccttcaacctttcaggcttccaattttctctctgaaaaggacagccaaatgaaaactcataattttagaagatgaggttagacggttggtaggtgcatgcagagaccagttattatttaggtattatggaagtttatagttcttgtatgttgagttcagtgtaagagtggccccaaacatagttaatgaccactccagacccagttgttatagagttggccccagctgtattgcttctatttaagactaggataagaaatgacactttcctactttttaccttattgaaagggtagaggctcactgttatcaatctcagttcacttgttgattgcactggcttgccaagtgagaatattagcacctctgcacatttctatagctctgccacttatgagatctttccttcccattgtcatatttaataatcaggatagccctataaaatatgcattctcatttcccagatgaggatactaaggctcaagtaggagaacttacttgtttagtaagatcatacagctaggaagtgggagaggcaagagttgaacccagatcttcctagctcctagtccattgttctgtctactgggtcacactggaccagccaggaggcaggaaaatcagctggggaatgtggtgccaacgtgtgatgtttgcctaaatgtgtgcatccttgctggaagccagccatgattcatgctgcataagtattcattaatgttcatttcatttatttggctatccatatgctttccagggcgaaggcaagctaggacaagggcagacaagcagccttaaagtttgggtgctttccttcgaagttgagctgcctgtttgaaaatcacactttttggtgatagaagatggttccagtacagattttatttattactgcatctacatggatagacattttccaaagcatagctgaaaatatgtgtaagtcccagaatattttctgatttagacacagactttgagcatgataaccacatttagcatgttaggaaattctgtcagaatgcttctggaaaggctacctttccagaatgaaatgaaaaaagaaaaggatggactttgaaactggctagatttgggttatacttactcatagtgtgaccctggcaaatgatttaacttctccgaatttcacttttcttattctttgaagtgaaattttaaaatgccatcttgcctgatttttgtgagaatgaaaatgagatcccacaccaggaatttagaagctactcagtaaatattgcttctctcctttccccttccccagtcctgtcccccgagacattcagtagttattcacaggcatgcattctgaagtctgcctactgctccatgttgaaatgcactgctcttgcaaggactgattatctatttttctgtcttccaaggccccctgtgttccactccaccctcccaattctgggggcttccaaagtgggcaggtacagaatgttctgtggagcatcggaggctgttactcaatatcttggccagcactctcaactgctctttgcacacactccatatgaaggcaaactccagatcttggagcccatgtgtgtgtcatgcattgtactgcttcttgtacccaaatccatctcaagggtgagtagaccaggctcagacttgtcctgggagcagatttctcaagctgcccatgtccccacactgtttgattaaaaggaggtgcttcaaactctttggctttatatagactagaatcagaatgattggtggtgcctctgttctcaaggtatcccaaagcactttgtaaggaaatatgacaagcgctgaggccatgcaggccagtacaacagccgccacccagcacttcacaattagtcatgcccagcctgggatcatcaagcctgtttttattggaagagcaagagagagagggaatgctagctggcaatttccccaggtaccctttatgaaagtgcccttggctcttccaatttcatctgaataaccagctcaggcaaattttcctctatcaaaaagcagaatgtgatagtgacaagctgatgcccggctgatgccccaggacattgactaaatagacttggcctcacaattggtttttattctctatctcctttcttcccttttgttctttttctgtgtttctttccccattgccatctgcagagtgttctcagtcagaagtcagctgtggggtggacagtttgtcattttaagatcatccctattctgtctacctttcttatccctcatatcattgcttttagagcaaggacaattctggaagtgaaactacaataacactctgggctcctttccctctagtagtactcaacacacttgtaattacatgttcaaatttgtctttcttatttctacttaggttcatgaaggcaagggacatgcctgtgttgcttactttctcttggcaggcacatacagcaagtcttcaaaaaatgcttgttaactacaaattaagtgtttaagaagtccactgttaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaagaagtccactgttagtatcttttcccctgcctagtttgtaagcaactggcctcttctatttgtaagttacctgttttcatttccatatgccccaaagcaaactttagctcacggccttacagagtgtgtatgttagtatgttaaaatgaaatcaactttcctctcccaggccttctaattgacatgaatttgggagtagacttgcattggcctttgtcctgacagccaacagagtcctcttctgttgtattcactgttgccttccatgaggatcccatggagaaagtttgtcattgatatacattttgagggcagactcaacttgagtaaacctgattgagctttccccatctgcctcccagagatcactgcctgtgctttgttaaaaagagaattataggagtcctctcaaggcagagaggcctaaaattagacatggcagccatgcctttggtgtgcatggaggttggatacaggcagccagtttcccctctgttttctcccttgcttacacagccaaggagtggagccaagcctcaaggggaggagctgtatactcgagcatgccctgtggttcctggccctgactgagggactattttatatatcccaatagagaagcgtggaagacatctaggttgccactgtcatttgaaattggaatttttaaaagagaaacctgaagacttgaagaaagctttcttttgcctccccttacagttgatttttgagcttcttaaagctacctagtccaaagtacccacactcttattcttttgtctttcctactggttttatttttttttcatcttcccaggtgtttgatgatcactaagagcttcaacattgctcaccctgaccaggtatgaagccaagagtttggtttagggcataaaagaatgtcggaactcaaggactaggttgaggtggggaagggggatgaaggcttctttttttcttgggttaagcagaaataacttagatctcagagtgaaagccttgaattatcacatatatcactggaaaagactagttctttgctatgataacaattgttcatcatctctcccctgaggatttggggtcaaggcctggctacaccttttaatgatttcagtcatgtgacttaacctctttaaacttggattttcttcatctttacaatggaaatgatgacaataatcactacctcacagatattgataataatgatatctcactaggaagagaattaagtaatatgagggataaaaaggcatttgtaaatggtaaaatgagattatgattttgaaagctattattattttcctttcactgtctattatctcaactcttctattttcttgccttttgtacagcatggataatttagatgtgactctggacagagggatggatcagatgacttcttaagttatcttccagtttaggagttcgtaaactatactttctcctttccagactatcctagtaagaaaattctcttttaagacagagtagaactctggaattcatcagttttgatgtttcttaaagtgtaatctaagatagtgctcctgtattaagttctgatgtctgaccattgttcaaataaagagtaaaatgcaaatgacaggaaattggctgcgttctgaatcctatttttatttgggataacaataagcctgtatggtcactgtgacctttgatttgctgtttctgcaacctcacacttgtctcaggattcttcttccacttctgcactttatattgggtttcttccaggcatcatattaaactttaagccaggtatgtgtatatgcatgggctgtgggcctgaaaaaaattagcccgagagagaaaaaaatttaagtagtgggctagaagtaagcatgctactagaaacagaatttgggaacacagctctgggcctagaaaagcgacctgtcaacttgttacagttaacatcaataactataggatgggtttggtggaaaattatgctgaccaacagggtgggagagaatagggtcagaatatatatcgctgtaaggttgagaaaaaaagaagtgaaaaaaaaagaaatgcatagagagaaaaaggagtttagaggtaacatgttaaagtgtgagaaataaactggagagcttgacttctcttgaatatatttttaaataaagtactcctttcaactccaaatgcagcaggcttggttcccttctcctacctccattgcggatgaaagcttaatctttaagatgggcttgggtgggtagagtacgccccttggtgagcactgtgctctctgcaaccccaataaggcccaacagggctctccaaggaggcaaaattctgatgatacatttctgtttagtggaaaatgggtagggaaaattatgtcttagaatcaattaaccaaacataaaatcctccaaggggcttggtaggatgcctagggaagagccacgagataaaaactccaggctggaagggcattgttgcagcactgtcattctccagtttctcttggagttgtcaccaccctctcctttgttctcactgctgacatcatttgtaaaataatttcttcccttaaataaacaagacatacaatcctctaaatgactaaagaacagttacctagaagaaaccttagtggaaagtattttcttcatctaacggatgattgtctttacagaggtggagtaaaggatgtgcgagggagcataatcaagctaagagatgcatgctgacttaaaaggcatgatatatgtgaaactaagataatgtgttcaagagtgatgctttgttgatgcagaaccactgaattccttactattatgtttgcctgactatcggcctcttaataaagaacttgtggtttgagtgttcattgaaattagccatattaggtttatgtggggatgtgaggatctatgtctaccaattgcagcctctgctgcaaattggaggcagaaatctgggctgaacaataggtaagagtgtcaactctacagatctctcacatgctaagcaagcacaatatagggcaatccaggtttacacaaaggattaatttgggaacaattatcctcattttcacttcctaaaaagattttgaataagatgtcttttaagtaagaagctccctgaatgcatttaaaatatgatttgattatgtacatttcagatttttctacctttctaggagtatctctgttgtataaaaacacaaaattctggaacttttgaaaggaagatgtgcctctcttcatacatttgtcattcttgaacgattgtaaaatgaagtgactgcatatcacgtcatgtgccctattgatttcttttcttgttttaggaatattcccagaaaaaaaaaaaacttttttttttttaaaatctactaagcatgctaggtaagactgaagatgaatctatttaagttatgtcaatatctatttataaagatttttgtgatattcttttcactgtagaacttcaagcatatcctaaaaggaacggttagatacctctacaaactgtggcaatgacttactgagtaattgctggcaactgatttttggtgcttcttgttttgatagtatagcagtgcgagtaggtttcagaagagcaaaactaagacaatccagggaaatgccatttgagaatttctaactttaaaaaaacaagtaaaatagtgccaagaatattatctaactaaccccaaagtctacaatgtaactcttttattttgataatgctgttctaaccctatctacttcagtcctttcccacccagctggtttaggaatcaaattcccaatgtttcatcactgttaacattactgttttactcttcactttagttcttaaatggcatagtgtcttaaattccctcagcctctttcacatttgatttctttggaaactttttaccttttcattgaagcccatatgatcttttccgaaacagacccttatctttacctccttctttggagtctttctcctacttgaatttctgaacttcttaaaatggccgctttgggttggtgtcagtaattcagtaataagttttcttttctttttttttttttctttttttttgagacagagtcttgctctgtcaccaggctgcaggctgtagtgcagtggagtgatcttggctcactgcaacctccacctcccgggttcaagcgattcccttgcctcagactcccaagtagcaagtagcagcaccatgcccagctaatgtttgtatttttagtagagtcggggtttcgccatgttggccaggatggtctcgatctcttgacctcatgatctgcccgccttgccctcccaaagtgctgggattacaggcgtgtgccagtatgcccagccagtaataagttttcttaagtgctttcttaatattctgatatttttaaaaaagatctggactattttgtcatacaggcaacagaatgttaaaccatttcataaaacaatgacaaatatacatgaatttttcatcagttataaatgcatttcctttataacattgaacatgtttttgcaactgaaataagtacggttttcatttttagaaggcacatgataaagttaaggcagtggttaattaattttttcagattaatttttcagaaaagtgactgtttctgtctattgtcttaaccccaggcatcaaaggattttaatcagaaagaaccgaggaataatttggttattttagtgcctttttttgagacaaagtcttattctgtctcccaggctggagtacagtagtgcgctcatggcttactacagcctcgatctcctggttcaagtgatcctccaacttcactttcccagctaactgggaccacaagtgggcaccacactctctgcaatttattttaatttttcatagaaatggggtctcactatgttgccctggctggtctcagaatcctaggttcaagcaatccttccacctcagcctcctaaagtgctgtgatttcaggcataagccactacactcaccctattttagagctttgtcaagctttggaaagaaaaccatttataatataatagataaattatggatatttgaggcagtttttatcatagtatacatggtaaaccacagcccccctttataatatttgtatttaataaaaatgaaaatattacttttatcttaaacatgttttaacaaagcaagcatatgtagattagcactaattaaaacaaaaacctttgtaatgatagctgttttttatatgattacaaaaaatttactatacaaatttttatcctaatcagtgtgaaaaactgcaaatattagcttatagggctagtcttcagagtcctcttcctacctactactgctaataagccaatgaaaaactctctgatgtgtgtggtggctcaggcctgtaatcccagcactttgggaggccaaggtgggtggatcacttgcactcaggagtttaagaccagcctgggcaacatggtgaaaccctgtctctactaaaaatacaaaaaattagctaggcgttgtggtacgcacctgtagtcccagctactcaggaggctgaggtgggaggatcacttgagcccaggaggttgaggttgcagtgagccaagatcacaggactgcactccagcctgagctacaaagtgaaaccttgtcaaaaagaaagaaagaagagagagagagagagacaggctcctccgctttttcagttcctaaataattttccaatctagaatgcaaaagattctgaaggaagacagttaccatttcagatcggcagaagttgtggctttaatctagactcgaatatgttttacatcaaagggttgcctcaacagtgctcaaacctgcctctctgaaaacatgctgagcacgaaggttacttgaagtcttagcttgagtacttaagagagtgctatggagggattgttgatgagagctgtgtcacagctaatttttctttagtaattaaaggtttataaaaatcttacactgtatattgacaaatttagcaacaaaatgagcttgagaaaaaaatcaaggcctgccatggcatctttgcttttttttcttaaaaaaaaaactttttagaaagattatgcgactgtattatctgtaactactgcaatggtgtaaatcctgatggtataatttgctttttaaagctatctttacttcagtataacttagattaaatttattttaaatttaaatgatatttttctctttgtttattattttataatgtttcccatagaattcacaaaattcattagaaagatttttttttacttccttaggtcattaagattctgatttgtcaatggatttcacataaaccctgtctttccaaaaatatacaaaaaaaaaaaaaatagccaggcgtgatggtgcgtgcctatagtcccagctactcagaaggccgagttgggaggattgcttgaacccaggaagttatggctgcagtgagctatggtcacaccactgcactccagcctgggcaacaaagtgagaccccatctccaataaataaataaacaaataagtaaataattttcaccttgaaaagcttataaatgtatgaaatcacaatgagggtcgctgatatagtttggatgtgtgtccctgcccaaatttggttttgaattgtaatccccagtgttggagatggggcctggagggaggtgattggatcatgagggcagttttttcatgaatggctcagcaccatccccttggtgctgttgtggtgatagtaagttctcatgagatctggttgtatagcacctccccccttgctctcttgttcctgctttcaccatgtgacatgcctgctcccccttcaccttctgccataattttaagttgcctgaggcctcaccagaagccgaacagatgccggcaccatgctttctgcacagcttgcaaagccatgagccaattaaacctcttttttttttttttataaattacccagtctcaagtattctttatagcaaggcaagaatggacttacacagtctcttttgtatcagggagagggtcttcttggtgactccacttcttttctttgtttatgtatccttccagatgatgtatttatttcctttgtttttcaattgatatttactcttaaattaaactaattatttaaaaaagcattttaaagtctcattttagattattttgactatctgatttttaaaatggtttaaaaaatctatcttggcctccatatgcaatcaaataagaaacacattttaagcatattatttaccttgtggattctgccttcctcagtgtgttcagtctgtgtatattcatttctcccacactgtaagaagctagtcagatgtataattggattatcatgctacataatcttagcacactcattttaagcatacatagactagtgagcaccactcattacatgtcatttctctagagaaactagttgggccatggctgcaggactctcacttgaaaagacatgtgtggtgatgttttctcaggcagttaagcaataaagtgtaccctgatttgcactgaaaataaagattcctttaaagggagcagttctagttatctctctctttaggtaccatatgctgaacgtttttctatgcactaaaacagcaactaggttttatactctgccttacagcctacttcacacccatttcacagggagaggaacagagaggtaagtgatttgccccaaattacataactaggaagttatttgctcagtgtggaaacttgttcagaaggtcatttcattgaaatgtaggaagagtttctggcacttctcttgagcaggagtcaaaaacctttttttgcactagcccagatagtaaacattttaggctttgtgggccatatgatctctgtcaaaactcctctacttcgttgttgtagtgcaaaagcagctatacacaatcctgaaatgaatgggtgtggccgtgttccagtacaaccttacagaaaaggcaataggctggatttggctctgagactgtagtttgctgacctcagctcttgaactgagctctttaactgacctcagctcttgaactatggtacaagatcccatggtcctgtttggtacctccatttgccctccttttcactctctgggagcatagctaagttcaaaattgaattaggtacttgtagtaagagcatacttataatcctgggatcttcatgttgccagatattaacctcttgaagtttttcaccacaacctgggcacttttctgatttgctcacttctagccccacctttgggccccttcataagcaaacatgcaggttttccagagagctgtatgctactgaatgcagaaaatttggctcatactggcctatggactatctgctcactgccctgataactattttccaagggagtgggtgccctacctttcctacatgaagttttttgctagtcttgccctaaaaattctaggtatcccttgcttttaggataaatatgtttcactgggaccagctggaaaacgaaaaatagaattatccaactaccactttaaaattggacaaagacttttgttgttgttgttggagggggtggtaaacatcattttagcagaccaaatatacttttggtgaaaggcagcctgttgcaaagacacaacacttggacaagattttgaagccctggttgcctttactactgacttaactacagtatttgcggacttgagcaagttgcttcccttctgtgagcctcaggttattcatctttgaaatgagtataatacctgtgattataattacttatctggattctgcagagaattgaaggagataatgggtgtaaaagtactttagcgcccagcactgctccttatgaaaatgaggaaataattgagatgagtgagccattgaggcaacagtacaaaaagtgctgaaaactcactgcttaaataagcacctcttactgcttttgtggcactttgtagcaatgtttttttttttttttttgagacggagtcttgctgtcttgcccaggctggagttcagtggcacgatctcggctcactgcaacctccgcctcacaggttcaagcattctctgacttcagcctcctgaatagctggattagaggtgcgtgccaccacgcccagctaatttttgtatttttagtagagacggggtttcaccatgttgatcaggttggtctcgaactcctgacctcatgatctgcccgccttggcctcccaaaatgctaggattacagatgtgagccaccgcaccccacctcagcaatgtgtttttattctgactagaaaagtaatgtttggttttgtttggctctttgcttaatatacccataataagggtacctatttgcctttggaccattagttcaaatattattttattaatatggaattactgggctccagaagccatagtcttcttagctgctccctatccccactctcacctcaatttttttttttcacttttgtttttcttctcagggaaaggtttgaggcaaagaatgtcttcttatgatccaaaaccaagcatggtggtgatttattcaccaagagattcctaagtacctgtgtgatggacatggtagaatctttgtcctgagggagctatctagatccattccttctgatatgcagccagtagccacttgtggtaatggagcaatagaaacaacactagttcaagtggaaacgtgagatgagaagtaggaggtggagagaactaaccagaagagggtacccaaataaaccagaaatatgtatgtgttagagaaggggcctattgagcgggtggcagtggcatgtgtggcattacttgctcctgtattctctgctttttacttagttgtggctttggtggtatagtctcaaatctaagttacgtaggtaatattgttatgtatcatgttttggcaatgtagactaaatacttgctcataagagtacaggacaatgaggatagtttggttttgtttactgcatggaaaatgcaggatgtttagtaaatagattcatggcgtagtgagttcactactaaaatcagactctgagaatgggtttgatttaaatggctagtttagaagactgaatttaggccacttgattgagaaaggccattttgggtaattataaaccaccaacattgtgttttgaatgttaaagcttatatttgtcttccagttaccagaatgtaagcttcttgaggagggagagaggagttttcttaatctctgaacctgcacctttcttctgtgcctagcccagtgcctggcaccaaacaggtgctcaatcaatgttgattctatgctaccaacaaaaatgagtccatgatgtttactattcaacaaatgaatacaattttagagtaaatttttactgcttacactacatgtagattttctttttagagatttcgcaatgctgatttatttcaaaataagcttgaagctaagcgacaaagctgaatgatgatttgttttttatttatttttaaatccaaacttacaattttacatgtcattgccagaaaaatcattaaataaattatgatatgcgcatatggaatactttgcaaccattaaatcaaccattaaatactatgcaaccattaaatcaaccattaaatatgttggtatatgcaaatgtgcatataccaacatattatatagttgagtaagaaaagctagtttcaaatgagtatgttaatatcatctgactcttgcaaaaggaaaaccatacatttgaatgtacatatatgcatatgtttatatgtgcatagaaaaagctatgaggggatatacctcaagttgctaaaagtggctccacctggagagggacatggaaaggagttggctaaaaactgaggtttgttatggtatacacccctgcacagtttgattttttaaaaacaatgattataaattacttttattatttataaaaatattatttaaaattttggtactaaaaacagagctccatcaacaggtcaatggataaagaaaatgtggtacatatatacaaccgagtactattcgtcataaaaaaatgagaccctgtcatttttgcaacaaaatggatggaactggaaattattatattaagtgaaataaggcaggcacagaaaggcaaacattgcatgttctcatttaatctgtggaatctaaaaatcaaaacaattgaactaatggatatagaaagtagaaggatggtaaccaaaggctagaaaggatagttggtggggcaggggagggtgaggtgagcatgtttaatgggcacaaaaaaatagaaacaatgaataagacctattatgtgatagcacaataaggtgactatagttaataataatttaattgtacattttaaaataactaaagaggtataataggattgattgtaacacaaagaataaatgcttgagggatgtatacctcattctctataatgtgattagtacacattgcatgcttctatcaaaaattttcatataccccataaatatatacatccattgtgtactcacaaaattaaaaaaaactgtgcattaaagaaaaacaaaaataaaaaccatagttcaagttataaacaaaataaaggtaatttggaggaaaactgtcttcagttatattggatatttgggggacatttttgtatgttagttagcaaagatcacttgaaaaagaagattcttccttctatgattcaagggagcctagcaaaaaataaatgaaatgaaataaaataatacaaagagaaaagattattccataaattctgcttacttatttctggcaaacttgttgacagcacatgtgaccttttggtaaaaagacatttttatatttttagttaagtttcaaatataaattgtttgtgtttttaaaataaattaaatggatgatttcagccagatcattatgaaaacacatgagatattgggttatgcaatgactaacagtgtgtaccttttcttgatatttattcataaactggggaataaaagtacattttggcccatttactccttaaataattttatgtctcccaaggagagttgtaagttgcttgatagtaaatgctatgtattttgtaccttagtgtatatattatgggatttcagcgttagaagagctcttaaatgccgtgttcatagtccaacctgtcttctgatgcttgaaatccccttgcagtaggaaatgcaaagtagagagcagacactcaataatgtagttagtgaattatttagaaagaggcattttgagcccataatgtatgataggtacttctacatttattattttattctttgcagacctgcagaaaactgtaagaaaaaagtttatttcagattcatgtgtttatttgattaatctcttcataggtttcatttttcagctcctgtcagaaaatacagattcttataaggttcaccttttacccataagaataatagtataaaggggataatgtgaaatacaatcacttcacagactgtttcaattaaataagagctcgtagataattcagtccaccacaccccattttacagatgttgaaattgaagcccccaccaaaaggaaaagacttgttcaaagtcacacagcaagtcagtggtgaacctaattaggccccctgccttccattttagtgagattcctgtgctgatagtcatacccatatcaaatcctctttggcagttatagcttgcccacagtaatgtgtcctgaaaaatatgacaattaattaagttggagacagaaccataacctctttataaaaattttctggaaagtttacatgacagtaagtaatatataattagaaaggataattcttatttcatatttatctttttgtttcagaataataaactaagctatctctactcagtccattttaatacaaaaatatttttacccggactgagtttttatgctttttaggaactttgtatctgcctcacttagttaaaatcctagctgcactaatcacttactgtggtgggcagaattctagaatgaccctgaataccttgtccttgtatgattccttcctctttaagtaaggataaaaactgtgaatatgatatcactcccttgattaggctttgttatatggcacagttaactttaagaaaggaccaatcacacaagccatttgaaagcagagggtttgggtattttttaactggtggcagaaagccacgcagagatttgaacattgaggggaatttgaatttgatgtgccagtactaacttgaagatagaggaggctgcatggaaagtggcctttaggagtgatccctggctgacagccagtaagaaaatgagggcctcagacctacagccataaagaattctgtcagtgaacttgaacttggaagtggattcttcctctagaacttccatataagagtccagcctgattgacaccttgattttggacttgtgagaccctgagcagagaatccagttgacttctgacctaaaaaaaaagtcagataataaatgagtattgttttaaactgctaattttgtgataatttgttatgcagcaataaaaaactaatatatttaccatgcaaggcaaggcatttatcctctcatgattcagtttctttttacctgacataatggaattaatttatactgctgtgaagttgtagttgagaaacatgacttctaaagtaatagaggacatgtattattaattttagtagtattaatagtaatgatactgattctcccaggcctatacaaatcctttgatacacaaatgaatagtaaaggaacataaattgtctctaggtagactttcccacaatgcaattttaggatacagaggtcatatgcctgttattctactgtggcagagaaaatatggagcctggaaaactgttcatttgcatcacatacatcttgggagctcactctgaacctggtaccataataagctctgtagacagtataaagaggaaaggaatcagacatggtgtctgacctcaagtgtctcataacgtagtagaagaggtaaaatatgggtcacactaactctactgcaaagtaggaagtgcttgtcgccttgagattgacaaaatttggtaagagttcagaggagattgtctgtgaactgggccttgaagaatagttaggatttgaataggagaaggtgaagaaggaaggcattccagctagggagaagagcacaaacaaaagcatagataaccttgaacatcatcatatgggataattcaatagttcagtataatggaagtataagatgcataaaaataagtgtagtaggaaacaagtttaaaagtatagattggggttagtcatacaaggccttgaatttcaggctaaggagtttagacattaacatttgtttttgaacaaaggggtgaactgatcacatctgtgatttagaaagaaaattctagcaatagtgtagataagggttgatggtaaagtttggaaggtggtgaggcagaggctggagacagggagcacatttaggatagaaagatgataaagagatgatttagaagagttgttttggaaaaggagaagacagaaaatgttttagaggtgtcatagagataaaattggcatggcatggtgcaaggaggtaaagcccaatagctttgtaaggtgctgagatagattgaaatcacagagttaggaagttttagagtcaggattagtaccaagacagcttggctctagatctcatacttaacacttacagtataattctgagagggtgggtaacagcaatagtcagaggaaagaacccttttatacatgatggtacaggaacaacactggcttccaaccccacagctgctctttaacagaaggtcagaagctggggagaaatatgtgtgtgtgtgtgtgtgtgtgtgtgtgtgtgtgtgtgtgtgtgtgtatgtgccatttctgggactaaggatgggaagtagattagttgaggccactgcagtggggtctgcaagttgctagcactcacccgttccaagaggccttaaaggtgttgatctgttccctgggcatcaccacattccacaaattaatgttcctctgagagaatagggtgattcaatttcactgtgcccgaaggttacttttggggttcatgtttgttctaagtctatgctaatgatctgccaactgtctgtttgtcactttctctaacccttagcatgtataaactgatctgttgggaaatgtgtagcatttataggatggtaggatttgtaacatgcgatcacaggactgtttatatagagtccctgggaaggggagagaagagtatttctgttacaaatgtggattctttggcccctcctcaaacttactgaggttcaagaattgacatttataataagcacatatccattttcaataaacatgaaagtttcataccctcttttaatgtttgaaatcctcaaataaattagtcattggtgccagagtatcaaataattatggtacagaatgtatttctctgaatgacaccttctcccagagattctgatatatattcctctgcactcaccctgtttgataattaccagtatatggaccatttacctgaagaataagagtagggtttcctactgttgttgaaaatttgcttgactcttaacaacttgtgtgtgactgtaacaagatcacacagggtaaacaatattagcttattcaaccactggctgaagaaatttaggaaagtgaacacatttttctttacatttctctttgttctgtgagccttttatgctggaatagttttcactgcaggctgttattgtctgcctccagaggagggagttgacctagcagtggtaactggagagtgttttttgaaacctctttccaaggttagttgccaatggcatctttggaacagtgtccttcacttttgtccctcagggaccagtgtgagaatgggaactttatgatctggagctggttaagtgaagtccaaaaataattaagaaagtgtttccttccctgggaatgagttcagtaggaatctcaatgtattgtagagcactaaggactcagcctcaggcatttgcaaaggattcttccagttgcctgtgttacagaggacacagttggcatttccttttggtgttgaggggagatgtgtacatggttgtgagatgactcaccctttttgcttagatagttccactttcattgtggacagactctttggagggccagtttggcatgcacgtgtgtgttcattccatcctggagcattctttatgagaaagccatttgttgagtggtttgccattttgttttacagccactctgtgggctatgaaatggtcatccggccgctttatttgtccctaaaaaaagcagtttttccctttcttatcttcatggctgccaagcagcagaaagagtaactcagggaagccatgtgatagccttttatctgtctgttcagaaactgatgatgtattggatttgataattcatcaaatctgaggtttactggtttgtatttgcctcaaaatgggcatataatattttgtcaggtaacataatagacagatcattggcattgctttattgaagtgaattaattcaataagcctgtaagtgcctgacatgtgccaggcactgtgctaggcattctgttaacagatgagacaaatctctgtcttttaggtgttttcagtcgaacaggggagacaaatatatgagcaaattgctattttttttaaatttcatagtgtacatgagtataaggtgctgaatatgtgattgattctgagggaaaagagagataagggaaagttctcagagaaagtcaagctgagggaagaaaagcaccccagacagagggactagcatagagctatgctagtacattgagtttaagggaatggcacatacttcactgttgcttcagcagacagcaggcctgttaggttacaaagggccttggatgacatgctgaggggttttaaaattttatttaaattttaattgacaaaatataattgtatatttctgtgaggtacaatgtgacgttatgatatatgtatgcaatgtagaatgattaaatcaagctaatttgtatatctaccacctcacatacttattttttggttagaacatttaaaatttattctcttaacaactttgaaatagacaacacattattatcaactgtagtcaccatgttgtgcagatctcaaaaacttctaacaaaaactttttaccctttgaagatattgaactgttttatgaacacaatcttagaaggatttaaaaaataatttgctattcaccaagtacttcttacgtacactgtgcatgaaatgattattactttttctaatattagttttcttgattgaggcttggcaattattagtttgtatgcctttagaaggatcataagcagaggtttatcccagtaggatttgcattttagaatgatgactttgggagtaaaatacagagaagtgaaaccagagatagtgggatcattctggagtctgttgcctacactgaacagtagttgagcgaaaaaggatgggcagaatgtgttggttctgggtattgcaaattcatggcacttgagtgaaaaagtttaagccttctattggctctttgtgaatatcttcaacatgcatgactacaaatagaacacatggttttgttgttattgttgttgtgtttttgtttttttttttatttgagatggagttttgctcttcttgcccagactggagtgcaatggcacgaatttggctcaccacaacctccgcctcccaggttcaagcgattctcctgcctcagcctcctgagtagctgggattagaatcatgcgccaccacacccggctaattttgtatttttagtagaaacagggtttctccatgttggtcaggctgtcttgaactcccgacctcagatgatcctcccacctcggcctcccaaagtactgagattacgggcatgagccaccgcgcccggcccacacggtatttttgaaagaacagtgagcttggattagaacactagtgtccaggccctgctgctactacataagtaattatgaatccatagccatcttgttgctcttcttctctgagccttggtttctttagctataaaatgggaagttgaaactttctagctacttctttgagttatgagtaacaagttaggtaatacacttaaaagagaatgtgctatacaaatactggttcttaagacagctgttgttaatgtactgagtattatgcttacctcacagggttattgtgagcatcaaatgggataatggatttgtaagcattttgtttaaagtgtgattcaaatgttaagaattagtaaaaatagtaaaagaacaattcattctccatccagatgttctgtccccactgtgacttatgtgctcattcagagttgtacagaaaaacctccacttaattttcacaagctggagttccacatgtaacagaatcatatgggaccaaaaaattctctgtattggcttcttccctgccgtattttggctctgggaccaacaagacacccattttgcatgagctgcctgccaccaactttgcgctcacatctagttctgttgcccatgtgcaagctgaatttgggcccgggcccccagatctaacatgaaactcaagtttccttctgttcaaactgtccaggcataatagtcttaaagtccgatgcccagcagagccgtagatttttcactggccaaaaatcaacatgaaaccagatgtatctgtaaatctagtttcataacactttgtagtcaatggaaatacagtagcaggcagaccagaccagagtttactatttgcagtggaattaataaccacatggaaactttgcctttggtatctgcgagatggaagataaaggtgcgaattcaaagcagttcccaccttaccctctaaattccaacataaagaggccttgaatgtccttctatcttattgtatatttcattaacagaagtatgttcctagctacttagtcattctatctctattctcctttgttttaacttcagtggtgccagcttaagatgctctggctttcagctttcatggagcacgtcatgtttttaaacttatctttagggacagaaatgttaggaagatcctagttcctcatctctttgctcctgacaaggaaatttagaattgcctaaagaaaggatgtattggccaacctaataataaatcagtattagtgaatctaaagcatatttgaaaaatttgtaacatgagttgaaattcagacctgcaatgaagtgtttttaaaagatttaaaatcgaaataatataaaagaatgttaaaaacaagtaaaacatatcactagttaatcactctaccaaaattcatttttatgtttgcatatttaaccatttttattttctatatttgtccatgaacatgtgtttttatatattgtttatattaaacatggttttaatcatggcttatttcttttatgttttacttcttttcctttgacataaaatattgtattttttaaattttaattgcttcttggcatacccttccaatattggtggctatatagattgaagttaaaactaattacaatcagagaaaattaacaattcatcccttcaatctcattagtcacaagttaaatactcaatagccacatctatctagttgctactgttttgaatagtacagatataagacattttcatcaacacagaaaattcacttggaaagcattgccctggagtaaatgtgccagactgtactatatcatttttctcttgttggacatctaagttatttcttattttttaaatattttatataacttgacggtgaatatacctatgtacatagctatttgctttggctgaattatttcttagaatcaatttcaaaagtggagttattaggtcaaagagcatgagaagattttttggaacctgcagtgtattgccatagtcctctcaaaaaagtttatgtcaacttaaagtacttctagcagcatatgattgtactaatttcgctgcaatctcaacaacactggacattataagtttttattctaccctattttccattaaaagatagcttatgcttgattgactttgcattttattttattattaataatgatgtggtttccttttttctagattttatttttatttaaggcatcctttgattttaacctgattttttttctctaaaaattattctaagaaaagacaaaggtgatacgaaatatatcctgagtttttatttttttcttgcatgggatttgtatatttgcacctttgcccatttatactatgatttcttagtgtcttccctggcaattttaatgaagacttcatgtatatcaatttttccacaaatataatctttctaaaaatatgttttttccacaatataattcagacgtattctccgaaatgttggaaaaacttaagtaggcatcaaagcatttgaagatttgtttaaaggttgtttttataccagttttaaattgtaatttaagggtcataaaataggtgaaaattaaatcatttttcagtaagggggcaagaccacttaactcttggaaaatacaggaaacgtagatttctagaggccaagaaggaggtagggattattttgtaactgcccccaaccttctaacctgtaatgaaacaaacactgaaggcccttaaacatttttaggcttaattggctgtccttgtacttagggcacatctaaaaatcctgaggcaaccactcaagagaacatgcttttgttaattcaaagggagctgtcctacgagtgtccagaatcctctgtagtcttgggcctggtgcttgagagacccaaaggaaaggtcaatggaattacagcttagtgttagagctttcatgcatcacactaattaattaatgtcataaaggtctctctcctgttatgggaaaaagcagcaaataggaacttctggtagggtgcttaaagttggtttgatattttttattagcatttttaactaatacaagtaatacatgcttatggtagaatgataaaactgaaaaaaaaggtatgaaaatttagaagttctcctactcatgacctcaccccttctttcactcccagtttcactcctcagagggtaaccacagtgactagcttcttgtgtttggttcctgagattttctatgtatatatattgttagatatatgcatggtatgttttcaaaattcctgttacactataattactgttctacaacttaattttttcacttaattaatagaccttatatatgcttttccatatcggtatatatagatctatataagttttcttaaaggttgcacaactttcaattgtatggctgtcttgtaatttactttttgtttcccttactaatggatatttcatgtttccctaactcttttgatattaagagtagtgctgcaattaacatccttgagaggcagtatatatggtgtttaagatgaatggttctggagccagactactttggattgaatattggtgccaccaattccttgctgtatgaccttaggcaagttgcttaatttctttgcctcagtgtccttgtgtgaaaaaatggaggcaataatggtcactatccagtagggcttttatgaggatttagtaagttaataatgcactttaagaacttagttatttttagattaagtagtgaaggactatataattgttagtataattgtatacctttattatcatacttttgcatgtatagcaataagacaaattcttagatgtttaaccattggacataaggaatgtacgcattttaagtactggtagatattaccttttccctgccaaaaattgcaaatattggatattaactttttaaatcttagtaaatctgataagtataaataacagtttatcatcattttaagttgcctatcttaattttgtgtgaaaatgattatcttttcacatgtttttttggccatttatgtttctttccatgtgaactaactgttcctggccattgcctatttgttgttgctgttactatatggcttttcatctgtttcttattggtttatggagctctttgtatatacaggaatttagcctctatttatatgtgtgacaaatactttttccaatttatctttaaaatttgtttatgttttcctattcatcagtctaaaattatgtagttaaattcatcattgttttttcttatgactttagagtttggagatcatgcttcaaaggtctttctaggtggggatgatttaaatcatgtactggaagtatttttgccaaaaagactcacgaattatggatgttagagctaaaagggaccttagagatttcctagttcaaccaccttttcttcatacctttttaatttttctctgcagatgaaaagaagtttagtcctaaagaaagaaaagagtctaaaggttctccagtaagctaatggcaaaaatgtagactggaacttctagctcctgatgtgtatttcagtgatcattcaatttaaccagatggtttcacaaaaagagctttctactaaaaaataaaatacatacttaagcaactcagagaattttttttttatttttcagattaattttcacttagagattcatcagcatatgtactatacatgtacaaatcacctgtgtgttttggatatttagttaaacaaatgtgcaaatattttaaccaaaggagcatattcatttgtgttttattttcttaatggttttcgttatgaatgtgaaatgtgtatttaccttaacagaaattaagtatatttttggtctgacatatatgagaactgaaaagcattggcttggctgctaactgcattctcatctttctttctctgctttggcaaagtctgggattaaatctaataccttttaaactgtttgggacttcagccagagtgacctgtcttgaattcagaactgcgcagatcattccccattctaaggccctctcatgcctcctcattgcctgtaggatgagatccaagtaccttagcatagcttatgcactgtagtcacttgacctctagcacctatgcagtcttccagtcttatttacacattcctttgcacatgctgtttccccgtgtggggcaacttttttcttgcctgtctgcctgcctaagccaacttaaataaacatcatttctgtaacttctgtgaagccttttccaatctctccactccaagacgaaggtgtttctataggcatgacttctggaatggcagatcaaggatctggtggaccctctactcagtgaaacaaccgtttaactagtaaaaatgatcaatcaaccatttaaaatcttcagaaaatatcctaagggcacatagcaaaaagagaaacatttattcaagaaaagctattaagcctcagtaaaaacagcaagagtctatggcatttgagtcatgacctgttcctaatccttcccttatctccattcttcaggcaagtgcaaccaagaagatggaggcttcctctctctcaaaatcttactccatagttataatttcacccacaatggggcagaccacaagcatctcttttttttcccccagccctatattacagaatcactgttctaggaaggcatagcttagaggattggagattccttccacacccactttctacgtatgagggctttgccccagggatggtaagtcaagaatacagggatcctgcttgtgcctgcctcagctcatatataaggtaaagcttccacactaggaaaggcaaattaagaggactagggaatataccgttatccccagggtccacttgtagaacaggggtgtcattctgggagaagcaggtcactgccccacttgtggaacaggggagtcactcgtcactgtccctggttcaaattctattgcagtgacagaggttctgtcccagggaaaggcaggttgttaggatggagaactccacagttctccctgaggtgactgactttatttggaacagagcatgaagaagttcatgcctaagggcactgtcaaaaataatggagatcttggtggtgagcaattaagagtggattggtagctccatgatactagtaacaacaagcaaaacagcagaccagcatggaggataccagagaaccagacaaaggaatcactaagaagagcccttgtggaattgcactcactgctgggtgtgtggaaagttatgcatgtgtgctttactgtaccctctcaaaagcaacctaaacaggatgtggggtaggctctaaagcattcctcaagccacacatggatccatcagtaaaatgtggagggcttaaggataaaaaggcttaagtacaatctctggccctacattttctaaatgttatgccaccctgaccaaggggcaactcctacaaagccaggcaaaataataaaatcatatttgtctctagtggaatggataactatgcctaaaactgtgccctttgaaaagcaactagagagataatttctgaagtgtttgtccctacctgaatgtgtggcaaaattctaaactccctgaagtgtgaaagtggtttccaagccacatgcacatccagtagtggtaaagggtgaaaatctaactggctaagagggcttcatagcaacattaaccaaaaagtggtttatgtagtctttgcctgcttcataattccctaggcattctatgctattctgtactcagaaggcttaaagtcaggttagggaaaggaggcctatgaggttactgtgcagaggcagtgctgggaaataaatgaagttaaataaatttaggccatcgtggtttaaagaatggattgtggagataagaaggataaaggaaacccagagtcaagaaaaataaaacttttcattggtgccatgccaacccatatccgagcctgaggcaaaaggaaaaatgtgctccctgatatacacttatacaaaatatcaactaattttatttgttggactgaatagaaaaagtcaacaaaaattaaaaataaaaaaatcatgactatatttttaataagtggtttatgtaaacccagagttgaccaatgggatgccagtctcaaccataaaaacaaacaaaacattgtgagtaacaacaccagaagtctcaaagtgtcagggaaaccaatttcacagaagcagttcagccaagtcactaaacaaacaaacgactaagcaaaaaacaagaatgagtctcagaaagggtcaagtcagtatccagagttgttacaatatagtatctaaaatattgttttgaactaaaaattttgaggcatgcaaagaatgaggaaagtatgactcatacatggtattatatgaaaaaatcaacaaaaaactatccatgaggaaacaaagatgttgaaattcactagggaaagactttaaaaaccagctatttaaatatattcaaagaactgaaggaactatgtctaaaatactaaaataaagtataataacaatttcttgtcaagtagagaatgccaataaagagatagaagttataaaaaaagaaaaaaatggaaaatctggagttgaaaattataataactgaaatgaaaaattcactagaaaaggtcacaagaagatataacttggcagaagaaacaatcagcaaattagaacatagatcaatatagattattcattttgaagggtagaaagaaaaaaagaatgaagaaaactgaagattcccaaagaaatgtaggacatcttaaagacacatcattaggagaagaaaagaagggaaagaaaagagcagaaagaatattttttaaaaaatggataaaatcttccaaaatttaatgaaaaacatcaacctacacatcaaagaaaatttttttaaaacttcaagcaggaaaatgtaacgatattgatacttagatacatcatagtcaaaatattggagtcaaatataaagagaaaattttgaaattagcaagagaaaaatgaaatggaaccacaataagattaacagctgattctcatcagaaataacagagagcagaaggcagtgcaatcccatattctaaacgttgaaagaataaaaaaactgtcagtcaagaatcatatattcaacaaaactatctttaaaggtaaaaatgaaatgaagacattcctaggtaaacaaaggctgagagaatttttcattagctgacatgccttgcaagaaatactaaaagcttcctagacagtagctttaatctgcatgaaaaaaaattccaataaagggaaatttgtaaataataaaaatacatcattatatattcttttccacttaacttatttaaaatcaatttcttaaagcactatctgtaaaattgtattgttatttgacaataaaatgtaaaagaggggagtgggaattaagctaaattggagtaaggaaatggtatcacatggtaaattgaatttacagaaagaaatgaaaaaattaagtggcaaatatgaagagtaacattaaaaacttctataaattaattgtggcctcctttcttcccttagcttctgtaaaagacataagactattaaaaatgacaataattataaacacattgttttattagtaataaacatagacaaattatctacaacaattattattatacaaggagagggaatggagctgtagaggagtaaagtttttataacctactggaactaagtcagtataaatatgatgtcgattctgttaatttgagatatatgttagaagccccaaagtaatcactgagaaaatgatgcaaaaatacagttttaaaaagttaaaaacatagtttagcttatgtgtgcctagtactccattattatttttttattatattttaagttctggggtacatgtgcagaatgtgcaggtttgttacataggcatacatgtgccatggtggtttgctgcacccatcaatccgtcatatacattaggtatttctcctaatactatccctccccctgtcccctaaccccctcaacaggccctggtgtgtgatgttcccctccctgtgtccatgtgttctcattgttcaactcccacttatgagtgagaacatgcggtgtttcgttttctgttcttgtgttagtttgctgagaatgatggtttccagcttcatccatgtccttgcagaggacatgaactcatcctttttatggctgcatagtagtccatcgtgtatatgtgccacattttctttctgcttgttcccaggagaaagtggctgaagattccagagagaagctgaatgcagtttaattctttttgccataaacacgacaacccattttcctgcaagctgtgttagtttgctctcttcttggttcattcattcatttattcatagcttccataaatatttaacaaacactaattaggggccaagccatgtgctaggcacaggggataaaactgtgaacaaaacaagccccagctactcttaaggaactgatagacaaatggaccagcaaacacgctggtcctgttttgaaggcaaagcgcctggtgctcctgatctcatgagcacagagcatttagcctaagtctcatcctcctaaggcctcagaaataaggccttattttaataagtgcaagtcagtcatttgaagactaaatcatagaatcctagaaaactagtaccgggagcaaggcaaaagaatgggatgagcatgaaacatatattcagaagttgtggtgtgtaggtatataagccaagctcttttcttcacttgcttgctaagtcacttagcttttctgcctttttgtttgctctgtctggaaatggagttaatgaaatatatctacatgatagggatattgagacgattaaataagatgctgctgtcacccagtatgcccttaccctgctgtacttagaagtatatgaaattcattttctaaatttttgtatgagtgtttcatgcatgcccaccaccatggaagctaccttaagacagtgagggactttgtttaacttgtttgtactacatcctcagtctaatggtgtctggcttatggtaggcaccaaatataattttattgacagaaaggatgataatgaatgtgaaggcatttttaagtttatgaagtgttgtgcatattgttgttaattttaagctgttacgttaaagaacccctaatccaactctcttgagttttatagatatcatagaagatatatcttcccttgacatagaagcttcccttgaaggttcccttgactcatgtatttgcctcacagtgattgtgcagatcccacaagataaatttatgtgaatgtgctttatgtgcttgaagtgctccacaaatatgggttttataagatgagaaaatagagtcagggagaaaggtgactgatccaaggtcatgcaaagagttagtgtcagaatttataatggaatttcaggctcccaactcccactccagtatactaaggcagattccagagaagaaacagtggagagcaggcactgatgagggacaaagaaaagcaggctccgtctggctgcaacttgtctcttcatggcaaaaagaaactaggaaagtgctatgccagagacgacatgataactttgcagaatggaaagagcttgtttaccacattgaatactttatctgtgtttatctaacgacagttccaccagctctttaccacttgacttttgcctaattcaaaaatataccaactatgaaacattttccttctcagtttttattctagattacattttgttcaactttatcttaatgtgtagtgtagaaagagtaaggtaagagtatagcaagtggttattttccatttctactgaggacagagaaataatctaagggatttgtattagagatgaagaagtgcatggccaggacatgagagatactgtgatagaatggatattgtgaagtctttggtagtttttgaggggaaaaaagagaaggttttctttgtctgatatagtttagcaacgtcttaatttaggattcaaaagttgttcagggtccatcttggccttcaaattaagatgccctttgagagataacattgttgttttcaaactctgttctgtgacttaagaatgagaggagaaggaagaaaagaggagaaaatttgagggaaaagtgcccaagcagcgtcaaggctagacactggaaatttatcaatgaaagccacatggtggatgggaatcagatatgtgcatcaattatttgtgttccaatccatatagaagtaccgtataatgcaccaagctaataggtgctttgaaagaagaccatacaagtggagatgtgttcctattctatctagggatagagtcaggaagggcttcattgaataagtggtagcctcttgggctgagacctgagttatgagatgatgtggcaaaggagacagatggctgggggcaaggtggggtcattgaaattggaggcagtagcaatataagcaaagctacaggggcatgaaaaagcaaggttagattagtgaattgcaacagggtggtactgctggaaggtcacatggaaaagattgtgaaggtattgagataagaagctagaaataagctttgaatgccatcctagtactttgaatttgcatgctgtaagccaagtggttttcacttggtcatttaataaaattacagattctcaggtctcacctgtaacttcagattcagaagagtctgctaactgaaggtggaatcagtgttccatattgctaattagctcctcagaggattctaatatatcagtgagttatgaccactgctgtaagccataggtagttattgaaagctgctatggagaggagccacagaagcagatgttttagataggattcctctggggtcctgtgtaatttatggactggagaggatcagacaggaagcagaaagacttgaataagacagttgcagttattttggaggcaaagattctctctctctctctctgtgtgtgtgtgtgtgtgtgtaattgtaggaactatttaggcagtaaaattaacagatattagtcactgattgactgagtggatggcagtgataggtggggtgcgttgagggaagtgtattacattaagtccaggatgactcatggttttctaagttgagtcattggggattgccatccaatgtgagaaactatatagtcttatcatagttgatcttggaggtagacttgaattaaaatcttgaagccatcaattgctgtatgtgggtcttgggcagaacacttaaggtttctggacctcagttatttcttctgtaaaatgaggaaaataatgcatacctcatgcatttgttgtaaagactaaatgaggttaaagtatgtagagtgtagtttagtaactgggacgtatagtggtccagtaaacatcagctgttattattgtgctatatgttgtgatgtgtactggagtgagatggggtaggggattttttagtctctgccaatgactcctctccccatgatcaaaatcagaaaatcagtctcttatgtgttgaggagtgagacacttctcccaagtgtttaaggctaataccttgccttgttttgccttgggccagacctcactacacatctgtttaagagatcagggtaagctctgttcttggtgagtatctcaatggggctgtttttctagttcttgtagtttctttgggccaacatgaaatgtctaaccttggcttcttggttgtggattctcgtcaacatttcactgctacccaagttgtgtctgcttacatgatgctatcttccttcttttgggtttctgaagccctcagacacttggctgaacatttttcacatttcttaagctatatcatctgtgttttccctgccacagacaaagtcacaaaaggactttaagataggttttggttttttttttccccagggtttttatacattttgggtaagggcaagtggtaaatgctgcttttctgccttaaccagtagtgtctgacagaggaggtagcatgatgattgcagagctcactggactgaaagtcagatgctttacccgcctagactctagtaccaaggggaagatggagtgagatggggtaaatggggagaaattaccatttattttgagtgtgccaggccttttctcatgtattgtctaatgcatttgtcacaattctctttgggtttgaaatgtgattttcttcattttatagataaggaaacttatgggaagggaggttaggttcatcttgtgcccaactttacatggctagtgatcaataatagtgagattcaaactcagatttctctgccccaaagcctttgctttttcctcttttgacactgtaactaatgagaagatgtatttaactctgagtctcatttgcctcaactgtaaaatggagctctgtaactcttgctctgtatgacagtaaatctcctcagaccagacttatgataggggataaggatatttgtatctttgggcccctaatgtattgaaagtgcttctaagtgcctggcacatagaagggcactcaataaatatttaccacattttccagaaagagggtagctccataatgggtgagatacattttggtggctactgtagtgtttaatgcttttaccatctgttaaaatgattttggagtatagctagataactgatgatggttgttatatagattttttcataggttgcctgttccaaattctatgccgtggaagaagttaaatatccagaatttgacaggaaatattattctacaacagatccctggcgtaagaatgataacacctgtgttctagtctcagacttgcctctgaataactgtttctcctggtcaattctctgtctctatctaggcttgaaatttcccccaaatgatgaaggagttggactagtttagtggggttcagcctcgagtggccattaaaattatttggggatctttgaaaaaaattagatgcccagatttttgtcgttgttgttgttgtttttgtttgtttgttttttaattatactttaagttctgggatacatgtgcagaacatgcaggtttgttacataggtatacacgtgccatggtggtttgctgcacccatcaacccgtcatctacattaggtatttctcctaatgctatccctccctagtcccctaaccccagacaggccctggtgtgtgatgttcccctccctgtgtctatgtgctctcattgttcagctcccccttatgagtgagaacgtgcagtgtttggttttctgttcctgtgttagtttgctgagaatgatggtttccagtttcatccatgttctttcaaaggacatgaacccatccttttttatggtggcctgatattccatggtgtattgaactgctcactccagttcaattaaatcagaatacagaatgttgagaggagcatcagtattttaagaaggccccctagtgaagttcaatgtgcagccaagggtgagaaacactggactagatgattgataagggccatccaactttgatagtcaacaagagacaatgctatagagtatggtggacagagcatgggctttagagttagccaggtatgcattcagaccctggctctgttacttactagttgtgtgatcttgaagaaatcaaaatggagatacactatgtacctggcagtaatagttgtggggattaagcaccttcaccagagcttaggacataataagcccccagtaaatagcttctttaatatcagaagttcagatggaagatgtgagaaaaatattggttcagtaagatttaacaggtaaattaaaatcaagtatttgaaaacattttcctgtttctttagcaatggattccagaaacataatgtggaaatagctctcagtccttagatttgatgacattgcagaaagaaatctggctagtcgtcccatggctgattggctatgatggctagaaagccattggaaaaaaaaaattggctcacagaagacagcagatgtggcttgggaaatgcaaggacatgactgtaataaggatttgtctatccagccccatttatgagagtgattccaggagaaaaggacagatttgtattgtcagtgggatacgctgttaaaaaacacttttgctactaccactccagctgtcttggcatgtttgttggtgatgtaagctacagaaaatggaaatcaccaatagggctatagcaacctgatgcatagtgacaagtaattgttctattcatggttatgtgttgtacagagcacttgctgcatgtcaggtttgagacttgagtatgcattagggccatggacacccccatcttatctttaagtagatttcaaagtaaatatttgatgaatatgtaaaatatttagtttggtcagtcatagggctgagaacatggtggcagttacctcctagtatctgcaagcaaaaaaagttttttcttcctatagcaattgccatctcagccacttttgcagcatttctttttgctacactttgcattaaccatttgtgcacttgtcttagcctcaaacaggccatgaaagctccttgaggataggggctatgtctttttcatctttatatatgcatcatttagcagagctgtccctttataatgtactaattactgaatgaagggatgcatagatgaataaatgaatgaaaagtaggagtgacctgtcttctctctttcttcacgatggggactagtgtgtgtatataaggggataatttttgtgtcacataaaatataaccttacttagaaggcaagacttccagaatggtggaatgagaaccacccccccgcccccataaatccgccctttcatgaaagcagtgaaaacgctagcaaacgttgtgaaaattaacttttccagaactctggaaaggaaacagaggcttccaacaatctgagaagaatgtattcaagaaaaacttcggtaagctctctgatcacagtggaaataataaacaattagtaatagaaggatagttgggaaattcaccatttgtgggatataaacagtggatcaaagaagaaatcataagggaaatgagaaaatactttgagattaatgaaaatgaaaatacattgttccaaaacttacaggatacagccaagctaaagcagtacttaaagggaaatttgtaactgcgaaggcctatatcaacaaagacaaatgatctcaaatcaagaacctaaccttccaccttagactaggaaaggaacagcaaactacaaagaaagcaggaagaaagactaataaagactaaaagggaaataaatgaaataatagagtagaaaaacactagaatcaatgaaattaaacattgattctttgaagagatcaacaaaactgaaaaaaactttagtcagattgaataagaaaaaaagagagaaaattcaaattatcaaaatgagcaatgaaaatggggccatcactacctaccttaaaaagaattttcaaaggattaaaagaaaatgccattgcattagttcattctcacacaactataaaaaagctacctgagatggggtagtttatgaagaaaagcgctttaattgactcacagttccacagtctgtacagcaggcatggatcatgaggccttaggaaatttacatcaggtgaaaggctaaggggcatggaagacatgtcttcacacggcagcaggagagagagcaaagagggaagtgccacacacttttaaaccatcagctctcatgacaactcactcactatcatgagaacagcaaggggaaaatctgccctcatgatccaattacttcctaccaggtcccttccccaacactggaaattacaattcaacgtgcgatttggatggtgtgacacagagcaaaaccatatcaaccatactgtatgccaaaaaattagatgacctagatgaaatggacaaatactcagaaaaacacaaactatctaaagtgaccagtgaagaaacagaaaatctgagtagtcctgtaacaagtcctgtaacaaaactggattagtaattaagaaacttcccacaaagaaaagcccaggttcagtcttcactggtgaatactatcaaatatttaaggaagatttaatccttcacaaattatttcaaaacttggaagaggctggaaccctttccaactaattctgcaaagtcagcattaccctgatgccaaaaccaaagatatgacacaaaaataaaactgcaggctaatatcacatttgaatatagataactttctaaaaatctcaacaaaatgctagcaaacagaattcagcaacaaataaaaagggttataaagggtgaccaagtaggatttatctctggaatgtaaattaacattcaaaaacctaagaataggaggaaactttcttaactttgtaatggacatctctgaaaaacacacagctaacatcatactaaatagggaaagattgaaatttttccttgtaagatcaggaacaagacaaggatgactgttctcaccatttcaatttaccattgtattgtagattcaagtcaaggcaattaggcaaaaaaaaaaaaaaaaaaaaaaaaaaaaaagaaagaggtaaaaggcacccatattggaaaggaagaggtgaaaatatctatattcacagatgacatgatcttatacaaagaaaaccttaaggaatccatgataaactattaaaacgagtaaacgagttcagcaaggtttcagaatacaagattaatgtgcaaaaatcaattgtatttctgtacactagcaatgagcaatctgaaaatgagattaagaaaacagttcactcacaatataatcaaaataccagaatacttaaaaataaatttaacaaaagaagcgtaagacttgtatgctgcaaaccacaaaacactgtggaaagtaattaaaaatctaaataaatagaaaaacatcccttgttcatgtactagaggactcaatattgtcaagatggaaatactccccaaagattgaaggaaatccctatcaaaatactggctgttttcttagcagaaaatgaaaatctgaccctaaaattaatatttaaatacatggaacctaggataaccaaaataatattgagaaagaaaaacaaagtcggcgtacccatgcttcctgattccaaaccttattacaaagcagtggtaatcaagagtgtatggtattggcataaggacaaacagatcaataaatggaatactattgagaatccaaaagttaactcttacatttaagaccaattgactttcaaaagtgttgctaagacatttcaatgaggaaagaatagtcttttcaataaattgtactggaaaaattggatatccacatgaaaataaaagattttggaccacttcaaacctgcaaaaaaaataaaatgatctcatggtgtatcatggatctaaatgctatagagctaagatgataaatctcagaagaaaatatcaaagtaaatctttatgaccttgaagtaggcaatggttttttggctataacaccaaaagcacaagcaataagagaaaaaaaatttttttaaaaaaacccttgattattttattaaaattttgttgtgggtacaaagtaggtgtgtatatttatggggtatatgagatattttgatacaggcatacaatgttcaatgatcatattaggataaatgaagtatccagtacctcaagcatttatcatttgtgttacaaacaatccaattatactcttttagttatttttaaatgtacagtacattattattgtagtcattcccttgtgctatcaaatactatatgttattcattctatctaactatattattgtacccattaaccatccccactcccctgcctcccagctacacttcgtagcatctggtaaccatgatttcctcttatctccatgagttcagtagtttcagctcatggagatagacagaactaattttattagctcccacaaattagctcccatgtcagaacatgtaaagtttgtctttctgtgccaggtttatttcacataacataacgaactctagttccaaccatgttggtgcaaatgacaggctctctcttttttttttttttttttttttttgagatggagtctggctgtctcccaggctggactgcagtggtgcaatctcagctcactgcaagctccgcctcccaggttcatgccattctcctgcctcagcctcctgagtagctgggactacaggcacccgccaccatgcccgactaattttatatatatatatatatatatatatttattattattatactttaagttttagggtacatgtgcacaatgtgcaggttagttacatatgtatacatgtgccatgcaggtgcgctgcacccactaactcatcatctagcattaggtatatctcccaatgctatccctcccccctcccccaccccacaacattccccagagtgtgatgttccccttcctctgtccatgtgttctcattgttcaattcccacctatgagtgagaacatgcggtgtttggttttttgttcttgcgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaataatgccgcaatgaacatacgtgtgcatgtgtctttatagcagcatgatttatagtcctttgggtatatacccagtaatgggatggctggttcaaatggtatttctagttctagatccctgaggaatcaccacactgacttccacaagggttgaactagtttacagtcccaccaacagtgtcaaagtgttcctatttctccacatcctctccagcacctgttgtttcctgactttttaatgattgccattctaactggcgtgagatgatatctcattgtggttttgatttgcatttctctgatggccagtgatggtgagcattttttcatgtgttttttgggtgcataaatgtcttctttttagaagtgtctgttcatatccttcgcccactttttgatggggtcgtttgtttttttcttgtaaatttgtttgagttcattgtagattctggatattagccctttgtcagatgagtacgttgcgaaaattttctctcattttgtaggttgcctgttcaatctgatggtagtttcttttgctgtgcagaagctctttagttgaattagatcccatttgtcaattttgacttttggtgttttagacatgcttttggtgttttagacatgaagtccttgcccatgcctatgtcctgaatggtaatgcctaggttttcttctagggtttttatggttttaggtctaacgtttaagtctttaatccatctcgaattgatttttgtataaggtgtaaggaagggatccagtttcagctttctacatatggctagccagtttttccagcaccatttattaaatagggaatccttgccccattgcttatttttgtcaggtttgtcaaagatcagatagttgtagatatgcggcattatttctgagggctctgttctgtttcattgatctatatctctcttttggtaccagtaccatgctgttttgattactgtagccttgtagtatagttagaagtcagggagtgtgatgcctccagctttgttcttttggcttaggattgacttggggatgtgggctcttttttggttccatatgaactttaaagtagttttttccaattctgtgaagaaagtcatcagtagcttgatggggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgaaagttggattcctaggtattttattctctttgaagcaattgtgaatgggagttcactcatgatttggctctctgtttgtctgttattggtgtataagaatgctgtgatttttgtacattgattttgtatcctgagactttgctgaagttgcttatcagcttaaggagattttgggctgagacaacggggttttctagatatacaatcatgtcatctgcaaacagggacaatttgacttcctcttttcctaattgaataccctttatttccttcttctgcctaattgccctggccagaacttccaacactatgttgaataggagtggtgagagagggcatccctgtcttgtgccagttttcaaagagaatgcttccagtttttgaccattcagtatgttattggctgtgggtttgtcatagatagctcttattattttaaaatacggcccatcaatacctaatttattgagagtttttagcatgaagcgttattgaattttgtcaaaggccttttctgcatctattgagataatcatgtggtttttgtctttggttctgtttatatgctggattacatttattgatttgcgtatattgaaccagccttgcatcccaaggatgaagcccacttgatcatggtggataagctttttgatgtgctgctggattccgtttgccagtattttattgaggatttttgcatcaatgttcatcaagcatattggtctaaaattctcttttttggttgtgtctctgcccgtctttggtatcaggatgatgctggcctcataaaatgagttagggaggattccctctttttctattgattggaatagtttcagaaggaatggtaccagttcctccttgtacctctgatagaattcggctgtgaatccatctggtcctggactctttttggttggtaagctattgattattgccacaatttcagatcctgttattggtctattcagagattcaacttcttcctggtttagtcttgggagggtgtatgtgtcaaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcagtctatcaattttgttgatcctttcaaaaaaccacctcctggattcattaattttttgaagggttttttgtgtctctatttcctttagttctgctctgattttagttatttcttgccttctgctagcttttgaatgtgtttgctcttgcttttctagttcttttaattgtgatgttagggtgtcaattttggatctttcctgctttctcttgcgggcatttagtgctataaatttccctctacacactgctttgaatgtgtcccagagattctggtatgttgtgtctttgttctctttggtttcaaagaacatctttatttctgccttcatttcgttatgtacccagtagtcattcaggagcaggttgttcagtttccatgtagttgagcggttttgagtgagattcttaatactgagttctagtttgattgcacggtggtctgagagatagtttgttataatttctgttcttttacatttgctgaggagagctttacttccaactatgtggtcaattttggaataggtgtggtgtggtgctgaaaaaaatgtatattctgttgatttggggtagagagttctgtagatgtctattaggtctgcttggtgcagagctgagttcaattcctgggtatccttgttaactttctgtctcgttgatctgtctaatgttgacagtggggtgttaaagtctcccattattaatgtgtgagagtctaagtctctttgtaggtcactaaggacttgctttatgaatctgggtgctcctgtattgggtgcatatatatttaggatacttagctcttcttgttgaattgatccctttaccattatgtaatggccttctttgtctcttttgatctttgttggtttaaagtctgttttatcagagactagaattgtaacccctgccttttttttgttttccatttgcttggtagatcttcctccatccttttattttgagcctatgtgtgtctctgcatatgagatgggtttcctgaatacagcacactgatgggtcttgactctttatccaatttgccagtctgtgtcttttaattggagcatttagtccatttacatttaaagttaatattgttatgtgtgaattttatcctgtcattatgattttagctggttattttgctcgttagttgatgcagtttcttcctagtctcgatggtctttacattttggcatgattttgcagcggctggtaccggtcgttcctttccatgtttagtgcttccttcaggacctcttttagggcaggcctggtggtgacaaaatctctcggcatttgcttgtctgtaaaggattttatttctccttcacttatgaagcttagtttggctggatatgaaattctgggttgaaaattcttttctttatgaatgttgaatattggcccctactctcttctggcttgtaaagtttctgccgagagatctgctgttagtctgatgggcttccctttgagggtaacctgacctttctctctggctgcccttaacattttttccttcatttcaacttttttgaatctgacaattatgtgtcttggagttgctcttctcaaggagtatctttgtggcattctctgtatttcctgaatctgaatgttggcctgccttgctagactggggaggttctcctggataatatcctgcagagtgttttccaacttggttccattctccccgtcactttcaggtacaccaatcagacatagatttggtcttttcccatagtcccatatttcttggaggctttgctcgtttctttttattcttttttctctaaagttcccttctcacttcatttcattcatttcatcttccatcgctgataccctttcttccagttgatcgcattggctcctgaggtttctgcattcttcacgtagttctcgagccttagttttcagctccatcagctcctttaagcacttctctgtattggttattctagttatacattcttctaaatttttttcaaagttttcaacttctttgcctttggtttgaatgtcctcccatagcttggagtaatttgattgtctgaagccttcttctctcatctcatcaaagtcattctctgtccagctttgttccgttgctggtgaggaactgcgttcctttggaggaggagaggcgctctgctttttagtgtttccagtttttctgctctgtttttccccatctttgtggttttatctacttttggtgtttgatgatggtgatgtacagatgggtttttggtgtggatgtcctttctgttttttagttttccttctaagagacaggaccctcagctgcaggtctgttggagtacccggccgtgtgaggtgtcagtctgcccctgctggggggtgcctcccagttaggctgctcaggggtcaggggtcagggacccacttgaggaggcagtctgcccattctcagatctccagctgcgtgctgggagaaccactgctctcttcaaagctgtccaacagggacatttaagtctgcagaggttactgctgtctttttgtttgtctatgccctgcccccagaggtgaagcctatagaggcaggcaggcctccttgagctgtggtgggctccacccagttcgagcttcccagctgctttgtttacctaagcaagcctgggcaatggcaggtgcccctcccccagcctcgctgccaccttgcagtttgatctcagactgctgtgctagcaataagcaagactccatgggcgtaggaccctctgagccatgtgcgggatataatctcctggtgcgccgttttttaagcccgtcagaaaaacgcagtatttgggtgggagtgacccaattttccaggtgccgtctgtcacccctttctttgactaggaatgggaactccctgaccccttgcgcttcccgagtgaggcaatgcctcgccctgcttcggctcacacacggtgcgctgcacccactgacctgcgcccactgtctggcactccctagtgagatgagcccgctacctcagatggaaatgcagaaatcacccgtcttctgcttcgctcatgctgggagctgtagacctgagctgttcctattcggccatcttggctccagaaaaaaaaattgttaaattggacttcatcaaatttgaaatttttgtgctgcaaatgataccatcaagaaagtgaaaatctcacccacagaatgagagaaagtatttgcaaatcatatatctgataagggtattgaatttagaatatataaagaactcttgcaactcaatataaaaagacaacccaattttaaaatgggcaaagtatttgaatagaaatttcttgatagaagatatacaaatttaaaaatgctcaacatcattagtcattagggaaatgcagatcaaaaccaaattgagataccggtttacacctattaagatggctatagaataaaagaacaaataacaagtattggctttaatgtggaggagccagaacccttatatattgctggtaaaatgtaaagtcatgcagccctttgaaatacagtctgcaagtctttaaaaaattactatttgttatttggtttttcttcacttttaatttaggttcagaggtacatatgcaggtttgctatatagctaaattgtgtgtcacaggagtttagtgtacacattatttcatcacccaggtaataagcatggtacccaataggtagtttttctatcctcaccctcctcctaccctccaccatcaagtaggccctggtgcctcttgttcttttctttgtgttcatatgtactcaatatttagcttccacttatcagtgagaacatgtggtatttggttttctgttcctgctttagtttgcttaggatactggcctccagattcatccacgttgctgcaaaggacatgatctcattctttttgcatagtatactatggtgtacatgtatcaaaaatgttactgtttgacctagtaattctattccaaggtaaatactcaagagaaatgaaaacatgtccacacaaatacttgtacacaaatgttcattgcagcattatttataatagccaaagagtggacgacaaatgtcttccaaatgtgggctccaaatgtccaccaactgataaatggaaaaacaaaatgtggtatatccatgccatggtttatctgtcaataataagaaatgaagtactcatacatgctccaacatggatgaaccttgaaaacattatgctaggtgaaaaaagcaactcacaaaagactacactgtatgattttatttgtattaaatgtccataaaagaaaaatatttagagatagaaaggaaattagtttttccagggtctgggaggagacagtatgaggagtggctgctaatgggtacaggatttctttttggagtgatataattgctctaaaattagtttgcagtaatagatgtgagtatgctaaaatgggtgaattttatagtatgtgaaatataactcagtaagcccattaaaaacaacctaattaaattaaaaccaagctataacagaaatattatatggctttggcagtttagaatagtgggaaaatatggagtaagggtggggaaatagtcccaagtataattctggttttgtcactactagtgtatggacttggacaagtcatttgctttctctaagtatcagtttgcatatatgcaaaatagaggtaatgatacctacctcagtggtaccttttcaaaaccttgttcttcctcatctctcctctaccactttctcataatattattacagtaataaccatttattaagcactgtgtccgcagtggtgtggggctgctttacctccacaacttcactgaatcctcactgcagtcttgtgggatctttatttctttgcccattttacatgtaaataaattgaagtcaaatgagttgttcaaggtccttctgttagcaagtggcagagatggacatgaaaactagatcttctacctatgtgtctttccacttcaactaaagaatttattaaagagaattgaaaagctatgaactaaatttcggtaatacttttaatagtaaacattgctgccctcgtgaatgaacacacactaaatttcaaatctcacggtggcagggaataaagatgctacctatcttaagccattacttcaccaacttctccaccaaaatattccttgtaaccacaaataagtaagcacaatagatctataaggagagaataattgtgaactctgattttatcttaaaaagtcatgtagggatgtcatgttccacaatgtgattaataaaatatattttgttactaaacacaaggaaaaatattatgttccataaagatgtttggtggttgcctcgacctcttttagtttgaaaagtaggtatgtatgagaaagatatgtgtttacatgtttacccttgccttctctctgtctcttcccctctctctccctccctccccaacccctatgccctacacccccgcaacccccacatgtatttacctttctctaaaagctctgcatagccaagaaaagtgctcttttttatttttaggatattagatatttcattttcttatggtaagacaaaagattaaggcaaccaagacttacaatgtgcctaccatgtggcaggcacagaggcaagggcttttacatgttatttaatgtaattgtaattctcacaaaagccgtctagagttgaaaatatttccaactctaaatgaggcaaatggagcacagagagccttaattatttcacccaaagttcagtggtagaggcaggattccaacccaggtctggtgggctccaaatccttgttgggttgccattcctcttgctaacaaataaaactggtctgtgacttttgcatttcaccccgcttccacagtcactggtgggacttacttaagttaatcagattcttcaaagtatccccaagtcctcctttgaaaagaaagttgggggacaggaggaggagcagaggagaggagataaaaaggaaaggagtcagggagagagagagagagagagaaacctggtgatctcagctgggtgccaaggtttcctaagcccaagttccccatggttgagcctgtattgtcaggccaacagcttctagtaatccacttttatttaattaatagtgaaactgttgaagaattgcaagtggtgttctggttcagaaaccttccgttctatggggcactgcttttgcttcagattcataaaaccaaatgctctgcctcaagataataagtgaacgtgtaaccctcgggaggtaagaaaaaacacaatgtcacgtgcaaattctgcacttgttctcaaagcaaacctctcctgtgtttgcaattaggatgttatctaggagcatattcaaaacttttgaggtttttattttagtttttctttcattatgtgctgttttagtaatatcaaagaatacatgtaatatataatttatatgtcataacaataaaattaatgttgatgagcccagattaaagaatcaacaacattaacatcatgattgcatcaaccctattagaatggaagctctgtgaaggcatggatttttgtccattttgttcactgctatatccccaggacctagaggagtgtcagccacataataggagcttagtcaatattttaaaaataagagcataaatctacttatatcctctttcctcttaccatcactcccagcctcccctcagaggtaaccactatcctatatttgggctttattattcccttgcattttgataagttttcacatgtatattcccaaataatatattgcttgcttttgcttctttttaaactttatataatggaatcatattgtatgtatcctattgtgaattatgtcttttacacaacattagtatttgagattcaactatgtgtagctcgattccattccttttcattgctgattgtagtttattggatatgtgtgccataaattatttttctcctgtcagttaatgtttatcatttatgctttaataaacaaaactgctatgactgttcctgcatgtgcctcctagtacatatgtgaccaactttctctaggatataagcctgagagagggactgcagttggaatttacatttccaaagcccaaagtttagctcatgagtcagagctgcaatgtgccctttgtccacactaggtcaggatcagtgggagtgctacccaaaatattttgctagctggggagtcagggagaagcagagactgacctagtgaggccaggaggcactatctcaggtctctagtcaaaatgggttgcaattagtaaaagtccagattctgaatccccttcactatttatcttcctcttcctcctttacagttatttttgttcaaggtgcactttattaaactcatgcctaacaaacaaaactctaatgaatattttgtctttcattgattgtaaattcaattaattagattgcttgaaaaaattttaactgtattttcactttagtatggatgaaaatttcgatttctttaaaaaacattttttaataataacacaacataaagtctaccctcataacaaaatttaagggcacaacaccatattgttttttttttattttattattattatactttaagttttagggtacatgtgcacaacgtgcaggtttgttgcatatgtatacatgtgccatgttggtgtgctgcacccattaactcgtcatttagcattaggtatatctcctaatgctatccctcccccctccccccaccccacaacagtccccagtgtgtgatgttccccttcctgtgtccatgtgttctcaatgttcagttcccacctatgagtgagaacatgtggtgtttggttttttgtccttgccatagtttgctgaggatgatggtttccagcttcatccatgtccctacaaaggacatgaactcatccttttttatggctgcatagtattccacggtgtatatgtgccacattttcttaatccagtctatcattgttggacatttgggttggttccaagtctttgctattgtgaatagtgccgcaataaacatacgtgtgcatgacaacaccatattgttaactgtaggcacaatgttgtacagcagacgtctagaactttttcttcaggcttaactgaaactttatagccattgaacagcaacactccatttccgtttcttaaaggtcctttacaaaatgagctttctgcgtgtttccattttgtttatctgataacttttttttctttttttattatactttaagttctggggtacatgtgcagaatgtacaggtttgttacataggtacacacatgccagggtgtttggctgcacctatcaacctgtcatctacattagatatttctcctaatgctattccctcccttgcccctcacccctcactggccccagtgtgtgatgttccctagcctgtgtccaagtgttctcattgttcaactcccacttttgagtgagaacatgcagtgtttgattttcttttcttgtgttagtttgctgagaatgatggtttccagcttcatccatgtccctgcaaaggacatgaactcttccttttatatggctgcacaatattccatggtgtatatgtgccacaatttctttatccaatctatcattgatgggcatttcagttgttccaagtctttgctattgtgaatagtgccacagtagacataagtgtgcatgtgtctttatggtagaatgatttataatcctttgtttatatacccagtaatagaaatgcttggtcaaatggtatttctagttctagatccttgaggaattgccacactgtcttccacaatggttgaactaatttacactcccaccaacaatgtaaaagcgttcctatttcttcacatcctctccagcacctgttgtttcctgactttttaatgatcacgattctaactggcgtgagatggtatttcattgtggttttgatttgcatttctctaatgaccagtgatgatgagctttttttcatgtttgttgaccgcataaatgtcttcttttgagaagtgcctgttcatttccttcacccactttttgatggggttgtttgtctttttcttgtaaatttgtttaagttcattgcacattctggatattaattaacctttcgtcagatggatagactgcagaaattttctcccattctgtaggttgcttgttcactctgatgatcgtttcttttgctgtgcagaagctcttgagtttaattagatcacatttgtcaatcttggctcttgttgccattgcttttggtgttttagtcatgtagtctttgcccatgcctatgtcctgaatggtattgcctaggttttcttctagggttttcatggttttaggtcttacgtgactcatcttgatttaatttttgtgtaaggtgtaaggaaggggtccagtttcagttttctgcatatggctagctagttttcccaacaccatttattaaatagggaatcctttccccattgcttgtctttgtcaggtttgtcaaagattagatggttgtagatgtgtggtattatttctgagacctctgttctgttccattggtctatatatctgttttggtaccagtaccgtgctattttggttactgtagccttgtagtatagtttgaagtcaggtagcatgatgcctccagctttgtgcttttggcttagaattgccttggctatgcaggctctttattggttccatatgaaatttaaagtagtttttttataattctgcgaagaaagtcattggcagcttgatggggttagtattgaatctgtaaaacactttgggcagtttggccattttcatgataatgattcttcctatccatgagcatggaatggttttccatttatttttgtcttctcttatttccttgagcagtggtttgtaattctccttgaagaggtccttcacatcccttgtaagttggattcctacatattttattctgtttgtagcaattgtgaatgggagttcactcatgatttggctctctgtttgtctgttattggtgtataggaatgcttgtgattttcgcacactgattttgtatcctgagactttgctgaagttgcttgtcagcttaaggtgattttgggctgagagaatggggttttctgaatatacattcatgtcatctgcaaacagagacaatttgacttcctgttttcctatttgaatatcctttattgctttctctttcctgattgccctggccagaacttccaatactatgttgaataggggtggtgagagacggcatccttgtcttgttctggttttcaaagggagtgcttccagtttttgaccattcagtatgatattgggtgtgggtttgtcataaatagctcttattattttgagatatattccatcaatacctagtttattgagagtttgagcatgaagcagtgttgtattttgtcgaaggccttttctgcatctattgagataatcatatggttttgtcattggttctgttgatgtgatggattatgtttattgatttgtgtatgttgaaccagccttgcatcccaggggtgaagcggacttgatcgtggtggataagctttttgatgtgctgctggattgggtttgccagtatttttttattgaggatttttgcactgatgttcatcagggttattggcctgacgttttctttttttgttgtgtctctgccaggttttggtatcaggatgatgctggcccataaaatgagttagggaggattccttctttttctgttgtttggaatagtttcggaaggaatggtaccagctcctctttgtacatctggtagaattcatctgtgaatccttctggttctggactttttttggttggtaggctattaattacttcctcaatttcagaacttgttatagttctattcaggtatttgacttcctgctttaggcttgggagggtatatgcgttcaggaatttatctatttcttctagattttctattttatttgccccagaggtgtttatagtattctctgatggtaatttgtatttctgtgggatccgtggtgatatcccctttatcattttttattgcatctgtgattcttctctcttttcttctttagtagtctggctagtggtctatctacaaaatagactgtttatctgatatttattttgtaattatctaataataaccatcattatcatcatcagcattatcattatcatctcctttacccatacatacatttgtgtctttcaaataataatcccatctttgaagtgcatcctcatctttagcagtctgcactctgctttcttatatcatttattatcttattttataattatttatttccagtccttcttctctaacagatagtagtttcttagggccaaggaaatatctcgatcaccactatatccccagcacctaaccctgtgcctggtccatagggccagatgctaagagttgagttgaaccattgtacctaatcttaaccttcattagcacaacatggtttgtcagtggttaagaatctacactttggagtcagactcacccaggatggaatcctggcattgccacttattattaatagatgcgtgatcttgaacaagtttacttaattgttctgagcatcagtttcctcttctgcaatatagggatgatacacagctacctggtaggttgttgggaaaattaaatgggatgatatgtatgaaatggcctggcatatagagtgcctaaatacatgttcttctgattctatttggacagtttgtgttagtaacagaagtcaaaaaggtggagaaaggagaaaggtacttgtgaaaattttctatttcttctccatgtttcattcaggactgaggaagggggcacagtttttacccaaggaaatgacatttttagccaaaagaaatgatcttagcatttagctgaattatatattggaagtaagctccttccatgtggaacttatggccttgctagccttggtttgttggaagtgctcttgctggctttctagttagggtagggaaaggaaggcttgtggggaatgaagataggccatgatatcaagccactgggtttgcaaatcagtagaattttttattgctttctgttgtacttgggacttgaataaaggctgatatttgtgtcttgctggtaaagtgcttgtaaagtgagtgaaagttttctttgctcttgtcctgacatagctgttcacttggggttgaggggaggataacctttcatgttttttttttttcttcattctgatgactgtgctgaacattcaaaccaaaaggccattggtggaaagtaaaggtgagtggtgagaagacaatagggtaatggaaactgtgttggacttgtaatcaaattgtcctgcacttcccctctccaagtcttaacgtttttcatctgtacagtggatattaaaatgagaaaataagcttgtcttcacagagttttcgttaggtgttgacacaacaaacaggctcccattagggctcattttccttcattccttagtaaggaagaagtgcttataaaatatagcagttgtgctcttgtgaatgatagcatgggcagttgtcatctccctgaagcagatgtaacccagaatgtcacttgagttttgtttaatgcttaggcataagacataggaatgacaaaagctgacctttgggtagtgagaacaatgttccattttgttcaaacttgaattttttactataggagactgagaattaaccttccatgaaggttttaggattggctttctggcccttctccttcatatccacctgaaagagcttgggcgcagaagttcttgcagaaaggcagttagacaaggtgacttctgaagctccagtggccaagtattttgatggtagcctaaaagatgtccagaatcattgtacatcattttttcaacagaagcttcaggcatagggattatgcttggtactttatgttgtggaatggaatctggcggatgtccatgtgatctatagaaacacctaaggaaagtgaagaaatgagggaaaaaaaagaacaagacttttatgataatactaatcacgatccttgtgtatttattccaatggcattttatccattatctgatttatattaccactcacagcagcagctcaataggatgggagatattatctctattttatagatgagatttgaggctcacgaagctaaagcaaggaacatcaaatcactttgatatttggtctggttttgttataggtctccctttggatgaggtaaagttacaaacctgggttcatatcatttaattagtctgaaaatgttgcctggacaccaccttcagttagatatcttaacctcaggcttcctgccttcattgctcccgcatatagacatagactatgagattggctaatcccagagaacttccctaatcccttggcaagatccaaaaaggctcagtcacaccctacaaccatcatctttaggagaagtctcagaaaattcagcttcacactaactaacttgagcaatgaataatagtcatttatgcctgcaggttaatgctgaagacctgagacttcacttgcctatttctgccattcagtgacatgtgttgcattggttttttgtgtctttccagtttggagactgccagggaccatgttttgcccattgactattactttccaccccagaagacctgcctgatctgtggagatgaagcttctgggtgtcactatggagctctcacatgtggaagctgcaaggtcttcttcaaaagagccgctgaaggtaaagggtcttgcacatgcacttctctttccctttctcctttaccttccagagagagacactaacctttcagggcccaggattttatcatctcagaaatagagtcattggcaaggccctatcaaataacttaggagcctaaggaagcaaatttttgtacttgctagttccctggtttcagcagccttgtttgtacaggcaatttaggcagtgaaggtggtcccagctggggcttggggctcagtgggtcctagaaatgaaagaaaaattaatgatttgaaaagatttaatttcctcccttcttgttttctactctgctggctagtaaaggaaaaatttgtccttattagagaggttagaagtggagaaaccccaactgagtccccagcctgttccttgggatgaatatgagactgttccttagcaaaggcttcctggcctcggccccagaaagggagtgttctcactcttcagcagactatcagtctctgcacctgctccctcctgttgtggcctccttgggacctgtctttgcattaatagttcctaggtaggtaagaactcagagtgaagaaacacatttattctcctctccagagacctgatctcaaagcctgtccattagtccctaaccttaatctaaggtagcatcttatatctggctaaattggctcaagccctagctccttagttttatttagcttagaacaactcatgtctgctcaacctctagaggcgctcagcccacattctgcagtagaaactcccattttcaggcctcttatatacggtaatgtctccttcctctaaccacccagggcttaagcttcctgcttatccacttcaccctgtattgagggctttcttctcaaagagacattgatgaggagcccctagagagagatgctgtgctctgggaccagaccccttgttaaacaccagtattcacctctgccccaactttccccaaagaggtacttcctgccaaggcctttctctttcctctcactggctggaagtgttgagttccacttcagaaccagaacagagaacctttccttctataagagctataaaccttgagaacagtcttaaaacataggtatgtaggccacaccattcaccacgaatgtactgatactcatcagaatatggaagaagcaccagagagtttgaagcatctagagaaaaggtagaaagagaatgccctttaactgacctcctcagtgatagccaatcacaatgatgagtgttgattcatcattttggctaggtggcagaaatatctataaaacagaagctgccatgttgttttcttccagtcctcagggcctacaagaaggcagctatcatttggtattactgaaaacatgccccatgttcagctcatacccccaaattacccattgctactgtttatgctgggctaatatgaagcccagggccctaatgtctaggtctaggcagtaaggcctagagcagtgcctaaagagcctgagagcagtgccttcctttcttcagagtactcatgaaaggatggctgtcagaaaaggaaatgaggatgggttccagagacttcagaccaccccaacttccccagtgagaccctggcacctccccataccctctcacctagcgggccctgtctatagagcagagaatgaaacagagcactcatctagaggtagtgtgtcagcaagcccaggcactgcaccacagtaatagcagccatatcagatgggaaaggagttcaagtgaacaaacaagcaaattcaatagtcagatagattagattatacttgatgcttcctctgagttttacaaatatgggtcactaaattgttattttcagaaaacaggggaaatgctcaatcacattgtgaaagggaagattttgctgtcatatcatacatcccacatgggagctttctgcagaagttagagctgaaggagggaggcaggcagaagggcaactggcagggctgcctgggaggagctctgcaatgaggtggatcctgtgccatttgagaacagggaagaaaagaaatgaggttttggggagggaatcacccaactcacagaacacacagaaatccagcaaggtttcaaaacgctctacaccttagagtctgttaagttagggaaactctgtgagctcatagggccaaatgcacttgcctgcttgaaatatgaaaaatcagcaatggattccttgaaaaacaatgaaaagggaaccttctgagccccttggttattttgacatatggaccatagatttcagtcctgagccctttgaaggtaggagaaggtggtttagaaaacacacacacacacgcacacaaacacacaccagaatgaagcaaaaaaaaaattactggtgttttctttctcctcccatctgtgaagctgttggattgattttactgccatcattatccctgtttgaaggcagggggctgtcttattacccaaagaggacatttattgatttggttttctttttccatttttacaatgcatctttatcgcccatatggcctttctggaggtggttttcagtctggcttgttgaaacatcaaattatacctgtcttagagaaaatagaaacaaaaatctttctcttccttacttgcttgttgtagtcagttaactcggactgagtattcagagtcttgattatcacttaattcatagtttcataaatctctggaatgggcataggtacaggacttaaaagcctggcatctcagacagaaatatgtttttagctttggtggtttataacagatgggacttttaggctgtcattggtgcagggctcagcacagagtcagttgtaatctggacaggttttgttgttgaggaagagtgggaagagggagtcctacattttctccttgtcagtaatgttggagaattggggtgagggtgaggctgggcagggagggtctgcatagaaaaaagggtgcggtgagaaaaaataatgctactaagccatgagggtaaaatgaccaaattctggttgagagaaacttggtcaaagtgtgtatggggagagaaagttggtcaaagtctgtgtctgagtgcttggtgggatgaactctgggttagaaacaggcatggagggaaatagttggtttatggagtgggtaggatgagtggggtggtgaaagggaaggcattttggatgctaagagaccaggaagtcaaagcaaggcaatacacataaacagaggtaagggctcagagaggttttagttgtgtagacttggataagaaattttcccttttggacctcagttttccttgtttgtaaaacaacggacttgaactagatattttaaaatgtgcttccagcttagacattttgtgaccgttctacaaattacaaacataatcatcatcatttcagcaaactcacatgtatttatacctgcataagtttttggtcttgctttcctagaaggtgactaatcccagatcctaatcaattaaagaagcaatcttcagatggggatagagccagctgagagagtgtactatggatggagtgagttaaaactcaggactcagattttctccttgtgatcattgctgggtaacttcctttcttttctattttctcatctggaaaatcaggatatgaatccccatctctacctcattatgtttcaaagagggttaattaatccatcatgtgcattatgtgctcaagaatttactatttttcagacattttctagtaaaacattgaagattatatgtccatttgttttgtacacatggagtgctgtttggtacacatcataaaattgaaactgtagtttacattctgaactcaaagaattacaccatcctcactgatgtttacaataggtcccaatttagtttctttagcaaattttatgtaagtatggctttgattctctctctcactccaggtttttgttagggaagaaatgcaagtgaaccctcattgaactctttctgtcctttaaatccattctttcccacctcaactcatgtggaattgaatgttgcctctagtttggagtctagcagagagtttttggtgcatatcagtgtccccttcactccctgacttttcaagtaacatttcccagaggcaaattaactctgctaagaggatctgcttgcagcttcaacagagccttcatcaggtatctttggccaaggagttgactgatcctgactttgcgagtcctagagatcttttcacaaagctcctctcatgtttctgcctctgattttcttaaatgtcacagacagactttagatttaggggttggttaactttttttgtaaagggccatgtagtaaatattttaggctttgtagatcatatggtctctgtgtcaactactcaactctgcctttgtaggatgaaagcagccatagacaatactggaactaatgggagtagctgtgttccaataaaactttatgggcactgaaatttgaatttcacttaattttcacatgtcgtttaatattatttttcttttttaccatttaaaaatttagaaatcattcttagctctttgggcctcacaaaaacagatggtagagtggatttggtttatgggctgcagtttgttgacctgtgctttagctaatcacttctgtacttataaatctgcataggttttatgtttttccatctcttggtatcttagtaggccagtcaaagtttgaacaacttgttagcacagaatacctggcctagtggcttcttggtcctgagcttatttactaaacaagagaaaaaataaataagtctagaaatgctagaagaggatacttttttgttttaatgatctagtagatcactcctccttgcaatacccagaggagaaactgaaaatatttcaaacattttctagacttctgtgttgtaaatttgtggataactatgaactatatatgaatgaacttttctggatgacacatatattccagatggtaaaaaggaagggctttggggactctctggtaccaagtgtcatggaaaaactgtgtgtctcatagaaagtagatcccaggaggccagcagagttgtggatctgccatatattacctcatgattctgtcttcgcacactcaccggcttaattctgggcctccccataacacgactagaccacaggcttgcagaagaaataatttagctctgtaactcattgaagttggtgcccacccaagtctctgtcagtgcccaattcgggagccatgccaagaatttgccattgctgcttcatggtggccttgtgcctgcttatttatagcctgtgcattttatgaaacagggattaataagaagttgccatagcacttgcaccattatgtaaatatctgtaatgcttacataacttttgtcacttgcaagaccttttgagtccattgccttctgctaccatgccttaccaatttcctagtcccttattattatttttcaattcattatatttaacttctgtgatacacgttcagaatatgcaggtttcttatataggtatacacgtgccgtggtggtgtgctgcaaccaacaacccgtcatctacattaggtatttctcctaatgctatccctccactagcccaccaccccctaataagccccagtgtgtgatgttcccctccctgtgtccatgtgttctcattgttcaactcccacttatgagtgagaacatgcagtgtttggttttctgttcctgtgtttgttttctgagaatgatggtttccagcttcatccgtgtccctgcaaaggacatgaactcatccttttttatgactgcatagtattccatggtgtatatgtgccacattttctttatccagtatatcattgatgggcatttcggttggttccaagtctgtgctattgtgaatagtgctgcaataaacatacgtatgcatgcgtctttatagaagaatgacttataatcctttgggtatatacccagtaatgggatggctgggtcaaatggcatttcaggttctagatccttgaggaatctccacactgtcttccacaatggttgaactgatttacacccccaccaacaatgtaaaagtgttcctatttctccatattctctccagcatctgttgtttcctgactttttaatgatcgccattctaactggcattgacatggtatctcactgtggttttgatttgcatttccctaatgaccagtgatgataagctttttttcatatgtttgttggccgcataaatgtcttcttttgagaagtgtctgttcatatccttcacccactttctggtgtggttggttatttttttcttgtaaatttgtttaagttccttgtagattctggatattagccctttgtcagatggatagattgcgaaaattttctctcattctgtaggttggttgttcactctgatgatagtttcttttgctgtgcagaagctctttagtttaattagatttcatttgtcaattttggcttttgttgccattgcttttggtgttttagccatgaagactttgcccattcacaattgctacaaagagaataaaatacctaggaatacaactcacaagggatgtgaaggacctcttcaaggagaactacaaaccactgctcaaggcaataagagaggacacaaacaaaaggagaaacattccatgctcatggataggaacaatcaatatcgtgaaaattgccatactgcccaaagtaaattatagattcaatgctatccccattaagctaccattgactttcttcacagaattagaaaatactactttaaatttcatatggaaccaaaaagagcccatatacccaagacaattctaagcaaaaagaataaagctggaggtatcaagctacctgacttcaaactatactacaaggctacagtaacccttatcaattttttatgtgcctctccatattctgcagtcagaagcttcttcagtcctttcagggaattgctgggtgactatcaaactctggtagttcatttttgcagttggctgctgttgtgaggataagagttagactcactttctcttcagagatagaaattatgtattaattctctgggttctagacccacagcaaggagcatactgctcctcaaaataactgaattctgcgagaagccatcattgtaaaacaacaatatcttcagttatagtagccatgtgtgcaacttctggaaactgttattcagattttcatgttccttccctgtctcttcatagctaggcagctgctttcagccttgtacagatgctagtgagctttctacctacaaacctgcagaaaattgaactgagatttggaggtgaaagactcttgataaagggaacaaggtttagaattctcagtccctttgctcccaggctgtgttgtgactactgaggcactccagtgaaatcactattcctcctatctagactaatgcctgtctctgcagagcacctcataagaacaggcctggtagtaatatcctcatgcattcagtcagtaaatatttacagagtgcttactacatatagggtattgggctgacatatgcaagatacagggcctgcttccaggaggttatagcttattgatcataaatgtggcattttttttttttgagacggagtcttgctctgtctgtcacccaggctggagtgcagtggcacgatctcggctcactgcaacctccacctcccaggttcatgtgattttcctgcctcaccctcctgagcagctgagactacaggggctcatcaccacacccagcttttttttttttttctgtatttttagtagagacagggtttcaccatattggccaggctggtctcgaactcctgacctcgtgatccacccacctcagcctcccaaagtgctgggattacaggcgtgaaaatgtggcaatctttaaagctcttcagtggatgaaaggccaccctatctgctgtccttttgaacttcgcaactttcttggtacagagtgagaggttattctcttggttttccatataagtaaactgaggctttgccagttcatcaacaggtagtaaataatatatttggaatttgaacccaagtcttctggggtcaaaggcagcattcactctgctctgtcacagcagctcctcaaataagccaacatagaaaccaagtactatgcctaggcaacaagaaaggcagcaatgaagagcaacagcagagtcaaatatgagagaaggaagttaagaaagatgttaagtactgtggggagtaactgagaaaccaccaagtatcgctaacatcacagggaacttgtcttcctaagaaaattccaagcacttaaaaccgctggtagttcatcagcaactctcttcattagatgtgcgagggacatgtgggccatagtccttctactaacttatattcttcaggggaaagttctgattctgatgagacccagcatggtagctcttaattcactgttgtcacacgactatagaacaggaagcacaacttaacacctgtgctcatgagaattttgctccttatgaccaagctaaagaaagagcttagacaggatgtgtggctataaatgtagattaatggttccttggctctttggtttgagccttctcagcagagcatcccacggagtgttttccatggggccacgagcaagagaaatccacttccctcctcctcaatgtcagaaaatagagaatattgtctttcaggatagaattaaaaagtcatagaggcagcaacttgttttcctatattagggttttaaaattctgtttttccttcctctcctgggtcagatcattgtgtggatggaccttgatttcattgtggtatctgtatgtggaccctgaagaccatggacttctaacaattccttaagttacataagcacattcctacaggtcacaagctcatttacttacaggatggttgatttggtcacaggttatttcatgaaaatacttaaaagatttgcagtgttcaaaactgcagtatctttaaacactaaaacttgaaggaagggaatttagaaatcaaaaaatctggtcaaaccatttcatggaaaaggaaagtgaggctcagagagaggaaattactttcctgggtttgtatagcctataaatggcagaaatgagagcctccctgccatttctagttttctgtctgagagactctcctgcctaatagctaattagcagagtcacagaggtcattaccttgcaattctcaagaattatgtgaggcagcatagtaagcatttatggcccttggttcctagaaggagcttagtccctgatagtcatctctgcctttgccattgtgtgagactgtcttctgtaactgtatgtcttcctccctagtaagttaatgagtaataaaggtattctatagtgagaggactctgtaagacatttcttggtgtgaggattgttccaaggttgttttgtgtgtatgtgcatgtataaacttttttagggagcatattcatagcttttacatggatctcagaggctctataacccagagaagattacagaataccagtcttgtctttggtaaggattttatagacccatcctgactacagtgatatccaacatggctatgtaatgactggcactttccccacataacatatatttattccacactcagtgcctactgtgtacatgagacctataccgggcactgggataagagacatgaaataacagctaaaattgtttattgagcagtcagtatgcattagatgctttgtagtcattttcttattcaatctgtataccctcaatttacaaatgaggaaactgaggcacagaagagttgagtgatttgcccaaagtcatacaaatagtcagtggctatgtgatgaatagttaccaacataaaagagtgagattactgctgtactaaaagtaggtacataatcccctgagcagacagtatgagagaatgatttattttacctggaaagtttaggaaggcttcacagaggagttaagggttgatctgggtcttgagggatggataagagtttgccagatacaaaaaggtaggaagagaacttcaggaggagggaacaggctgagcaaagacacggcgatgtgaaagtgggaggcttgtttggggaacattatggaatctggaggttattgtggggaatctcatcagatgcagcaagctgtttgacaggccttcagttggctctttgtaccttgctccctccgcatgctgagctgtccatagctgccctaggctggtgtctgggattttcggaagaaggttactatccaggtagtgtaacaagatgcagtgcaaaagcaccagattggggctctggctctgctgctgacttaccacctggccttaagcatgtctagttccctctttgtacattaaaatctccattggaacagtaacatggttgtattaaatgatcttgaagattttacctgcacgttttgcacatgtaccctaaaacttaaagtataataaaaaaattaaaataaaaaataaaaatataacaatataaatctttaacaataattttagtagtaaatctctacaattttacagataatccagatgcatccattggccaatggttcactttgtatgcataatatttgggaaacaggcagacccaatttcaatccttagttgtaagacttaatacatatgtgatctcgagcaaatcacttttgtatgcctctataaggataataatagctcacagaattattttaagaactaaatgatgtgtaataaagctactggtactcagtaagttttgtatccttttcctagagtgagtcttggtcataggcatgcgtatacttgcagcgtccctgggtaggccgaaagagcaaataagagatggtatctatggtattccccaggtaaaggaggccttgggttggcataagatttcacttctctttagagttacttaattagggaccagaaaggccatcagcatttgtatgagaatataacaaaggtcaatctcttcctctttactttttacctcccagtacactgtgagtaacattccccagccagcccagccagcacgtgttcattgcctctcttgacttccagactttggacttgaaggtgtcagagctctctgtgtatctttgtccccaacaagataagtctgacctccccagcaaattcaagtcctaagccactgtccaggagaaaagctagcaaggtcataaattattctccatattttccagccattggtttcccttgtccagccagaggtgtgtctcaaagtatgctgaggccagattcaatagaaacctgagccagcacctgtgtaaataatttttaaagctccttttcctgaagctggatgaatatttttaaaaactaagctggattgtcttttatctagcatgccgtctcctacattcctagtgctatggacctcttggaggaatgtggtttggttatagtggtattgtcttgtctgttgtgggggagggagacatttctttcagaagcaaggtaatactttggtctggtctatgactctattttgtttaaaatgaaactatggcagtatagtggtattcattctgcttcccataggttaactttacatccctctgtcttcacccactcttcagttctgattcttttaaaagcagccaaccaaaaccagcaagtacatactgcttatctctgacttccaccagaatcaacttcagatcttgtccaaagctccatctgaagagaggggaataacacccagccaagagccctcagggcccatcagtaagtagacatcctgtccttgaggttccttaactctgctcagcttcagaatacagaaggggttggttcttcatttgtgttgtttataactaaaagcctcctactccccacttttttgcatagcttcttctgccatcccacctgtgtagcctcttcaactcccccaaaactcctctgtagcccatgtcacttggaaagagttttctttgtctcttttgcaacttgacaatgactagccagcaagtttaagttcaaattattgttccatgggagcagagatagatataggaaacaaaaaaaagggatatggaggtatagagtgatttcccacctacctagtgagcactactgagatattcaagtactctctacccaagaattctattgatataaaggtaaaaaacttgatcttaggtctaatatccgttagtagtgtgaccttgggaaaatgataccacccccaaaggcttagttttcttaactgtaaaataggcatacagatgaccacccccagaggattcataaggataacatgagataaggcaacttgaaatttcctagcatagtgatagactttcgaaaataaaatgaatcaaacactgataacagtacttcctagtacacaaatgagaaatcagtccctcatcaaattacagcacattttcaatgctccaattatgtcactgtagaaatgctaatgtggattaaataatttgtctgttgctatttatacggataatttgatagtagttatttttggacatggatagctttgaagccttacagatgagtccatccccaagtacccaaaactaaagaaagttggctagagtgatgacaaggtggcagcacagagctccctgcgttctgggccctgtcccctagctagagagaactccaggctataagcatttgtattctcatagtccaatggcagggaagaagggctggaggtgagtagttttcactcatttattttttcaacaagcatgtatggtatcaggccttgtatgcatccagagacaaatgtgaactagccgtgtcctcaaggagattccagtctggtgggcctgccttccaaggtcagttgcagctttagcactataaagagcacctacctgcggcagatacaatgtgatgggacatgacagagaaaaaatctataagcagagcctccccattcccaggcattgaaacaatcctaaccaagactggcatagtacaatgagcctgtccctatcagcaggtttggaagccttaacaacaacaacaaaaacaataataatggtgatgataatcatagagcctaatgttaccaaacattttccatgtgttaagtactatactaagtgcatacttaatcctcacaacaatgctataagatagtagatactcttactactaccctgattttacaaatgtggaaactgaggcacagaagactaagagaacaggaatacacctaattcacctcagttcaacaaacatcaagcatctgttttatgtcaggcctcgtgctggatggcagggagagagagatgagtaaagcatagtttcagtccagtgggagcaaatgacagcacacagtggggcaggtatattgcagcccttctgcttgatgctaagaactcagtgtcagtgatgaatgaaacacagtcattctctcaaagatcttaaagcttagtaggagatatctgtgtggaaacaaaaattaaatactgctgtgataagtgtcataagagataagtggaaaatgagagagagagatcactgtagcaattgattggtttaaatcaaagcccccaaaaaaatgttattgagaattataaaacaactaattgatttaaatcaaagcccaaacagaagtgtttgctaattttatttcaatttggttgataatttggttgaaatgaatttatttcattttttattccatccttacaatggaagattagtgcttgtttcccacccaaggataccaggatatttcaggggctgtattacaatatagttaaattattcctttatctcaaagcacatccacactttcccctatccttacctttactcagggtatctcttctgcctcaggtgctttttctccacatttccatattcttaagtcctaccttccttcagggcctcactcaaatgcctcctcctccatgaagcattcacccgactgaaaggtaccccgccctctcctgtactccacatcacttcatgggtgtctccacttcctgctttatctttcagtaatacacttacagttctctttcctccactagactgagctcttcagaggaagactcacttggctgaaaccatgattttactttaaacacattgaaaacctctactggagtgcattgtgtctggtgggcttcaaccttaattcttaagtatgtgaaaacacatcacctatctggaggtttacactttctgctaatgactttatttttaagcccaccaccctaacacaacaaatacttaaaacttgtcttcatttcctttaggtctggccctcatgcatgcatataatttatagagtcactgttttgctcggttgtcctcatgcctctatattattggaggtttagattgtttccatatactcaggttgtattcatgtcctttttttctttttaaatttccttagcatccatttccaccattggaaattcagggtcaaaacaggggtttgggattggagcatgtctatcacagataaccaatcatgtgttatgacttaagaatttatgaaagggccctctacctgaagatatcttgctactgatgctgtctcacagtgtctgaaactcccatcatatgtggaattgttttggaaggctttgcctcctgggacacattcagccataatcaagaaatagtattgagcattagactgtcagtatgtccattagcaagactgtggaggaatggaatcaccaatattatattttataggggatacagaatacaagagaagttctgaagagaaaattcttatgtagaataggaaggcttagatacagcatgaaagctgcaggctttgaggagccagaggtcaaatgaaagcattgagtatttgtttagatgaaagaacagaaagggaaaaagaagcagaggaagggatagtagagagaaatgtataagttttatccatttaacttgtaattgtgtttggctatgggcacaatagaagcagtgagatcactttattttattttattctttatagacagggtcttgctatgttgcccaggctgcagtgtgcagctcttcacaagtgtgatcatagcgtactacaccctcaaactcctggactcaagcaatcctcccatctcagcctcctgagtagctgggactacaagtgcacaccaccacgcccagtgagatcacttgaaactagggagagatgtgtgagttctgggcaaccagtagttggctttacatagaactgtaggggtcaaggccaaaggggacgtcctgttccaagtcaccttctttggacattagaaaaccacgaggggtttggaaatcagaaaaccagcagaggcaggaaaactcagggcagcatgggagattcagtatatacaaaaaggttcacaccagtaatcaaacagaattttaactgctgatgtggagtagaggcagctttgtctgctgtgtgataaccaaacctttacgaatagtaggtgtatatggggaattggagggagataggtggctgtgtttagtaattggttgacttcactgagatggtttggggattgtggcttccagatgatcagattttcttttttaggtagagactccaacatcattacagaactataaattacatgtggaaaagaaaggcctcctatgttagaatagaaaataaaatgctgtggggttgagggacagaggtgctgtctaggaagtcagatagcgttttccagttctgtccctcagagttccttgtcctcattgagactcaatttctcttacttttttttttatactttaagttttagggtacatgtgcacaacatgcaggtttgttacatatgtatacatgtgccatgttggtgtgctgcacccattaactcatcatttaacattaggtatatctcctaatgctatccttcccctctcccctctccccaccacaggccctagtgtgtgatgttccccttcctgtgtccatgtgttctcattgttcaattctcacctgtgagtgagaacatgcggtgtttggttttttgtccttgtgatagtttgctgagaatgatggtttccagcttcatccatgtccctacaaaggacatgaactcttcattttttatggctgcgtagtattccatggtatatatgtgccacattttcttaatccagtttatcattgatggacatttgggttggttccaaggctttgctattgtgaatagtgccatgataaacatacgtgtgcatgtgtctttatagcagcatgatttataatccttagggtatatacccagtaatgggatggctgggtcaaatggtatttctagttctagatccctgaggaatcgccacactgacttccacaatggttcaactagtttacagtcccaccaacagtgtaaaagggttcctatttctccacgtcctctccagcacctgttgtttcctgactttttaatgatcaccattctaattggtgtgagatggtatctcgtggttttgatttgcatttctctgatggccagtgatgatgagcattttttcatgtgtctgttggctgtgtaaatgtcttctttgagacgtgtctgttcatatcctttgcccactttttgatagggttgtttgtttttttcttgtaaatttgtttgagttctttgtagattctggatattaccctttgtcagatgagtagattgcaaaagttttctcccattctgtaggttgcctgttcactctgatggtagtttcttttgctatgcagaagttctttagttgaattagatcccatttgtcaattttggcttttgttgccattgcttttggtgttttagacatgaagtccttgcccatgcctatgtcctgaatggtattgcgtaggttttcttctagggtttttatggttttaggtctaacatgtaagtctttaatccatcttgaattaattttagtataaggtgtaaggaagggatccagtttcagctgtctacatatggctagccagttttcccaacaccatttattaaatagggaatcctttccccatttcttgtttttgtcaggtttgtcaaagatcagatggttgtatatatgcggcattatttctcagggctctgttctgttccattggtctatatctctgttttggtaccagtaccatgctgttttggctactgtagccttgtagtatagtttgaagtcagatagcgtgatgcctccagctctgttcttttggcttagggttgacttggcgattcaggctcttttttggttccatatgaactttaaagtagttttttccatttctgtgaagaaagtcatgggtagcttgatgaggatggcattgaatctataaattaccttgggcagtatggccattttcacaatattgattcttcctacccatgagcatggaatgttcttccatttgtttgtatcttcttttatttcattgagcagtggtttgtagttctccttgaagaggtccttcaagtcccttgtaagttggattcctaggtattttattctcttagaagcaattgcaaatgggagttcactcatgatttggctctctgttttctgttattggtgcataagaatgcttgtgatttttgcacattgattttgtatcctgagactttgctgaagttgcttatcagcttaaggagattttgggttgagacgatggggttttctaggtatacaatcatgtcatctgcaaacagagacaatttgacttcctcttttcctaattgaatgccctttatttccttctcctgcctgattgccctggccagaacttccaacagtatgttgaataggagtggtgagagagggcatccctgtcttgtgccagttttcaaagggaatgcttccagtttttgcccattcagtatgatattggctgtgggtttgtcatagatagctcttattattttgagatacgtcccatcaataactaatttattgagagtttttagcatgaagcgctgttgaattttgttaaaggccttttctgcatctattgagataatcatgtggtttttgtcgttggttctgtttatatgctggattatgtttattgatttgcgtatattgaaccagccttgcatcccagggatgaagcccacttgatcatagtggatacgctttttgctggtattttattgaggatttttgcatcaatgtttatcagggatatcggtctaaaattctcttttttgttgtgtctctgcctggctttggtatcaggatgatgttggcctcctaaaatgagttagggaggattccctctttttctatttattggaatagtttcagaaggaagggtaccagctcctccttgtacctctggtaggattcagctgtgaatccatctggttctggactttttttgattggtaagctattagttatatcctcaatttcagagcctgttattggtctattcagagattcaacttcttcctggtttagtcttgggatggtgtatgtgtcgaggaatttatccatttcttctagattttctagtttatttgcatacaggtgtttatagtatgctctgatggtagtttgtacttctgtgggatcggtgattatatcccctttatcattttttattgcgtctatttgattcttctcccttttcttctttattagtcttgctagtggtctatcaattttgttgatcttttcaaaaaaccagttcctggattcattgattttttgaagggttttttacatctctatttccttcagttctgctctgatcttagttatttcttgccttctgctagcttttgaatgtgtttgcccttgcttctctagttcttttaattgtgatgttagggtttcaattttggatctttcctgctttctcttgtgggcatttagtgctataaatttccctctccacactgctttgaatgtgtcccagagattctggtatgttgtgtctttgttctcattggtttcaaagaacatctttatttctgccttcatttcattatgtacctagtagtcattaaggagtaggttgttcagtttccatgtagttgagcggttttgagtgagtttcttaatcctgagttctagtttgattgcactgtagtctgagagacagtttgttataatttctgttcttttacatttgctgaggagtgctttacttccaactatgtggtcaattttggaataggtgtggtgtggtgctgaaaagaatgtatattctgttgatttggggtggagagttctgtagatgtctgttaggtctgcttgacagtggagtgttaaagtctcccattattattgtgtgggagtctaagtctctttgtaggtctctaaggacttgctttatgaatctgggtgctcctgtattggttgcatatatatttaggatagttagctcttcttgttgaattgatccctttaccattatgtaatggccttctttgtctcttttgatctttgttggtttaaagtctgttttatctgagactaggattgcaatccctgcctttttgtgttttccgtttgcttgataaatcttcttccatccctttattttgagcctatgtgtgtctctgcatgttagacgggtttcctgaatacagcacactgatgggtcttgtctctttatccaatttgccagtctgtgtcttttaattggagcatttagcccatttacatttaaggttaatattgttatgtgtgaatttgatcctgtcattatgatgttagctggttattttgctcgttagttgatgcagtttcttcctagcctcgacggtctttacaatttggtatgtttttgcagtggctggtaccggttgttcctttccatgtttagtgcttccttcaggagctcctgcagtgcaggcctggtggtgacaaaatttctcagcatttgcttgtctgtaaaggattttatttctccttcacctatgaaggttagtttggctggatatgaaattctggttttaaaattcttttctttaagaatgttgaatattggcccccactctcttctggcttgtagagtttctgctgagagatcagctcttaatctgatgggcttccctttgtggggaacctgacctgtttctctggctgcctttaacattttttccttcatttcaactttggtgaatctgacaattatgtgtcttggagttgctcttctcaaggagtatctttgtggtgttctctgtatttcctgaatttgaatattggcctgccttgctagattggggaagttgtcctggataatatcctacagagtgttttccaacttggttccattctccccatcactttcaggtacaccaatcagacatagatttggtcttttcacatagtcccatatttcttggaggctttgttcatttctttttattctttttcctctgaacttctcgcttcatttcattcatttgatcttcaatcactgataccctttcttccagttgatctaatcggctactgaggcttgtgcatttgtcacgtagttctcgtgctgtgtttttcagctccatcaggtcctttaaggacttctctgcattggttattctagttagccatttgtctaattttttttcaaggtttttaacttctttgccatgcgttcgaacttcctcctttagctcagagtagtttgattgtctgaagccttcttctctcaactcgtcaaagtcattctccatccagctttgttccattgctggtgaggagctgcattcctttggaggaagaaaggcactctgatttttagagtttccggtttttctgctctgttttttccccatctttgtggttttatctccctttggtctttgaagatggtgatgtacagatgagcgtttggtgtggatgtcctttctgtttgttagttttccttctgtcaggaccctcagctgcaggtctgttggagtttgctgcaggtccactccagaccctgtttgcctggttatcagcagcagaggctgcagaacagtggatattggtgaacagaaaatgttgctggttgatcattcctctggaagttttgtctcagaggaatacccggatgtgtgaggtgtcagtctgcccctacttgggggtgcctcccagttaggctactcggggttcagggaaccacttgaggaggcagtctgtccgttctcagatctccagctgcatactgggagaaccactactctcttcaaagctgtcagacagggacatttaagtctgcagaggtttctgctgccttttgttcggctatgccctgcccccagaggtggagtctacagaggcaggcaggcctccttgagctgtggtgggctccacccagttcgagcttcccagctgctttgtttacctactcaagcttcagcaatggcgggcacccctcccccagcctcgctgctgccttgcagtttggtctcagactgctatactagcaatgagcgaggctctgtgggcgtaggaccctctgagccaggcacaggatataatctcctggtgtgccgtttgtgaagaccattgaaaaagtgcagtattatggtgggagtgacccgattttccaggtgccatctgtcacccctttctttgactaggaaagggaattctctgatcccttgtgcttcctgggtgaggcgatgtctcgccctgctttggctcatgctcggtgcgctgcacccactgtcctgcacccaccatttgacactcccctgtgagatgaacccggtacctcagttggaaatgcagaaatcacccatcttctgtgttgctcacgctgggagctgtagactggagctgttcctattcggccatcttcacaaaaatcttactttggtttctagtgttaccacccactgttctttctcatctcaaccctgagtataagtacagatcacattccttgggttcttagaaaataatagaaatgaactctcattcatcaaaatgcccattagtaaatactgagggagaacaaactagaaatccagtatagaaaataaaaataggattatattccttggaatctcagaaaaaaacaatgaagagctttctttgggcattagacactttcccataaggtggctgactctcttttagtcatgtcagcttggcccaatcttcacttggtagcccttctttcttcttcattaatccatctcctatgctcctatggggtcctagagaaatgcccatcatgtacacacacatctaataacacaaagatcactctcgactagcaagcccttttatgatggtgtgagcatttgacacccttgttgctagtaacatcagtgagtgacctgacccatttttggaacagaatatgatcagtatgttgcctcaaggaggccctcactgttctaggaaatataattccagagtttgctgactcacaccatggaatatatgcataaaatggatcctgcagataagcctttctctgactagtttcagacatttttttctgggtaattttaaagttattttttatttttgtgggtacaaagtaggtgtatatatgtatgaggtacctgaggcattttgatacaagcatacagtgtataataatcaccagagttaatggggtatccctcaccacaagcatttatcctttctttgtgatacaaacaatccaattatattcttttagttattttaagatgtataataaattattgttgactgcagtcaccctgttgagctatcaaatactagatcttattcattctaactatacttttgtacccagtagccatcccacttcctcccctcccactacccttcccagcctctgataaccatcattccactctctatctctatgagctcaattgttttaagttttagctcccacaaatatgtgagaaaatgccaagtttgtctttctgtgcctggcttatttcacataatataatgtcctctagttccatccatgttattgcaaatgacaggatctctttcttttttatggcttaatagtactttattgtatgtatgtaccacattttcttcatccatttgtctgttgatagacaagagttgcttccaaatattgactattgtgaatagtgctgcaataaacgtgggaatgcagatctctttgatatactgattttctttctttagggtgtatacccagcagtgggattgctgggtcatatgatagctctatttttagtattttgtggaacctcaaatctattctacataatggttttactgacttacatatccaccaacagtgtatgaggatactcttttctccacatcctcaccagcattcattactgcctgttctttggatgaaagccattttaactgtggtgaaatgagatctcattgttgttttgatgtgcacttctctgatgatcagtgaggttgaggaccttgtcatatatctgtttgtcatttgtatgttttattttgagagatgtctacccagatcttttgcccattttttaatcagattgttagattttttttttcctacagagtgcttgagctctttatatgccctagttactagtccctggtcagatgggtagtttgcaaatagttgctctcattctgtgggttgtctcttcactttgttgatcgaatcacttgctgtgcagaaggtttttaacttgatgtgacctcatttgtccatttttagttgcctgtgctggtgcggtattactcaagaaatttttgcccagattaatgttctggagagtttccccaatgttttcttgaagtagtttcatggattgatgtcttagatttaagtctttaatatgttttgattttatttttgtatttgctgagagatagggctctagtttccttctgcatatggatatccagtttttctagcaccttttgttaaagagactattcattctctaatatacgttcttggcacctttgttgaaaataagttcactgtagatgtatggacttgtttctgggttctctgttctgttccattggtctatgtgtctgcttttatgtgaataccatgttgttttggttgcaaaagctctgtagtataatttgaaatcaggtaatgtgattcttccagttttgctctgttctttttcctcaagatagctttgcctatcctgggtctcttgtggttctatataaattttaggattattttttctatttatgtcaagaatgtcattgatattttgatataaattgcgttgaatctgtagatagcttcaggtagtgtggacattttaacaatatcaattcttgaaatccacgaacatggaatatccttctattatttggatgtcttcttcaatttcttatattaatttttttttagttttcattgtagagatatttcatttatttgactaagtttattgctaggtattttattttatttttacctattgacaatgggattgctttcttgatttcttttttagattgttcactgttggcatacagaaatgctactgatttttatgtgatgattttgtatcccgcaactttactgaatttgtttatcagttctaataggcttttggtgcagactttaggcttttccaaatataagatcatattatctgcaaacaagaataatttgacttctttcttttcaatttggatgcctttcatttctttctcttgtctgattgctctaactaggacttccagtactctgttgaataacagtggggaaagttaacatccttgttttgtttcagatcttatagccaaggccttcagtttttctgaatttagtatgatactagctatgggtctgtcatatatggcttttattatgttgaagtatgttccctagttttttgaaggtttttatattttaaggaagataaaaattgaactttatcaaatgcttttcatgcaacaattgaaatgatcaagtgctttttgtctttcattctgttgatacgatgtatcacactgattgacttgtgtatttagaaccatccttgcatcccgtggtaaatcccacttagtcatggtgaatgaactttttaatgtgttgttgaattcagtttgctagtattttgttggggatttttgcatcagtgtttatcagggatattggcctatagttttccttttttttatgtgtcttttgggttttgttatcagggtaatactggccttgtagaatgagtttggaatgattctctcctctattttttgaaatactttgaataggattgatgttacttctttaaatgtttggtaaaattctgcactgaagccattgggtcctgggctttttactgctggggagacttttcattacagcttcaatcttattacttgttattggtctgttcaggctttagatttttttcatgaatcaatcttcacaagttgtctgtttctcaaaatttatcaatttcttctaggttttccaatgtattgtcatccagttgctcataatgccctctaatgatgccttgaatttttgcagtaaccactgtaatgtttccttttttaatctctgattttatttgagctttctctttttttcttagtctagctaaatatttgtcaatgttgtttgttcatccacaaaaccaacttttcatttcactgatcttttgtattattttttccttttaattttatttatttctattctgatatttatcatttcatttcttccagttatttgagtttggtttgctcttgcttttccagttctttaagatgcattgttaggttatttatttgaacttttttgatataggtgcatattgctataaactttcaccataatattgcttttgctgtatcccataggttttagtatgttgtttagtatgtttccaatttggtacatttcaataaatttttaaattttcttctttatttattgacatagtcattccagagtatactgtttaatttccatgtggtttgtatagtttccaaaattcctcttgttattgatttctagttttattccattgtggtcagagaagaagcttgatatgaatgcaattgttaataatttttttaaaacttgttttgtgacctaagatatgatctgtcattgagaatgatccatatgctgaggaaagaatgtatattctgcagccattggataaaattgtctttaaatatctattaggtccatttaagacataatgcagattaaagccgatgtttcattgttcatttttctgtctggatgatctcttcagtgctgaaagtggtgtgttaaaatctctaaatattattgttttgggatctttctcttctttcaactctgataatatttgctttagatacctgggtgctccagtgttgggtgcatatatacttaaaattgttgtatcctcctgatgaattgacccctttatcattatataatgaccttctttttctctttgtgtagtgtttgtcttgaaatctattttgtcggatattagtattgctgctaatttttttggtttccatttgcatgaaatatctttttcattcctttattttcaggcagcgtgtttctttatatttaataggtgaaatatgtttcttgtaaataaaaattattattttaaaatatttttaaaataatactattttttaataagaacaattattattttttaaaaaatttcattagttttgggggcacaagtggattttggttaaatgggtgagttctttagtagtggattttgagattttagtgcagcagccacctgagaagtgtacattacccatatattatatatatactatatatgctttatatatatagtgtgtatatataatatatatacaactacatattgggtaatgtacacttctcaggtgactgctgcactaaaatctcaaaatccactactaaagaactcacccatttaaccaaaatccacttgtgcccccaaaactaatgaaattttttaaaaaataataattgttcttattaaaaaatagtattattttaaaaatattttaaaataataatttttatttacaagaaacataattcacctattaaatataaagaaacacgctgcctgaaagtaaaggaatgaaaaagatatttcatgcaaatggaaaccaaaaaaattagcagctatactaatatattatatatatactacataaagcatatatatagtatagtatatatataatacatttataaagcatatatatagtatgtagataatatatgtttatatactttaagttctgggatacatgtgcagaacgtgcaggtttcttacataggtatactcgtgccatggtggtttgctgcacccatcaacctgccatatacattaagtatttctcctaatgctatctttcccctagccctaccccactccctgacaggccctggtgtatgatgttcccctccctgtgtccatgtgttctcattgttcaactgccacttatgagtgagaacatgtggtgtttggttttctgttcttgtgttttagtttgctgaggatgatggtttccagcttcatccatgtccctgcaaaggacatgaactcatcctttttgatggctgcatagtattccatggtgtatatgtgccacgttttctttatccagtatatcattgatgggcattttggttggttccaagtctttgctattgtgaatagtgctgcaataaacatacgtgtgcatttgtctttatagaagaatgatttataatcttttgggtatatacccagtaatgggattgctgagtcaaatgatatttctggttctagatccttaatgaattgccacactgtcttccacaatggttgaactaatttatgctcccaccaacagtgtaaaagcgttcctatttcttcaaatcctcaccagcatctgttgtttcctgactttttaatcgccattctaactggcatgagatggtatctcattgtggttttgatttgcatttctctaatgaccagtgatgatgagctttttttcatgtttgttggcagcataaatgtcttcttttgagaagtgtctgttcatattcttcacccactttttgatggagttatttgttttcttcttgtaaatttgtttaagttccttgtcgattctggatattagctctttgtcagatgaatagattgcaaaaattttctcccattctgtaagttgcctgttccctctgctgatagtttcttctgctgtgcagaagctctttagtttaattagatcccatttgtcaattttggcttttgttgccattgcttctggtgttttagtcatgaagtctctacccatgcctatgtcctggatggtattgccttggttttcttctacagtttttatggttttaggtcttgcatttaagtctttaatccatcttgagttaattttgtataacgtgtaaggaagaggtccactttcagttttctgcatgaggctaacgagttttcccaacaccatttattaaatagggaatcctttccccattgtttgtttttgtcaagtttgtcaaagatcaggtggttgtagatgtgtggtgttatttctgaggcctctgctctgttccacgtgtctatatctctgttttggtaccagtaccatgctgttttgggtactgtaccacttgattggtgagagagggaatccttgtcttgcactggttttcaaagggaatgcttcagcttttgcctattcagtatgaccaatatgtagtcttttattcctcaccctctctcaacaccccacccccacggagtcctcaaagtccattatatcactctgtatgtttttgcgttctcatagcttagctcccacttataaatgagaaaatacagtatttggttttccattctttggttacttaattagtataatggcctccagctccatccaggtgtcttgtttttcatccattcagccagtctataacttttgcttggagagtttcgtccatttagattcagcgttatgattgataactaagggcttactcctgccatttggttgttttctggttattctgtggtcttctcttccttttttccttctttcctgtctcccttttagtgaaagtggttttctctggtggtgtattttattttcttcctttttatttttttttgtgtgtatttgttgcatgttattgatttgaggttaccatgaggcttgtacataatattttctaactcattatttcaaactgatgacaacactctatcgcataaaaaaacatggaaagagaaaactaataaaaactctacattttaacttcatctctctgcttgttgtcactttgtcgtttctatttacatcttattgtactgtttatgtcttgaaaagtagtttcagttattacttttgattggttcatctcatagtctttctactcaagatatgagtagttcacacaccacaattacagtgttacaatattctgtgtttttctgtgtactttcaattacccatgagttttgtattttcagataatttgttattgctcactaacatcctattctttcagattaaagagctccctttagcatttcttgtaggaaaagtctggtgttaatgaattccttcagctcttgttgatctgtgaaagtctttatttttccttcatgtttcaaggatattttcactggatagtctattctagggtaaaagttttttttttttttttcttcagcccttcaggtaagtcatgccactctctcctggcctataaggctaccactgaaaagtctgctgccagacatatatgagttccattctatgttacttgtttattttctcttgttacttttaggatcctttctttatctttgacctttgggagtttgattattaaatgccttgaggtggtcttttttggattaaatcttcttcgtgttcttgtacttggatattaatatctttctctaggtttgggaagttctctgttattatccctttgaataaactttctaccaagatctctctttctctctctgtctctctctctctctctctctccttcttaaggccaataacttttagatttgcccttttgaggctgttttctagatctcgtaggtgtgcttcattgtttgctattttttttttttttttgtctcttctgactacattttcaaatagcctgttttaaaactcactaattctttcttttgcctggtcaattatgctgttaagagactctgaggcattcttcagtgtgtcagttgcatttttcagcaccagaatgtctgcttatttttttttagattatttccatctctttgttaaatatatctgatagaattctgaattctttcttagtgttatctttaatttccttgaatttcctcaacacaactattttgaattatctgtctgaaaggtcacatatctctatttttccaggattgctatctggtgctttatttagttcattttgtgaggtcatgttttcctggatggtgttaatgctagtagatgtttttcagtgtctgagcattgaaaagttagatgtttattgtagtcttcacagtctgggcttgttcatacctgccctccttgggagactttccaagtattcgaagggatttggatgctgtgatcttagtctttggtcactgcagccatatctgctttatggagcatcccatgctcagtaatgctgtggctctttcagactcatagagttactgcctgcatgctcttgggtaagagccaggaaaattccctggattaccaagcagagactcttgttctcttctctcactttcccccaaacaaatagagtctctctctctctctctctttctctctctctctctccctctcattctctgccgacctgcctgaatctggggtagggatgacacaatcacatttgtagtcaacaccattgggactgtgctaggtcagacccaaagctggcacagcactgagtctcgcccaacgcccacagagaccactccctgggtaatgtctgtgtttgctcaaagcctaagggctatacaatcagtcagtggtgaagccagcctgtcttatgtccttcccttcagggtgatgagttcctcaagcaggtccagggatggtgtccaggagccaaggcctcgagctgtgactgagctggcacccaatccataagacaaagattttttccacactttccttccttgtcctcaagcaaaggagtctctccctgtggccaccaccacccccatgttcatggcaagtattgtctggctaccaccaatcttcactcaaggcccaggggttctttagttagcttatggtgaatgctaccaaggctgagtctctcccttcaaggaagtgggctcctctctggcccagggcaggtccggaaatactatccaagagccaaggcctggaatcagtttccccaagagtccatttggtgctctacacccactgtggcagaaccagtacccaagctgcaagacaaagtcctctttactcttccttctcctttacagagactctccctatagccaccacagctgggaatatgctgggtcactcttgaagcaagaacagctctgagtctcactcaaaactcctggcaagtactgcctggctatcacactgattattcagggcccaagggctctttagtcagcaggagatgaatcctgccagtactgattccttcccttcaaggcagccggtttctttctggcccagtgtgtatctagaaatatcatttgggagctagggcctggcatggtgacctcaggactctgcctggtgccctgttctactgtggctgatgtagtatccaaattgcaagaccaagtcctctttactctcccctctcctgtcttcaagcagaaggaatgagtccgccctggagttgggagctgcattgcctgggattggaggaggggtggcacaagcactctcttggtcaccccagctggtgtcttactaggtcgcatgttccccaagtccactggctctgaggctagcacaccaggatttgaccaagaattgcaattcttgtggcttacactgcctttcaagtttatttgagatcccagagcactttagcccacagtgacagggcttgccagaatttagtttctgactgctgagatggacaatttgcgtctgattagggctggtctaagtgctccttctgtgggcactggctgagttctgctccatgttgctttctgctgtgacagggcaacattgagtttcaatgcaagtcccacagtcactgcaatcttcctctcccaagcctgctctgaacaccatgtggttgctgctgggggctgggggagggatgttgtaggcaattcaagaatgtctttcctacccttttcggtgcttctttccttggtatgatattaaaaccagttactgtgattgctcacctgatttttggttcttatgaaggtgcttttttgtgtggatcactgttcaatttgtgcctgcaagcggggatgggggacaattgctggaggcttctctttggccatcttgctccacctctaccctagtattagcaatttcaaagcagttgggatggaggtagaaggaaagggcgcttggaatcagaaaatccatgtcttagctttgagccttagaaaattcatttgacccttgtaagcctcagttgcttcatctgtaaaagagaaataatataatggctgaaaagatcaaaggtgataatgcttttgaaaacactatagaaaatgacaaaatatcacatgagtattattttctagtttctaggagtctccttaccattgtacaggacaaccatgtctatttttaaataaattattatttgcctctgagcaaccctgcaaagagttgcctgtaggagaaacagctttacttgcaaatcactccactgttttctttgtgcacagcttattaatacataaggcacatgtcctccagcctgcagtaacattggaatcattacctctttggagtacctaccagagcttctcaaagtgaattttgtttatcaccacaaaaaatagtctgttgcagagataacctccaaattcaatgacaatatttccaatcacttttgcatgatgcagaaatagacaaatatataattttgcttatagagacaattattgtctcccaacaagtgatcagtagtcagaaaatggccaagaaataccatggggtgtgccttcccataacagcttatctttgtgttttagttgcaaggttactaaaagcctgtgcagggtttatggcaaaagtaaaacttgctccaggagcaagcccttgtttcattgtctaatgttcttaatccccagcagacaggatttggatctggcatttggtaacagggcagtttccaaagttgctgtacgcaacttgaggaagagaggtgatattatcggaatgaatttctttgttgtaagttataaatgtatgggcttttccaatcccatcacccttaaaactttatttgttttctgcagtgagggtgtctccgttgtctttaatatgcttgctttgagttcatggatgaacattcctgcctggctgacatgtggactctctgaaattgttataaggtctttttctttgtttttttcttgatgcccaagctgccaagggtagtactggcagtggtgggcagacaaggaggtgatagcaaactttgtcctctggcctcccttgacccattccattcattatctaagggactccaagccagcattccacagagtgccctcaccaaactcactaagactgaaggcgaaccaggattccaaacagccattatgaaaggaaagagagagagacttagggtttgcaaaataagataccctgttgattctttttattccatacagatactactattctttaggaaaacgttaaaatcacatgatcttccaggacctgggctgcttctttaagaagcatgttacagaaagctttattggccaacaacatattgaaagatagattaatcaatcattcattcaaataaggtatattcagaattgaggtatattgtagccagacagtgagactacaaaaaaagaatgcaccgtacccttatctcttgcacaatctaacgagggagataaccactctttcaatttatagtgacctataacatttcgtacactgctgaatatctttacatggtaataacacaatggaaagcttgcaaaatagacagaggctaggggaagaaggattgagtgtgaatatagcctcttataaatcgagaggaatggtctgtgtcttctgatcatacagagataataaatatggaaatgatttcaaactaacaaagcaaatgtgcagaaaatactgagaatatagtgggcaggatacctgagttttggttccatctctgttattgactcattgtgtaatctgagtcaggtctgttctgctctctggatctcaccctttcctatctgtaaaatgagattgttggattagatgatctccatagaggttctcacctattctgacattcaaaaggactcctaatttttcttatataataataatatatatgatctgtagagtgctttacactttatatgatatttttgcatctgttatctcatgtgagaaaagcactggactgctggactggcaatgaggacacctggattcttgtctctgttttgacactgattcatggtgtgatcttcaagcaaattctctgagtttcagtttctcaatctgtaaaataggggggtatgaagattggactaaatcagtaggtctctaaaatgttccacaaagccctggggtggggggctcctacagagtttcgctaaggcaaaccacaacgctaagcctgcatggaagaggagaaaaagagtggcctgacaagagaagttcccagtttcctatgccaaccccaggcagattacatttaattttatctgatttatatagagagtttctatgtaatgttttattcttaaaaatagtttactataaaaaactcaactggtttgatttttaaagattgcacatataagtgagatcatgcagtcagtatttgtctttctatgcctggcttatttcacttagcataatgtcttccagcatcatctatgttgctgcaaatgacagacttttcttttcattaaaggctatatagtattccatcgtgtatgtacaccacattttctcttttgtaactttcattttaggttcaggggttcatgtgcatgtttgatatataggtaaactgcatgtcagagaggtttcttgtacagattatttcatcacccaggtaataagcatagtatctaatcaatttttttctgatcctctcccttctcccaccctacaacctcaagtaggccctggtgtctattgttcccctctttgtgtccattacaccacattttctttatccacttatccatccatggacacttagtttgcttccatatgttggctattgtgaataatgctgaaaaaagtcaaactcatagaagcagagagtagaatggtggttaccagggactgggaggcagttgactgagctaggaaaagagagataataaaagggtacaatgtgtcagttatatagaaggaataagttatattgaactattgcacagcatggtgaccatagttaataataatgtattatatgtctcagtattgctaaaagagtaaatttaaatattctaaccacaaaaaattattagtaggcaaggtgatggatatgttaatttgcttgatttaatctttctagaatgcatacatatatcaaaacatcccactgtaccccataaatatatacaattattatttgtcaatttagaaatttaaaaacttgatttagatgagctctaaggccttaagtattaaagtattaagtattaaagtgatatgtaaccaagtatattgtttggtaacttcatttttgttattattttaacaaaccaatatattgtgaatatacttccaagtgaaaagaaaaaagacattgcagtcatcactaataactgcaaaacattcctttgcaagaatatggaataattcatttaatcattcccctaatgttagacattcaaatgtttccaactttttctatttaaataatgctacaataaacttctattttgtgcttattgtattattttcttacaacacatccctagaagtggaattcctagaagtttatacacatttccaatttttttccaaatatatggcaaaatttctctctaaagtatttttattcctaccagaaatacctcttcaccaacacgtagtatttaatctgtaccaatctggcttaagacaatgatatttaatttgtatttctgtgatttctagctaaattaaataatcttcatatgcttattggtcatttgtacttctaactgctttctcctgtctgttgcccatttttctattgtgctgtttatttttatatatcgaatatattgaccattggttttacatacttgatgctaataattattcttagtttatggtttgtctttgagttttataatggtgtttatttcacataagaaattataaatgttttctaatgaaatttatcaagtctgtcttcacttatgttttcttcattgtcaataacttaaaatgaccttttctacctttaaaaattttgaaattttcctctgtattgtctaatagtacttacatgatttcctcttttaaattgacatatttaatccatttggaatttattttgattttaactagtaatttaactttattttcttctccaaatgattcactagttgttctgacattatttagtgaataattcatcctttcttcactgaattggaatggcatattccatatactgtgtctggttttggcttttctgatctcttccactgatcaacctaagctggagccagtatcaaactgttgtaatcattatgcctttagatactttaaatgtacagcagggaatgtcttattactcttatttttcacaaatatcttggcattgtctcatgttttattccttcagataaattttgggattattttgtcaagattttgtttgagttgttttaaatttttagatttcattgggaaagaactgaaatccttgaaatattgcttcttcttagccaggaatatggtacaactttgcatttaattcagttctttccttaaataccaccatgaagttttttgttttgttcatataggtcctgcattaacaccatatatataaagtgtgagaaatactacattcttcaggattctctgtaggttaacaatgaagatgatgactcaaccctttctttgtttgcataatgtgatgccactaatagtgggtaacttctctgccttacctcctctgttccaaacaggatttttcagaatgaacaaattaaaagaatcataatcagacactaaccccaagccatactgcatggcagcaccaatgggactgacagaaaacaacagaaataggaagaaatcctacagagaaacaaacttgaaagctgtctcatggcctttgaatcatacttaagttttatgatggaaggatacgactatgaagaaagacacagagcaacatcagacagtcaagaatttcagagccagctggcatgcagtggacctcatgccagcccattttatgactatttaggtagtcaagggtttaagatttttctaataagacagttattatgcatttcaatgagtgatttctttgcagctctagagtgtggccttacctacttcaacatgagaagatttttgtattttgtcagtcatttcacaatgacttttagtgagcccttcattatagactgtggatacaactttgctgttggaaattaacagtgtcaaacaactgggtataatgtttgtaatatctgaggagggggagctgcctaggaagttgtattccctgtgttaatttttcagtctcttaggttatagaggaccttctagaaccaccttacagcaggattacatcccatttacacagttctctgtcacttgaatacagagaagggatccacaaggccatatgcttcctagacaaagagaaaagatttctgccacactcagaacgctttgtcttcagactataatcacccacaccatatttcctttggatccactttccagatttttgtgctggcactaacaccaacttgctgtggcttggggcatgtaatttcaatactttgtgcccattttcataagtgaagtgtcaggcatcacattggacattttaagattctttacagcccaatgattctgtgtttctaattaggcccaatgggttagagctaaaaggaaacagtgagtttcctggaaggaaaggacatataacacagtccagaggtaaaatgggctgtattcaagaaaagataggacaatactttgcagggatgctgcagagaggattcaagccttgtatggaggaatggatgtgatacaaccaaaaagtctttaaaaattctttccaactaatctgagatttgtaaccttatggactgtgatttgcagcaaaccaaggatgtgataaagactagtattgtttctagaatgcaaggatggttcaacatatgcaaatcaatagtattaacagaatgaaggacaaaaactatatgatcatctcaatagatgcagaaaaataatttgacaaaattcaacatcattttatgataaaatctttcaagaaattgggtattagaaggaatgtttctcaacacaataaaggccatatcagacaagcccacagctaacattatattcaatgaccaggaatgagataaggatgctcactctcaccacttctgtttaacatagtactggaagtcctagccaatttcatattaatgagcctcattttcttcatcatagaatgaagtatataataatccctgttatacttactttgcacagattattattattatttaattattattttgagacagggtctcactctgtcacccaggctggagtgcagtaccacaatcacagcttacttcagccacgacctcccaggcataaaggatcctagcccctcagcctcctgagtagctgggagtacaggtgcacaccaccacacctagctaatttttttttttcatttttttatagagacggagtctcactatgctgcccaggctggtctcaaactcctgtgctcaagcaatctttccaccttggccttccaaagtgctgggattacaggagtgagccactgcacctggccttgcagattattattaaactttgtaaactaatcaaatgagagtgattattgttactgttaagaactctgatagcctcatccatatatttggagaaattgaataaataataggaaagaaataatagcatcccaatgattttaccttggctctaccatcatttggggaagtgataattcagataggagaagtgacttggaagcagtcttgagagattgcctgttccatcccctatctttgtccttaaaccaaattgtacagataaataaggtcttatttttaggacttacagaaaaaagattcctttcatatccatctttgcaatcctcaaccacttctgtcactattatgtgtcatttcaaacattaaattcctcattctgctttgaaggaacacatgtgtcatgtgtacccatttgtatgttttggtgtgttttatgctttatgtgatcacccacatatgcacagataattccaaaatccagtgtgtgggtgttgtattccctgtgttaattattcagtcacactcaaacacctatgcactcacacatacatgaatacacacatgtacattagcatgtttatgcttatgttgcatgtgactggcaacatcagtgcctttctaaggcaatgttaactaccttgagttttgggagagctttagagaacaaagacaagagactaaatgattctagatgtaagagacaatgttgcaataagttactatcctaaaaagacagaatacagggacaagagactattattttggatagtttcttgcttaccagtaatacttaagtcctttacattaaaaaaaaaaaactctgtaaatatattgcagaagaaatccagacatccttcaagattcttagagctggaaaagattttaatgactttccagtccaatctatctcatgtaatcaatggggcccagagaggcaaaaggtcttgtccaaggtcatatagtgagttagtgataaggctgaacaaggattcagatgttggggcttccagcccactgctctttctctcatctgggatttgtgtatttttgttcattagagattttcctctgtaacctcaatatccaatgcagggccttgcacataatagattatcagtaaatgttaaattaatatgtcatggctttggttgtactgggcttttgcacttactcctgagtaaattgtaaagaatatctacgttttaggttgccttgttttagaccaagaggtacccagagaaaaggtgtgaactatgctaaggaaattatccgagttccaaattgaaaaaaaaaaaaaatcatgcttttccgctataacctctctcattcacagagtgattctctttcagaagggcaatctagaactattatgggagccatattccattggtggtgcaaccatttcttgacaaactagggtccaagaaagtattttcctggggaagatgagatttctcaaagaaggcacgcactttctaacctaagcttatttcagtaatcaatgtaacaagctggtcttgatgattgcagcagtaccaatactgtgggagtgtaccagttctagaacagctacaacattggaattgaacgcactagaattggatacaggacctgtttttgaggagctaacacccaaaggctgaacagcactcgtagcaccgtcctttctgtgcacatatggtagtcctcagtttgcaacagaaataaagctgttagcaaattatgtgttctatttatgcaaataaaatcttgtggtatgctagaaagagcactggcctggagaccttagttttctcatatgttaaaaacccctaacacaggcctggttcatagtaggcacccaataaatagtagttttcttcctttgggggcctccgattcagtgtgcttcttcaggtaagtcacttccctggaactcctccttggaatgagagttgtactgttgtgatttttaacagttccttcaagccaagcattttggaatcctttcataaagggagaaaggaaggaaagaagaaaggaaaattaaaggaaaaagaacaaataaaacgttaaaaaggaggaaaggaaaaaggatcctttactacaataaaactaatcttatgttcttgcaagtagcactttaagtaaaagaagttctttgctgacctggttactactgaacctactacataaaatagcctactataatagatgcatttatgtgcctaatcttcactttttaggcttagtaaagggagaggaaagctgatgtatagttaaatttatgtttttagttgtttttttttctactctcaaatatcaatcactctttagtttctctttctttttccgaccacaagcattcttcctctgcttaaagaagcttccctaaaatcccagtctatccagtaagccaaagcacagcaataaatttgaggaaaaaataccagggacttagagacagaaaggagtgaggggatgcagaagctgaagctggagcacggttgcaagcatgagaagttctgcgtgtttcagagcagccaaggatgtatttttgcctattcctgctggtgactctgtgtgtctatgcatccatctgctatatttacatgtttagtcagtcaatccacgtttgctgagagcctgctgtgtgccaggattgtgctagcgtaaaggagcaaagtattgagcaaaatatgtttgagcagctgtaattctgaggatctctaggtctgagcatgtgtatgtgtgtgcgcttctatgtatctgtgacaactccaggtgttcatgacagtgatctttgttactctgttggcttcatcgaacttccttttacttgctgtgattcactacatagagtgggctttatctctgatttttataacctgcaagactgggggtatgatcaccagcaatctaaaaacagttagaaatcccatggagttatcttttgtagaaattttcctctactaatattatgaaaaataagcatcttattagctcgagtgtaattctatgcatgattacaggtatcaataggaagaaacattgactgagttcaaatctcttctacgccatgctaaaggggtgacaagttccacaatggatcattttctcatgggcatttctgacttttggtaaaagtagagcaccttattttaaaaaccattgagtagtcctaatagtggagatatcatcaggatctgaattgttcatccctaaaaaaaacaccaatggaaatcaaacaatatagtgccaaattaaactgtttgaatatttaggttctgtatgatcaaattgtttggtgccatactctgtccacttttttcatgtggtaggatataatttcatatcttttctgttctagaaatacccgaagaaagagactctggaaactcattatcaggtctatcaactcttgtatttgttctcccagggaaacagaagtacctgtgcgccagcagaaatgattgcactattgataaattccgaaggaaaaattgtccatcttgtcgtcttcggaaatgttatgaagcagggatgactctgggaggtaagatacttttctttctcttcctcctccttcctctctcccccttctccctcattttctagtctctctttagaccagattttcttctttgatgcttccaaggggaccagccatgctctagacacaggctgaccctttcataggcaacgtggccatcagccagctggtgccttttttttaatccttatctataccaatccccattccggggctcagcattagagcaggcggtgtgaagcagggatcaggagccaacagaaggtgagtgaggatgcatctgactgggcagggcccccaggggacttaatgatactggcctgatgttgttcagtggtagctaggatgagagaactaagaaatccagaacagtcagaggtgcaggatgacccaggcataggcgcaggatgacccaggcacaggctgatcctgaacacctgggaatatcccttagctaactgctgcctatgttgtagggccagccacctcgaatgagaagctacttctctttggagcctgtgactaggctgccacacagagccaatttcctatcctatctctcccaaagatgagcaggtgttttaataatttccttttctttgcaaagctattgaccatttccaaaagcattttttttcagtagcacagtaacgtgatagatggaagatacagctctttcaagggcgttcctctatcataaggctctctgtcccacaaacctgtctaccatgagtgttgtcaccattccagaaaggcttgacatcagttgattgagacttatattttccctctccaaactcccccatctcttcatgtttacatctgcccaatgccagggtcctcgctgctgcctgctacttccaaaaagatgtgtctttcatgagaaaaacaagatcattaatccacttcgatttggaaatggaatttgaagaaaggcaagcctatttctgagtgcctgcaactgtagcctcatacccaattattcattattagcctggaaaacccaagtgcctagaatccaaccctctcccctctcctcttaagtctaatttagaccagttgtctatctctggctttctgtgaggtgttcaataccttgtctgcctatgtgcacatttatagacaacaactagttctcttatcctggagcagggccatgtgtggatcttcatatagataactatatcctccccatcctcacagggcagtagtattatttaaacagaacaaagtacctcacatgaattgacccaggctggatgagagacaatttcaaaagaatcatctcaagtagcgtccagtactcccaaacatcacaggtagatgttctgtgagtggctttccaagcatccacatcaaatgagactcagatatctgagaaaactcaaccttgttttggtttgcttggtgcaccccaaagaaatccaacaattgaggtctacagtggagaagaagtaggactggggtcagggagtacagaggcaaaggcaggaagggtgacaaagtgattgacaagaaaaaatgttctccatatgaatgttgcagccccatgttgagggttcttatacactcaactgtcaattatttagccttctgtgaattatgtatagtataaaagatagggactctcaagtagggaacctcttggcttgccatctggcaatatgaattgcaagtccactttgatgcaggtaaagtttaatggtaacaaaagtcctcataacatttggatgcaaatcttaacattaattccatgtctcagccaacattctccattattaagcagcctgtgatgtgattacagtgaaccacttttgaaaaggagcctgtgtataacagatagtttcactatactatataaccgtcagatgcaggcttgtaaattaatttgttggtgacaatgtttcagtacattttcaaattgattcattggtatagtactcaaatttgagtgggcttggtgaacacaatgaagacaagctgagaagtgctgtgactggccttcatttcagttgcaggcccatgatattttgagtgtcttccatgtacaaggcaccatgctaggcattagagcttgaggctggcaaacttcaggaagtgttcacaagataccaggattcttgatgttgtgtaaatggccttgcctttagagtcaggcagatctagtttaaaggctcagctcctttatttactgtgtgcccctctgagcctcaatttcctcatctctgatttagaaataccatcctcatagagttataatgagtatcagatgacatgatgaatgtgaacatccttgataaatagcaaaatgctagacaaatatgggggcttaatatgacattgaggtcactagtaatttagctggaaagtctgtaacacagcacttcccgatggcttttaccctaagtaacttggtatgccatataatatgtaacagcaccaacaggcagagaatcgccagaaaacactcttgattacctcaaacgaaaaagtaccaccaggatcctgttcagaagctaattttagtaattaagggaatcatatgctatgttcaaataccatgccagtaaaaacccaattgtttaccttcttaaatcactgcttgaagagcaaatctttccattttgctgaatgaacttatctccacgttccctgccctactgacacaaccccctcccaagtttattgttaacttacacattcaatgcacagcacacctttactcaaacaatggaaaagaaagaaagtgtcaattcaaagtggcccttgtctattccttaaggagtagacttccattttcatcagatttggatttagcatagacatattgattaccttgaagaagaattcatataattttatcttctgattcccatcactcaaatcaaaattacataatatattccaaaatggcaactaggaatgtggccttgggcaagtcccttctctcctctgatgcttggttttcccatcatagaactggaattgtggcttcaccgaggacctttctggtgctaacattttgtgattctatgtaaaaagccacacagaaaggattgtttttcagccctttcttagattgtctgttccctgctcccagaagtatagatagtgagacttgagtgctttgatacatcgtaattgtatctacctccattcacacctacttaagatatctgtctaaaagtagactagacagattattcagagagtggagggcagaagggctgtctctgtatcttaaagaagctggcactcttcagctgatggctgcttggtcttgaggcctcaagatctttaatctggctttctctatagtgtttcattcactgtttggtgatggaatctcttcagttcagagatacttaatagatatagctttttctttcctgcttccaggcctacctacctgtttcttgcttttttttctagcagctgttgttgtttctgaaagaatcttgagggtgtttggagtctcagaatggcttccttaaagactaccttcagactctcagctgctcatccacaacagagatcagcctttctttgtagatgattcattcctggctgcatttgaaaaccacatattgttaattgcttgacgaatttaaatcccttgactacttttcatttcagaaaacacttacaaaaaaagtccaaatgaggaccttccctccagtgaattagctgtggctttctcacagtccatagttaggataaatgtaaagccatttctcatttttctccgcactttccaagggtacactccttgtttccaagatggaatgagaaataaagaagtgcccttcctgccatcttctcccctgaccctttcctccttcccactttcctcctattcctccccaaacatgatttatttctgcgttttgcaactcttgagttctcagcatttagtaaatggtgttggtccctgttgattccttcctctcctggaccatggaaggtagtaggcctttcagaaatttcaggtagcagccaaaccccagaagaagagaaggaacacagagacctagaccatgtgagaacctgaggtgtgcagcatttacttcacagattcgtctagcatatttgagaggtgtctttcctactaggagactgaactctgcatctgagaataaaaacttaacatatctacaggttttgacaacctctgtgaattatctagttgagaggatggctcaaggagcctattgccatggtctgatgtcgttatggacgctatgaacatccttgcagtttccattgttgaagacagccctgatgccagctgtctcatcattccccatgttcaagagcatcccagcattgctacctcaggatcccatgtcctgaatgcaacagagtgatttcgctgctgaattactattcatggcatggctcttcacagcatttattcatccatgtatctatccattcatccttccagccagccaagaagttcacgctttcatcttttcatccatttactcacctatttattcatttagcaaatatttattgagtaccaactatgtgccagacactctgctaggcattttggggaagcagaactgaataagatactattcctttcctcaaaaatttgagcaagaggagaaaggaagtaatgaggaatattccttagccataaaggaaaaataagaaatcacttggaagaagttaggtgagatggaaggaaaaggacatctaaggtaaagcgtacagtttgaataaaggcacagagacatgaacaaaatgcattgagggtttgaggaacagcaattggtttaacatggccagagctggggaaatggtaagggcaagctgaaaccacattgaaagcaaacttggttattatactaggtagtttagacttcaagcagttgaaaatctttgagcatgggataggcatgatgacattgtgtttatttgcatgtttctttaaagaaaactggcagcagcacaaatgttttgttgatgagggtttaaattgtagaaagtgagacaattttaggaaggccagctagagagaaatttctagcatcaaattttgctaaacacctaggatttgtagttacctccatttgggttgttacctgcaagtactgaccacgtatatgaagaagtactggtttagaccaaggcaattggcttgtataagaggcctaccctcataccaaaagccagtttccttggtctaggccagtgtttactggtatgtgtcctgagaaaactagttccatgacatgttccatgaaaaatatgatttctattgtcaaataagtgagggaaacttgcatatcatggtcctgctcaggaagatttacaatccttattagcatatcacaggtcctggtgaatactgcggtaaagtaaccgaggagctttgtaactcaggattcccgaagttgattcaaccacaggacctcatttattcacataacacctgttatcctacaaaaccactgttctctggaatacactttcgaaaacatgggtatagacaaaaactctatcctataggcagagaatacctatacctctagctcaggtcatcattttgcagatgtgtgtgtcattaagaatcagtcaataatgcattaatgatcaaaagcagaccatccttaccacatggtgcataagattatgctattatgctattagctactaatgccactaaagttaattatgttgggtctgcaacgttgtcatacacaaaggataggatgcaaaactgtcctaggccaaagcatggttattgcccaagttatctaatgtctgcaggtacatattcctggcctaaggattgtgctaaagaagttatttctaagaaatatagtgacttccagcatcatgcagaatgaccatttaatattttgaatatctagacattctgctgtagaatttaatagtccttttatacactgtctgaccaacattttgacatttactcagaaccccatcacagtgctaccacataacctcattgctaaagtgggaggcctagaaatcacagatttgtagaaaccatccaatgattgaatcccctctacttcctgttcagcaggcagcagagtgtcataaagaattaacaacgtggaactcagttactgggatttcttccattctcctttgattctctagactagaattccaaagaccctcaggctggtgatgcaagtgggaagtctcatttctgagaagtgctgcttcctacccacaattctttgatagctgagtgctttagctgatctgcataactgaggtgtgcaccaaggagcagaattactctataaattttggcatcaacatgtgcaacttgtgactcagcactttgaaactctggggatttttttgtttggttggtttttgttttaagatgtcctgtggtatagtggaaatagtacaatagactcagatacagagaggccttgtttctagtcttggttctgtcacttactatcttgatgtccttgcacaaatcaccagacctctctgagcctcagtttctccaaccacactgtgggaataataaaatcttttttacggcattgttgtaagtatgtagagaaactggtacacagtaggcacacaatcaatgtcaccgtacccttcagcccttcttttgtggatgaaaaatggtctttgtgctcccagtcaccactggggtctgttctctctctctctgctgttacagtgtggcttttggttcttgtttctttgttctttggtctgtaaattacccttgaaacaacccttgaaatttccactccatgacctaaatcgtcatccctaaattggttacatacatatttggtgacactttggaggggaaaagctttatgtctctctaactgtagttcttaagggaatttgcatatggaaaaaacagagactgcgtctcttaattcctccaaaccaaattatctgggatagcacatatatgttgtactctgtctctgagcatttgctcttagagaactatggttagagcgaagtaaatttttctaatcataaaaattaatgataccgcatatctgatacttgaatgagtacctccttgtaaaatttatacttaaatccttgagtttttaaagtgtaatagcaatagaaagattttattgttgtttacttttactgtgagtgctccaaaatccctcagttgctcttgaaagagcaagatgatgccataggcaatattttccaaaggtagtaggcagaaaactgagtacacagcacacaataggccatatatacaaaagcaagtattttgcaaataataataattcaggaaaaaagcttcactttcgttggtaacctgtttgtttaaaaccattttattatttattatttaaaaagagtgtcacttgttacagattgtgggatgtgttccttaagatcacaaaaatgtaaaatattttctttttatactgaacacatgcatagacaacttacctgagcaagctgctttttggagacatttgcacatcttttgggatcacgttgttaagaagtagaactaagggaaaaacacgcagccacccagaaatcggtagagccttcagctcatctgttattaatatttctgtgacaacagatatctaggaagtaaacaggaaattgcatcgctatcctgcatcaccttttttggaatcaggttccattcttctcagtccagttcaaccttgtgatactttttagatctcaaccaaggcatagaaatatattttcccttgcttaataccccatggaaccaatgcccctgtggttgaagtaaaaattgattgttgagggacatttcagccctctagcagtcaacaattaaaaacatgtaagcaccgagcacctgcagaaaacttggactggcatttggatctaagaagaaaatctgcatcttgaccaagatgaaaagtcaccagcccaagcttgtgcagtgaagtgtcatgttggccacaatgaaactgaaagagactgatgactctcctcagggtggaaaatgaggcatggaagctttgattagtgagctgttaggcacacagacattaatttcaaagcattctcatctccagtctgagtaataatgcttatagtattatgcaattgtttggctgctgcaagaaattcagcagactccaacaagtagtctttcttggtctctgagtgactgtaacttaaattctacctcccttctcttctcctacatcttctcactccccaccccacccccacatacacacaattcttgtccactatgttcagagagatgcacgcacacatatatatgtatatatatagtatatttgtcaataaagcagaaaagaagaaaaaactccaagtaaacaattttccatttccccatctcacttctgtcttacaagtggataggaaaagaaaaacccccagtaaaaaatggcaaccgcccacctccccaactttacatgctgcttcctatgttagaggatctgtcttaggcatctgattatggagcctgctagatacaagcccgtatttagactgctacagtcaacaatgtctctctttcatactagaaaaattccgggttggcaattgcaagcatctcaaaatgaccagaccctgaagaaaggctgacttgcctcattcaaaatgagggctctagagggctctagtggatagtctggagaaacctggcgtctgaggcttaggagcttaggtttttgctcctcaacacagactttgacgttggggttgggggctactctcttgattgctgactccctccagcgggaccaatagtgttttcctacctcacagggatgttgtgaggacgggctgtagaagtaatagtggttaccattcatgtagttgtgagtatcatgattattgtttcctgtaatgtggcttggcattggcaaagtgctttttgattgttcttgatcacatatgatgggggccaggcactgactcaggcggatgcagtgaagctctggctcagtcgcttgcttttcgtggtgtgctgccaggaagaaactttgctgatgggactcaaggtgtcaccttggacaagaagcaactgtgtctgtctgaggttcctgtggccatctttatttgtgtattaggcaattcgtatttcccccttaggttctagccttctggatcccagccagtgacctagatcttagcctcaggccctgtcactgagctgaaggtagtagctgatccacagaagttcagtaaacaaggaccagatttctgcttctccaggagaagaagccagccaacccctctcttcaaacacactgagagactacagtccgactttccctcttacatctagccttactgtagccacactccttgattgctctctcacatcacatgcttctcttcatcagttgtaagcctctcattcttctcccaagccagactcaaatattgtattgatgtcaaagaagaatcacttagagtttggaatatcttgttctctctctgctccatagcttccatattgacaccagtttctttctagtggagaagtggagtctgtgaagccagggaaacacacatgtgagagtcagaaggactctccctgacttgcctggggcctgtctttcccaccttctccagtctgtctaaacacacacacacacacacacacacacacacacacgctctctctctctctccccccccaacacacacacactctctctctctctcacacacacacacatacacacacacttctttctctttcccctgactcagcaacattctggagaaaagccaaggaaggacttcaggaggggagtttcccccttctcagggcagaattttaatctccagaccaacaagaagttccctaatgtggattgaaaggctaatgaggtttatttttaactactttctatttgtttgaatgttgcatatttctactagtgaaattttcccttaataaagccattaatacaccaatcgtattttcttatttacaacagactgagagaattaatgctgttaacattggatcttttttcttttttttttttccttttttttctctctcgtttgctttccaggtcatgctgacctgttcagcttggactgtttcacatttgtttttaatgtcagtttaaatgtaattgtaaaagcatgtatgctctaaaatcatgtagttacttttttcagtggaaaagcctggtattcgaaagcatttccaggctctgcaatttcatatgagcaggtttttggtaaaatcttttgtccctcactcagggtggtatctggacagtgagcccctttcttctggctcagtagtcagagagaggagacttggagacagtttctgctggatcctgtgctttggcaaggatgtgcagcattgcatatcattctatcattaattatgtttactcctccatgaactaaaaaccattagactaaatagtccaacataaaccttgaaagataaaatttgatattcttttgcctggccatttctctgacccagaattggggctgggaggggattggagacttgggggaaagaatcaaggagccttcttgcctgggggaatttggcatgcacttattaatcccatttggttgcactccctactaatccctcactccatacctgccaaggattggctctgctccctgcttctcatccctgtcctagttcttcctcacctatctccatttcccactactgatccttctctccagtaagatgctattcaacccgatgaaatataaagagtagcaccaccctggaagtcaggataccttagttttagctcctgctctaccattatctagctgtgtgacctggggcatgacttaacctttgctcttcagtctgaacagtctttaagaattggtttggaggaggaaggaagggatagacaagatccaaggcctttgaactcttttttggaaatgggtccttttcttcaaacaaaatttgatgcagagtcccaaatttacctacagaataaaatactgctgttcttgtttgaaaggaagtggggtgcttggagccacatgctcaggcccactttgccccctctcaggaaccctcgaaaaaacttataggacttataggactgttggggatctgccaagtctctcttatgttacatttcagtccttgtgaaactctatatgtttcatcagttcactttttcagaaagttcacctgcttggggtaaaggtcatgaagtggagaatgtggggctcagtaactagcaatagtaaaaaacatcattgattggcttgcagaatttactctgttctaagcatcttacacacatactcatccgaaaactcacaacaaccttgtgaggtagatctgttattatcttaagattctgaaacctgccagcatgactctcaatctttgacttgagaccagttgcccaacatggaaggttatacttttcacagtttaccaccataagcagtctttcagagtgatttctagctagagatccattcttagaaaaagtcagaacctgcccattagcatacactgtcacatggtgcagagtaccttcactgggttcatctcatttcctcctaaaaatagtcctatgcagtagtccagtcatatcatcaccattatatagatgagaaaaactgaggtgtaggagaaatcaagagatctgttcaaggtcacacattccataagactctgaataccaccatcaagaataataaaccttttatgtgaaaagcattttagaacttcagtgtcattattgcattctgcctcctggagttcagtgcactttttcaccatgctttaatcttggagtcctggtggtacagaatctgccttctactctcagacaacaccacagtgtctttatccctcataacaaacttatgaattaagtaatgatattatccccattttacaaattagttaactgagataccaagaggctaagtcttgcccaaagtcacacagctagtcagtgatagagccggagttacaaatgaggcatcctgactccagaatatttgctcttaactactactctttatacatatgtaaggaaactaaaagcaaaagagggaaagatgtccctgaggccccacagtgagctcccctgactcacaatccagtattcctctgaccttctaatcctaaagttatacagtaaggtcccttgactctaatcctagtagatggaaagatggctggcatgatttaagccagaggccacaaactggcttccccagagccagaattcacctgcagaattctgtttgtccagcacagtgtttgtttagaaaattgacgtagactgcccctaggcagggcatcaatcactgtcattgtccccagccctccttatttatgtttgccaggcttttttactcatttatgtgtctgcctgacttgtgaaggtatttgagtttatgacttttagatttaagcattgcaatatataagcactgcacacatgcattcacaaaagtatagcctagtctagcttcacaaagaatttgtagccctacaccaaacacacctttatgtttacttagtgtttagaattagatttaagatcagaatttagtttcacaggcattcatgtgtggaagaacctcagttattgttttttgtttcatactgtctcacccttgctttccctgctgtgtctggacccctgtcaatcctgctttctgccattcttcatgcctgagttagggcccctgcaagccattcactggttaatctttaggaatgaatggagagtgaaaaccagtttggagggttcactgtgtcccaagcatcctctcatttagttctcataagtgtcctaagagacaggtagcagcacattcgttttataaatgaggaaactaaatctcagagaagctgaacaaagacctcaaagtcattaaggtagtaattaacggagccgggatttgaacgcaagactgttggactccagagcctattcttttgccctacaccacagttccttacaaggaagatgtattcattttctattactgcataacacattgccacaaatttagcagcttcaaacatttatcagctcactgttttgtaagtcagaagtctggcacagcatggctagattctcagttcagggtctctgaaggatgaaactgatgtgtttaccaggatgcattctaatctgaagctcagggttctcttccaagctcatgtaattattgcaggattcagttatttgtggttgtaggactaaggctccctcttcctttctggctaccagccaagggccattctcagctcttggaggctgccctctttccttatcatgtggaccccaacgccttcaaagccaacaacagagactcttccttgtgttgaatgtttctcactctacggatgtctttcctggaggatcccagtcccgtaagggctcacctgatgaggtcaggtacatcaagaatagccacccttcaaattcaactgaattagcaccttcattacatctacctagcctttttacaacagcatctaggttagtgcttgactgaatgactggaaactaaggtctcagaatctcggggaccgtcttagaagtcagcctactacagatgttgattcttttcatgtgtcaaatttcatagtgagatagggagaacagaaacatcacatccttgaccttaggtaaagggattcaaacttcctaagactttggaaacttcacgccactttcaccttttccttaatcatggttgagaaggcctatatcttggagtggccaggagtgagactggaacagtacctaaaggttaaggacgctaaagaagttacagattggttacatctgctcctccctaggaatgatccatggaacctgatttgaaatttttttctctggtgctatagatagctcccacaggggtctaatgccccagggctgaaaagttagttccccataggatccatccaggcatgatatcaggccaggtgttacaatctcctaaagaggaggtatggactggaaagccccttgccaatggccctttcttgtcactgctctgacccaagactaacagggcagagatagtgaactcacatactattaaaactatccacttatacttccccctttctctttgctttatcactccatttaagtaaaccaatgagtctctgccttgacacagtggcaagctgacctgtatcttatatgaaagaattagatttgactctggggctcaggtgcagagggcaggaggggcataaggatggccttcatggaagaaaagaagtccttggatactgagtaacagctgagactagcaagcctcattgtccaggattccaagtcgtctagcaacatcctggtctctgctgcagacagaacagaggatcccccggcagaatgaatggagtctgatttcaattacgttcagtatagtcactctctttaggcagagaagccagaacacctggtgcagctagggccactgtggtcacagggacaagcacactacctgggtcctggaggcaagtgggaatgcagtttttcttccttaagcagatgccatataggcctggggaggaggatgtgagaataccagccaagttctcattggcactatacagagaaaggggaattatttcatcttgatggattctccccacagtctctgcacatattgatcttacttgtaatgagtttgcttaggttcacgagtcatcatcccagggagatctgagtcattggtgggaaagtcgaggcgacagattatatctcactgatctcactgtcaccaattgctctgtgtgtccctccaccttttgaaaaagtccatggattcatttgtgtgtaattcatttggatttatttcttctttatcaatagctttagtggggtattgcaaatgggaaagttgccccagagaacagtgtacattcacagcattattcagtagaactttctgagatgatgaaaatcttctatatcttatgttgtacaatataatacagccactaactacatgtagcttttgaacactggaaatgtggcaggtgagactgagggattatatttttaattttttaatgttgtaattaatttaattttttaaaatttttgctttctattttatagtttaataattaaactaaacttacgtagcccacatgtggctagttggctactatactggacagtacaagtctagaaggatctcagagagacacatgctgagatacagcaggaataagtcaaaaagagagccaatgtaacatagggaattctggattgggaattagagccctggctctaatctcagctctgccactaggtgaccttgccctctctggcttcagcctccccatctttgacttgaaaggttaaactaactaacgtcgaaagtcccaaaatggtggctatggactgaattcaattttgggatacacaagtttcaggaattttttaaaaatctattaatgccttctaggtgtgtgtatgcacgcttgcagacatgtgcccatgcacaagcatgggaaggcagtaaggcattcatttcaattcaccagtgtactaaccattcacacacacacacacacacacacacacacacacacatgcacacacaccctactgtattgcctatgtagagcctgaagatcttttaatctgtcaccattggataagataatttctaaggacccttcctgttttgtcatgctgaaaatctttaagccactatagtgtcccaaatctattccagtttgggcagatgactggagtattctcatagcctcctgtctattcccttctggatttgatactagttatgaagtttggagtcaagggtgaagaagggaggcagggatgatataaccccagccccactcctcaactctgcttttgagttagaagtagggttcagggcttcagattccttggggaggcagtagagagaatatgggctttataatcagaagatgaggttcagatgattgggttctcaccttttttatagctgtgttacctcagtttattcatttgtaaaatagggataagaaatatctttaacctcctaagatcatgtggaattaagtgatgtaatgtgatgaagcgaggcacgcagaaggccctgaaaaaattagtagttacccttaaggggactaaatggtctggcaactcccgagctcaaagctagaaaggtccagtaatggggaagatggggtctttctgtaggaactgtagcaggggagcagatcctgtaggccaccagtctgtggagctgtgtccaagaactcatgtttgcaataagcccaccaaatgacaagttattgtggggttcaggcctctaactcaagaagatggtcttggcccagatcataccttgcagcctgtgcctttggtgggatgtgggtgttggcagtggctatgcatatctccttattactggctgtgccaaagccccgcagaaatgattgttggacaaagtcatcttgcactcagggctggttttccaggcttccttgttattttcccctgagttcttctgtgttcctcttgcaacaccaaccccactattttcctcttccctaccctagttgttggtccaaacatgtaatccattcttgcagtgatttattgggtgacaccatgactggagtttgcattgaaggacttctttttctaattagaactaaaagtcagttccaggctgggtgtggtggctcacgcctataatcccagcactttgggaggccgagatgggaggattgcttaaggccaggagtttgagtccagcctggacaacatagtgagatcccatctctacaaaaaatgttaaccaggagtggtagtgtacaactctggtcccagctacttgggagactgaggagggagaattgcttgagcccaggaagttgaggctacagtgagctttgatcgtgccactgctctccagctgggtgacagaggaagatcctccttcaaaaaataaataaaaactaaaaaaaaagtcagttccaggttgtatcttttttcacaggggccagacacagatgagagcaggttttgttgtatttatccatttaaattgagcaataaaattctctctttggtttctacctttcttatttattattattatgttaaagggattaaagtggttcatggtctttctcagtgcaactgcttatgctagacctcagaattatgaccttttcaattatttatatttctgtctatataaatactggaaaaaatagtacaaagtaagcatcggaatgcctaaggacctctaaattgtgtgtgtgagcacatggggaagatggttcttaaggtttgagttttggattattgtggttgtcttaaataatgttatttctatcattctttccaatgactgtctcctagcatagttcccattttacagactgatggcagaggcagaaagattctctcacttctttgatactattgaggacttcagcctttcaccgctcttctcccctttgctaaaaaagaaaaaaatcaatatgtatgttacagtgcatttttttaaatattttttattatactttaagttctagggtacgtgtgcacaacttgcaggtttgttacatatgtatacatgtgccaagttggtgtgctgcacccattaactccttatttacattaagtatatctcctaatgctatccctccacccttccccaaccccacaacaggccccagtgtgtgatgttccccttcctgtgtccaggtgttctcattgttcaattcccacctgtgagtgagaacatgcagtgtttggctttttgtccttgagatagtttgctgagaatgatggtttccagcttcatccatgtccctacaaaggacatgaactcatcattttttatggctgcatagtattccatggtgtatatatgccacattttcttaatccagtctatcattgatggacatttgggttggttccaaggctttgctattgtgaatagtgccacaataaacatatgtgtgcatgtacctttagagcagcatgacatataatcctttgggtatatacccaataatgggatggctgggtgcaatggtatttctagttctagatccctgaggaatcaccacactgacttccacaatggttgaactagtttacagtcccaccaacagtgtaaaagtgttcctatttctccacatcctttccagcacctgttgtttcctgactttttaatgatcgccattctaactggtgtgagatggtatctcattgtggttttgatttgcatttctctgatggccagtgatgatgagcattttttcatgtgtctgttggctgcataaatgtctttttttgagaagtatctgttaatatcctctgcccactttttgatggggttgtttgtttttttcttgtaaatttgtttgagttctttgtagattctgggtatttgccctttgtcagatgagtagatggaaaaaattttctcccattctgtaggttgcctgttcactctgatggtagtttcttttgctgtgtagaagctctttagtttaattagatcccatttgtcaattttggcttttgttgccattgcttttggtgttttagacatgaagtccttgccggtgcctatgtcatgaatggtattgcctaggttttcttctagggttttatggttttaggtctaacatttaagtcttgaatccatcttgaattaatttttctataaggtgtaaggaagggatccagtttcagctttctacatatggctaaccagttttcacagcaccatttgttaaatagggaatcttttcccaatttcttgtttttgtcaggtttgtcaaagatcagatggttgtagatacgcagcattatttctgagggctctgttctgttccattgatctatatctctgttttggtaccagtatcatgctgttttggttactgtagccttgtagtatagtttgaagtcaggtagcgtgatacctccagctttgttcttttggcttaggattgtcttggcaatgcaggctcttttttggttccatatgaactttaaagtagttttctccaattctgtggagaaagtcattgatagcttgatggggatggcattgaatctatgaattaccttgggcagtatggccattttcacgatattgattcttcctacccatgagcatggaatgttcttccatttctttgtatcctcttttatttcattgagcagtggtttgtagttctccttgaagaggtccttcacgtcccttgtaagttggattcctaggtattttattctcttagaagcagttgtgaatgggagttcactcatgatttggcttctgtttgtgtgttattggtgtataagaatgcttgtgatttttgcacattgattttgtatcctgagactttgctgaagttgcttatcagcttaaggagattttgggctgagacaatggggttttctagatatacaatcatgtcatcggcaaacagggacaatttgacttcctcttttcctaattgaataccctttatttctttctgctgcctgattgtcctagccagaacttccaacactatgttgaataggaatggtgagagagggcatccctgtcttgtgccagttttcaaagggagtgcttccagtttttgcctattcagtatgatattggctgtgggtttgtcataaatagctcttattattttgagatacgtcccatcaatacctaatttattgagagtttttagcatgaagggctgttgaattttgtcaaaggccttttctgcatctattgagataatcatgtggtttttgtctttggttctgtttgtatgctcaattacatttattgatttgcatatgtggaaccagtcttgcatcccagggatgaagcccacttgatcatggtggataagctttttgatgtgctgctggattcagtttgccagtattgtattgaggttttttgcatcgatattcatcagggatattggtgtaaaattctctttttttgttgtgtctctgccaggctttggtatcaggatgatgctggcctcataaaatgagttagggaggattccctctttttctagtgattggaatggtttcagaaggaatggtaccagctcctccttgtacctctggtagaattcagctgtgaaatccatctagtcctggactttttttggctggtaagctattaattattgcctcaatttcagaacctgttattggtctattaagagattcaacttcctcctagtttagtcttgggagggtgtatgtgtcgaggaatttatccatttcttctagattttctagtttatttgcatagaggtatttatagtattctctgatggtagtttgtatttctgtgggatcggtggtgatctcccctttatcattttttattgcatctatttgatttttctctcttttcttctttattagtcttgccagcagtctatcaattttgttgatcttttcaaaaaaccagctcctggattcattgattttttgaagggtttcccatgtctctatctccttcagttcttctctgatcttggttatttcttgccttctgctagcttttgaatgtgtttgctcttccttctctagttcttttaattgtgatgttagggtgtcaattttagatctttcctgctttctcttgtgggaatttggtgctataaatttccctctacacactactttaaatgtgtcccagagattctggtatgttgtgtctttgttctcattggtttcaaggaacatctttatttctgccttcatttcattatgtacccagtagtcattcaggagcaggttgttcagtttccatgtagtagagtggttttgagtgagtttcttaatcctgagttccagtttgattgcactgtggtctgagagacagtttgttataatttctgttcttttacatttgctgaggagtgttttacttccaactcagtggtcaattttggaataggtgtggtgtggtgctgagaagaatgtatattctgttgatttggggtggagagttctgtataagtctattaggtccacttggtacagagctgagttcaattcctggatatcctttgtgtcttgttgatctgtctaatgttgacagtggggtgttaaagtctcccttgattattgtgtgggagtctaagtctctttgtaggtctctaagtaatcactttatgaatctggttgttcctgtattggtgcatatatatttaggatagttagttcttcttgttgaactgatccctttaccattatgtaatggccttctttgtctcttttgatctttgttggtttaaagtctgttttatcagagactagcattgcaatccctgcctcttttggttttccatttgcttggtagatcttcctccatccctttgttttgagcctatatgtgtctctgcacatgagatgggtttcctgaatacagcacactgatgggtcttgactctttatccaatttgccagtctgtgtcttttaattggagcatttaggttaatatttacgtttaaggttaatattgttatatgtgaatttgatcctgtcattgtgatgttagctggttcttttgctcgttggttgatgcagtttcttcctagcctcgatggtctttacaatttggcatgtttttgcagtggctggtaccggttgttcctttccatgtttagtgcttccttcaggagctcctgtagtgcaggcctggtggtgacaaaatctctcagcatttgcttgtttttaaagtattttatttctccttcacttatgaagcttagtttggctggatatgaaattctgggttgaaaattcttttctttaagaatgatgaatattggcccccactctcttctggcttgtagagtttctgccaagaaatccactgttagtctgatggcttccctttgtgggtaacccgacctttctctctggctgcccttaacattgtatccttcatttcaactttggcgaatctgataattatgtgtcttggagttgctcttctcgaggagtatctttgtggcgttctctgtatttcctgaatgtgaatgttggcctgtcttgctaggttgggtaagttctcctggggaatatcctgcagagtgttttccaacttggttccattctccctgtcactttcaggtacaccaatcagatgtagatttggtcttttcacatagtcccatatttcttggaggctttgttcgtttctttttactctttttttctctaaacttctcttctcgcttcatttcattcatttgatcttcaatcactgatacccttttttccagttgatcgaatcagctactgaagcttgtgcattcgtcatatagttctcgtgccatggttttcagctccatcaggtcatttaaggccgtctctacattgattattctagttagccattcgtctaatcttttttcaaggtttttaacttctttgcgatgggttcaaacttcctcctttagcttggagaaatttggtcatctgaagccttctctcaactcatcaaagtcattctccgtccaggtttgttctgttgctggtgaggagctgtgttcctttggaggagaagaggggctctgatttttagaatgtttcagtttttctgctctgttttttccccatctttgtggttttatctacctttggtctttgatgatggtgacatacagatgggattttggtgtggatgtcctttctgtttgttagttttccttctaacagtcaggaccctcagctgcaggtctgttggagtttgctggaggtccactctagaccctgtttgcctgggtgtcggcagcagaggctcagaacagcgaatattgctgaacagcaaatgttgctgcctactcattcttctggaagtttcgtctcagaggggtacctagccatgtgaggtatcagtctgcccctactggtgggtgtctcccagttaggctactcgggggtcagggagccacttgaggaggcagtctgtccgttctcagatctccagctgtgtgctgggagaaccactactctcttcaaagctgtcagacagggacatttaagtctgcagaggtttctgctgccttttgttcggctatgccctgcccccagaggtggagtctacagaggcatgcaggcctccttgagttgcggtaggctccacccagttcgagcttcccagctgctttgtttacctactcaagcctcagcaatggcgggtgcccctcccccagcctcactgctgccttgcagttcgatttcagactgctctgctagcagtgagcgatgctccatgggcgtgggaccctccgagccaggtgtgggatataatctcctggtgtgccgtttgctaagaccattggaaaagtgcagtattagggtgggagtgacccaattttccaggtgccatctgtcacagctttgcttggctaggaaagggaatttcctgaccctttgcacttcccgggtgaggcgatgcctctccctgctttggctcacacttggtgcactgcacccactgtcctgtacccactgtccaacaagccccagtgagatgaacccggtacctcagtcggaaatgcagaaatcactcatcttctgcgtcactcacgctgggagctgtagactggagctgttcctattcggccatcttatgaatcatgcatgttcaactatgagcaactatgtgtattcaatgggaaatggaataccataaaattgtcatatgttgagcccaaaatgataggatagaatttgatagtctgaggatggaaaggaccttcaaggccacttttaaaaaccccattcccatatgatgcttgaattcttaaccactgtgtgtctagtattttctcatttccagtgatatgtgtgcctgccaacctttccgtctccaagagctttaactatcaaaatgtatgtgtgtgtgtttttgtgtgtgcatgtgtgtgtgagtgtgcgtgtgtgtgtgtgtgtgtttagagagagagagagagacagaaagagaaggagagactaaaatccaattcactgttctttctgggacccaaagaacaagtctagtcattctccatttctagtctctttccctagcaatcggctagacatgctagacatagacacatgtacatcactcctttgaattacaacattcagtatttgtctatcacttatatgataaaatacaaacttagcttttatttttatttttttagagacagtgttttactatgtcacccaggctagagcatcagtggcacaatcatagcccactgcagcctggaacccctgggctcaaggaatccttccacctctgcctcctgagtagcagagactacagatgtgcaccaccagacccagctaatttggttttttactattttttgtggagatggtgtattgtcttgtggtgttgctcaggctgatcttgagctcctggcctcaagcactcctcccatctcagcctcccaaaatgctgggattacaggcatgaaccaccttacccagccaaatttcttaatatgatatacatgctcctttaaaatcaagcaccatctttgctttcaacctcattattaaccactttcccatatatgcaacatatgtttcagccatactagtgtctagtttttccctgaacactccttggtgcttttgtttatgccctttctgcccacctttgcctggtgaaatcctcatcaatcttcaaattctatcaaatactatcttccatataaagcattttctaaacccacctatgtaaaaagattagtgttttcctattttgttgatgcctccattgcagcattttccagtccaacgttttctagaattgattgtggccaggctaccagactgggccagggcctgtgtcttttctgtcacccagaagcaaaggtctaacaatggatatctgctgaatgaatgaacgaaaatgaatcattaatatattagtaaatacgttaattaaagttccaggtatgaatactgaaggctgcattcaggcagagctggatccaaggatatgctaggttggtctagcacaagaatcagagttttcctctgcaagctatgaaaaatttgggtttagcaggtatttgggatgatgaattatacatttaaccagtgttgaatgagcacttgtccttaaggagtttagagtctgtgaccagggagaatggtgattttcttagctagggcagtttttctaaaaaggtagttgcattgtgtgtttttgaccactgatgataaattcaagtctctcttccttcccaatagcccggaagctgaagaaacttggtaatctgaaactacaggaggaaggagaggcttccagcaccaccagccccactgaggagacaacccagaagctgacagtgtcacacattgaaggctatgaatgtcagcccatctttctgaatgtcctggaagccattgagccaggtgtagtgtgtgctggacacgacaacaaccagcccgactcctttgcagccttgctctctagcctcaatgaactgggagagagacagcttgtacacgtggtcaagtgggccaaggccttgcctggtaaggaaaagggaagtgggagcatgagataagggggatcatatttagtgaacgctcctatggaccagccaccatgtctggtgcttttctgcccattaactcaggcagtcttcatcataaccctgtgggagagggattgttacaagtctcaatttaaacatacagggatcgaaactcagaaagcaaagagaaagatagtattatcgggtgtcttatgtggcccacattgatgcacagcagtcatgctttcatattcaactcacaaaaatggtcagcaaattttccattaatcacaaatcacatagacatacccatatatgccttaggatgctcttctatatttgcacacacaggctcaccccaaagataatctctagtttgactgacattctgtcttcaatgtcatctttaggagctatatcatgggaactctcataatatggtatggtggaaagaacatgaggttgggaatcagaacacttcgggtctgctcttagctctgctagtaacttattgtgtgatcccttccccttctgggtctcaatttctctatctgtataatgtataaagcgtggtttgtatcaaattgatggtttccagtttttgaaaaaaggaacgctttttgcaccttaaactacctaaggaatcataatgagaggaaagattaggtaatagtgaaagaattaccaagtgttggtctaacagaagttggataacagaagttcctcagtgatggggaactcacttctttcttatgtcatctgttgtttaaacaagtctggttattaaaatattacagcttaaggaattcttagagatcctctatccaatgattcacaaactttcctttagcagccaagtgctttatttctcaaaagaattgtacacagatacaagtggagctagtttatttaaagccagagcctgtagcttgggcctcaccagttcagcctctttctctctatcccagggaagccctaggtcactcttgcaaaatcttagggctccaaggaacacagtttgaaaaccagtgaagtatatgccctttaaaggttctcctaatcctgcaattatgattcaaagattcttttgaaataacaacaaccaaaccttctcttgtggagtcaaagattaacctgcctttcaataataactgccattcaggtagaaatttatagtgaacagagcaattttgtatgtattacctgaattgattcttataggaatcctataacatgagattctttctcttattttacagaccaaatagggaagctgtgagaatgatgtgattggcctatagttacatagtcagaaaatagcaggaccagaacttgagcccaggttctctcctgattccaaattctctctattccactccacctgtaggctgtagcaccactgcagttctgtagctctgggctttacagtgaggggccaaggcttcattgaaggccacttgggtcatagtatgggcttgttgcatttgaagacatttcatgttggctgtcaagtcttagatttgtatttccaactcacagggcctggtcacagccctaaccatctcttataccttctcagcttgggaagctgaggtcgactagccaataagaacactgggaaggaaacccaaggactctgactggatatgctctgtgccaaaacagagggttcactcagagaggaaaaatataaaaaagaaaaaggagaaggttgctttaattcttatcactttttcatctggatattttgatatcatgtgtttgacagagattcaaagtttaatcttcccaagcagtttccaaacacttatctcattttataggctacagagctttttcatatatatgatcccacttaatctttacaacaattctatgaatcatagagactattatttccatttcacatgccaaggctcaaagaggttaactaacttgctccatttggtcacttaacacatggaaccagaacttgacctagaccttcgggtttctaaattggttatcttgacaataacctagtgcaaaacactatagcagaatttgtatgacttgggatcactggggctttccttggcccaaccaccaagatggaaagccccctccccttacattaacaaatctgcaagccaatatcagttcaccatctagcttgccagactaaatgatttctgaccccaagtcttttaaaagaatagcttcaaaagaaagccaattaccacattcacaagaactgttcttcatattatctataattacctacaagtacaagtaatttgctaattcaatagattgagttcttgacctgtaagatgaactgtgctaggcccctaataagataaattttgttttaagttttctgtgacagtaaagatgtatgaaaattgcctagtagagtacctggcacattaataaatgataactgttaatttggagtgggtgagtagactgggtgtgcacagtatatttagaatcaaatttatctggtttggaatcctagctatggactagttctgtgaccttgagcaaatcacatgtcttctctgtgcttctgtgtcctcatttgtaagatgatagaataatcactacctttcaaattgttgtcaacaaaaagattatgtataaagagcacctagtaacgtagcctgaaacatagtcaatgctctgtaaatggtggtttattattatgagacttgaatgctaagccactgctttcacgaaactcaattttagctaccacttgccttgcctagaagctcatgcatggaccccaaggtgaaattgtgttctctgaagacctcggctggcagatgtactacagcagcaaagatttccaaactggcctttctttgagcccattctcccagactagacaggagactacaagtttctgctgcacatgaaaaaaatatgatgtcaatcggattctagtgagaaaacagagtctcaaagaaactgcttctgctccctagcgtgtttaatgtgtttcagaacctgagaatgactcctctctgtttctccagaacagcctaacacagtggcaaatgggtgttgagtgaatgcatacttaaggaaatctgtagggttgcagctactctttcctcaagtaatcccttgatagtcatgtaggctacttcagagattgggcattagagaacagagtcaggtattataatcagattagactctagggaggttagccagccatattgctgatatgtgcacagttactgggtttgagtgctaagcagctctcattaaggacggttaattaatattatggccaaattaagctttcccttttctctcctctttgttagttcggtggcattttagggagaaaaaaataagcatcagtatggacaatttgcttgatacctgtacaatttaattctcatccttccatgtgccttcacattcacacattccaccagaagaccaaggttcaccagccaaaagcttttcttgctccccactgcctcctacccaagatattcagggtcaacctcccaggcctcttctctaagagatccttggttgctacatgcttagaccctgcttcttatttcctgctgagaagggtcagtccaaggcattctgtgctacagaagggttccaagcaggaactactctgggatctgaggctccagccggtctgtcagcgtgtcattacagtgaaggtgggaagcacaggcctgggagctaagactgctaagatgagggactctagaatccctgatacctggaaggcctaggatctaaaagaaaagaacagggaaatggggctatatgagtggacagggaccaaccaagcagaacaatgtgtctggataatgtagacttcagacctgatcctatggctgacaaaagctggtgaccttggtagttcctgagctgtaaccttcattagtggagtagaaaaaacactggagaagagaatcagaacacctgggttctagtattagttcagccacatataaaccatatgaccttgggtaagtcagtttatttctctggccctcatgttccttgttggtaaaataagtgccacatcacctaacctctgggattattgtgagagttaaattaggtcatcaacaggaaagtgagaagtttgatctaaatttggggaagcattcctaatgaggtatgatgacaaaatttcagataattctggatttgttggtgagaagagagagtgttggtagggacgagctctgaggtgatgcctttataactttaagcatccaactgtttcaaaaactccaggagaacatggccatgtctgttctacctgtgtattattgtagacgtagcttctgggagcctctgctctctgagcttaagggaggtaatttggagatcatttaattctcattttacaaaaggaaaaaaaattgagggtctttaggccatttgtttaggtaatatttcttaagtgcccactcaaatacgtggactgtactaagtactagggaggtaaagataaataagaagatatggtccctgtcttcaagaagctccaagtcttgtgggggagacagacatgtatatacatagacttcaatgctgtgtaatgactgctataattgggtgaggctacacaaggtgcaatgagaatgtaaaagaagaatctttaagccttcttcttggatgagttgggaaagccttcacagaagaggtagcctttgagtgaagacttgaaagatgagtagtgtttaccggatgaaaggcctgagaaggaggaatgcattctaggcaaaagtaactgcctgtgcagagataacagagatatagaggcatgtgagagcgcaagtggcaagagatcagtctaggtaggcaggtcataaagggcctattcatgtataatgatggcagtaagatgaggatggcagtagggtgggaaattagtagggccagggtacctattgagtagaaaagaatggagaggaaatgccaggcagaaagaggatggacgcaagagagggaacatgaaagtggtgaacaggtggcagtggctgtcaagacatctctccataccctgtacactgtatgtaatatccatctcccagggttgttagaagggtcaaaccagatcgtagctggaaaacagctttgtgaagtgaaaactgctgtttatgtgggggaaatgattgttaaactgcatctttggaaaggtgaagtgatcaagagcacagaccttggaatctgactgctttgctttgtaacttggtctgccaattactagctgtatgatcttggacaagttccttaacctctctctgactcacttgtactggttcacagaatggagataataatagtacttaccttactcattgttgtgaatgttaaatgagataatataagtaaagtgcttagaaaagagttaaatgtaccccataaatacatacaactatcatgtacccaaaattatttttaatttttttaaaaaagagcaatccaatagcaaaagaaaaaaagagttcactcatataagcagtcaataagtgttagattatttttctcttacaactgacaatgccctttttgtctccatcatcatctcatttgagcagctcagggaagtagggaggataaggaatattatcctcaccatatagtttgtgcttttccccaccaccccttaatggccagcctggatggtccctggggatccttaggggatgcccgaataccagagcatctctgcccaacagggactcagacttagctcaacccgtcagtacccagactgaccactgcctctgcctcttcttctccaggcttccgcaacttacacgtggacgaccagatggctgtcattcagtactcctggatggggctcatggtgtttgccatgggctggcgatccttcaccaatgtcaactccaggatgctctacttcgcccctgatctggttttcaatgagtaagtgctcctggggcccagacctcactaaaatacagcagcttggccagacctggttggtggtgatggtgatggggtgacagtgaagcttagctcatttgatctgcagttgtcgcagcggatgccccagccagccaatccagtatgaggcggctttgccctggctttcagccaactggcaggagcccaggaggatggtgctgagaccacccctttcacacccaagaaccaatcctagtcatatttctggtctgctttgcagcttatctcaaaaccacatggaaagattcctccccttcacatataaaagaggcagaaagactctggctttaagggctggagtttcttgggttcttttgctaccaccaaaggctacttctagtcaccatttgctgagcaactagtttgtgccaagactatgctagatactttctaaatcctagctcattgagtcctcatggtgacctgacctcacctttttatagataacactatttttttatggatggggaaaatcaggctcagcaaaataaagtgactcacccaaagtcacagagctagtgcctgttggagacaagattcaaacgtatgtccctgtcgatctcagctcttctgcgtcatggtggtaactgatgggaaggagtacctctaccgctctctggctgtgtgaccttggtactgccattttccttcccttaaacagctttaattaatacctgccctgccaccagctccatataacatcatgaatttggccagtggctcagattttggaattacatttttctccactaaaatctcagttctactattttcttagtcagcatctttgggaaagacctttaacttttccgaccctcaatttcttcatccattaatgataacagaaccttcataagtaatttcttatgataactaaatgggaattgacagatgtggaatgtctggcccatagtaggcaagaaggaaaaaaaaagtccctttctgattcaccctttccctaatagtgatacattttttttccccgagatggggttttgctctgccacccaggctggagggcagtggcgcaatgatctcagcccagtgcaacctccacctccctggttcaagcaattctcctgcctcagcttcccgagtagctgggattatagatgcccgccaccgtgtccatctaatttttgtatttttggtagagacgggatttcaccatgttagccaggctggtctcaaactcctgacctcatgatctgcccgcctcagccgggcatgataatcttttctatgtctgctgtatgaggtccctcgatggcattgtgaatggagctggccagagaaatcttcccaaggaccttgagctagtctcaccacagagaatccttccagtcaggacaggaattgaccttcccccctcttcagccctctaacccagaagagtcttaaaataaaatctacaggccaatggttccttccagtacagcactgcaatgcgagggagagtgagcgtccccagctgccctctcccaaccctgccagcctggtagccaaaagctaagaataaccactaggcttttggcacaaactgctttgtggttttcagatctccgcaaagttgcctatgatgccatcttctggggcaggccttgaaaagccccctaactgttcatctcccatccttaaacccctgctgcccttaagcagttgaatcaactccatgagcacctgctctaccttccccagagccctgagacctttggagctttgaaaagtgataattggttgttctctaaatcctcatttccttctctgcctctaagtaagcatgtggcatcccacctcggcttcctggtccagtcttgttcatcttataaaaaggcctccctacggggtcagaggcctagacccatcaaacccagggctcctgaaacaataggacccctattcctcctgtaggaagccactgtgttagagctctcagggtgtctacaaacatctagataagtgtttctcaacatggattctgttgacatattgggaaaaataattttgtcattatgtagaatatggttaacatacctggcaccagcctactctataccaaataggattccagtcattctgacagcccaaactgctcccacacatttctgacacccactgaagaggcagtactctccagttgagtgcaactaatccctgccagccttcctaaggtgctaatggggagcctcagacccaaagagagagagaagaacttgtccaatgtaggtcaacccatttgctgatctcttcaacaccaagctctattatcagccctgtttttttctttctttctctctttgtagagatcacatgttgtgaggataatgagcttgaaccttagctgtgtgaccttgggcaaattactgaacttctatgtgccgcaaattttatctggagactgctgaagagtattataatagcacctttctatatgtcatttattgaacacctgctatgtgtcaggcactgtgctcagtgttttccaatcttcatttctcctcttattttctctcttgcactcccaccaaccttgttctcttcctaaattccattcctgcctcatttttctaccctccattctcctctctcttccttcctttaactgtctccctagtatttttccccttttccccctttcttttccccttcccccatgaatttcttctctttcctttccccttctctttcctccattccccactttttctgcccctgaggcctgcagcaatgttaaaggaatcctcattccagcattgtgatttcaatggtaaaaagattgcagcattgtcatcaacagaggtgggaaagtacattggagactggagcagagccagacctcagggtcagccaatcttactaaaaaattctctacagtgaaagagcttggagcaacactgttctgctcaattgatttgtgataccatctaaacacttcctctttctagttgggcttcagcctgagttgaataattctacaccatctgccctcttctctctttctccaggacagccaagatctctctgagataggatgctgagcttccacccagacaataccaggcctgctcatcctatggagtaggctagtggcttggaaaccaaaatgtcaaaccatagcctttaggctccatctgggaggtctttgtcctcaccacttaagtgggtgtcaaatttccttccctttctgcacacgctgcacaatcaatttctgtcttacacacacacacacacacacacacacacacgatttttgaagtgctgaaaactggaaggcctactagcatgaggatgctgtgtcttctcttagaggtatgccatggtcagccatggaaccgagaggttgctcttccttgaaaagctggccaagcattggccacttccccatataatttataggtgataatgtggtgatctgttcagaagtgactataataaatgcaactcacatatgtctacagtttccaaactgtggtaaggagcagccagcatatgagggaatgggctccccttcagcaggggacatttaaactagacattcaaaaacactccctggcagatttaacattggaactcgttttgaaagaacaatgtggaatctccttcactgggagtttttgaataagtatgaaatttctagtattccaggccagaggcaaaggggtcaacaggatgaccaaacacttcgggtcatttgcaaatcttgatgtcctgatgttaagagctgactactggggcttctcctaaaaatccttcatgttgagctgcctggaaggcaggttctcattctggctgtagctgagatgttagaactgtagtcagggagaccatgtgcctcccccattgtgttcatttggttaggctttcctgtccctgactcagaaaacagaaggggcacagagacctggaaattccatgtgctaacccatatcctggccagagaagatgagtagttatcagggtgtcaggattttggaaaacagagagagaaaaaaaacaaacaaacagacaaacaaacaaaaaaaccttttcctggtccctggagcaccagcaggagaaacagcaagctcttcttggaaaacctggcgagggatggcaatcagagacattccctctgggcttattgtaaacttcccctcattcctttttcctctgtgtatctccttcccaggtaccgcatgcacaagtcccggatgtacagccagtgtgtccgaatgaggcacctctctcaagagtttggatggctccaaatcaccccccaggaattcctgtgcatgaaagcactgctactcttcagcattagtaagtgcctagaagtgcagggaatgccccctgagggcacagagattcagagaggaccacttttgccattaaaacattattagggaaaagccagctcctggacatttcccttcttcattccccctccccatccccactctactctctctcagcatcattttcctaacaagaaacaatttcatgactagaagccaatttatttgctagaagtcaacctccatcagattccccacctatccccagtctgtctttgggacaaggcctttttgactggttacagcaggtctctgaatttttccatagcttctgctatagaaacagacatgggccaccttgtattctttgcagggcagtagagcaggaggcatttcctcctggaaagatttcctcttctgccaacaggaggagatctatgtaagcaactcagataggatttgtatggcagccaaggaacttttctttaatatcttttctaagagccctctcttagcccctacggagggagaagggcaaaatttgatattcaaagctatgtgttttggttatctaaatcagggttttactgtgaatgacataaaagcttaggtcctaaaaaatgagtatctgagaagagtagaaaaagaaaaggttcaggaaatttgatttacttgactcctttcagatcggatccagctatcctttcccctgagatctccctgacagactgaaggccccaagcacacagacttcaactaacaggaagccaagtagatggttccctgtgggggtgggggtcaagtctgtggtcagaaaacttggtgctttgtctaatgctccttcgtgggcatgcttcccctccccattctgtcttcatcccacatcagttccagtggatgggctgaaaaatcaaaaattctttgatgaacttcgaatgaactacatcaaggaactcgatcgtatcattgcatgcaaaagaaaaaatcccacatcctgctcaagacgcttctaccagctcaccaagctcctggactccgtgcagcctgtaagcaaacgatggagggtgctttatcagggagaacagcctgatagagccaatgataatatgcttctctagagtctggcaccacctgttgggaggtgcttccattcccctctggctttgagtgtggtccaggaagaaaatgtggtgaagaaaagaacacgggtcacagtgtcccagctggatattgtgaaaggggtggaggagttgagaacagagcagttgggactcagggaagggacttgcagcagatgaattctctaggcagacaaaacagacctggatgtttttcccctcttctttgagtcatgttcatgtgagtttgtctgtctgtgtgtgtgtgtgtgtgtgtgtgtgtgtgtgtgtgtgtgtcagagagagagagagagagagagagatggagtgcggaggcttgggtgagagcacaagctggagaagtcttgagtcagagagcttacaatggtataagacatctcttgggagccctcagtgactccatggagaccatttctttctctctctctcgctgtctctctctaacacacacacacacacacacgacctcatgggggaggaccaaggaagtacggggaagggggaggaaacaaaaggctgaaagaccaaaaatcagaggttggggaagaggctagcagaggccacctccttgtcaaccctgtttttctccctcttattgttccctacagattgcgagagagctgcatcagttcacttttgacctgctaatcaagtcacacatggtgagcgtggactttccggaaatgatggcagagatcatctctgtgcaagtgcccaagatcctttctgggaaagtcaagcccatctatttccacacccagtgaagcattggaaaccctatttccccaccccagctcatgccccctttcagatgtcttctgcctgttataactctgcactactcctctgcagtgccttggggaatttcctctattgatgtacagtctgtcatgaacatgttcctgaattctatttgctgggctttttttttctctttctctcctttctttttcttcttccctccctatctaaccctcccatggcaccttcagactttgcttcccattgtggctcctatctgtgttttgaatggtgttgtatgcctttaaatctgtgatgatcctcatatggcccagtgtcaagttgtgcttgtttacagcactactctgtgccagccacacaaacgtttacttatcttatgccacgggaagtttagagagctaagattatctggggaaatcaaaacaaaaacaagcaaacaaaaaaaaaaagcaaaaacaaaacaaaaaataagccaaaaaaccttgctagtgttttttcctcaaaaataaataaataaataaataaatacgtacatacatacacacatacatacaaacatatagaaatccccaaagaggccaatagtgacgagaaggtgaaaattgcaggcccatggggagttactgattttttcatctcctccctccacgggagactttattttctgccaatggctattgccattagagggcagagtgaccccagagctgagttgggcaggggggtggacagagaggagaggacaaggagggcaatggagcatcagtacctgcccacagccttggtccctgggggctagactgctcaactgtggagcaattcattatactgaaaatgtgcttgttgttgaaaatttgtctgcatgttaatgcctcacccccaaacccttttctctctcactctctgcctccaacttcagattgactttcaatagtttttctaagacctttgaactgaatgttctcttcagccaaaacttggcgacttccacagaaaagtctgaccactgagaagaaggagagcagagatttaaccctttgtaaggccccatttggatccaggtctgctttctcatgtgtgagtcagggaggagctggagccagaggagaagaaaatgatagcttggctgttctcctgcttaggacactgactgaatagttaaactctcactgccactaccttttccccacctttaaaagacctgaatgaagttttctgccaaactccgtgaagccacaagcaccttatgtcctcccttcagtgttttgtgggcctgaatttcatcacactgcatttcagccatggtcatcaagcctgtttgcttcttttgggcatgttcacagattctctgttaagagcccccaccaccaagaaggttagcaggccaacagctctgacatctatctgtagatgccagtagtcacaaagatttcttaccaactctcagatcgctggagcccttagacaaactggaaagaaggcatcaaagggatcaggcaagctgggcgtcttgcccttgtcccccagagatgataccctcccagcaagtggagaagttctcacttccttctttagagcagctaaaggggctacccagatcagggttgaagagaaaactcaattaccagggtgggaagaatgaaggcactagaaccagaaaccctgcaaatgctcttcttgtcacccagcatatccacctgcagaagtcatgagaagagagaaggaacaaagaggagactctgactactgaattaaaatcttcagcggcaaagcctaaagccagatggacaccatctggtgagtttactcatcatcctcctctgctgctgattctgggctctgacattgcccatactcactcagattccccacctttgttgctgcctcttagtcagagggaggccaaaccattgagactttctacagaaccatggcttctttcggaaaggtctggttggtgtggctccaatactttgccacccatgaactcagggtgtgccctgggacactggttttatatagtcttttggcacacctgtgttctgttgacttcgttcttcaagcccaagtgcaagggaaaatgtccacctactttctcatcttggcctctgcctccttacttagctcttaatctcatctgttgaactcaagaaatcaagggccagtcatcaagctgcccattttaattgattcactctgtttgttgagaggatagtttctgagtgacatgatatgatccacaagggtttccttccctgatttctgcattgatattaatagccaaacgaacttcaaaacagctttaaataacaagggagaggggaacctaagatgagtaatatgccaatccaagactgctggagaaaactaaagctgacaggttccctttttggggtgggatagacatgttctggttttctttattattacacaatctggctcatgtacaggatcacttttagctgttttaaacagaaaaaaatatccaccactcttttcagttacactaggttacattttaataggtcctttacatctgttttggaatgattttcatcttttgtgatacacagattgaattatatcattttcatatctctccttgtaaatactagaagctctcctttacatttctctatcaaatttttcatctttatgggtttcccaattgtgactcttgtcttcatgaatatatgtttttcatttgcaaaagccaaaaatcagtgaaacagcagtgtaattaaaagcaacaactggattactccaaatttccaaatgacaaaactagggaaaaatagcctacacaagcctttaggcctactctttctgtgcttgggtttgagtgaacaaaggagattttagcttggctctgttctcccatggatgaaaggaggaggattttttttttcttttggccattgatgttctagccaatgtaattgacagaagtctcattttgcatgcgctctgctctacaaacagagttggtatggttggtatactgtactcacctgtgagggactggccactcagacccacttagctggtgagctagaagatgaggatcactcactggaaaagtcacaaggaccatctccaaacaagttggcagtgctcgatgtggacgaagagtgaggaagagaaaaagaaggagcaccagggagaaggctccgtctgtgctgggcagcagacagctgccaggatcacgaactctgtagtcaaagaaaagagtcgtgtggcagtttcagctctcgttcattgggcagctcgcctaggcccagcctctgagctgacatgggagttgttggattctttgtttcatagctttttctatgccataggcaatattgttgttcttggaaagtttattatttttttaactcccttactctgagaaagggatattttgaaggactgtcatatatctttgaaaaaagaaaatctgtaatacatatatttttatgtatgttcactggcactaaaaaatatagagagcttcattctgtcctttgggtagttgctgaggtaattgtccaggttgaaaaataatgtgctgatgctagagtccctctctgtccatactctacttctaaatacatataggcatacatagcaagttttatttgacttgtactttaagagaaaatatgtccaccatccacatgatgcacaaatgagctaacattgagcttcaagtagcttctaagtgtttgtttcattaggcacagcacagatgtggcctttccccccttctctcccttgatatctggcagggcataaaggcccaggccacttcctctgccccttcccagccctgcaccaaagctgcatttcaggagactctctccagacagcccagtaactacccgagcatggcccctgcatagccctggaaaaataagaggctgactgtctacgaattatcttgtgccagttgcccaggtgagagggcactgggccaagggagtggttttcatgtttgacccactacaaggggtcatgggaatcaggaatgccaaagcaccagatcaaatccaaaacttaaagtcaaaataagccattcagcatgttcagtttcttggaaaaggaagtttctacccctgatgcctttgtaggcagatctgttctcaccattaatctttttgaaaatcttttaaagcagtttttaaaaagagagatgaaagcatcacattatataaccaaagattacattgtacctgctaagataccaaaattcataagggcagggggggagcaagcattagtgcctctttgataagctgtccaaagacagactaaaggactctgctggtgactgacttataagagctttgtgggtttttttttccctaataatatacatgtttagaagaattgaaaataatttcgggaaaatgggattatgggtccttcactaagtgattttataagcagaactggctttccttttctctagtagttgctgagcaaattgttgaagctccatcattgcatggttggaaatggagctgttcttagccactgtgtttgctagtgcccatgttagcttatctgaagatgtgaaacccttgctgataagggagcatttaaagtactagattttgcactagagggacagcaggcagaaatccttatttctgcccactttggatggcacaaaaagttatctgcagttgaaggcagaaagttgaaatacattgtaaatgaatatttgtatccatgtttcaaaattgaaatatatatatatatatatatatatatatatatatatatatagtgtgtgtgtgtgttctgatagctttaactttctctgcatctttatatttggttccagatcacacctgatgccatgtacttgtgagagaggatgcagttttgttttggaagctctctcagaacaaacaagacacctggattgatcagttaactaaaagttttctcccctattgggtttgacccacaggtcctgtgaaggagcagagggataaaaagagtagaggacatgatacattgtactttactagttcaagacagatgaatgtggaaagcataaaaactcaatggaactgactgagatttaccacagggaaggcccaaacttggggccaaaagcctacccaagtgattgaccagtggccccctaatgggacctgagctgttggaagaagagaactgttccttggtcttcaccatccttgtgagagaagggcagtttcctgcattggaacctggagcaagcgctctatctttcacacaaattccctcacctgagattgaggtgctcttgttactgggtgtctgtgtgctgtaattctggttttggatatgttctgtaaagattttgacaaatgaaaatgtgtttttctctgttaaaacttgtcagagtactagaagttgtatctctgtaggtgcaggtccatttctgcccacaggtagggtgtttttctttgattaagagattgacacttctgttgcctaggacctcccaactcaaccatttctaggtgaaggcagaaaaatccacattagttactcctcttcagacatttcagctgagataacaaatcttttggaattttttcacccatagaaagagtggtagatatttgaatttagcaggtggagtttcatagtaaaaacagcttttgactcagctttgatttatcctcatttgatttggccagaaagtaggtaatatgcattgattggcttctgattccaattcagtatagcaaggtgctaggttttttcctttccccacctgtctcttagcctggggaattaaatgagaagccttagaatgggtggcccttgtgacctgaaacacttcccacataagctacttaacaagattgtcatggagctgcagattccattgcccaccaaagactagaacacacacatatccatacaccaaaggaaagacaattctgaaatgctgtttctctggtggttccctctctggctgctgcctcacagtatgggaacctgtactctgcagaggtgacaggccagatttgcattatctcacaaccttagcccttggtgctaactgtcctacagtgaagtgcctggggggttgtcctatcccataagccacttggatgctgacagcagccaccatcagaatgacccacgcaaaaaaaagaaaaaaaaaattaaaaagtcccctcacaacccagtgacacctttctgctttcctctagactggaacattgattagggagtgcctcagacatgacattcttgtgctgtccttggaattaatctggcagcaggagggagcagactatgtaaacagagataaaaattaattttcaatattgaaggaaaaaagaaataagaagagagagagaaagaaagcatcacacaaagattttcttaaaagaaacaattttgcttgaaatctctttagatggggctcatttctcacggtggcacttggcctccactgggcagcaggaccagctccaagcgctagtgttctgttctctttttgtaatcttggaatcttttgttgctctaaatacaattaaaaatggcagaaacttgtttgttggactacatgtgtgactttgggtctgtctctgcctctgctttcagaaatgtcatccattgtgtaaaatattggcttactggtctgccagctaaaacttggccacatcccctgttatggctgcaggatcgagttattgttaacaaagagacccaagaaaagctgctaatgtcctcttatcattgttgttaatttgttaaaacataaagaaatctaaaatttca

SEQ ID NO: 24 - DNA, 41350 bp, Homo Sapiens
gactttcaagctttctagtaattttattttatcaaaacaccctcccctcccatctttatgacaccatttcattcttgccaaattcggtccacccccacacacacacccccaagctctaccaaatgcctactcaaagagctgttggacccctttgtgcggctatttacatcctccctcctaaaaaatattttcatcgcaaattcagtctgtcttaattctctcgggaaatttcaggcacaataatttcttggcctttgctcagaagccactatcccagggaatcaaagaagaggtgcattcccagatgtagagaggggcctttttgtattgagtgggagcacaaaggctccagggctcctaagcttgggatttcctctgagaaagtgaaattggggcttgtggagaagagaagtagaaccaagaagcttattggcgagctcaggattcttcatccatgacatctagaatattgctcagaagaattttgaaagtgggacgctcatctgctttctaaaaccaaagaaaaagtaaagtgttagagtggctagaatccagaattcaagggaaatgcaatgagtaagcagcaaatgtttattaaatatatgctctatgcccagtagcatgccctgtcgattacaaaaggaaaaaaaaaaaaaaaagaaatagcagctctccataaagtctttgtgcacttttcatctttagtaactcaggttattagtgtgataagaacaatttgcaaattaaactgacaatcacactgatcaaaattgagggcaagttcattatgtaactgtatacaacacattcttattttggatcctcaagtgaaaaatggctaccaaacaagttcaagtggttggcagaacagaaatcccatgtgataatttttagtgattaatatttcaaaaccacaggctgtattactgagcagggattctgagtacctgggacctttttttttttttttttttttttaccactggtaacaaaaagactaaggtttttttttttttttctttttgagacagagtctcaccctgttgtccaggctggagtgcagtggtgtgagctcagctcactgccacctcccaggttcaagcgattttcctgcctcagcctcccaggtagctgggattacaggtgcacgccatcacgcccagctaattttcgtatttttagtatagaccgggtttcaccatgttggtcagactagtctcgaattcctgacctaaggtaattcccccgcctcagcctcccaaagtgctgggattacaggcgtgagccaccgcgcccggcctacgactaaggttctttttgatggccatggcccataagcccccgaggtatttggtatttagtggttcagggaacattcatgccagaatgctctcaatctgttagaaccaatggtcatcaatttcttgattccttgactcagtgattcttaaacttagctgagtatcagaatttcctgggaagtttaaaaagagatttctgggttccacttcaggcatagctaatcagaatttctggagaaaagtcccagttacctgaatttttttttgtgacacagtctcgctctgtcactcaggccagagtgcagtggcaggatctcggctcactgcaacctccacctcctgggttcaagtcattctcctgcctcagcctcctgagtagctgagattacaggcacacatcaccacgcctggttaatttttgtatttttagtagagacagggtttcaccatgttggccagaatggtctagatctcctgaccacgtgatccgcttgccttggcctcccaaactgctgggattacaggcatgagccaccatgcccagccagtaatctgcatttttaagagctccttagggtttctgatatgcatccaattttgaccactcctttaaacaggctgtggataaagtacctgtctgaaatcatttttaattagcagagtaagaaggtcctgattgggagggagcatagccaatcacccttaatcctgcatcacacagaagaaagaaggagtcctccctttctgcactttctctgtgatctgtcatttgttcgagggaaaccagccatgctcggatccagatacccacttttcacctcaccaagaaggctccagattcacatatgcacttgttggacactctgaagagttgagcatttatttcctactagaaatttaggttgccaaggatctactgaaaagtagagaaggcatcttgggaagaactcgaggtaagaggagcaaagcagtttaatagtagtaggacagatttccttatttccaaaataccacacctacccacataccccacgatgcaccatattaaaaagcaaaacaaaacaaagcaaacaaaaaacccactacctgttttagttccctttcaagcagtaggttttaaaaaaaatctcatttagccgggcgctgtggctcatgcctgtaatcccagcactttgggaggcagaggcgggtggatcacaaggtcaggagatcgagaccatcttggctaacacggtgaaaccctgtctctactaaaaatacaaaaaattagccgggcgtggtggcgggcccctgtagtcccagctactcgagaggctgaggcaggagaatgctgtgaacccaggaggcggggcttgcggtgagccgagatcacgccactgcactccagcctgggcgacagagaaagactcggtctcaaaaaaaaaaaaaaaaaaatctcatttaggacctcagccagaaacggttggcagctaataaagtagaagaaagggccaatgacacacaaaggaatgaacaaactttcatgacttttcttttgtaatgcccattcacttgtctgaatgcctctggctgcctgcttatgctagatgacatggccccacaacacctcactccctaaagctgagctggcattggagtgtactaatgacactctagtgagaatcggagtgggcctgggaaagcctctggccatcagatgatcaagttgcaggccaaggtcagagaatgtgtgcaaggcctggcgtggtggttgatgcctctaatcccagcactttgggaggccgaggtgggcggatcacttgaggccaggagttcgagatcagcctggtcaacatggcgaaatgccatctctactaaaaatacaaaattggccaggctcagtggctcacgcctgtaatcccagcactttgggaggccgaggtgggtggatcacctgaggtcaggagttcaagacctgcctggccaacatggtgaaatgctgtctctactaaaaatgcaaaaattagctgggcacggtggcatgtgcctgtagtcccagctactcgggaggctaaggcaggagaatcacttgaacccaggaggcagaggttgcagtgagccaaaatcgtgccactgcactccagcctgggtgacagagcaagactgtgtcaccaaaaaaaaaaaaaaaaattagcttggtgtggtggtgcacgcctataatcccagctacttgggaggctgagacatgagaatcgcttgaatctgggaggcgaaggttgcagtaagccaagatcgcgccactgtactccaacctgggtgaaagagcgagaccttgtctcaaattaaaaaaaaaaaaaaaggaaaaaaaagaatgtgtgcagctatcagtctttggtggctgaatggccagctaaatgggcaagtagattcaaggaaataatttaagagatcctaataaagcacttacctcatgccagcaactgtacatgatggtatataccttctctgaagccagatgaggcctgtagagacgtaggccttgggcaatgtgttcagcagtctcactgttagtaaatctctcatatggcatcttccccagggagtaaatttcccacatcaaaacccctagaaggtgaaaaaaattattaaattggtttgcagtctttttggatagcaggggtcctagtcttcctagatcaacctcaaagattagaatcagttggttccccgctctgtgctttttatattttgcccaaatttctgctatagtactgaccacactagatggagatcaaggtcgtactagactattaactcctctagaagagagacagcatcttatttgtctttgcagttatagggtctggcagagtgcctggtacataatcagtattcagaagctgttgaaaactgaatgaattgttttccttaacatggtttaagttctaaaaaggcagagatcatgtccagtttagttttcatcctcagaaacccctgtggtggctgacacacagtaagcactccccaaggattggaagaatgaaagcaagaacaatatctctgtggaggttgcaaagtgtgaattttcccattgcatttcttatcctttgagctgtataatctgtgtaatcttatccacttaccaaaagcccaaatgtcagatttgctgctgaacttgctatacatcaggacttccggtggggaccaccggactggaaatttggagcctactgagcttgtgtattcatcatccaggacatacctgcaagggattcaggacttgttgcattaggatttggaggcttgatatttgcttacgttttcttggcacggtcacaagagtgtcacaaacacacacaggctttctcaaaagtctctcctcctcaactagtatcttctacaaacgttacttttaacgaatttcctgtttttgtatctgattgagctttcctgattgacaatatggttacaagaaggatgaagtgaaataagatctagtaggtactcccttcctcttctctatccacctttcctttctctgctcttctccttcccttccttttatctgcagttgtcactgggaattagactgattaagaaagaaggaggaatggagtaaagtcatcaggattaatagatcaagataaggtattggggaaatagatttaaaaaagaggaggtagagataaagggagaaaggaaggaaagggatatgacaataaaacaaaaggatgaaagaggtggcttaaataactcagaggaagaaaaagaatagaaagatcggcagaaaacgctagaatgagaaaaaaaagaaaaggagaggattaaaactgtaacacctacccatgtttcatactgtgctatttttacttctggagggaaagatgaaaaagccacactcacctggacaggccgaaatcagatactttaacaactccttgatcgtttaccaaacagtttcgagctgcctgtagtgcaaacagagaccagtgagactccgtccccagcacagaggttaaaggcacaaagcttctgctgaccagtagaatgaagccagggaagcttcatctccttcgactacagacaccttcccacctaataggaatctgttgatgccaccaagaaattttgattcatttccaccacgtggaaagcaacctgctgtgtagtcctaggtaaagcactgaggacatacagaacgattgcattctcatgggcaattccacaccaccccattccctcactgatatgctgaaagaattaagggagaggctgggtgcagtggctcacgcctgtaatcccaacactttgggaggccgaggtgggtggatcacctgaggtcaagagttcaagaccagcctggccaacatggcgataccccatctactaaaaatacaaaaattagctgggcgtggtgttgggcgcctgtgatcccagctacttgggaggctgaggcaggagaattgcttgaatctgggaggcggagtttgcagtgagccgagatggtgccattgcactctagcctgggcaacagagcgagactccatctcaaaacaaaacaaaacaaaacaaaacaaacaaaaaacaaagaagggagaatgagaagtaagtttttttgctttctgcttttctgccagtgagactaggacaatttgagccttggcctgactgaaagaaacaggggcgcaaactctgatgcttacaggggccaggcaagttaagtaagagtgaagtgaagtggatcgagattgcaggaaatggagagtacatgcctagaggaaaggaggcggttcgtgagaatgtggacctggtatttccagacggtgtagattttcaagagaagctggaaattccagggtttttttttttttaagcgaaatgtttctttttaagggtttgctaattattatataacataaaaaaaacccacacatgtgggccaaatgcatccacaggccccagtatgtgactctgaaggaaccaaatgatggccccatgccaggagcagtcccattgggaagcacagtcccttctgttccaaatccagaatggccactgaaagaccccaccattttcttgtgggtggtagggggttgggagtgagtgactgctctgattcccaccacggcagacttcatggagctgaggctggagatatttgatgggctcagcactggggcagaggcacgcctaacttatagtactttctagataaaattgaaatgatggcaccagcagcccccctcaaccatgtatgatatatcttccactgctacttccaccccatcagccctttgtcctaggccaatccttctaaggtcccaccaggtctcggtgaaggaactgctttgactccaggtattccatggcttcacagacatccttgcacatctctagcagctgctgagtctggaagcggtggcgcatctccctcaggtagttcaggaggcagccattggccatgtactcagtgatgatgaagatggggcgctgcttggtgcagacgccatacaactgcaccagcttctcatgggaaagattcctacaggaaaggcaaggaactagtcttctccttttggctctgcataatagcaataaaggggctggggaggaaggggctgacctaggagtagagcatcagataaggggtcacaccagcaagtttattttcctctttcccaccctaaatctcaaaagtgcttaaaatgtggaagcaagcagggatttggagcccatcaattgaaaaagaaacaagtccaggaatgaaagaacgctaaggctaaattagaatatttctcttgaaagtttaattttctacatctacccccaaatgctactgagatggtacacacccatgatcaccactattctcaaccaatatctaaggcacagaaactattatcttagcacttaggactaccgccagttaaaggtaaacttcagtccctcgtcccaaacctctcttactgtaagtcatctttaagcctcagtgggttgttgtgtgaattcctagactccagcaaatagattgagagttgagtttgggctataactcacatcatgactttggcttcttcaatgaattcatcttcagacatggagccttctttgatcatcttgatggccacgtcgtactggcctctccatttcccatacttcactaccccaaattgtccagtccccagctccttcaagaaggtcaggtcctttggatcaatttcccatgatcctaacaataaagtcttggtgtgattctttggggtcatgaatgtataattcttacaatagacaaaaatccctactggggtagaaataggaaaactagtaaaagggaaatttttagaagtactaatctgtctttgcttaagtcaatctcagaaacgggattcattggttagaggaatctgggaattttaggttcaaggtggccataaggcaagaagatagactaagcaacctccccaaatccctttatgattatgttagtgatggtagttaatgaactcagggatagtactgaaaattttcccacaattaaaaataaaagacaaaaagacccaagacaacgacaaagccctttatgaatctatgtttttgcagtcccagtcgtagccactagaggaagaaaatcagtgaataacttttgcttggatctgtcttgagcgtccttgaggcagctgctgcagaacagtgtacctcaaggacactccctaaggcaaggccagcaaaggtagtttttgcaactggccagtccaccctaccccagagaaataaggagttaccgtatcccaggcctgcagtggaaggtgcattcttgttttgttgagacactggatatttgagcctggatatgagtcctgaaacagagagagaggtcatgctgttggtgtggtgtaggaggtgggatgcctcacacatcctcacttaaagcctcacacttccggtgtgtatctttctagtacattttgaatcccagaagacctccatgaacccacatatttccagaggtttctcctctcacaaaatacttttcagggacaaaaaagagaaaatactaattgaaatacactgcctaactgaatatattcccacctcccagcccaggcttagctcacatcctaccttcttgatgaagctgttcccccatatccatgccctcactaatgtctcagtttttagaaattttacagtgcttataaactttcttctgatgttgtctaacctgtatgttctttgaggacaaggacctcgactcagaatgttcccgtgttctcctctagaactgaggaaatcgctgagtacacagtaggaactcaatgaatacttgctgatgaatcagtcaccagcctcttttgtgtcttctcttaacactgaacatcaatcaccaaataaagagtcagtccctgttgggtgtaggtctgcctctgaccacctctttaccagcttctacccagtatcacagggatttcctttcacagtgaattcacactgtcctgtgaggcagattcttcctcttatcaccttgtcctgcattgcttatcctggtgtctgtaactcccttctcagttgcccctggtactcacctgcagagttgtgctgatggtagttaatgagctcagggatggtgctgaaaaggtgcttctcagccaggtaatactggctctgaggtgtggaacacacaacataatgacgtatcaccccttgagggtccctgaagaagtggatgcttagtcagtaacttgggcacaaaggtcaacagaacccaggaagtgaagtgagatgagttttgagtttcagagacagaggaagtgggacgggcacagcatcaaggagctattaggagggtacccctgttctttgtcctcagggccttggaatagtagcactcaccctgtggatttagcaaacacagacactgtatatttgccagctttgctggagtctctgacaatgaaacctccttctttcccctgaaacaacgaaaaagaagctgtctgtaggaggaagtggtgctcacacctgcatcccacctgcccaaacttgagagagaaaatagaacaacccctgattttactgccaagttccacgcttgagctacagcctcattgcttttaatattaaaaggtgcaggccgggcatggtggctcatgcctgtaatcccagcattttgggaggccgaggtgggcggatcacctgaggtcaggagttcgagaccagcctggccaacatggtgaaaccccgtctctgctaaaaatacaaaaattagtcgggcgtggtggcatgtgcctgtaatcccagctacttgggaggctgaggtaggagaattacttgaacccagaaggcggaggttgcagtgagcccagatcacgccactgcactccagcctgggtgacagaccgagagtccgtctcagaaaaacaaaaacaaaaaaaatggtgtaattgggatcccagacgatggcagctttgacactgccttgcccaaaggtagggggcagaacaggccctcagttcaagatcctcacttatgcaaggagaatgctgtgtgctagtggttccacacttacctcttgctttagcagttgctcagcctgactccgagtcatgtgtttggaataccacctgtgaagggagagtgctgcttgagtggctcctggtcataagcagattggaggttacagcaccctccagggcttgtccatgtcagtgattcagtcaactcactcaaaccctatttactgagcatctgtcatgtgcatagcacactgtatccctttcccaaacccaggttggcattgaagattcatggaaatggagagtagcaggcaaaggcaagcagcagggagttgcagggaagagatcagggactagggcacttgagaacaatccacttccatgattagggaggaaaggacaacagtagcagtttgacattttaattctttcatcaggtcgtcaactcctttttctttgagtgtgattcttctggatttgagggcatggtgacctctccagctctcataaatggagggtgtttggggggtaaaggtaagacagatacactaatttgaggtggtggcatcatttgattcagatggtactaattttaatatatatcttgaaataaaaaatatgttgaaagtagaaaaaagtgtatatatatatatacacacttgtgtatgtatacataatatacctatatatacaccagtgtatgtatacatatgtatacatatatacacttgtgtgtgttatatatatatataaatatatataaaatatatataaataaataaatatatatatatatagagagagagagttcctcctggaagattgtggactgacataaacatacttactcatacatttctatggagtcttctgcttcagtgacatagttactaggaatgtagccttcctgcctgtgaaggaaacaatgtggcagttcatccagcacctccccagcctccaggagacagattcatatgcccacgtccctgagctcagaacaaatctcaaatggaggtatatgtatcatgcacctccctcaaagacaatcatgtctctgatgcatggttaggcagtgagccagtgaggtgcagagcttatgcacatgttgcattggttatatgtgcccaacaacagaggctcagagatgtggcagaggccatgtatagggagctgcacgctgggaagtacttggagggagagcatgttcagtctggtgtgggaagaacagtctctgatgaggatgctgatcacgggaattatgccgcagcactttttgcgtgtagggagtgggcaggcaccaggctcaggaagggctggtgtggactcacccatttttatctcgtgctctccaccatggtaagttgctttcctccaagataaaatattcatcacccttccgcagctgtagatcatttgcattcattggcatgtaatcataaagggccacaacctttttcagctcacttgtggagactggtgctgctgctggctcaggcggtagtggctttttcaagatctatgtagttaggagaaaaggtaggagggtttgtcaagataccaagcactcttctcttctctcccaactctctggcttactcaagacacccaaatcaggcatactaaaatattactcagcagtcattcaacaaccatttttaagcaccagtgcaggagttctcagccttgcacacatataaagaccatgtatggaacttttaaattccaatgtactttcggaggccaaggcgggcggatcagttgaggccaggagttcgagaccagcctggccaacgtgacgaaaccccatctctactaaaaatgcaaaaatcagctgggcatggtagtgtgtgcatatagccccagctactcaggaggctgaggcaggagaataacttgaccccaggaggcggaggttgtagtgagccaagaccacgccactgcactccagcctgggtgacagagtgagactgtctcaaaaaaaaacccacaaaaaacaaaaaaccaattccaatacctagtcagtttcctcacagaccaattacatcaaaatcaaactctcaggaatgggacccaaacattactatttttaaagctcactagacaaaaaccatttatagctaaggtcaggaaaccggcttggcactaaacttgtacgtgaatctactaagtggctcagaaccttggtttccttctttgtaaaatgagtataataatacctgctctacttacttacaatatgtgagaaagggctttctagccctcaagaaggaaccaaaaaaaaaaaaaaaacttctgaagtgttagtgataggtggtgttagtgctaagtgttgagtatgttggtattaagtgttaaattcttctaactttactgtatgtttgaaaatactttccagctgggcacggtggctcacgcctgtaatcccagcactttaggaggccgaggcgggttcgagaccagcctgaacaacatggtgacacccccatctctactaaaaatacaaaaattagctgggcgtggtggtgcatgcctgtaatcccagctactcaggaggctgagacaggagaatcacttgaatctgggaggcggaggttgcagtgagccgagatcatgccattacactcgaacctgggcgacagagcgagactccgtctcaaaacaaaaacaaaagcaaaaacaaaacaacaacaaaaactttacattaaaaaaatcaggttttgttctaaacaggtgattggattacatggttgctgagagccttctatctttccatcgaggaggaaatcctaattagaagaacaaatcccccatcttagcaagaataccaattaacactgccaagtcccagggtaattctaagactctagtgtgttcttagggcttgactataagtttccatttaagcagtggcagcacccagtttccctgtatacctggtcctcctcaggcgttgggggaagaggcttttttgtcttccggtgagaactcccaggttttaagcctgcaaaacaagaagccagtgatgatatggaatgcactttaggaaaggggccaaggacaggtttggtcagggactttgccgtccatattgagtgcctttaggcaagttagaaaaagtagctaggcatgccaggtcacatagcttggagagcagattaccagctggatttcagcccccatgtgcctcctccctcccccaggaccctttgtttagcacccaaagtgtacaaccttatgctatgaccctgggcttgacagacccttgggagagtgatggaaacagtcaaaggagaaagaaattatatcgatcagattgcttacttccattcctgttctccaaaatttggcagcccatagcatttttggctgtctgagagcagcagagatactgcccatcgatccagaagcaagggtgatatttctgaaccagatcactgttgtaccggattactgtagcaggaaagaagagagagatcacatctgacatggaggagaagccaccatttgcatgttttcctctttgagcttagtggtgaacttcaagcaactgccccctccttggccaccctgaaggagagcagatcacaggaccagttggctcacatgactggcctgcctgactgtgccctggtcccagacagttcctgtgcagttttctttagtggtctgtgatgaggagtatctcccaatcaacaagataagactatctgatggcttgagagcccaacaacagaaatatgttatctatgttttcccagtagccattacaatgttcctgtaaggcaagtgtttcccagataagggaaacagtgtgcccaggccaatctccccagcttttaatactgatttctcagttccttgagtgatcttttagggataattagccttagtgagaacttctgcatgaggctttctgtatagaatagtcaacagagctgatctcaagggcaaatgaaggtgactttgcctctagaatcaacatgatttgaatcttcctagggccactgaggtagactgagctcattgccagaggtaacacagcagcttcattccctcatggagttgtgaggcccaaaagatctcccagagtaaaagtattttgcaaagaatagagtggatgcagagaggaggaattagtattggtgtttataatactatggcatatcaaaaaccttcacatgaagtcaattagaaaagttggccagacgcggtggctcacgcctgtaatcccagcactttgggaggccgaggtgggtggagcatgaggtcaggagttcaagaccagcctggccaagatggtgaaaccccgtctccactaaaagtacaaaaattacagcgtgcctgtaatcccagctactcgggaggctgaggcaagagaatcgcttgaacctggctggcggaggttgcagtgagccgagatcgcgccactgcactccagcctgggtgacagtgtgagactctgtctcaacaaaaaaaaaaaaaaagaaaagtcatccagggttcatagtgtcagataactgagagaagcaaagacaattgaaataactgatagcagcaaacactagagcaaagacccaggctggtccaggaacacgcacatttgagaacatatacatttcagcatttacagctaagaagaatcccgcacattattattattattattattattattattattattattattattattattggagatggggtcttcctgtgtttcccaggcaggccttgaattcctggactcaagcagtcctcccacctcagcttcccaaatacctgggactacaagcactcaccaccaggtccagtggctggcataactttttttaaaaaagacaaaaacaaaacaaaaccttccactgtagaaaacaactaaaatccggctgggtgtggtggctcgcacctgtaatcccagcactttgggaggcagaggcgggtagatcacctgaggtgaggagttcaagaccagcctgaccaatatgatgaaaccccgtctctactaaaaatacaaaaattagctgggcatggtggcatgcacctataatccctgctactcgggaggctgagacaggagaatcacttgaacccaggaggtggaggtcccagtgaactgggatggcgccattgtgctccagcctggccaacaggaacgaaactccaactcaaaaaaaaaaaaaaagaaaagaaaaaagaaaaagaaacaactcaaatccttaagggcttgctagtcacacttcactcacttaaggctttgcaggaaagcctaaaagctgctagtagctggtgcattttgcaggcaaatgaacaaaagttctttttttttttttaagagccattttggtacttttctccacatagatttgaaaacttcaaaccattctcccctacccaccctcaccctgactttttcagcactcctcttcaccagtgtaccaaggacagaatggtgggagctgttcagatagagtgcaggctataagggactgcattgcatagagggaattttttttttttgagacagtgtctcgctctgttgcccaggctagagtgcagtggtgccacctcggctcactgtaacctccacctcctgggttcaagcgattcttctgcctcagcctcccgagtagctgggactacaggcacgcaccaccaagcccggctaatttttgtgtttttagcagagacatggtttcaccatattggccaggatggtctcgaacttctgacctcgtgattcacccgccccccatcgcccctcaaagtgttgggattacaggcatgagccaccacgcccagcccctagagggaattttaaaacaataataaaaccgacccaaagtctgtctgccttttgttattactaagcactggtagagttgtgaacaatgtcattgatactcctccctgccaggattgattactcctaccacatccacactctggcccctccccgcatgccactccctgtcacctagggatttgaagatcctcaagtttgctctgtcttctgcagggctgggcaccagtagacatgccaaagaatacctaatcgacaattagccactctaataaactaagcttgctaatacgataatgaggggaaataaggcttcttgtcttccccacccctagcacactcattaagaaacctccctacattctcaaataatgtctgcctcttaagaggtcccttgaagatgacaccccttcttttgttggctaatccaaagctggtatttccagctacttaggacaggattgcaaaagcagggtgtacaagtgggagggctgggggagactgcttgcttcaccaatgcacattcccctattgggaagcactaatggttagtacatattctccaagcacttgatgggctggtcttttctatccatatttatgaggttaatgtctaaaattctgtttcaggcatacatgaatcattcctttccatactgtttgtaggagatttgccaatgctattctcttattcattttggtgaggtcaggtcatttgcctacttttgaatttgcaattaggataggttctattgagcttgaccaaagattcaagaataagtataggcaaatatttgtggtgctggaacatagaagggcccactgccatatttaaggaaatggaaagagagagtctgtggctaagcccacaggaatacaacctttgcatggcaagcaccattgagaaaatgtggcagctggatatgaggtatctgaggctatgcttttaaaattgaggtataggcctggtgcagtggctcacgccttgggaggctgaggtgggcagatcacttgaggtcaggcatttgagaccagcctggctaacatggtgaaatcccgtctctaccaaaaatacaaaaattagctgggcgtggtggtgagcgcctgtaatcccagctacttgggaggctgaggcaggagaatcgcttgaacgcaggaggcagagtttgcagtgagccgagattgtgccactgcactccagcctgcacgatagagcaagactctctctctcaaaataaaaaaaaataaataaataaaattgaggtataatttacatataataaagtgcacagatttaatgtgtacagcaaaccatatttttccacacccatttaacctccttgagatccagcacctcatgcctcttcagtcaatatccctgcaaaggtaaccagtattctcatgaggtccccttttcatgtcaatgatttcttattggtgcattttacccaagagtaggataataaaaacataaaaacaaacaagaaaaaaacaaaaagagtggaataatatcattattttgtggctcctaggctaactcactattgacattggcagcacctgggactgtcctgggattgttaggacttgcacctaaatctcccagcaatcatggtatttgtcagaaggtgcctactttttggctcttgttgttagcccaggacggttcaacaagactatacccaggtggaactactgggaaaaaaaatgcctttggtgaaacataagggaagagaaggcaaagatgtgcctagccacactccctgatcacactgatgacccagctgaagtgatggtgtttctgtttatttattttggctttatttttagcctgttgtgaatttacttagctaatgaaccttaaaagcagcacataatcaagattgtaaggttaacatctgagttaggaaaccaagctcggctgggcatagtggcttacgcctgtaatctcagcacattgggaggccgaggcaggtggatcacctgaggtcaggagttcaagaccagcctggccaacatgatgaaaccctgtctctaccaaagatacaaaaattagccgggcatgatggtgcacgcctgtagtcccagctactcgggaggctgagggaggagaattgcttgaacctaggaggcggcggttgcagtgagccaacatcacgtcactctactccagcctgggcaacagagtgagactccatatcaagaaaaaaaaaaaagaaaaaaagaaagctcacaagctcacaagctggatatccttatcttcggtcattactcacccttaaatatagtggacattcaataaatatttgttgggccaggtgtggtggctcatgctttaatcccagcagtttgggaggcagaggcgggtggatcacctgaggtcaggagtttgagacgagcctggccaacatggtgaaaccctgtcgctactaaaaatacaaaaattagctgggcatggtggcaggcgcctgtcatcccaactactcgggaggctgaggtaggagaatcgcttgaactcgggaggcggaggttgcagtgagccgagatcgtgccattgcactccagcctgggtgacaagagcgaaactccatctcaaaataaataaataaataaataaataaataaataaataaataaataaatatttgttggactaaactatgactggttttgaaattagtatatgaagtgtaaagaagttaccaacttgagcatgccagtttctcccttatttctccttcagctagtctgccttgcattcccccatttccagactaaaacctagccatttatcgatgtggagcccaagctggtgatggttgtttattcccacagataaatcagttaacacaactactgatccctttctgtgtgcaaggcgctgtatgaggcattgtggagagaactaaagaagtacaagtatacatgtcctgcagagctcttatcccagtctctgcaaatatttctgtggctggagatagtatattggttcaggacatggagtctggggcctgaattcaaagcctgaccctgccatttaccaaccgagggcctttgggcaagttacttaacctctctgtacctcagctttcttatctgtaaaatggggatgacaagataactgcctcatatggttaatacaaagttaatatatgtaaagaacttaaagaagagcctgtatcacaataagcagtattaaagagtttgctcattttgtagccccagggctaaagcagaccccttatcttaaaatatgccaagaactgaactgtgtattgcaggatatcacctatttgtaatattcaacatagctttactatagaatattttgcaaccaactacatgtgaaatttctggacttggaaaccaagcagcgcaaaactatgcaatgagcttgggctttggagtcatacagacacagggatgtgataagaatccaggctccaccattcactgtgtgcccatgagcaagttgcataacatctttgagcttcagtttcctcatctgtaaataggggaataatacatacttcttaaggctactgcaaagatcaaataagtaatacatttgaagcacttgggacagagcctgctacatagtaagtgctcattaagtgttagttatcattgttgttgtttttaggccaaggttgttgtgaaaattaaatgagataatatataaaaggtatttagctcaatatctggcacatagcaataattgaatagatgatccttcatcttcgttcctcctgttccctttcagtttgaaagacttggctaatataattttgaccaaccaaacttgcattcaagggagtgtacaaggctggtatagccagccagtgagtatcagaatctaaatgtttattaagacaaagggctgtcatgcaataacccaaccataccattatcagtctgccatccttcctgtttctctaggcagcctttcctgatgtcaactcaaccagttaatctctcagtcacttgacatgtggctatatatacacacaaatatgtgtgcatgcatcctgtgctgcaagcatttacagtcaagtttatctgaacacactgtatggttgatgtgaaatgctgaaactgttcaagtttaggtcctcacaaagcaaggaatatgaaatatttccttgggaaatatttatccacaacaaagagatgtacagtgctttcgtatacagtgatttacagttttccatgtgcttttacatgtattattacttcatttgatccttacaacaaccccagaggtagatgtggcatgaattaccattattctcctttgagaagaagaaactgagcatcaaagaagcttgttggccttcttgccagaaatcacccagtttgtaaatggtaaaagagggcttgaaaccaggttctctgactctgacttcaagcactctcatacatcatctatttaattttttggagctaggtattttatacttaggattctaaatattgcataaccattgaatgccacaccacccttgtattcagtgcaaaaaatgggacttttcttaataaatagagaaatggaggtgcctaaaattacaaaattgcactagagagatagtgatagaactgggaaactcttagtctaatattttatcttttattcatatgatggaatactaagctcaattgtattactaatattgaaacaaaatacaaactttcctttgtttctttgttatttgtctttctttcctccctcatccccttccttctttccttgcttccttccttcctgtctccctcctcccctccctctctctttcttttctccccttctatccatttttttcttcttttctctctacgtttctcctttctctttctttctcgtttctctcttccttctttccttttcctcccgtctatctcctcttccttcctttccttctttctttggaaacatttattttccaaataattctcaccgtttttgagctggtgaatccaccgcttccttagttcttcagttggggagaagacgtagagaggcccttcatcatatacaacctgggtcgatgaaaacacagacttcagcagttaggattcagaaaaaaggagaaagaccttgaaagtactaatcttaggggacaatttgtatatttattgtagaaaacaaagaaaggcagaatcttcagtcagcaatggtgttcaggttatgtgaactatctgaaggattcctgaactcttcatatctaggaatgtagcgtttaaaagctcttagaatttttcatactcttaggtcctcctgacttgtgcttcaattcatgcataaacttattttataaggtctccgtctgcccttgctggagataacatttttgtttatccaacaaagggtattttatcttattattaaattctgactttgtatagaagagaaatgaagtgataatctatataaattaagtcttgattagtacatatgggttattcacttggataatatggagtaaaattttaattcatggctaattacctccacctccactacctagtggcctcccctcaccaatattagccaaaataaatcaaatttggaactacaaacctacttcaaaaagggtaaggtatataataagcaatatcatcaagtcaaatagtatttttttaaccatgtacaaggcatcatgctaggtgttacgaagatgcatgaaatatataagatgtggttccaaccctcacagagtttatagacatcacataataaattctgaagtcaaatataaattaatttaaaattatctgctgttcagcattgttcactagtgcagccaaacaatgtcatcttgttgaaaggcattggtagtaaaaactgtgtctgaaatacccctctttcaaaggtttcgtaaatttgatatagtcagggacacgaacaagatccttttacatttttctttttgcttgttagtcttgctgtgctcataaatccatgacagaaagccccctcccctgagactttccacttccttttctggctttcactgttgcagaggctgctatattcacgacatgtggcctacagagttctcaggatgtaagcaagccaaactgaagaccaaatttgtagttcttgctctcctaaacagatgcatatgtggcacttcagctcttccagattacaacagaatttaggtttatgcataagtctaataagtcttcctcatactgaacttcctaatactactccccttttctatcttttcaacccacatgaccactattagacagatagtcagaaccagaaggaagtgaaatgctcactcaacaagcagagcatctttctcaatgcagttatcatagacaagacacactatgatagaattggtgctgctatgtattctttttgaggtatagagactaaaagaaactatgttagattaggtaaatagaaaagcaaacattcttagcccatgccagtctcatttcttggttcagcatccttgtccacctcaacttctattcactgggtcctcgtagccttccctctgccctgcaccccaccaccccttctaattgtgttacaggggcctttcgagatttggtgagagaaaataactcacctggaagggataagggaacctttcaatgattgaaatttgctccatttcactggactcttcacctcttctctgtaatgaaataagaaaaaatggttattggttgatgcattgctcttttctgaatttccttaggtactagaagccttttgctgtggcttcagaagtttctcctgcacagacaaggctgattcttagtgattactttctataggccaatagggacacatatccaatacgacccaacacatacccagtcaagagagactcaggtatttcaaatcactgggaaaatggaggtttctaaaaaattgttgttgggacaaatatttaaccactaacgttgtggggaggagaggagttaggtagctatgctacaccatacaccaaagaaaattccagatggattcaagagcttaatataaaaaataaaactatgaatgactgagagtaaatataagcaattatttatataatcctgtgggaggcaagctttttctaatataaggatgaaacttagaactattaagaaaaacctgaactaatttgatgacatagactttaaatccctatatggcaaaaagcatcataaacaaaattgaaagataaaggataaactgaaaaacattttcaacatactttacagttaaaggataaatgttcttatatcaagatctctttaaaagtattagaaatgaggtaaacatctcaatgtaaaaaatggaccaaaaattaatgggcaattcacaaataaaatataaatgagcagtagaccaactttatgagtaaaagaaattgcaaaataagttagcaataaaatgctattttttttttttgagacggagtcttgctctgtcgtccagcctggatgtgcagtggtgcgatctcggctcactgcaacctccgcctcctgggttcaagggagtctcctgcctcagcctcccgagtagctgggattacaggctcgcgccaccatgcccagctaatttttgtatttttagtagagacggggtttcaccatgttggtcaggctggtctcgaactcctgctcatgatccgcctgccttggcctcccaaagtgctgggattacaggcgtgagccaccacgccccacctgaaatgctatttttcttggctgtcaaattaactaatatttaaaatatctagtgttgggctgggcacagtggctcacgcctgtaatcccagcactttgggaggccgaggtgggaggatcacttgaggtcaggagtttgagatcagcctgaccaatctggtgaaaccccatctctactaaaaatacaaaaattagcagggtgtggtggtgggcgcctgtagtcccagctactcaggaggctggggcaggagaatcacttgaaccggaggcagaggttacagtgagcggagatcgcaccactgcactccagcctgggcgacacagcgagactccatctcagaaaataataataataataaaaataacaaaatatctagtgttggaaaaaatgtacagaaacaggcactctcatacatagcttgtaggtgtgtatgaaattcaattccacttctagaaaatgaaataaaaagataaaaataaccaaagtgcacagattttcttaaagagaagaacaaaattttacttctaggaaattatcataaggaaaagaataaaaaaagtacagaaagatgtatgcaagattgttcctctcaacatggtttatactatcaagtacttgtagacaaaccgaatgtgtaataatgggagattaaacaaattacaatacatccataatagggaataccatacagtcattaaaatcatgttattaaagaatatctattgtcatggggaaaagtttcccacatatcgttacattgaaaaagtacgttacaaagcaagatgtgtactatgagtctatgttttaaatatatgacatatatataagtgtatgcgtatgtgttctcagtgaagaaaaacatctgtaagtctatgtacaccaatatgttgatagttgttttaactgggtaacaggattatgcatcattttaatctttttgtattttttatatattccagagtttctgtaataaatacgcaattctcctgtgatcaagaaaatactgaaaatggtcagacccagtgggtggctcacgcctgtaatctttgcactttgggaggccgagacaggcggatcacttgaggccaggagttcaagaccagcctggccaacatggtgaaaccccgtctctactaaaaaaatacgaaaaattagccaggcatggtggtgcacacctgtaatcccagctacttgggaggctgaggcatgagaattgcttgaacccgggaggtgaaggttgcagtgagccaagatggcaccagtgcattccagcctgggcaacagagcgagactctgtctaaaaaaagaaaaaaaaaagaaaaaaagaaaatactgaaattgatatatattttttaaaagtgaactcaaaaatcagtaggttttatgtctctcgctccggaaagtgagaagagaataaatagtaaggtattaaaggatatcatgtgactcagagccctaggattatgacattcagacttacttaagcctctaaatctgatcctgagagaactgagggaataaaatcaatgatctctgaccagtttgaaaactagatatagcatcatttaaaagtttgtgttaacaaattttccatgtttagtgagatgttctgaatatgaaggaaagaagctaagattctttataaccaatatggtagagtgaagaatttttaaaggaaacttgaccgtgttccacgttgcacagcatcaccagtctatttacagagaatttaaatgttgcaaatttcttcaaatctgctgttccccatctcagacattggtctcttcttaccggaatctgtctttctggaggaggatttttttcaggaaccactgtttcaacacaagtgatcttctcaacatctattgaacccttcttactgcctcttctctgagaagtagaatgaggaagaaaatggagaaagattaagagggattaagcaaccagatgattagattttgttatctaatcattcaacaaagtgaggtggcaccaggacctgtcatgtgggggaagaaaaaaaaatccttccagatctataaatctatgactaccaaatggagggcaaataccatggaagagtgaatgactgtatgtaccttcctcataggaagtaaggaagcaatttccaactcttcgatttcattttcaacaatcatttaatgagtgctcatcaattccaagattccatggtaatattttccttgtggcttcttaggacctttgactttccggctttagctagttataggctaggaaatattttgctgaatttgaaagaacttaggtccattctactcccctcctcctaccaacgaaaatttacctcttccccaagaaagatctaaggccaagtccttgatatcttgaaactcagttttcatagtcgagaaacttaccccacgttcaaagtcatactcatagtaggagagtttgtgcacggtcaagagaaacaggcgcttcttgaagtttagaggtgatgttttctttttctgttgggatcgcttcagaaagatgctctccagaatcactgcggccatagcttcttctttctggagttcacctgtgtgctgttgataatgaaagttcctgaggacccaggacattaatcctcatccctcttggttccccctcagcctagctacctagtttcaaatggaacaaaaatgtgcacagctcacaaaataatttcttcctaccaacctcctcccacagcccccagctctgtcaggtttcaggtataatggatgcacactgaattggggggggattggttcgatgttgtgagctcatataaactgagttcttgtataaggcaatggaatgctctagatgttaaatggcacgcacctgtgtgcttggtaaggtgtagaggtagctttacactattcacctttatatgatatgtgtagaatctgtgaaaagcaaaagtatctgtgcagctgttgatcttgatatacccagaagggataatgcaggtgccagaactccactgaggcagatattggactttcagttcccaatttcctagacggtgaatataatttttcaaacattgtcccactggggtctgtaaccaagggaactaataaggatatggaggctgcacctgcagttctggacacacactaactgctgcccaactgattttgcccacacccactgactgagctacaaaggatagaagatttgttctaaagttgaaaacataattttttttggtgggttttggtggggggggggtagttgttgttttctgaccttttccccatttagcttaaattagttcttttagacagcatcatgcaaaagtgatgcaactgtcttactgatatagatgccacctctgttcatttatgaaacacaacttatttagcctccccaaacctacaatactccagaaggattcaatttaggtaactgaaacacagaaagacaaataaagttcccaaagtcaccactggcttttttattcacaccaagcaacacttcatatcagttattcacttacagtttatgcacagtgtaatattattactaattccgaactttcattggaaagataaagtgaaaacaaatgctgtcataaaaatagaacactaggccggcgcggtggctcacatctgtaatcccagcactttgggaggccgaggctggcggatcacctgaggtcaacagttcaagaccaacctggccaacatggcaaaaccccgtctctactaaaaatacaaaaatagccgggcgtagtggtggatgcctgtaatcccagctactcgggaggctgaggcaggagaatcgcttgaacccaggaggcggaggttgcagtgagccgagattgtgccattatactccagtcggggcaacaagagcgaaactccgtctcaaaaaacaaaatcaaaaacaacaacaaaaaaacactaagtaagtaacgaaaaaaccaccagccctccattcaagtttaattagtggtagggatttttcctctggtgggggggtgggggtgggaatgtgtctattttttaagtaaactccttatgcttttggtggcaccgtggaagcagaatgaataaagccagcagtttttttctactttttaagcagattattgctcacactaggaaagcaagggagtgaattttatcaaagcctgggggctatccacactgttattttgctctttcctgtggtgtaggaggttctattctcatgctggggagacgaaaatacgtcaaaggaacaccaggggtgttctggaagatcgctttgccacttatctaccatgtgtatgccactatcttctggaggtggattaattcaatattttgtaaattagattttgagaaaaattgggcaagagtgcaaacctttccctccaccctgccacacaccctgactccctggtttaaatggtctctcactggagtgacaaattgatgagtttacaatcagcccttcccaacactcagttttagctctaaactcaaagaggttcattttaacattacaattatgcatttactcaggagtagtggtaaccaaataatactactctattctcaggaactaccaactcattgagagccctgtaatcataccacaattattcttgtggcaaattataattaagtacctcttcacaatcaaagactcaaattacaggataaaaaataaaaccctaaataaattgagtactgtgaccagtaaatggggtcagaagcatcccaacaaaccatgtctggtgtacttctcttagccgaataaatcgcaggcaacattttatctttagttttgttgcaggctcttggtggatacattccctgcttagacccaccatctgtttcattcttgtcccctgctcttacttcctataagacaggtccttctggaagctgcctctactctttctctgttttagaacaaatccagtttgtacaagaggaagtcttcctctctctcaagtatctgtgtttgggcagggtttagtgctgctctgactatgaggaagtaagcaagtctctcactagccatcgcccctctgagcaaaaggtgaaatggcctccacctctagatcattgagctagaggtctaccagaattgccatgatttggtaccaccttctttgactgcttttctcctgtttcttatgatccagtccagactcacacagcctgaaaatgtggtagctcttccttaggtgccactggtccatcactcaataatgtgaaaggaaagggatccatttttgagtcctccagaaggttggtgtgtaacacacagctctgagttaaaaagtagttagagggtaaagcttctgtgggtacttattgtgaaaggccccattttttttttttttttttgagacggaatcttgctttgttgcccaggctggagtgcagtggcacgatcttggctcactgcaacctccatctcctgggttcaagcaattctcctgcctcggcctcccaagtagccgggattacaggcgtgtgccaccacacctggctaatttttgtatttttagtagaggtggggtttccccatgttggccaggctggtcttgaactcctgacctcaggtgacctgcctaccttggcctcccaaagtgctggaattacaggtatgagccaccgtgcctggccagtaaaggccccaatttttttaaaacaatttcagtagcctacagagtcggtttgaccacaaaatatgcacaatgatggctaaccctgagctccactcagggtgaagggtggaaatggaagtgacttgaatgtctcaaacatacagacacacacacacacacacacacacacacacacacaccactgttgtttatagaaagaaagaaatgggggaggagaaaaaatagacacagagctcttcatttaaaatatggagttccagtgttacaatgtcccctttattaaattataaatgcaaagatttttacagggccaccttttgcagcctcccagctccctatggagcaacagaattcagaaagacgaagcttattaacaagagtgcagccatcatacaaactgcagtatgccaaggaattaatagaaatagcacttgcagaatcagtaaactaaaccatcttgggctcttatcttcgctcataagataaaatactattaagaataataagtccaggcgcagtggctcatgcccgtaatcccagcactttgggaggctgaggctggcggatcacttgaggtcaggagttagagaccagcctggccaacatggtgaaatcccgtctctattaaaatacaaaaaattagccgggcgtggtgacaggcgcctgtagtcccagcaactcaggaggctgaggcaggagaatcgcttgaactcgggaggcggaggttgcagtgagccaagatcgtgacactgcactccagcctggagtctcaaaaaaaaaataaaaaataaaaataaaaaaaaaaaagaagaagaataccagagcaaaattcagaaaactacacagccagcctatgattgggaagagtctatgagatatgatttaaaataaaataaccagtcaactgtacttcaaatgactacttagccaaaatatccaagaagtagtgttttctcttgatttctccttgaaagcactactcaattggctaggaagattctggccattccctgtctttccttagggggatggaatggaacttctgttcctttcagtgacttctacctgacaggcattttacaggcattatttcatttattcctcacaacaaacagatgaggaaactgacacagaggttatgtgacttgtccaacctcatccatctgtagctcttggtatatcatctatagcccttgctttttttgtggtgtttcactgcctaccggagggatttttgttcgtttatttgttttttggtctttgatgaggttgatgccatctgccttggggcccctgtcattctccatggctatcatcaaagagcagttgtgacaaactcctctccattttctaggaatgttcagcaagagaggaaatggtggtaaatacaggagataagagagtattcaagatcctaagctctttcctctgcaatattcctccaggctggtaaggatgatctgtctctggtaactgtcaactatactttttttgcacttgaggactcttcttagtcttgccaggttttcttacattttccctctttaaatcattcccaaggagattctgtctaactagtgaatttctagagtcacttgttgtttcctttcctggatgtttcattgttgatggaatgaaagcacagtgtttaggtggaacatccacccttctctgtccctagggttcttattgcttactgtgaatataaaactttgatcaaatataccttctatttttttgagacagggtctcactctgtcacccaggatggagtgcagtagcaagatcaccactcactgcagcctccacctcctgggctcaagcgatcctcctgcctcagcctctcaagtagctgggactacaggtgtgcactaccacacccagctaatttttaatttttttgtagagacacgggtctcactttgttgcctaggctagtctcaaactcctggatgcaagtgatcttcttgtctcagccttccaaagtgtggggattacaggcatgagctgctgcacctggcctcaaatatactttgttttatattatgaaatatttcaaatagaaagtacagggactataacattacaatcttggactcaccgcttagctctacaaaatcctaaaattgtgccatattgcctcacgtgttaagaagtgagatacaatctatataatcaagacccctttatgtactccaaaatcttagtcttctccctccatagagattaccaatatcttgagtttggtgtttatcattcctaggtatgttttcatattattattacagatgtaagtatctataaaagatatatagtattggtttacatgtttaaaatttacatatggccaggtgcggtaactcaggcctgtaatcccagcactttgggaggctgaggcgggtggatgacaaggtcaggagtttgagagcagccagcctgaccaacatggagaaaccctgtctctactaaaaatacaaaaactagctgggccaacgctactctcccagctactcaggaggctgaggcgggagaatcccttgaacccgggaggcagaggttgcagtgagccgagatcttgccattgcactccagcctgggcaacaagagtgaaactcggtcgcgaaaaaaaaaaaaaaaaaaaaagaaaatttatatatatatatatggtacacattctccagcaacttgcttttttcccctcaatataatatgttaggatttatttatctggctagttctacttcatatgttttaattcatttttatatgcataaaatattctatatgatgaatacattccaatatatttattcattctcctgttgatggacatttaggttgtttgctttcagtgataaacaatgctgctgtgaacattattttgattttttgatctcagaatgaattctcagttacttagacaaactggcaaacctaggtccagcttatcttttggactatgcaatttgcatcattccttcttgccttttcagtcctgtcttcctgatgcttcactatgaaatgtggtagaattatcaactatctctagtgggaggttaaatttggcctacggaaaatctcttcccagtcccaagaagcatccttcacgttctaactgagatttcaattgagaattccttggccttgggaccagaagagaacgtgttaagaactgaaatactatctatataatcaagacccctttatgtactccaaaatcttagtcttctccctccttagagattaccaatatcttgaatttggtgtttatcattcctaggtacgttttcatattatcattacagatgtaaatatctataaaagatatacagtattggtttacatgtttaaaatttacatatggccacgtgtggtagctcatgcctgtaatcccagcactttgggaggctgaggcggctggatggcaaggtcaggagtttgagagcagccagcctgaccaacatggagaaaccctgtctctactaaaaatacaaaaattagcctggcgtggtggcgcgcacctgtaatcccagttactcaggaggctgaggcaggagaattgcttgaacccaggaggcggaggttgcagtgagccgagatcgtgccactgcactccagcctgggtgacagagtcagactccgtctcaaaaaaaaaaaaaaagaaaaaagaaaaaaaaatcatacccacagcaacaaagcaacctttaatcttgttaaattcccaagatgcttttgttcgggccccagtgaaacccaattattttatgataagcttcatagtcaaggctacaggggaccaaatttgtgatgaaggcatcaagccaaactcaattttcgaaagctgcatgctgaccagggaaactctcctgctgtagtcatttacaggaggccttagggctctctggttcttccacagcagttcatgttttatttatttatttatttatttatttatttttgagacagagtctcgctctgtcatccaggcttcggtacagtagcgcaatcttggctcactgcaatcgctacctcccagtttcaagcaattctcttgcctcagcctcctgagtagcttggactacagccgcacaccatgacacctgcctcggcctcccaaaatgctgggattacaggcttgagccaccgcgcctggccttatgtttttagcattttacatttttcttctgtggttttggaaacttctaggtctctgtgattcatcatctctttttgtcttgcattagcgacaatatattctggccaactgatgatggaaggagagccagagagccaatctgcaagtttatagtcagtgccagatcagatcagtggtaatactttcaatattctccctctgctctgagggtgactgctggggtgtctgtctttcactctggacttgtgtgcccttttggccttctttttcaacctagtttttgttttccttggcttaaacattttatttattttttccatcgatatcaaaataacacacgcagctgggtgcagtggggtgcacctgtagtcccagctactcaggaggctgatattggaggattgcttgagcccaagagttcaaggtcagcctgagaaacatagggagacccccatctcaaaataaaacaaaatatagtaaaataaaacatgcttattgtagaaaatatgtcaagtacagggatataaaaaagaaaaaatcattcataaactcatccagaggcattaatatatcggcatattccttccatttttttctgtgtgtgtttcttataatatttgagatcatattgcacattcagttaatttacctatttttcgtaacatctatgtatgtatgtatgcatgtatgtatgtatctatccatccatccatccgttcaaggtacctttttccaaaaaaagatctaatgttcttatttaacattattcctaattattttcccatgttattaggatctctatacaagcatcatttccagagtcaaaaaagtatgtgcattttgcattttgatacatactgccaaaatagtttccagaaacattgtcccaatttcagttccaaatagttttagagagccccctttctcattatccttatctcttttctggtccatttctaatcatttttaaaactctggttttactgcagacaaatcttttttttttttcattgagtcaatgatcttaaactccagtatattccaacttccagcttgtctaaaacttaacttctcttgactctagaatttccttcttctagggtgagctaacagactacagtttgttttcagttcagggaggtagggcagtgagaggagcttctccttgagattcaaataaccaatataatcctaaagacatcttgtgagaactttctaagagcggagagaagagcctggtattaaagcttctgggtttccaatgctctcagattgccctcagccactgcacatgaatctccatagaaactgaaagtcacacgtggcccaattgtttcagggtcctcagaggagttctccctcctccttcccctccccagatggcttcatgcataaccaagtagctttggagtcaaatatgtcaaggcctcttttctagcttcttgctgagcactgtgtcactgaaaattctagttcttccttattttcagtagttagcaatcagatctcagcaatcagatcattgtgggtgtagaagggggtatctgataactctttggagaacgcccaaactttggttttcgaaagctgtatcttccctttatacctaagtcacttcctgatatgggtctagtccactgaaaggaaactctataggaaatttgctcaaatggaaatagcaaatcatagtgataatttaaaattgcaccaatcccccataactggatggaaagttacattagttcgcaccataaggagtttacaaagaattccagggtgggtgcggtggctcacgcctgtaatcctagcactttgggaggcccaagcaggcagatcacctgaggttgggagttcgagaccagcctgaccaacatggagaaaccccgtctctactagaaatacaaaattagctgggcgtggtggcacatgcctgtaatcccagctacttgggaggctgaggcaggagaattgtttgaacccgggaggcggaggttgcggtgagctgagatcccgagatcgtgccattgcactccagcctgggcagcaagagtgaaactccgtgtcaaaaaaaaaaaaaaaaaattccaaacaaaaatatcaatagccatacgcaatggaaatttggacttcaacacaagcaagcagtttaaatagtttgaatataaaaggagtcagaatagacaggacaagccctaagggacactgtttgggtataatgctttaggttgccatgagtatttgcattttgtggcttatttggaaagtgacattattttatcaaataactgaggctccagagaggctggagtctgggcaacttatccaaggatgtcttgattggggtcaccaatcacttttattctaaatgtcatattatttgctctaggtaggccctctgggggacattggcaggtctgaggcagagtaaaaattatagcaaatactgagatccagcacttactattgccaggccctgttttaaaagctttacatgtatttgcacatttactgctcacaaccaccttatggggaaggtgctaggcaggcagggaggaggaaatggaaagggaaaggaaaagggaaaagagcgggggaagaaaggagcaagaaaaagtcaatgcaattcggcaattatttgttaagtgctaactgtatgtcagggtctggtaatcaacagaacagaggagggtataatgaagaggggatataggtagagaaaagaggatgagtgggaagaggaggaggttggagaggaggaaaggaaaggagaaataatgaagacaagagaaaagcaagccatgcacatggagggcaatggtaagaggagaaacctttgccacaacctcaagggttggccgcactgtctgggctgaggcagaggctgctttctcctggcccagtcttttacccattgttaccacgaggttggcacagcttccacacagtcctttaataagccagctctgaccctggcgacatttggcctggtacagctcaaggcaggtagcctacaccctggcctagccaggcctttccctagctcacaaaggtcaacttcataacgtggagcgtgagcttttaccatgttctcagagaatctgcctcttagtatttctttttctaaaggcttcattgacccatgtatccctattgagtcttcaagcactatttgacagaagggcttgtttttatctgactgctccctgcaatattacttttccactaagtttgccagaggtacccctttctaacatttgctacctgttcggatggtcacctcatgtcacatttttctcttcctgttccgcccaccctcagcccttgtcggaaaggaccctttcggcctctctaatcaccagaagggactgccagggccttgtgctgatgacactcccaccctccgtcagcctcctccactagctgataaatggcaccagccatgctgtctctctggtttttaggggtcccaagcaaggtacattgctgctgctgcccagcccctgccataccccagacccacctcagtcctgacttaatgcaggtagcttcccagatgcattgagatgccaggacttggaaggtgggactcgatcgcagcagacactggccctggagacatattcttacagtccagagaggaaggacagtctgagcaaaccccaccctttcacagccactcagttccctttttttgcttcctgacctaaaccaatgtctttttttcttctcagcagcatgctatctggttccctgctgccgtccctattccaccccctcaactgtccccgcccttcatttgcttgggacctctgacactactatcttgagtctatctttgaaagaacctttctcaacatgactggggccactgagactctagatggggctggcctgagcagacaggtcatcaagctatcctcccagaggtaaagggacaacatacctaaagtactatgaagacagtcagcacagggagaggggcttacaggaaagaggagagatgctgggggctggcagacacagagcaaagagactggccaggaagagcgtttttcgagtctcctgtcctccggggcagaggagtctcagggacacacagttgaacttgatagtgaagggaccccaaaggacaaaacaagacagaggtagagacaagacttccccgtgctgagtcattttctaagaaagcatttttcccctacagataaaaatgtcggaatataagcccacagaaatacttgtgcccttccccattttctgtggatgttgactttctccatttaagatttggcctcagggattaactctcaatgtccacctttctcttgagtcctgtaaaccggtaaagcagactaggtatgtcacttgaagcctggaggttttctcaggggccccctacattatgctccaactgcaatgattcccccagggattctcctaggaaatgcagccagtattgaatgcagaccatgatggtggagcccctgctgactgatctgcctgcccaccttgacacctcgggcactgccatatttccttgccccaaggcactgtatcctaatgtagaaacagatcacaggtcccactacaatttcatccgaagttttaagtcaacaggaccttatttttttttctttattttgtctaaaaaacaaacaaacaagcaaacaaaaaaaatggggtatatgtgcagaaggtgcaagtttgttacataggtatatgtgtgacatggtgatttgctgcacctattgacccatcctctaagatccctcccctcacccccaagccccaacaggccctgggaccttttttttttttttttttttttgagacagggtcttgctctgaagcccaggttggagtgcagtggcgtgatcatggctcactgcagcctccacctcctgggctcaagtgatcctctcacctcagtcaccctagtacctgggactataggcacacatcactgtgctgggctaatttttctactttttgtagagatggggtttcactatgttgcccaggctggtctcaaactcctgggctcaagcgatactcctgccttggcctcccaaaatgcagggattacaggagtgagccacctctcccagccatcaacaggactttaaataaaaacatttaaagtatttgtagactgatgatagagtggttgatactcacatttgcacaagacagatggacagcatgtgttgtatgattgccttactttattgacaacgtctatcctttcgctagtcacccccaatagctgttccactcacctgcctgagggttggccacaggcattcatcttccctcctcttttcttcagttttttttttttttgagacggagtcttgccctgtcgcccaggctggagtgcagtggcatgatctcggctcactgcaagctccacctcccgggttcacgccattgtcctgcctcagtctcctgagtagttgggactacaggtgcctgccaccacgcctggctaattttttgtatttttagtagagacggggtttcaccatgttagccaggatggtctcgatctcctgacctcgtgatccacccgcctcagcttcccaaagtgctgggattacatgcgtgagccaccgtgcccaggctcttttcttcagtcttatgccacttgttgtcacatgccctgtcctttctcaagatccatcttggggtggggactgggaggtgataggcatccaatgggagagctaaacaagagagagagaggagcacaagggaaaagagcaagtagacgtaggcttttcttcaccctctgcccacgaccactcccctagcacactcatccatactgacagaaagactgtactcagatagtgcaaataaacagctgagtgtcacctgaagagattcccaatgcaatataaggttctattcttggtgctatcctgttcagcatttttattgatcatctttgaggaaaatataaaaagtagcccggttagtctatgaatggtgcaaggctttgtgtgctagactggatgacagaagagggcaattagttcccaaaaagatcttgatcacctggtgtgagaagccaaattccacaaagtgtattttaccagggctaaaggtgatgtctcataattgggccccaaatttgaacttcaaatgactccaggagaaagtggagtagcagtagcatttgtgaaaatggttcaggggtttttgctgatagtaatcaaaaggcatgtcatcagttaacatggcttccagaaaagccaaggtgacattgaggcttccttatggaagtaaaatatctagacagaggaaggtaacatgccacttactctgcaaagccagaccacacctagagtcctgcattcagttctgagtgcctcgtcttaggggaaattaatgagcaggagcatgtccaaaacagagaacagctcaagcgatcctcccacctcggtgtcagcattggtgtacaaactttcacttataggatgtataagctctggggatctaatgtgcaatatagtgaccatagttaataatactgtattattgaaatttgataagagagcagattttaagtgtcctcaccacccccatggtaactatggatggtgatggatgatagatgtgttaatcaatttgactgtggtaatcattacacagtgtatacacatatcaaatcatcatgttgtacaccttgaatataaacaatttttgtcaattaaatatttttaagtaaacaaaaacaagcaaaacccccacaaagccacataacaccagatatgatagaaagaactaaggttgattaaatgaagaggggccatgttcacggtcttcatatttccatgttactaacataaacccctaaaggccagtgagattgcttaagaatctggaaagaaaaagaaaatgctggaagtttggcaaagaaattttcaggaaatgtagcaggtagtggtaatatatttattatctcattcccagagaccacccaacaaaaaagggggtgatcagagtgtcagctcaggtcccacgcgtgttcctggagggttgtgcaagcaagataccccagactctcacggttcttcagcccctattccactgccacctcctcctgtgtctcagcccaattctgtctcctcaccatcctctacactgcagatgcccctgcttcctttgtatgatgtagtggttaagtgcaaggctatagtgttagactacctaggatcaaattccagctccacaaaaaaataacaacctgtgtgacttcaggtaagtaaacttaacatctcttgtgcctcagtttcctcacctgttaaatactaatactggtatatacctcctggggttgctgtcaggattaaaaggggtagtatgtaaggtggttaggagaatgcctggcatatagtaagtgcgccataatttttttagctattataattaccaggccacaacagcaatattttataatgttaaaggaacgcgggctctagagtcagtctacttgggtttgtatcctagattcactaaataccgttgacattgggcaaatcgtttaacatcctacagcctcaatttcttaatctgtaaaatgagaataatagtaccacctgtctcctagaattattgtgagaattgtatgacacaatctatttaaaatgtttagcaccctgaagtctttctatgctggactctcttgagacctagtatatgccttctgccaggtttgcaaggaagggaagagccgctaggtactttctacttctaggcttgatgattgctattacaggagccaaacaatttcattgtcacttttcagaacctagagctgctgacttactccctcaacagaagggtgctgctttaatgccaatcattgttccttttcttcaaagtacttagttcataattgcacatttataagcctattagattactgtacctctcccccggaacagtgcctgccacataatgggcatccaataaccatttgttgaatggaccaactggccatgtgatagatgaactggaacaattggctccctccaggtcttcattgaattagcagtttgctgcgaaaggtgttcccagtgaccttgaggtggaacaggaatggaacgtggaggtggaggaccccttcattcgaccctagtcctggcttccctcggggacggggaggccagaggatctgggaaaaacactgctcccttcactgaacgccactacgtagcagagtccaccaaaagagataaagtgacgaa

SEQ ID NO: 25 - DNA, 5904 bp, Homo Sapiens
cttttccactcctccccttacctcccttctcttctgaattctccattctgggctcttgcctgtgaaatctttctttgctttccccatcttttcctcgcattttttcaccatctttccctcaatctccaggagccaatgcgagactttggctccgattaagcgacggcccgagactcggggtgcgcgaggaggatcgacagagtggtgaggggacctaggagggcgggagtggcagaggtatgagagagagagaggtgagtgggaggcgaagagtgagaggaaggcagggagaagctaggagatcggaaggcgtgggtcagggtgaatgacgtgaagtagacttgggaagggaaaagaggtggctttagatttgggaagcatggaggggagaggttaccgccgtacttagcagaagtgggctaagagatagaagataggaaggacgggcagatttggagcttgtagactggtctgaccaggatgggatggaagagagaggtgtgggctcaattttctttgtccctgtttagccaaagatgagacaagtcattgaaatacaaaatgatcttgcaaacactggacagttaacaattctgtcacttggtaattgagggaagactggagttgaagggcagaaatagggtgaggaggcaagaaagggagggagattggtcaggtttgggagaaaccagaggagatgagtgacatgggaaaggagaccacagaaaaggtggggttattgtggggactgatggatctggaatcagttagaaaggtcaggggtgacactggcatggatggtgaggttgcacttctgacgtttgcattcctcaggtgatggagagcaccccttcaaggggactgaaccgagtacacctacaatgcaggaatctgcaggaattcttagggggcctgagccctggggtattggaccgattgtatgggcaccctgccacatgtctggctgtcttcaggtgagaagccccttcatggcagggaaatgtaatggggtctgcggagtggaataaaatatcataggtaaaagtgtagcagcctggagtcggggtggggactgggggcaagggttggaaattgctctaaagtgtggaggccaaaacagcaggactggtaaagttgtgctggagtgagatgagatgtttgagaggtaattgagggcagagatgcagatacaatgcagcttctgatactaacctttgacctctgttcctgtacagggagctcccatccttggctaagaactgggtgatgcggatgctctttctggagcagcctttgccacaggctgctgtagctctgtgggtaaagaaggaattcagcaagtaagtctcagccagatacaaatttctcaacagctacatttcccaaactgctgttccttggagcacttccaggaagtgttaatagatatatcacaaaacttaaaaataaatacatttgggaaactctgcatattgccttttcccttttatttatttcccagctgagatcttgctttcaaatgtatcttccctcttaaagagttatgtgtgatatctgtaatgaggctctgataagtaatgcagtaaagaatttgtcttaggaagatactaatttcactctgtggaacagtgttccaagggtcagcaagttcagaacaggcagagatggtggcttttatgggcctcctttttgttttccaaataccctactcacctctctgcttctgttccagggctcaggaggaaagtacagggctgctgagcggcctccggatctggcacacacagctgctcccaggcgggctccagggcctcatcctcaaccccattttccgccagaacctccgcattgcccttctgggtgggtatgtcacttctctctcttcctaagctagggcaggggaactgctgcttattaaaccactaattaaactttgggagggggagctcctgggggcctccccagaaccttgtggtctccacgttgggaactcctttaggagtaagttggaccagatgtagtgtgtggtgtaggaaatgtcccccactcatggcccctgaggataagggtggaaagatggcagagggcagcaaggaacacagacagggttccttactctttttttgttgttctgttttgtttgtttttgagacagagtctcactctgtcaccaaggccagagtgcagtggtgtaatcttgactcacggcagcctctacctcctgggttcaagtgattctcctgcctcagcctcctgagtagctgggattacaggcacccaccacgacgccaggctaattttttgtatttttagtagagatggggtttcgccatgttggccaggctggtcttgaactcctgacctcaagtgatccgcccatctcggcctcccaaagtacagggattacaggtgtgagccactgcgcctggccagggttccttactcttggcccatcctggccgtagggggaaggcctggtctgatgacacaagtcagctgggaccagacaagcatgcccgggacgttccctcccttgacaagtacgccgaggagcgatgggaggtaagcacttgggagtgtgtgtgtctctgcttgtgcttctacttcccatggcccttggggcatggtctccctgttctcttctgttcttcaggtggtcttgcacttcatggtgggctcccccagtgcagctgtcagccaggacttggctcagctcctcagccaggctgggctcatgaagaggtgaggaagccggaggtacagcagctctctgctgtgccatctccttgggtccctaagaaatggtatctggggctagtcaagatcagaggacattagctggaaaaggcaagctgagtagaatatagccagagataccaagaaaaaacgtgagtggacaagtggggatagtagtctttctctgcatatcaccatcattgtcctggtctttgtctctagtactgaacctggagagccgccctgcattacttccgctggcttccagttcctgttgctggacaccccggctcagctctggtactttatgttgcagtatttgcagacagcccaggtgaggaggcagggccacttaaccagcatgctctgctcctctcaggtctcactgagagactcctgcctacagactgttccctgattttctcttctctgtccctttcttcccattgtctccctcccatccctcctcctttgtctctgcctctttctccctagagccggggcatggacctggtagagattctctccttcctcttccagctcagcttctctactctgggcaaggtaagcagggggctgaaaggtatagagatgggaaggggaaagcaagttgtggggcagtagagtagactgagaagataagaatgaaaacagaacgaacagagatggagaaagaaagaatgaatgtatggggttgggggtgggtgggttgtgttttggaccccagctggaaacctctgttcctcaggattactctgtggaaggtatgagtgattctctgttgaacttcctgcaacatctgcgtgagtttgggcttgttttccagaggaaggtatgagcgcctagataagtggcttccagggaagaaacagggtggtgtgttgcctttgcctttaaaaaggagtggggtcttggggcagtagcaggaagcagttgccagaactgaatacttgggtctctcgggggagagaagttgggggttgaggttctgcatcttgggagggatctgatatttcaggcaggaagatgtaaggcagtgacttctgagacaaggcatctgcctttctattcttttcagaggaaatctcggcgttactaccccacacgcctggccatcaatctctcatcaggtgtctctggagctgggggcactgtgcatcagccaggtttcattgtcgtggaaaccaattaccgactgtatgcctacacgggtgaggcgggacagagggcccctggaagaggaggttgggggtgagggaatgccagtttatgttcgtgtttacctggcagtctacagagctctctgacatttctcatgacacttgaaagaagggcttgagggagtctgggtgtgggggtggcctcctcatcctctttctatccctggctcagagtcggagctgcagattgccctcattgccctcttctctgagatgctctatcggttccccaacatggtggtggcgcaggtgacccgggagagtgtgcagcaggcaatcgccagtggcatcacagcccagcaggtattcccacttgggagaggtggagcaggaagacaggctgcacttgggctgcgggggacaggggtcacattatggaaggctagctctgagtctgttataataggtggtggtgagttgtctgtgtttgaagagaaatgaaggctttgggtgtgagaataggtagacccttgaggggaaaaaaacatggagggaggaggtatagatctggatttgtgcctcggcactgccacatcctaactgcgtaaactagacatagttgttttgcctctgtgagcctcagtttcctcatctagtaaatgacagttcttacctcagggttgccgggataattcattggaagaataggggcaaagcattgagctcagcacctgtcatgcaataaatgctaaaaaaagaaaatagtagctgctgctattttaaagaaagaaaaacaaaacattactggaaagggcgaatgtgccagaaaaggaatatcccacgttgctgggagcagcaacgtgggataacagctgaactgggatgggtggagttgatgacaggagttatgagtttttagaataagctgatgttccagtgacattaggtgacagctcagatggctttcctgccttcttgctggagccctcatgccattcttgtctgttttcctagataatccatttcctaaggacaagagcccacccagtgatgctcaaacaggtatagacaggctccaagatgtcagaggctggcagctggtgatgacatgatggaaaagaaaaaggggcatccaaatctggggaagaaacagagggccgggttgtctggggcagtattctgagtccctacagtcaacccttgctccttgcagacacctgtgctgccccccaccatcaccgaccagatccggctctgggagctggaaagggacagactccggttcactgagggtgagtagcttctggtggccaagtcttggtcattggccagagaaagggcagacagttcagtctgcattttattttttacttcatggactaggagagaaaagctggcaagacagttttttgttgttttggggtgagtcggtagtaaacaaatcgtcccaaatcaatgcactttggatttggctaggtgagggaataattcacagtaatttgtattaggcctttctgaatatggctggatcacactggtgttaagatgaacccctgagcagacaagcatagagaattagtttgtaaaattgcggtgggggcaagcccagaccgcgtccagggctgccaccaaggagctggggggattcccaataggagctccgagcttcactttctcgtcttctccccgcgcccctcccgtcctgccgaccccaggtgtcctgtataaccagttcctgtcgcaagtggactttgagctgctgctggcccacgcgcgggagctgggcgtgctcgtgttcgagaactcggccaagcggctcatggtggtgaccccggccgggcacagcgacgtcaagcgcttttggaagcggcagaaacatagctcctgagagcgcgggacttggacacggacctcggcgggcgggactgggcggggcggggcatcagaactcaggtgttttttatttacgcgtcagggcttttcttgtttaataaagttatgatagcta

SEQ ID NO: 26 - DNA, 26648 bp, Homo Sapiens
agatgccaaaacagcacccagctgcccatcaagattaccagaagggccccagttcctggcttctctgtggctcacactctggtcctattgcctacccttgggaactcagagcatcctctttctcttttctgctgagctggtggctgcaccgagttgcctctgtctctttaagagagaaagagagagcgagagacggaaatcaggaagtgcgagagagctgagagccaggactcagtgctgagcttggtgtcccaccgccacaaggaggcagggaagaaacccactagtcccagctcctggggtggcacagacattgcaactggccctgcctgtgggtcctaggggcccttggctaccaggaggctaagaacactgctcatgaatgacagtgagccctgaaagctctgggggtgtcacccagtcccacaagcctgcatcccctgcagtggagatggggtgagtgtgcagcgtgcggaggggggtgggggtggaatgaggggccagacaaggggcagctgcagggcagctcagccgggtgcaggggtgtgggcttgttggcagcggtgctctcacatagagcgttgtgtgtggcatggaggtgagccaccacgggccaaccacaagccctccctgggctctgcttaccaacacccaaagccagcgatcagcacccagcgcctgccctcacctttcccggggtctttctccctggccggagtctcaggagtaggagacgctgggaaaggctccctgaacagtttgggaatagagctggaaacccccagcccagccctgtgggggaaggtgacaaacaggaaagggttaaagggctagggccggcggcctttgatggaggctgagaagcaactgcactgaggggcgcctctcatccgccctcctctttccggtgtagctcagctcctggacgtgccacagacagaaagcataacatacactcgccaggaagagcctttgcctgactcagggcagctcagagtgtggggtaagtgcacttggccacagcagagccctgaggagggaggggaggggagaggtgggtgggtggtgtctcacatgcttcactgtccactgctcattcatccaaccactggctgagggccactgagcccttctttgcaccaggtgcttggggtggtggggggaggatctgcagagcgtgcagagttaagccagatgtgccacaaccagagctcccgggcacagaatccaggggcacaccgcttgtctgggggtctgcgctttgcacctcactgcctattatcccagagtcctgagctgttccttgccccagtatcagagcccttggccttgatttcagcctgctgtgctccaaccccagccccagcccccagacctgctggctgcctccagcctcagcggggaaaaccagacccactcattcatgctgagctactgtgttgtcttcaggaagcctctcagtacctcagttgcttctgtgtaatgtccgctcctacctgatctgaaactaggagttgaccaccgatctcttcaaggggcctctggctcaatgaaatgacattatcaaggatttgcatttttaaaaaagattacacagagaaaaagttcagagcgaaggaacataggattccaggcatggcaaccctcagtttgagaacctgtaagatgttagaacacgaagatgccttttctagtctagcgttatttaaaagtatttaagtggccaggcatggtggctcacacctgtaatcccagcaattttttggggaagcccatgtggccggattgcctgagctcaggagttcaagaccagcctgggcaacatggcaaaaacccatctctactaaaaatacaaaagacagccaggtgtggtggtgcacacctatggtcctaagctcctcaggaggctgagttgggaggattgcttgagcccagggggtggaggttgcagtgagtcatgattgtaccactgcaccccagcctggatgacagagtgagaccttacgtcaaaataaaaaaaagaaaaaggaaaaagaaagtatttaaaggatggtggcccttctaatgcttctgtccccaggtatcccaaaaaggccagcactggccttatttttcaaagagaaattgagtttaacttctgaggatacactttctggtactaattgctttaggagaactaggctttggggaaaagatgaggacaaagatgggaaacagagttgtagggggtttcagattctcccaatggctgaatgatgaattttgcctcccctataccctgctctcacacacacacccacacccttctccccaacgccctacacacatacacacacacacactctcacacacacacacacacacacacactctgaagcagccccatctctcttggagcagtactggcccggctgtcagctcacagcagcaggaagtggtgggcctggcaggcaggccagcgggggctgggggagtggctctggactcatgttgcaatcctggagatttgtggtggtgtgggagatgctccctgaccctgggcccttcctcctatactgtttctgtttcctgggacaatctcaagcctggatgccaaaaccccagaatcttcagtgctggggagaggtggtagagacaagaggtttgtctctgcagaatgacctgcctcaggaggggcttcaagggaacgtggggagccaggacaggcagcaggtggaacaggtgccggctgtgggctgagggctcagtgggggccctcttgttgtgctgtgcgtccttttggggaagttacttaacctttctgtgcttcacacttcccccgctcccttgcttgtggaatggccacatggagcccttcttagggtagccttggggcacagttacaggtcaggccaccagcggccaccctgtgccaggaatggaatcctgggcccccagcatgctctttctctaggcagaaggtgaccagccagctcagggcaggagatgcagagcacagccaattacctgtggcacacagatgacctgctggggcagggggccactgccagtgtgtacaaggcccgcaacaaggtaggaagcaaccctggccaggccctgtccagcccagccttggccccctcatgcctcagaagctggcccagtcagcccccagtgggcattgagggtggtgggacagggacctctggatgttgtgtagcacactcatactgtgggtttgagcagaggcatagggagctgaaaacggctccttgagaggatgcctctgtcgggcacgagttggagcaagagaactgtgaagtaacaaggcaaacatccgaggaaggtaacagcaaatggaatctaggaatagcagagtggggaattaggccttgtttggatttatcctgcgagaatgtatgagatgatatccactctgtcttattcaagagtggtagccggccgggcacggtggcttatgcctgtaatcccagcactttgggaggccgaggtgggcagatcacgaggtcaggagatcgagaccatcctggtcaagatggtgaaaccctgtctctactaaaaatacaaaaattagctgggcatggtggcgtgcacctgtaatcccagctactcaggaggctgaggcagagaatcgcttgaacctgggaggcagaggttgcagtgagctgagatcttgacactgcactccagcctgggtgacagagcgaggctccgtctcaaaaaaaaaaaaaaaaaaaaaaaagaattggagccatacagaccaggttccaatcccttccctgctgctaaccccagggagtgttagctgccctgtgatgattgtcaatagcaattgtaataatgacaacaagccatcccctgcagaagatcagagtgtcaggatcttgtcacctcccagtgctggactctctaccccttgagagggaaaggcggtgcggatgggagcccccatccaaccaggctaatctctggggttgggctggccggagaggctgaatggaggcccaggagagggtggctgctcccctgtgggagtgggacatgtgctaatcccatgctgtctcccactgctccctccccaatggcagaaatccggagagctggttgctgtgaaggtcttcaacactaccagctacctgcggccccgcgaggtgcaggtgagggagtttgaggtcctgcggaagctgaaccaccagaacattgtcaagctctttgcggtggaggagacggtaggtccggtgcttggtcagagaatggtcttgtccttgacccttatggtctggggagaatcaggccacatgataacagagatttggtcccatgctcatcagcaggtcagagacagcaggcaaattgcagaagggagcaaagggggcaagggggtgggggcggtgcactggaaaggaacgatggacagaatcagtacctaagcagagggcttcctggaataactgactttggattccagtgtgcgggatcagtgtgaggccaaggagggaaggccaggccagaagctgggacctggagaatgggggctctgggctccaggctgagccacttcttcctggtgggtggggaggagaagtgccgtcctcatgagcccctctctgtcccacccatagggcggaagccggcagaaggtactggtgatggagtactgctccagtgggagcctgctgagtgtgctggagagccctgagaatgcctttgggctgcctgaggatgagttcctggtggtgctgcgctgtgtgggtgagcccctccctgtccctgcctccaccctcagaccagcggcaggcctgggacagatgctgacaggactcaggtgtctgactcctgctaatcattccatttaaaattccaacttaaaaattaaacctaaaaaagattgtacaccaatgttcacagcagcattatttacaatagccaaaaggtggaaacatcctaactgtgaaaacaaaatgtgggaggtacctaaaatagaatattattcagtcttaaaaggaaagaaattctgacacctgctacaacatggatggaccttgatgacattatgttaagtgaaaaaagccagacacagaaggacaaatcctgtatgattccactcatacattcatagaaacagaaagtaccatggtggtttccagtggctgggggcagaggagaatgaggagttgtttaataagtatggtttcaagtttgaagaatgaggccgggtgcagtggctcatgcctgtaatcccagcactttgggaggcccaagtgggcggatcatttgaggttgggggtttgagaccagtctggcgaacacggtgaaaccctgtctctactaaaaaaatacaaaaattagctgggtgtggtggtgcatgcctgtagttccagccacttgggaggctgaggcatgagaatcgattgaacctgggaggcagagattgcagtgagctgagattgcaccactgtactccagcctatgtgtcagagtgagactctgtctccaaaaaaaaaaaaaaaattggagaatgagaaaagttctaagatggatggtgtgatggtggcacagcagcgtgggtgtgcttagtgccaatgaagtgtacacttaaaattggttaaaatgggaaatttcgttatgcatattttaccacaattgaacacctaatcaaaagaagtaatacaaagaggggtgctgcccttgaggacacagagccaccacccatcttggtttcctagagaatccagatggtacctccataccctagtgtccttgagatgccccctaagccccatgcatgtctctgtccttctgcctgtcccatggctctgtcagcccatgggaactcctgtctctctggatgcaaggacagccttcccaccaagatgagcctcagacactagactgtccccgaccagagccagctagtggcctccccgtctgtccccagtggccggcatgaaccacctgcgggagaacggcattgtgcatcgcgacatcaagccggggaacatcatgcgcctcgtaggggaggaggggcagagcatctacaagctgacagacttcggcgctgcccgggagctggatgatgatgagaagttcgtctcggtctatgggactgaggagtacctggtgggtgagctgctcgagacccgctgccctatgctgagggctccccttgccttgtgagccccccagagcccccatgagggggtgtggcccacctcctgcttccacaggagttatgtctctcccctgtaccccaaccagaagaatgcattctgttctctaagatggaaaaggtgaggctgacacccatttttaagatgacaaagaaggatttgaacagttctgttttcacctgcaggcggtgaaagggggtctgacaggtctcaggcccttgccagccctccggctccatggcctcattctggttctctccggcagcatcccgacatgtatgagcgggcggtgcttcgaaagccccagcaaaaagcgttcggggtgactgtggatctctggagcattggagtgaccttgtaccatgcagccactggcagcctgcccttcatcccctttggtgggccacggcggaacaaggagatcatgtacggtgggccacagggcagggaatggggcggactggcagtcccctggcccttcccccaccggtccttgctgtgtcttctggtcccctcacactccatggccctcctctggtccaccccccaacccaggctctttgtagatctttttttgttaatgggatcaaacaagcagctgagctctgcccagggctgatgggagtctgtgaatatgctctatgttagttcggtgcttcactctagccctctgctcccttactgctctcctcgtctcaaccgaagctcaaagagtgccttgcctaaggtggaagagctcaccaggggcaaaggtggcagcttcctgttcccaggtccaaggtctttccatggttttgtgccatcggacagggaagtagcaagtggctggagacagtagcggctccctctgagtgcacagcccagagcagaggagatgtcagctggcttagtgggaaggttgctgcacccacctcagccccggggtccagctgtgtggaacctatatcaggcccgcaaaaggggcagaagaccagcatggatgggggttgtcagggaaggctggactctgaagggaaagaaagaggagaggatactggggccatgcatagcatgggcaaaggtgtggaggaggctggccaggctgagggaagtgtagcggggggagaggcagtggacagggcaaaggtgtctctacctgaagcaaagggctccaggaggagtgctgaggcaaggcgctctcacagctgagagccaggtttctcacactccatctgtcaggctactttggggtagctgggtgacttgaacctgtgctccgagccctttgtgctgagtgtgtcgttgcccggcaatgtgatagctggggatcccgctgacctggccttcctccccgcaggtaccggatcaccacggagaagccggctggggccattgcaggtgcccagaggcgggagaacgggcccctggagtggagctacaccctccccatcacctgccagctgtcactgtgagtgggaccctgctggggggtgatgctggagtctgagctgggtgtcacttctctctgctaagtcaagacttctgaggcctgttccagcaggttccgggcatgctgcaggcttgggcacaccactttcccatctggttgctggaacgagttcttccagctcttcctccccaacccaccctgccccaccatcttggtcctagctcttcaggatattctcttagaacgctcctattgcctgcttaaggaggataggtctgggcccccacccctgacagtctccatgtcctgggagggcagggggctgcagagccagctggtgcccatcctggccaacatcctggaggtggagcaggccaagtgctggggcttcgaccagttctttgcggagaccagtgacatcctgcagcgagttgtcgtccatgtcttctccctgtcccaggcagtcctgcaccacatctatatccatgcccacaacacgtaagtgggggcgagggagggaagcggtgagaaccttctctacccaagcagcagtgcatgtccaaagcagcatctcccacagtacgttctgaggagtgtgtacataggaacgcttccaggtccaaacgtagttgggaaaagactagttctacaaagttaaagctaaacaggttttcttgcatgtacttcagagagtcagtaccttttctaatgctaatatgcattatacatctgagaagtgtgtgcgtggtgtatgttggctgtacatttcgtaaaggtactgctcatagtacccttgattcctggataattttatagaactaggtaaattttaatggcagtgtgacaggaagaggtgcagaggcaaaggctgggtattaggactcctgggacctgttcccactctgtctccatcactataagatgtgaactctccccttggtctctccacccttgatgacagagaaaaccacccccgtccctccctctgcaaaacagagccctgtctatgggcaacgcttagctggggcttaggtcaccctagccccctgccttgcctactgacaccccctgccctctgctccccaccacggctgtgtctaggatagccattttccaggaggccgtgcacaagcagaccagtgtggccccccgacaccaggagtacctctttgagggtcacctctgtgtcctcgagcccagcgtctcagcacagcacatcgcccacacgacggcaagcagccccctgaccctcttcagcacagccatccctaaggggctggccttcagggaccgtgagtagagccacctgggctggatctttctcctccccacattttcctctgagacaggagtttgcaatccaggccattggttacttttctttgtgggtgtttctttggggccacagggagcaggaggcagatgtgggttctaattctgcagacgcctctgagatgccacatgacgtgggctggtggcttgacctccctggggcttactggcatcctcagagctgtggaaagagctccagtggaaacagggagatctggatttaatgcactttccataatctctgatttgtggggaagcctcaggcagtttgtgttggaagaagcccaagtctgagctcctggaaagaagggaagggggtcggggtccagagcttgggcctctctccaaactctagcaaaaatgtcctttcttctcacttgaacagtgcaagttttatcctctttctctgaggctaggaaggggtattcacctcaaaacctgtggacaagagggtgatttagtccattttcagctcttggacatgaggaggtagttctcaaaagtggccgcaaggtggcagtgagggatcacaactttaagtgtggctaaggctggcaaggtgggaggctcagggtgagttgtgaagcctgaggtgggagattggcagtgaggggtgagtgtgagctggaaataatgaaagataagccgacccagcaccatacaggcaggcccctcagacagggtctttgtctgcagctgctctggacgtccccaagttcgtccccaaagtggacctgcaggcggattacaacactgccaaggtgaggggcaacccccaggtggcagggaggggcatgacccaagggtaggaggtgtgggacctggccctgtgcatctctgtgtttcagggcgtgttgggcgccggctaccaggccctgcggctggcacgggccctgctggatgggcaggagctaatgtttcgggggctgcactgggtcatgtgagtaatcatgagggctgggcacagagggggaggcgggcaggagagggaggcggacaggagggggagtgggcaggaaggggagatgggtggggggtgggcaggaagtggaggtgagcaggaggagggggtgggcaggagagggaggtgggcagagagggggaggcgggctggagggggaggcgggctgtaggtggaggcaggccggagggggaggcaggccagagggggaggccggcaggaggtggaggccagtatcctgggatgctgtctgcatgcacggtgctgagtcccccgatcaaggcagctctgactcagtctccccttggacagggaggtgctccaggccacatgcagacggactctggaagtggcaaggacatccctcctctacctcagcagcagcctgggaactgagaggtgggtgttcgcctcaggccagctgggacctctcagccctgccttgtctgctcctcaccctagatacttccaacaatgcacctcttctcccccaagccagggctactgccttccctgccctcctagaatagagggcacccgcaccctatcccttatccccacctcaccaaataactgcaatggctcccccaaaacccagtccctcacctgcaggggaaggggcccatgggggcacagactctccaggtaccaaggtggcctccctatcccaagaaggggcttgtgtcctgccaagtccttctctgaatgatttagagtgctcaccctatgccaagtgccagcagaactctagggggaggacacacacccacgcacagttcctggatgtgaccagggatggagatccaggtggtctcgttctccatgcctcatctcctgctttctctgagtcttcaacttatccttgccttccttgggttccctgccccaatctttggaaccccactccctccactcccttgtcttgggctaataaggggggatgggttggaaaaagagagagaccgggcaggaggaagccaagtggaagggtctggagatggggaatgtgggaagacttcattggccagagcacgattgagaagtaggcacagcaccccaaatcctggaaggcacgaggccatggtacgggtgagggtgggagctctgcagcctagggatgccactggtgacaggagtctttgggaacagaagatcagagactgcccatatgcctgaaggccccctcctcccgccacccccagcccttgtcctcagggagctccagggagtttcccagctgtgggctgactcatgcagccccgcgtgcctcctgcttcgcagcagcaactcagttgatggggcagctgggaggtggaggagcagggaggaggaagaggagcatctccagataacagggatggagtctccatccagactgagcccctctcaaatggtgacagagagtagggttcagtcagcagaactgcaagtgaatctcctttgagcagagctctgtccagggcacagagggggctccaggggtagatgtggcatcctgtcattcagagaggcccatgcttcctccggagcagctagcccttcctggacatgtgagggctgatgggattgttgggtaagaggagacctgagatgggtagaggcaaccacggaggccttcctgaaggatgaggctttttttttttttttttttttttttttttttgagacggagcctcgctctgtcgcccaggctggagtgcagtggcgcgatctcggctcactgcaagctccgcctcccgggttcacgccattctcctgcctcagcctcccaagtagctgggactacaggtgcccgccactacgcccggctaattttttgtatttttagtagagacggggtttcaccgttttagccgggatggtctcgatctcctgacctcgtgatctgcctgcctcagcctcccaaagtgctgggattacaggcgtgagccaccgcgcccggcctaggatgaggcttttaaggccagaaagaagaagaatacctcaggcaggaaggtctgcgcagagacagagaagaaaagggccctgttcgggggaaaggaggggatgctggggaggcttactgaagccacagtcatgatggcagatagcccagagctaagccagaggcggacagaggtggaggtgaggaggggaggaaagaaggcatagaggccctgaaggagtccagctagagagaggttggaccccaataaaacaaccagtagagagccattgtagattcttgacctggaaagatgtgtttgggaaagctttttgggtgtctgtctgcccacttgccctggatggacaggcatggtggggaatggcacgctggcctgggtctggcgtcctggcatcctggtgtccgctggctgctgttcccctgttctggctctgcagcctcctccaaggtggcctccgtggtgtgtctagagagctggggtcaggcaagtgcctgctttgaagcctatttcagcctcccatcaaggaggaggatggtgagcaaaaacagttgtgagcagggagccagagggccaggtgcagcctcttctcttagtctgggtgtggctccagcccattgtcaccttcccctacctgggcctctgtgtcctcattttcaaaatgagagggttgcatgatctctgcggcctcccagctcccacatgttgcaagcccattcttgcctgaacatccccagacctgtagattctcctaagggctgaagacactagctccacccgcagtggaaccaggtattttcatgagctgaatgtcacactggaggaacccagcacctcatgccaagtggcccacctttgcccatcctggtgacccacctctcccccagtgtgcatatcctgcctcaggttccccaggacaggtcctttggtagagcaaccttgcctttgtcccaaagctccctggccctcctgggcagctgctgccatccacaggcactgctcaggcagccaggacgggctttgggaatcctagggcttcccccagccccgccaccaggcaagacattccaggcaagacttcatctccaaggtcccttttgatccctatgaatatcttattgtgtcgcaggaaggaaatttgtctcctcgttttataggtgaagagcctgaggcctggagagctaaaggactaacccaaggtcatgcagatagcaaatgccaggactaggactcgaacccatgtctcctgactccctgtggagatgtattgggtccagcctcaccctcttctgccgtcaaatttcccatgccttaaaatccatttgtgcactcagtaacgccttcagcatccgtgcactgacggactaccatgtgccgaacacgttgctaggcacgagacgtacgaggagcaaagcgacggcacccctgtcttcaaggagcctgcagttcattcctgattctctctttgctcagctcccctctccttccctgctcctccattcccaagccaaaatacacagcatactttttaaaaatcatgattgttactaaaatgtatatactaatggtagaaagttagaaaacagagataagcaaaaataagaaaattaaaatcccataacctactatctagagacaggttatcacaccttaggagtacacatccttctagatatttttctactatgagtaaacattaaccaacatgaaatgatagtgtatttgctgttttataacctgttttggggatcacatctgctgtcccaccttctggactcatctagagcttccccttgaagttgtttgtcttgtccttctttctcagcatttcctgtaaactgggaagttttaaaaatttttttttagtattttattttatttcttttcttttttttcaaggcagggtctcactgtgttggccaggctggtcttgaactcctgacctcaagcaattctcccaccttggcctcccaaagtgctggtattaccggtgtgagccaccatgcctggcttttattttgtattgtattgtattgtattgtattgtattgtattgtattgtattgtattgtattgtattgtattattatttttgtagagacagggtctcactgtgtttcccaggctgatctcaaactcctggtatcaagcaatcctcccacttctgcctcccaaagtgctgggattacaggcatgaaccactgtgccaggcctaaactgggagtgcacaaggctagatggattccagttgaacattttttgctagaatacattattgatgatgccgggtattgtatgttgacataccactggctggtgatggcctgattcctctgctgtaccgttacattgtccctgtagaagaaagaagcagagtggtgtgaccttgtcaccgtgcaaatgcccaccccattatcaaccatcattgcttgtaaggctatgccccagagaacgatttcactgggcagcaagatgataatgttctaacttctgatatatcattgcctagtagtctacaaaatatagcttttccctcatcagaaagctattggttatcaagaaatacagtttctactggacaggaacttaattctttccctttagttacaaagtttcctggtaaggagatcattaatagcagccttgcatcatgggcccgtgaattttcatagactcaaggtgttacaatctgtctcaacctttattatttgcaatactcaacaatgtcacaacttgggtaagcagggccctcgtcaggatggcgcctctgtcccaaacacaaaacttcccagagacccggagagccaccaaggctgtcccacagatgctatgcccagcatgtgccaacagagctctctgcctcccaccttggctgctcctaagcccccaaatgtggcctttctctttgcttccctcaaggttcagcagcgtggctggaacgcctgagatccaggaactgaaggcggctgcagaactgaggtccaggctgcggactgtgagtgaggctggagggcaagggcttagcaggatcagagctgggggcccgtgttccagccagcctgcccaccagtgcccaggctgaagaccccacgggggtctgcctttgtgccccacagctagcggaggtcctctccagatgctcccaaaatatcacggagacccaggagagcctgagcagcctgaaccgggagctggtgaagagccgggatcaggtacatgaggacagaaggtctgtgggattttccttctttgtggggtgggagtgggggagtgggcagctccaaaggtccagtaacctttagccttttagacgtcagcttgcattcccctttctcttggcaagggtgctagggcatgggggagtagagggagatccagcaataaacaagaaccccccgactgccccagacaccagccaggaggagaaaaggatctggggtcctgcacccatcttggagtttgaggaatgcctcgggaatcttagcaggtgctataattctgaataaaagaagactttagttccctttctctgtgtcaggcccttgggtaggtcctctcacgtacagcatctcgttgaatcctgaaaacaataatgatgctatgataatgccctttttatagaacctcagtcagtgaggttaacttaccctgagtcacagccagtaaatgacaaatgacagaggtggcttcaggtcgggtctgtccacctccaaagcctatgttcttggcctatgccaggcaggggtttacaacctttaaggcaccactctcccttttaacagacataaaaatacccccctcccccaggccccagctgactgtggggagccgctgcctaccttgccgcttctgaccaggggatgggtggtacccagcgcggacctcctccccattctctgctggtgcctactgtaatctgggcctatccccatccatcatcccatggcctcaattctaaattcaaacagctctgaacaccacaggagtttttcttaactgttttggccataaaacctgacctaaatcgaatgaggctctttatagaatttatcccacttacggtgaatgttcttgtggttctttggagatgtgaatgtgtttgattaggagttgatgccctgctcgggccattccacaatacactgtgtgggtaccaaattgcctttctgatatcagaagacgattctcaattcagagcacatttggccccgtccttttggatgaaggctgcagatctgaggccccgtccttttggatgaaggctgcagatctgaggccctgtccttttggatgaaggctgcagatctgaggccctgtccttttggatgaaggctgaggatcgaggtcctgtccttttggatgaaggctgcggatcccaggccctgtcttttggatgaaggctgtggatcgaggccccatccttttggatgaaggctgaggatcaaggccccatccttttggatgaaggctgcagatctgaggccctgtccttttggatgaaggctgaggatcccaggccctgtcttttggatgaaggctgaggatcgaggccccatccttttggatgaaggctgcagatcccaggctctgtcttttggatgaaggctgtggatctgagccctgtccttttggatgaaggctgaggatcgaggtcccatccttttggatgaaggctgcggatcccaggccctgtcttttggatgaaggctgtggatcccaggccctgtcttttggatgaaggctgtggatcgaggccccgtccttttggatgaaggctgaggatcaaggcctcatccttttggatgaaggctgcagatctgaggccctgtccttttggatgaaggctgaggatcaaggccccatccatttggatgaaggctgcagatctgagccctgtccttttggatgaaggctgtggatcccaggccttgtcttttggatgaaggctgtggatctgaggcctgtcccagccacttcatcttccaccctcatgttcctggcggggcaggctccttcggctggcagagccctggaacaagcctgtgctctgttcagagtcaagctccagaaatagcagagatggggtcacttggaggtgctgcagggaggaagtggagctacataggcctgtgggtgaggaagaacttttcccagacactcccgacttctcaaacaaagtgtttgtttccagcctgaaaaggggaaggaagaaataataatgaccttcaaccccagaacaagaaagtcctcgggagatcatctccccagttcctccgcctccgggcaggaccgaggcctgttgattcattcttgttttcaataaggattattgattcattatttatgttaagtttctgctgtgtgccacacattgggtaaaccaagaagctatattcttctgctttttccagttgaccagagagagattttagctcccctctatccccagctgtcactgccagacacgctcttaggtttcaggggcctaggctccttcccagggcctagtctcacaacttctcaggtagtaaaggccacgttcctgttgcccgtcctgcttggcttcctgtctctcttatctcctacttaactcatgctgcgagtgcatgtgtgtgagagaggaagaataagccatgagaacgagagacggctggctgactgtacggggtctcaaataagcctagagacgggacagccacctccactcccagactgatcccccaaaactgtggctgtgaggctcctcccctattccactgccacccttcccctccctccctctttcctctgtgctattagattcttccaacacctggtccctgtctcctgcccacagcatccagcagattcagtgctgtttggacaagatgaacttcatctacaaacagttcaagaagtctaggatgaggccaggtgagcccggggagggcagatgccccttctctctcctctgtctcccttctttcgcctttcttccttttcactggtgctaccagtggccactaacctccagctaagtggccgctaacctccagctggtggttcttggaggcccactaagcggatggttctgtgcagctgctctaggggcaaggcccctgtctgcaagctgcctgcaggccagtgggggacatgaaacctttacatgcctgcctgttgccacatgagagacttggatcacatggttgggggatccagtgggccgggacctgggtgctgtaggagaggtggtcctggaaagagatctcgcaccttggcagggcactttaaagtatagaatgtcactatccgttgtgtccttgggacactgagacagtcaggttttccagaaaagggggggtcaggagaagtcccattttgagtcactgggtcaggcattttggctgcttgatccattaatcctcacaaggatgctgtggcaggggcagcccatttacaggctcgggggtgggaagctgcttgtccaaagtgactgccattgtggggtagtgcaagggtgggacccagggagggctggtgagggggttggagggagcctgcggaggctccagttgactcctcaggttggggaactaacacaccaggaaccaaacctccccctcctctcccaggccccaagcatttcctaatctgtaggctgaaggtcttgggctttattgccaaattctcttctctccttgggattatctaaaaaccactgtccaatagaaatataatgccagacacgtatgtaattctaagtcttctagtagccaatttttaaaaagtagaaagaaacaagtgaaattaattttaatgtgttattcaacccaatatatccagtgtcattttagcgtgtaatcaatataaacaaaatcactaaggaaataccttatattctttttgtgttatcttcaaaatcccacgtgtatatatacacataaatatataacttatttccttagcaattctgtttatattgattacatgctaatatatatatttgagacagggcctttgtcacccaggcaggagtacaatggcatgatcactgctcactgtcgcctcaacctcctgggctcaagccatcctcccatctcaggctcctgactagctgggactacaggatgctttcccatcacttcattgttttatatttcacatatatatatataattcatatatatattattcacatatatatattattcatatatatattattcacatatatataacatttataacacatctctattgggaaactaaattttatatatgtgtgtatatgtgtgtgtgtgtgtgtgtgtgtgtatatatatatatatatatatatatatatatacacacacacacatacatggagctgtgtgcagtggctcatgtctgtaatctcagcactttggaaaactgaagcgggaggatcacttgggcccaggagttcaagaccagcctgggcaacatagcaagaccccgtctctacaaaaaataaacaaaactagctggacgtgggcatgcgcctgtagtcctaactacttgggaggctgaggtgggaggatcacctgagcctgggagctgggagttcgagactgcagtgagctaagatcacaccactgcagcactccagccagggcaagagcgagaccctgtctcaaacaacaacaataacaaaacctctaggcatcattaccctccccattttatagatgagaaaaccaagacacagaaaggttaagtagcccaagtaatctaggtccagctgcttttaactatcccattttacagcctcaaaggagttttacttctattggtctttaagagtcctttaataaaattaaaaatgaacccctaactgttaaaacccagcgtgttgaaagataccattttttaaaatgcccggtggtcttcaggctctctcgcatgagcctcacgggactcccaagtggcacctgtgatggataaggagacaggctcagcgaagtgaaatcactcgcctagtgccgcctgccaacaggaggaagggctgaggtttgtcccaggtctctcggactgcacacatgctcttagctggccgagtgcagggcccaggagggggactctgctatgagaggagtgggatggggaggccctcgaagtgaaccgccatcatcatttcatcttggggctgccgccaccctggaggcccattcctgcgaagaccaggagggggcagcatctccctagtgcatgagccttagggcccttcaggaggcagccaaggccatgaaagcttcagcctttctggcaaaagtggctgggcagagcggggaggtagaaggtggtggcctgatttctccagctcgttgcaggtagcgcccatgaacattcagggatgggaccacccagctgcaggcatcagtcactctgggagggtgctggataaggggctatggttgaccgagcctccttctaagcccacttcatccaccaactcccacctgaagcatcccccacgtccccaccccggccctgcactgcaggctgccttcccctggggccctcacacaatttccccatggcttcttgaggccctggctttgtcctaatcagctattccggtgctagcttcactcctctgcccctcctgctccgctgggcggtgagttcccgtgaagcagcacaggctgggccgtcttcatcttttaactgtctctcgacctttgctgcacactgtttcgttgactgattgaataggtgacatctgttctgtctgtttcctccagggcttggctacaacgaggagcagattcacaagctggataagtgagtggcctgtcctccggcaggtgggtgggcaggagggtgggtgtcctcagggcagagcgattctcaacgccagaggagaggcagtgaagggccctgtcccggactgcagctgagcagagttggggataacaggttatctggggccaggggagggagtatgcatagcttagttggagggagacttctcagatgcaatcttgaagtaactggatttacttctggtatggacaagactgtttgcaggctttttttttctctagttgtcctcactgatgcaccacttaccacttcctgcttctgccctctgcctgaaccttccctgcctccccccgctcctctgtctcccatgtttcccggacacactcacgtccaggaggccctccctgatttaatggttatctgggaactcactcccccagttctacaagcaccccgacccctttttgtctcacacacacacgcactcacacaccttctttccacggctgcctcactttcccttccctttcctgaggactaagcttgagcacatgtgtgttccctgaggaccccctgtgtgtctcccacgtctccctgttgatgtgggctttgctggccactgcaaccttcacaatccaagtgtgtgaccgtccttcctcctttcccagagacatagccctgctgtggacgcagggcttgggcacttacgacaaggtggtgacggagactgacggagactgagggatggtgggcttgtgcatagtggttctggcagctcatctgcaccttggttctctgtcgttctagggtgaatttcagtcatttagccaaaagactcctgcaggtgttccaggaggagtgcgtgcagaagtatcaagcgtccttagtcacacacggcaagaggatgaggtaacagcccctcctgagctcctggagcccagggcctggcctggcccttctaggcttcagaggacccagggctttgtggagccctgaggcagagggaggagtgagtgaaggggtgtgagcagaggagtggttttctgtccctgggtggaccaggcagttggctgggagatttctgtagctcagcttatttactcctacaacacctgccctatacagtagatatcatcaccctatttcctaggtgaggaaactgaggctctgagaacaggtctcctctgcacatcacatggctagtaagtggcagacccaagactcgtatgtggctctgcctgcctctacaatctagattcttcagggcttttgaggggtaaaatcaaatcaaatctggattctttctaccgttccacctggttatattgagaagtctcctttaggagaacactaggtgcccctgggataaggacagtggcagtggcccttaagtagaaccttctgtcacactgtccccttcaggagttttgggttccgccttctcagatcaggcccactctccatcccctgcctgtgtgaacactggcccctcctgagaagagaggacaatttcccacgtgctaccacattctgaggcctgtaggacctcaccttgttatggggctgagaccttggcactcacccgtcctcatatcagaataccaatgcctgcttcttctactccaacccaccacacattctggtgtaattgctctggagcagggcttggatgtcagtgtagtacagcttctccaggtgattctaatgtgtggcgagggctgacctccaacccctgatttaacagctctgggccttggggaaaatgttcctgttccttcactccacttagagatagaagagaattcacactggaaatgagagcgtgggcagttccccacactgagagccctggtgtgggctatcctctgcctctctgcagcctgactggtgccacgctcaccataggtggcatgcgtcacccagccccagccacatgcatgttgttggtgctccacactacggctctgaagggggcctcccagcctcagccagctgtgtgcttctgcattattgcagtggggcgggcaagcgtggagggcacagctggcagggcagaggcagcgagggaggcaaatacccgggacccacctgtgtccatgtgtggatccgatggcagctaggcgagccctggggaatgggctgagtcctgctctaattctaagtctctgtgtgttctcttgagggtggtgcacgagaccaggaaccacctgcgcctggttggctgttctgtggctgcctgtaacacagaagcccagggggtccaggagagtctcagcaaggtgggcatggcagaaggattctaggtgctctggggatgcaggctggggcgcttgttacccatgtcttcccctcctccagcactccccctacccagccacacataagctggctactaattgctgaccaaagtatggcttccctgcagctcctggaagagctatctcaccagctccttcaggaccgagcaaagggggctcaggcctcgccgcctcccatagctccttaccccagccctacacgaaaggacctgcttctccagtaagtgctggggagaaagcggttgtgtatctgtgtggaagggggttgcagggagcagagtatgctgaggttagagcctgaggggtttggcgtcatgccaggcctaggaggcaagattaaagagactagctgggtgcggtggctcacacctgtaatcccagcactttgagaggccaaggtgagcggatcaacttgaggccagaagttggagaccaacctgccaaacatggtgaaaccccatctctggtaaaaatacaaaatttagccgggtgtggtggcaggcacctgtaatctcagctacttgggaggctgaggcataagaattgcttgaatccaggaggcagaggttgcagtgagccaagattatgccactgcactccagcctgggcaaaggagcaagactccgtctcaaataagcaaacaaaaaagaataaagaggcttctttggtggggctgcagaggagggtgggcctcccaggaaaagggtctgggcagggcaacttccagcctcagccgcctctcctgcctctgccttgggcagcatgcaagagctctgcgaggggatgaagctgctggcatctgacctcctggacaacaaccgcatcatcgaacggtaaggagctttcaccttgtgtaggtcagggccgggtcttcaagctacccttgcctgggggtggtgaagagtccccaagcctgcccatgcaggtttgatgacacgtgtccattttcgaagaagccctgttgaagcttaggcattttccacaaatgagttgacatcctcaggaggtgtagggttcacttacagcctttaaaatgtgagcctccatgctgtcagggagatgggggcctggaggcatggggtttgtgcctgtgtccagctctgcactccatatgtactctgtgctcaagctgccccagatgcctccttgaatcacagccatcctcaggataggtgctgttttcatccccatgtgctaccccaggaagccacagcgcagacaccttggatacgatgcccaaggccggtgtttctctggccttgtggggctcccgtccctcctgccaatgctcatgggccagcccggggctgcaggatcatctcctgatttgactcccctccttggggtgctgaggggtcatgagaggttggtgtgggaacgcaacagggctccgactctgagattgagattttgcataccagtaaaagttctttctttttttttttttttttttttttttttttgagacggagtctcactctgtcacccaggctggagtgcagtggtactgtgtcggctcactgcaacctccatctcctgggttcaagcaattctcctgcctcagcctcctgagtagccaggattacaggtgtccaccaccacacgcagttaatttttatatttttagtagagacagggtttcaccatcttggccaggctggtctcaaactcctggtctcagatgatctgcctgccttggcctcccaaagtgctgggattacagacatgaaccactgcgcccggctacgtaccagtatagttctaaaagaaaactcgagaacaacagagttaccagctgctcacataaccaagtaagcacatttgaagtaaaaaaaaaaaaaaaaaaaagccctgtcatctagtaaccctactttataaaacacattttaccaccaaagagagataacctcaggataaaggatggtccttgcttgccctgaaggccagcggccctgtttatatacatgtacacacgtgcacgcatctcccactcctgcctgtcatcctcgtgtctgtcattttcctgtctgagaaccaatggcagggtagagtcagcagaggttcctacaggatttcaatcctgaccctgctttttaccaactgcgtgaccctgggaggtgtgttcagctttgagcttcagttccctcccctgtgaaacaggagtaataatttctacctcatggtgttgacatagggatttaaaaaaatgagatatgcaaggtgcttgcgcataggggggtgtggagggaagggctcactaaatgttacttcttccccagaggccactccagtctcacactagaattggggccaggaggtagggaaaccaggagcagagcttgtggtttgtccccagagtttcagagggtccttgggtaagggaggaatctcctccctgtcctgttccagcaagagaactcatcctcttaaacacccacaaagaggacatttgacagcttcttggaaggattttccaaaacagccctcttggtcaggaagttctaattttagtgccaacaaaaattgctcttgctgtgatatgtcatctatttgcagatagctcaaaactttattttagtgaattttcacttccttattcagagctgtagccaaagagccaaatgaatccatttaaactcctttcccctcctaaaccttggctacacactggaatcaccaggggagcttttaaacgtacaaatgcctgggtcttgccccagagactctgggtacagcttgtggttaggatttgcatgagctttccaagtgattccaacatatagtcagaggcgagagccagtgggttcttgtcggggagtgagggtgctacaaggggagagctgaggacttgaatggctcagtgttcttgaaagctaattgtgctgggccctggagtgtggtctgcaggcctctccaacaggtgggcactgctagcctgtaccttttcttgtaggctaaatagagtcccagcacctcctgatgtctgagctccatggggcacatgaggcatcctgaagcattagaatgattccaacactgctcttctgcaccatgagaccaacccagggcaagatcccatcccatcacatcagcctacctccctcctggctgctggccaggatgtcgccagcattaccttccactgcctttctccctgggaagcagcacagctgagactgggcaccaggccacctctgttgggacccacaggaaagagtgtggcagcaactgcctggctgacctttctatcttctctaggctcaggtactgctcctccatgcccatggctgggccgtggggagaagaagctctcatacgccttcccactccctctggtttataggacttcactccctagccaacaggagaggaggcctcctggggtttccccagggcagtaggtcaaacgacctcatcacagtcttccttcctcttcaagcgtttcatgttgaacacagctctctccgctcccttgtgatttctgagggtcaccactgccagcctcaggcaacatagagagcctcctgttctttctatgcttggtctgactgagcctaaagttgagaaaatgggtggccaaggccagtgccagtgtcttggggcccctttggctctccctcactctctgaggctccagctggtcctgggacatgcagccaggactgtgagtctgggcaggtccaaggcctgcaccttcaagaagtggaataaatgtggcctttgcttctgttt

SEQ ID NO: 27 - DNA, 122548 bp, Homo Sapiens
tccaaaatggctcaacataatttattttttatgttaaaatgtacagagttcttttgaaagtacttgctagaaaggggaaaaaaaggtattacatacaaggagaggaagggaggccggctggcccaggagcgcgtgacatggagagatacaaaggcatctaggcaccccttccccttagcttacaagtcaccatgaacaaagtacaaagaggttacaaaacaggaaaagcaaatataaacagacaggatagacgtggcttcctttgtacatgcggcttttagaggcatctggagctctattcacacacgctagagatctctttaaagagaatttatctttcttaaaatagtttttaatattctacaacaaagataaaaaattttaaagatggaatgaaatgaaaaagctcttattttaaaaggcatcaaagtcactaacagtgagtttttaaatttcttttttagaagattacccaagttatcttgctaaaaatacattttttttaaacagaagtgaaaaaatgacaggtaccaatattactgtgttggataatttcttttataatatagaaaagaactttttttttctacaatagttctacagtcacaaagaggcttgtggaaaagggagctgcccgattgaattttttataaagaaacaaacaaaaccaaacacaaccgcaaaccaacagaaactgatttcacggccctcatttcaacagcttctccttctgccttgacccaccctcctcccaatatacctccctcccgacccaccccgtccccaccccaaccaggaagcaatgacacagctgaagatgtagggcgatggcagcacagtgcactttctacatagatgactgggaactggaatagtatatacagagaaactgggtcctacacagccttgcacatgctcagagctgagagcgggaagatgtggaattctgcgtttctacctagcacgcttgagaaagtcaattaaagtgtattaaaaaaaccaacaaacctgtgcatttgaaaaaagttaatgcctaattagtactttaaaaatttatctatataaaatgtacaaataaaggagagaatttaatgcttacagatatttctctaagcagtacttcccccttttggatatttgactgcacataccaagtggtataatagtttccatcttctaatgatggaatatatatatatatatatgtgtgtgtgtgtgtgtgtgtgtgtgtgtatatatatatatatatattttttttttttttttttttttttttacctatccctggagcaagtaataggaagagaatgggcaaactggttgcacgagagaaaagagaatggagttgggagcaacacatgaacttgcgttataacattctgctgtccagatctgccctactgtgctggtggtcggtctgtccctcttctcattagccactcacaggagaggtgcttgtgcactctgattcacaggggatgaactcaggatctcaaaagacatacaaaaactagaggtatgtatcacttaaatagctacgaaactcacaccgtgatctcccttctgacacacatctgcgccatctcttccaacataaaataaactgtttcaatggtttgtcagttatttttcaaatcactaaaatgtacagtcatccaccaacaatttaagaaagaacctaagaggcaaatcactggggactgctatttgagttttatcagtcaaaggctcaagcatcaagaccctcagttagcatttcaaagtacatactagaaacaagaggctgggtggcgtgtgtgtgcgttatggctgattcaccaggtggtaaaaaaacaagaggttaatctcctctttttgattgttaattgaccatctctattcctccaaaggctggatttggattgcaaacagcttttctctgagattctgctgttaattgagacttacagtatttttgtgtctctgagtgctgagtgggaatattttaaaaaagaagaaaaaaattatattacacttgattcaagaacaacaaagatttcaatgaagtccgtctataaagaaacattcttggggaagggtttcaagaggtgtgtgtgtgtgaggagtggaggggattttaaaaggagaagcattttcctgcctcactttattaataataataataataatattaacaataataataagtttaaggagcttgggttgttctccatgtccccatccgagtctcccctaagtgcctcctgctggaatgaagtaggaaatgaaaggttgggtttggaggaaagggtctggttaacccttgagatgtatataacatttaaaaatgacaacattgggagctgcaaacagtgaggggaaacatacattttaaaataaagataattcacttttacacaaattctgtccatgtggtatgtaaagaaagtaaggctctttttaattatgaaaagattttgtgcatgtttccccatccccaaatccatttttagatgagttctactgtaaaatgttcaagattgtgaagaaaaccaaaacccagaacaaaatgaacccaaaaaaagagaagatcaggttttctaaaaaataaaataaaccaaagaaaaattcctctaaatctacagcaatattttaactggaaaaaggtccatttttctctggtttgtcagtataaaaggttcctttatttatatatatttaagtttttgattgcaagttcatcttgctcatcttctcatgtaaggtccgttgagtgactgcttgggcacgccagcagcgttcatgtagctgtgatgggaggggcctgtgtacatcatgttcccatgagggttaggctgcataggctgctgggtataggcctggctccccatcattcccatctgcatctgcataggatactgtgctgtctggttcatgtaggcagggttactatggtaactgctgttcatcatgggctgtgtcattcgatagctgttcatggcattcaaggtgttcatattcatggaattgacattataggcgggagtaggcatcagattaacccccatgttcatgccacgctgaacagccagtgcgcgagggccagcctgcatggcaactgccgatgggctacggccatacagctgctgctggtgagcagccgcagagggcagtggcgcagacttggagcggatggaaatgtgccccttcactggcatttgcccttgcaatctctgcgtgtgaggaatgccaatgttggtggcagacatgttgcactgaagcagaggagatgtgaggttcatggtagtggatgccaagtttgggggtggcgtcatggtggcttgtgcttgaggagtcccagctaagggatgagatggagccagctgagccagtcctgtattggacagagaaacactggttgcataggaagtcacagcaggagaatggctataaggcatggcatgagggtccataatggtgttggtcagctgctgcagcttggctaggctgaaggtggctgatggttgagagtagctgccggcaccaaaatcccctggaatcctctcatagatacttatgttcccagtgcttccagattctggtatctccatgatcataggagctggggtgaaactgttattcatactacactgtgacagcgggggctgctgctggggagggggtgggggtggaggctgctggggctgaggctgcggctgctgttgcggctgctgctggggtggtggaggctgtggtgctggttgtggttgtggcggcggcggctgtggctgctgtggaggcggtggtggcggctgctgctgctggttactgggaggcctctccaccacgcagctctgaggtgacttgatgctgcagttggcagcaggctggacgctgctctgctgcatcatgctgcagctgctgcccatgctggccatctgctgagtgaccacacagctgctctgggtgaggctgctggaggacgacagcccaccgtaggagcagctgctctgggaagagctgttcccacagatgctgccgcccatcgtggagtcgtaactgcttgggttctcatagttttcagtggtgctctcaatgctgcccaggtcactgaagccgctgtccaccacctgctgagagtggtctgatacggaaggcacatccatcatggggctggtctccatgttctgcatagagggtgcggacagggatccttgttctgggctgatctgggtgtagccactctcaagggcaggcacgttgggactgctgaccgaacggactgactggctggggtgagactgaacggaggagatagggctattatgttctgacgcatgacagtcttcaaccatggacatctgagggtcctcgtcagcctgggtgtaactctgcagggtctgacacgccgcaagagtttcctcacagtcctggtaggcgccctcatgctcactgctttcttcttgagtcaaagactgcactgcctgtacagtttccagatccagctcactatgaggaatctcttcctcctcttttaattcgattaactcttccttagtgtgggagtcttcttcgtggtcgtcctcagacccagccatctgctctgacaccacggacgtgtcatgggaaggctgctcctcttcggaatccagctcggtttcctctttatcctttatcttttccctactcttctgcatattagcatctaaaaaagactcttgaacaccaggctcctccttgacatcttccctcgtgggctgttcctctagctcctttttctttgtggactccaggtggccatcatcctcatcatcagcgtcgtggtcgtcattctgggcagtctctgcagctgcatcttcctcctcctctggctctggctcctctaattcctgctgctcctcctctgactgcctctgctcctctgagacacggggcttctcttcttcctcctccacctcaggctccttggtttcggtctcaggactattgctgctgtctgctggagaggctgctgggacttcactgctggctgcatcctcttcctcaccctcttcagcctcttctgcctctgcttgcatctcctcctcctccttcctctcctcgggtaggggcatgtcttcttttggctcaacagtttcttcactctcctggatcttgggtttacgtccagctttaggaatggaaacgatgggctcaatgacgcatgcttgagtagaaactggcatgatttcccgactcaacttaaatcctggttttcgaccaggtcttttcttccagtggattggtttgcggctcttgcctttgggccatccctttttctttttcaaaggtgtggatgtatctggctcaagaggagaattcttcacatcacgttttcgcaaaagagatactggctttaagataggagtgtctatacaggaaggaaaaaaaacaaagacaggttacaaggtcttacattttctagttccttcttccaagactagcatatacaatagaaatgactttattaatcattacttttataaactcctgattgtcttcattttaaagttaagaacctagaggataaaactaattagtgacatattctaagtcacacagtgaattggcagaactatgaaagaatcctggtcaacattatgttatcagacactagtcagaaccaattcaagactaccatcatcagctgcatgtctgtgggaagttactctacatttcagtttcatcatctgtaaaatggagatgaactttataaagaggcaaataagtagtaagcagtacttttatcaagttgtctctactaaaagttacaaattagcttatttcctctttttttttctgcttgtgatttactttatctctcggattttcttactttccacaaatcatcacttcaggtagtatgatgagccaattactctaggccatgactgagccatcgtatgtgaacagttgttcaattaatgttgtgtttgtatgggaatagctgcaaagcatttatttagtcctagacaaaaactgacatttagacttagacaaacaagaaaaaattaaagcaccaattacattcattagaaataaattttatattattagcattttaaaaaaactatggtaaactatacgtaacataaaacttaaaattttaaccatttataagtgttaagttcagtggcattaagtacactcacattgcctattaatttttaaagaataagaataccaagacaagaacatgatgcagtgggggcacggctaaaaaggcacagttagtagtagtaacttgaaagtcaacaaaggaaatggctgcatcagcaaaaatctaagtccatgggaacttaatcaggggtactattttagtgtacaatgatctaagacagaatataaagtgctaaatttacaaaataaatttttagtttcctagttatgttatttcaaaacatagcaagttaaactctgtagaatcattcatgatagagcaaagaacacattcatcttatcactatattaaaagtatttgttggccaggcagggtggctcacacctgtaatcccagcactttgggagtccaaggcgggtggatcacttgaggtcaggagtttgagaccagcctggccaacatggtgaaaccccgtctctactaaaaatacaaaaattagccaggcatggtggcgtgcacctataatcccaactacttgggatgctgaggcacgagaatcgcttgaacccggaggtggaggttgcagtgagctgagactgtgccactgcactcccacctgggtgacagagggagactccatctcaaaaaaataaaaaataaaaaataaaaaagtatttgttatatagaaaatatgagaatggagaaaatgtaagtttatcttctagacttgaaactgactgaatttttaaaagaattaaaaagttcaaccagttaatgcataaaagctaaaggtttatgtaccaagactggacaagtagatttcttcaaatttgcccaacaaagtaaaaatgctcattctgagcccatgcgagataaacacactgcagatgcaggcagcatgagacactggcaaaactttaggctagggtgaaaaagacttgtttctgacctggctcatatatatgagacctagtttcagtgtctctagagaagaaatgacaactaggctgctttaaaagtaaatagttggatttgtatctatactataaaatttattttgagttattgttaccatttgtgagaaatttactactagttgggtaagacacattagagatacaattcaggaaagactcctgaacagatgtgacacaagttccaatttacatgaatctgctctttctggagaattgtcttcttagcattcactcatttaacactacttactgagcgccgggcttaagcactcagcatacagcaatgagcaaaacagactaagtctagagaatgcacattctagtgaagggttattacatcttcctgatgctaagtccaactctcccattaactaaagattctgataaaggcttagaaaggattgggcaaaaaagaacagttgcctaatagtaagatattttctgcagaggcaaattaatagaggttctgagttgaagggaaaacacatttaaaaatcaagatggatatacttgatacaactttttagagattgccaaacgttccttttcttgcttagtgggttgtgttcatttttcagcctttttactgaagggtctgtcactgctactgctatatatctgaagacaataaaccacagtaagtgagttctgtaaaacataccatcagcatcatctgactcttcatcttcttcttcatctttagacttcctcttagaagaggactgacacctgagtacatcctgcgaagacaaacgacggaagtattctctagggaaaagttcattttcatcctcttcctcctcttcttcatcgatctcaaacgtgggttctaatcttggcattggcctctcggagtcagaatcttcaaaaggttcatctaacacttcagtggtctcagaaatagtttctgtgactacactgctattgtggtgtttgcgctttcggactctcctccttcggtggagaaatggtttctgtttaatagagaaagcaagtatttacagttatgaacactatcttttctattaataatacgaaaacagttttaaaaccaaatagaattagcacatataaaatgaggatgttgtttgccaaaaaatattttgaatattatttcaaaatactatagtaagataatacacttattataaatacaaaggtattaggcaattgaacacaactttgtaaaagaataggcagccatctccaaatagcagacattataattctcttaatagttcagttaaatttagcaccctagagagttgccctgttttaatactgaactgacccagaggctaatcccttaacttttccaacttaagagcaaaagagaaataaaaacactttgtcttatagcactactgtgaaggtttgcagaactatcagtaaagttgtatgccattttcatgaactactcataaaaagctgtggaatgtagaaatatggggctgaaatgtatttactcagtgttagtgaaatatttcaaaagtaaaataaatctgttactgaaatttgggcacactgagcacaactttgcactggactgaccaaatagctaaaattatacaactaatatcacaaaataagagatgatgccccagagattatctaatccaatcccttcattctatagatgtcagagagggtataggacttgcttaagttcacacatccagtcaaagcatttattcattaacttcaaaattactttgcatgtgagcttactgcctgttctttttctttttttaacatgatttgttttacttcataaattggcaatacaagtgctaggatgacaaagatctattcttcatgatcatgcaatgaacagcagttagtcaatgttcaatttttctctacttcaaacttaatagtcccaatcgagaatgtaattttcaaattagattaaaaatggccctggtccttggagaaaaggctgattctaggacaagggcatgaaatatacaagatgaacttgaagcatcttgtagtgccagaaaggaaatgcttaaaaacaaacaaaaagaccccacaatgacaacaacagtatatatgttaaacacaggaggccaggcgcggtggctcacacctgtaatcccagcaccttggaggccaaggcaggtggaccgcccaagctcaggagttcaagaccagcctgagcaacatagcgaaaccctgtctctatcaaaagtacaaaaaattagccaggcgtgatggaacatgcctgtagtccaagttattcaagaggctgaggtgggagcgttgcttgcatcccaggaggtggaggttgcagtgagctgagatcatgccgctgcactccagcctaggtgacagagtaagaccccatctggggaaggaaaaaaaaaaaaaaaaaaaaaaagcagcagcagcccaagagggaaactaaaagaaggagcttctaatggtcaaaactggaacaatctgagcaacaaattttaaaaagcagtagtattggattataaagtgaagtatcacgtaaatatctgggccaataatgatataaataaatgcttggataaataaacagatgagggagaaaggacaaatctcccaagcagaaattcaaataatttatgctgagcctccactctgagggggtagaaatcttaagtgtggctatgcacagtgacttccttccagtaaagggaaaagaaaagtagaaacctgacaaacaatatcttaagccaggtcatcaaagttaacttcaatagggaaaaatcaaattgataatacccttatatttgatacttgcttctttttatttttacagacggagtcttgctatgtcacgcaggttggactacagtggctatttacaggtacaatcattgtgcactacagcctccagctcaagtgatcctcccgcctcagcctcccaagtagctaggattacaagagtgaccactatgcccagcttccctatacatactgatagatatatgccaacaggtaccctttaattatgtgatgagaatggcactttacctctatggtcttcctctcaagaatatattaccccattctaatatcatgagggatcatctacaaaatacctgaccagtcattctcaaaactatgaaggccatcgaaactaaggaaattctgagaaactaccacagccaagaggaacctaaagacacatgactactaaatgtaatgcgatatgctgggtgggatcctggaacagaaaaaggacgttagggaaaactatggaaatctgaataaagtatgaactctagttactgatgtatctacactggttcagtaactgtgatagatgtaccacaccaacgcaagggattaataatagaggaaactggctggggtatgcgagaactctctgtactttctttgcattaattctgtaaatgtaaaactgctctgaagatattattcttaaaacaaaacaaaacaaaacaaaagatcctgtcttgctttttaagaccctgtaaggaaaggaacgattgtgctgctttggctggaagctggctgagtggctcttccagggagcagcctcgcttcagtctggctgcctcctggcaatgcttaaaatccactccatagcctgggatgtttctggtaaacggcttaacagaattcattatcatcattgtacattatttaataactaattggctatcattatgatggaatatagtttagaaaatatttttaaagcaagagagaccacgttaaaccactggagggatgtgtgagaagtggggagagtagagagaaaacaatagcacccaagatgagctactgtactctgagtaccccaaaatatagggcagcactatgttcactttccaattaattatgtaatattttggcctccttttctaatataaacacttctaatctgtacatactttaaaaatatcttttaaagatattttagggctttaagcccctaaaagtcatgatttgaacatcaaaccagtaagctaaaaaaaagtttgtttgcatcccaggaggtgaagcccttaaataagcttatgatttctaagtgaattcccatgaatcaaagaagtcaaacacacacacacatctcaaatgttcactgggaagatcttgagctacaatatacagaggcttaaggtttataaagcaatgcactaggaatttctaacttatactctttcagaactgtaagctaaaacgagaaggtgtaagataaactggaattggaggaagagaagacctggaaagaaatgcgttacctttcgcttcagcgtgggctttgtgagaattggtggcgagcttgaccgagggctttccggctcctcctcctcctcgctgctctcactgaagcccctgaggacagccctgtcaccctcactgtagcgacggggcagcctctcacttccttctgttaatctgcacttcagagcctcagggcttttcttgagctgtcctcgccagggctcaaccccctcactgagtcttctcttgggaaggtcaggtttcccgtcctggcttggctgctcctcagaagccaccagctgttcttcactttcagtgtattgttcctgggtggcttctgatttctccccacattctccatattgttcctgaggagctgaagacgtctcttccaagagcagtttagaatctttatcaccaaaacgttcctgggtttttctgttcttcctcccccagcggcccctccgagatggctggctatttgcaggaagactatcatgaggaaggacttgtttgctcaaacgtgtagaactgactggagccataacttctggtttcttttcactttctactgaataagaatcttgttctttgttctcatgagacacagactttcccacctgattttagaaaataaaacaatgctggttaatttttcagtcttgtttgcttacatttacctattctgaccttttaagtattgagagaagaaaaggaaactgagctttaaaaagaaaatgatcagttatttaacatggatatttcctgtttcagcactgctttaaattctgtatatgcattatttatttaatctccccaacaatcatatgaagtattaccactacaactccactttacaaatgaggcatgtggggtagaaaaaaatttaagtaatctgccccaggtcacgcaagagcaagagaagatgctgggatagaaagcctggcagtctgactccagagcctatgttctgaatctttctgcagtaccaccctcaataagcaaagtgaatactattgttcttttaaatgttaaatgagattgtttaataaaatttctcagaaataaaaatttgtaaacagggtggaggagacaggatcttgagacatgggcaagaggaaggaggcatttgagaaatatgaaagaaagtttatgtagtttttaaatttacttttattctgaataatttcattttgaaaaattaaactgcactaaagagaggcatgggattttttatgtttattaaaggaggataccggtgttgaaaggatgaagcactgcttaaaaaaaagagctataaaagtatgcatcacatgaagaaaaatactgacaatgacacatgcactacagttcaccagcaaccctttaacggctaaagagatctgtgtgtccacaggatgttttggtgccccatcagaaaacatacacaagtttacaatagttacttaatattctatttaaggaaaatgtatctccatttcattttgttgttgggttttttttgtagagatggggtctcactatatttccctggttgtcctgaactcctaatctcaagcaatcctcccgcctgggcctcctaaagcgctgagattacaggcatgaaacaccacacccaacctccatttcatttttaaaaactgtcagatttggattcaattcagatttctcaactactatccagcttaaaactgagctgcttcttggcaccctggtaacaaatatttttctcacaagtaacacattataagaaatttgatggtctcctcctaattgtccaaggcttaaaaatacttaagtaaaccaggtccagtcttcttgaaatctctaccactgaaataaaactcttgacattctaatgtgaatttacttttctgtgaaagatgatcataatacattattataaatactcatgaaatcaaaaatatatcttctgtcatcaaaaatagagactattcatgcccttacactgatctctaattctctttcctggcactgtggctcttcgttttctccttcctcagcctcctcttcttcctcctctgagaccacagagttggacactatgactggagtccagcgcaaacattctggatctacatctacaggtcgcaaattcagctgaagctttgccatgtgatcctggataagtttttcccggcggataatcacaaatctggaaccagagaaaagtttatagcaatcaacaatgtacaaggtgtacataaaaatgaatgtggagatgagacccctggtgaagcatgtaagatgataggtgctgcaaagatagcctgcctgggacgatggaatgcagaaatgtgccaccacatgagacggccaggagtgtgaagcaggacaaatgcttcgctctctaccgtggccgcgggctgttttcactgcctgctgtctcacacgtcccgctccagaagttctgctgctcttctgcactctctttcctattctccatttatttggctcaaatgcctcctttctttgtgacctttttctgaccactttagtgaagggtgaactgtctgttcttcctttcaatctatatttactttgtgccatttatatgaaaatttaacatgggcattttatttaatgactgtttctagagtggttacttcttgtattgtgaaagagctcccaatactagaagatgaaagattcagtagcttaggtccaaaaattaggggtatcagaaaaacaattcagtttaaaaagcatatatatagactatatatagaccatatatatagtcaatcaaataaaatatcctagaaaggaaaatgatatctcattatcaccaagtatatcatttatattagttaatgccctttcatcaataatctgactggctgatccaaaaaacttcaacctaattatctttcaaaggtatacaaaaagatgtgatactcactggtcactacggaagtccagcattcgtaggtggtggagtgtggaagtgatgtcttgagggcagattccagtcaacttgcttaacttcttaatgctgatctgcttgtcattttggtgataaaggcactccaatattacacttttccaatatgccatgtaggaaagacgacccagatcagataacggtttctctggagaccctgcttggccttcacgctttgataacaaataacctaaagaatcacaaataactcaaatcagaactaggtcagcaactctgaaaaactggattcaccaaaataacaatcccctcttctacaaccaagaataactccaaaggtaaattccttccaaaaaaaaaaagagagaaacaaattgcaaaactacttcaaaacaaatctgcagaaagaatacataatttatatatattgaagactaagttagtattattatgtctacagttaatatcaatcaccttgttaaaatattcgaagtgttaaaaatcaggactgttaacagtttcgttcaacgtcctggggaaaacaagccttgcatgctttatttggaccactagatggcaactgctgtatctgaactgagaagtacaaaagaatgccttcattttcacataatcctattaaaattgtagttctgtcagtgaattagatgacaatctttcacttcaaccaaaactcctcacaattacctatcattctaactctaggcaagcaggactgccaatataagtgtggaactgtggactctgtcctctatagtgcacaactctcaagaactgaaaaacaaaggcctaacttctaaggaaaagcaacgaaaatggagatggcagagaaaggtatttttactgtcattaaagaaaacataaaagcagtctaagaatgttaatttggaaacgtattacattaggaaaagtaaatacaaacaatactgttattgcacggactgtttgtataccatacacacacacccccaatcaccaaaagtaaaatattttccctaactttgcaatttaatggcatatataacatgtctaatcatgagtcctatttcaaaacaatatattaacattaaaggaagtaatctgagttccatcccctactgctcatctaaaaagaccagaaaatgtgtaaaacaaccagtagcacaagcttccaataaaatatggacagaaggacagtctaaagctaagagaaggcttaattaacatctcaagactagaatcaaaatcctttgtttgaaccattagttctgcatatattcatctaaatatcattgtatagcaatatctgaggtaaaatattccctcaaattacacagatcccacaatgatctctttagaactgtgagctatcacttttgaactcagattaaacaattttctctatcattcacttcttcagatatttaaagatgtgttgcagatgtttaaccactaggtagagcctaactaaaaaaaatgcacacattttctcagataactggataacaaaaatacggcaggtatagtacttttttttttttttttgagatggagttttgctcgtcacccaggctagagtgcagtggcgtgatcttggctcactgaaacctccacctcccgggttcaagcaattcttctgcctcagcctcccaagtagctgggattacaggcgcccaccaccacacccagctaattttttgtatttttagtagagacgaggtttcaccatgttgggcaggctggtctcaaactcccgacctcatgatctgcccactttggcctcccaaagtgttgggattacaggagtgagccaccacacccggcccacagtacttccttattagctctaattgaagtagttatacaatgtttttagtattattagtattactgcatgaaactgagttccattgtaaatgaacaataggaaattaaaggtatgtgctacacatcacacaaaattttattcaatattagctgtttaaaaatatttcgtgtccaaggccacgcatggtggctcacgcctgtaatcccagtactttgggaggccaaggcgggtggatcacgaggtcaggagatcgagaccatcctggctaacacggtaaaaccccgtctctagtaaaaatacaaaaaaattagccgggttgtggtggctggtgcctgtagtcccagctactcgggaggctgaggcagaagaatagcctgaacccaggaggcagagcttgcagtgagccgagatcacgccactgcactccagcctgggtgacagagcgagactctgtctctcaaaaaaaaaaaaaaaaattcgtgtccaaccaaaataaaaggaacgtgtggctttaggttttatttatttccatttttattttgagacagagtcttgctctgtggcccaggctagggcctgcaatgcaggggtagcattgctcactgcagcttcaacctcctgggcactcaagtgatcctctcacctctgcttcctgagtaggtggaaccctaggtacatgccatcatgcccacctaactttttaaattttttgtagagacagggtcttgccatgttgcctaagctggtcttgaactactgggctcaagcaatcctcccaccccagtttcccaaagtgctgggattagaggtatgagccacagtgtccagcagtggctttaggttttaaagaatcatatagctatatgacaaaagatactagcagccaacaaagcacctacaaatctttaaatatatatatatacacacacacacacacacacacacacacacacacacacacacacacacagagaaggtccactggaaaagaccaatgagaaattaatataatccttactgaaatcgatgagaaacctgccatagcccttacgctggtattgaggaagaatcattatacaggaaacattgtacttctgttggcagtgcttttcctggtggagaaaacacaagtcaagtttgaaaacaggctggtaaaagtgaataataacgtgaattaagaaacaaagactaatggccaaaacccacagccctggtcctttgggaatagcaacgtacatcaacaaacaactacccagctgggagaagataggataatgtcaagtcactgccattacccacaaagcaaccatcccaggagagtaaaaatatataacaaaacaatgccatccaacaccatctgcaactcaaacacagtacgccaatgcctaaggatcagcaccggaatctgagtcccaaacaatccgtaaagctacaaatgatgaatcagtgtgccactctagaagtgagaagactcattaattatgtcagagttttctttctctcctgctctggtgctcctcagagcagtcctattagttgtatctaactttacacaaaatagtcacttttataattttataaatgagtgaatatattttaagtcacatctaactaatgaagtagcctaaagaattcttataaatgcttataaaaagctagtacttcccctaactgttttatacacttggattttaccacaggcttgcttaaataaaagtatatcttttatgttctctgactagaaataaactttctccctctaagggaatggaagattaaaaaaggagaaaatatcctttaaccaaaatgccttcttactcttatttctatgcctaaagttcaaataaggaagagaagattgaagctgagacagaactcagagagctaatgactgtttatttcagaagttccatgttattaccatgggaagagaagccatttaaaaccttccccgtgagtattgccagcagtccataatcctaggagaatataggttgttgaatgttactaagcaccttctagcacctggtaagtttccaaatgttccttctattctttccaaacagctagatgacacctaggaggtgctgcatcttgttgtgtccccgagtgagaaccagcaaagattctttcagatttctatatgagttcaaacaaactttaagctgacatacttaccttagaaaagtagccaacaaggtggcagcccttgacatcattctgtgttagtacataaaaaagaaatggctccacatcgtaatagagggttttgtggtcaagaaacaactttgccaaaagacacaggttttgacaataaatggtactcacattcccatcaacctagagaaataaacagaacaaaacagtcagtagagggtctctttagttctagaataatatgtatcagttaaaagcatctctagatatccacagtccagactaggagaaggtgtccatgaccagaacactttggaacctggaagccatcctttgaaatggcagtattatgctatctgctgttttaagacaaccaaatatataaaacctcataccttcaacatagcaggaacagccagataaggaagtgataatctggttttaaaagagcaatttttgctttaataaaaagatgaattgtagcaatcctttagatagcaagtttcgttttcaaagtacttaacacaacaaaagatctaaatacaacccttctaaaatacatttattaggtaaaagaagatgtaactatgtagtctaatctatgccagctgcctgaagcaatgcaatctgactaccatgatcgggcttgaacccagataaaactacttaagggggtactaactattgccacgcagaagcaccaagcgggttcctcaagcaatcatgtggtaaatgaggctccaggttggccaggcccaggagcactctgctgctcttttgctcctggcagccttgtctgtgttcatggagttgccagagctttctatcaaaacgccaatggatgcccacattagctcccaagacactgtctgcgatactaacagaactcctcaacaacccaggtagtttaatattctcttcaaacagtatataccacacctaccccagcttctcccaaggtaaagaactcctctactgatcacttaaaagagtcttagggaggaccaagaaaagtgagagactgaggggatcctgacaatctgaaattttactgttacagtaagtaaacggcacataagcaagtactcaattaatacttggcacgaaaaccacagaactgaggatcaagagcgctactaacagcaatagagaatcacagagcagaggtcacacatcatcatcatcatcatcatcatcatcaagatttactattaaacagatctctgtgagatattccttttaaataagtgatagaaatcctttcatttaaatgccatatttcatagattctaagatgtacttttatcacatcttaatatatgcaaaatcaactggcattttataatcaaatgaagttttaaaaattataattagtactttttccattttagtgatacataaaatagacaatagaaagttgcacaatagatgcaatataggtggccctacttatgaaatggatgagaggacaattactaagtatctaccttacctcaaagacagaaatattattctttctgtaaatctcattggcaggaggatggaaccaaccacatttcttcatgtgctgctgcagaatagttctacttttcatatattttagacaaaattcacaaagatacaatttgggcagcctgtaaacgataattaaacaaaaaagacagggctttatattttagagtacttcaaacttccacaattatcatctttttgcctctcattactacccaggtaacaggttaaaaaaaaaactgcatatgcaaaaatactggacggtaaaatgacaaaatatataattcaaataaattactgtatcttgtctcatatttaagtactgagatgaaaaaattaatttagttgctatcaatttggatagttatgcttaaaatactatcctagaattaaagaaaataatatttgctaagtagattaacacacacaaaaatgtttgatttgtgtgaagaccataaccattttttcaagttcccattttgaaagcagcttttgaaatataatttatctgagaacatctaaaattctactaaagcttttcccaaggtatatttatggaacacaaatcctgcaggtactaaggatttcgtgctcaaataagggcaagagggcacacgctttttcccaactttcctgggggactcacaatgtgcattaattcttcccatataacctcacatcttattttttaaactgtcattcaattcagcacactgaaagtttccaaggaacttttgtagtatactattactaaacatctatggtatacaatattgtttttcaaaatctctcatgttagccacaccaatacaacttgtaattatattattagtacaacccttccaaaatcaagcactaagtgaaacaaataatgactggcactataaattagagtcaagaagcaggagctaagagcatggaaagcagtgtgttgttggctactttgtttccactgcattctgcctcaagccccactattcaagaggaaccactagataaagaggtttttccttcttcaccaccacagctacaaatcacagaatgaaatggcttgttataaacttcatcatctaatatgagcactaaatgtattaactaagccttacaggtgacctacaactgccagaccaccttcctgaatacctggattctgagtaatttcttcttcaaaggaagaggaagaatgagtctccttatgtagatacaacgggtggcacctccctccctaactgttttacttacctcttacatgtgctaaattctcagtgagcaatcttaacttgtcacagcatgaagatacagaagtaacactatctgagtacagtttcattttgagagctaaatattacaactaaatacttcctataatacgaatcagagaaacctaaaaaattttgtgctttttaaagtatttttgtaaaaatgatagagtaaaaaacagtgacagaccatgaagctttccaaattatggtaaagataaatgccaactttaagggcatccaatccaactgttaggtctcagcacagagacatgaaaataaagtaccatttatgttagctagatttagtcatatttcataatgtgtatatttcaaaacatcatgttgtacatgataaatatatacaattttatctgtcaattaaaaaatcgaaaatattcaataaatgctaattacttttctggaaacagaagggagaggggagagaggaagggagggaggaagggaggaaaataaactacaatttatttcctaagatctgtgagagaaggccaaaaatgtttaaagctcttacagtaaccaaattgctcaagaaaacatcaggagaaataaaatctctgagaaaattactatcaagtcttctccagtaaatgaagagttcatgccacttccttagaatggcaagatgtatggcattttattgatgattaaaaaaaaaaaaacaaaactttagtgaaccttattatgtgaaaaatagtaaactgaaaacaagcattatgatctactttattccaatctagttctcactgaaaacattttaaaagctccttactttattagaaccaagcccactgggatgatactgctaatctaaagggaatcatctagaaaaaaaactactggaaaaccaaaatatttctagaaatattataaacaactgctgttctctcacagaaaaaaaagatctatcatatagaaagaacatgagactacaggaaatgaaatgtagttataaagattatgaatactcctagccctagagaatcttgttgggggctgcttttagtgatcttcctggcaggacctaggtctcagctatcaaacaggtagctgtacggtggctttgatcaactgcacatgaagtgtcacctccacactggaagttgattctaaagtctgccacaatgctgataacccagcccatggaatcagggctgtgctgcagctgggcatgcttctctaacttctagaatgatgcaattattattctcaggaatttctacagtaccttctggcttctgaacatggcccaacatagtagcagtttgtgcagtcaacttgtagcaaatttttaatgtaacaataaaaattataccaaatattacttaaatctaagattatggtacaagtcaagtgagatcaacctagatacacatgctacatggagcagcgtaggcccagtgattaatggttatggctatgcagtaagagagaagtgagcttcaagttctgccacttatacactgtactgtctgggaccaggtctgcaaaatgaatacagtaatattcatctcacagaattacaccagagatgcttagtccagtaccaagctcaatggatggtaattacagctgctattacttaacgattattatttgtattcttcttccatcaattttactcaataatttaatagccaaaggcattagggattctatttggtttcttcttcagtaactgggatgacgagaataatcaaactggttctagtgacaatctcataatctaagcatcaaataaagtccagaggagaatcaaaaggcagaggaatcttcctaggctactctatcacctaggaatctacctctttaggatctcaaagctaagctcaaagcagcacaggagcagagggcatccaatgatcataatttcttttgccttaagcccatctatgtcatgctcttaatggcagagtaggtttcgcaatgaacctactgataaaccaaatgaaacagtattattgcttcattgtttttgatttttaaagacagggatacaagattacttaataggcaatgcatacacaaatatctggatatgaaagaacattccgtaaagtataatcccacttcccaaaagacgtttttcttgtgatctttgcatttttgtttgctcctattgccctgtttttgtacgttacagtgtttgaaacctttaataagaaaataatttataagcagtttagcacgaaataataaataggcattaacaaaattaagaatagaggtttattatttggaaaatgtaagatctccaaacattttagtcacctcaagtttcaagctcatttaagtaaatataatttttttaaaaaatgtaaccaagagaactacgaatataaagatagaaaaaaagtcataattactcaagaacctattaaaaattacaggatattttctaattgaaaactcaaagaaccctatccaatggatgaaaaaatatacagaaaatgtctaaaactgcttaaggaagttgatgaattttacaagttcctatcctgtttctgctttctactggttcctattatactttttttggttattttttgatggcattatttattctttcactgataactagtctcctcacacctgtttctaatgaaaatctcatcagaacaaaagctacattttcaataaatcctttaaatatctatcttaaaagaaaacagtttatgattccattctcatcattctcttgaacaaaagtaaatgctagccctctatttccattcctgaatctatttcctctccccaccttgagtagacaaggggcctgtggtttccatctatctgtactatagtctccggaacagttgacagacatgtggaaaagctttcttttctaagttgagtgctcttgtgatttgggcagcttgcaaagagctcacttaaaaaatgatcataacaacttattttaaacctgatgaaaaaattaattccttggcatatttattttcttttcttttgagatggagtttcgctcctgttgcccaggcgagagtgcaatggcgcgatctcagttcactgcaacctccgcctcccaggttcaagcgattctcctacctcagcctcctgagtagctgggattacaggcacccaccaccacgcctggctaatttttatatttttagtagagacagggtttcgccatgttggccaggctggtcttgaactcctgacctcaggcgatctgcctatctcggcctcccaaagtgctgggattacaggcgtgtccttggcgtatttcttctcggtcataaaagatcttggctattcagaattcctgaggaatgagttaacttgaacgctgagttctgtaggtagttgaggaagttcctgccttcctttaacatatatacatatacaatacatacatgtataatatatatgtataatatggaaatgcaaatacaatgtaaccttatcttaaagtcacattaattgttgtcagctcatgaaacagtgtgcttccttaaagatacaccacagtgtttggggctaactgatcccacagtaaatggccctcaattgctgtgtttcatgagcttgtgtgttagtttcctggggttttgctttttcttctgtttttgttagctgtcactttgaggtcagtgtctgaaatggcattcttacccctatttttctacttcgactgtagactagagaagcaagttattatatggaaagaaaaagtaaaaagataaataagttttactggatggcccttttaacaactatactggcctattcctagtttcttggcaacaacccatgttaaggcactcaacatattgtaaggtactaaataaattttgctaatattttggccaggcaatgttactacatgggtgaaaacttacatgatgagaatattctgaacatgtatttaacccacaaagcaccatgatgtattatttcttgtaacaccctactaaatgggaaactgaggcataagtagtttatagattagagagcattaatgtcactacaattaactagtatttaattttttgatctcatttcatcttttaattttaaccataaagaaaaaatataataactgacattattgagcacttaccattttctaagtgatttacatgttgtagctcatttaatgtcctcaatatccccacgaagtaagtactattactatctctgctttacagatgaggaaactgaggcacagagcagttgggcagcttttaaggttacacaacttaccaatttcagagctgagtcatgaaaccactttagctccaccaagctggtgagtgatcaatgtttattaatatatctggaagcccaaactatttatatataatttttacaccaattgtccaattatttctgggaaaacaaaccatttattaagtttgtcaaattataaatatttatttacatcaaagactaatcaactgaaactttatattaatttatatatgagttcttctctttttcaaaattcttagtgataggagtgaagacaaatttctcttaaaaaaaaaataaaaaagcattccccttttattgtgaccatgcattcgggtttctcattttaaacatcagcgtctgagaggttacagaagagaacatctaaagcaaactgggatgaagtggctgccaaagccgctgctattatggacatttaaaagcccccagtttcctcaaatgtaaaggataaggtggactcaaacatcttcaagatcccttccagttccagacttctatggatctcaaaacagaaggtcaagggtctctcaaaacataccttgagtattcttgaggatatggggaggagtaccaggtgtgaatttcatacttcccaaactcaatgacagagggacagcggacttgtggatcagggggaccagtcactccaactttctgtgcagtcaagaaatacattcaaaagttagctaaattagacacactgagataacaaagaaagttctgaatctaaatgttgtcttctcaggactccaaaggagtaaaacaaaaacaaaagccagaacaagctaacatattttgaaataagttatattattccttaaacagagcacccagatgaaaaataaaaatgctaataaatctcttagaaccaaatgcattgggtgttgctgcatttctacatttaataacagtaaaaatattttcctcaattaaactcactcttaatgacttaatattaaagagaaactgctgatacttggtgatataagataaagaataatttacaagtgagggagggggacactgcatatttgctgaagtcctaccacactgcctccgctgacaacaatggagatgccctactgaatatgtaagcacacaaaggatgattttttagtttgggaaagtagatatttaagagaaatacaaaaagaatctgacaaaacaagtatcaagagagtcttcatttcatactatgcctaaaattcccttcattagtagctctgcatagatttaaccaaagaaagacactctgttatatacagaccttctcttttttctgccttctctttacaatgaaaacaatctctatacccctcatccctgcaatagtctgaactacattatctaaacagagaataatttttaaagcctttatgacttccctgactttccagatcagaaattcaaacataagtacgtagctcaagaaaataaaggctgttaagggtcttaacatgttaactcaagggcaacatgacttgctctgcacccagtctagcaacagatgcatatacacactcatgtccatgtgtgtgagtgcagatatatcatggatgctctacaaatactaactgacaagaaaaagacaaaagagtttagcctaaccaaaaacaagcattaataactcttccccaaaaggataactgaaattatccttcaattttatgctttaaagaccactaagagactagtaaaaatcccttgttggagcatgcagacacacatacatattttataacaaaactaaaagaaatttttattcattggttttatataaatccgtttaaagaagcctcttcaccataactcattagagaccttctggtctttctaaccattctcttttataaaaggccaagggacttatctcaggtttcatactggaatgtagccaaatgaaacctcaagctcttccttagacacctcaaaacaaaagacaaagatctgtttgtgggatgaattgtgttataacaccaccaagtactggggctcctccaaatacaaaaccaaaaacaatgaagaatacataatacagggttaaaataagatttctttcatttctcaaaacccaaacagaactttgtaaaaagattttttaaaggctgtttttaaactacattctagaatcaactactctaactcataaagtactatcttttcatctatcttcacaactcaaagtaataacaacagtataggaaactttcaaaataactaaataccagaaaccagatctaacttcctgaggcaaggatcagatagaaagcccaaaagctgaagtcatgcacctgctgcggcactgtctgttgtttgagggtcttcccatcagctgcccgctgctcttctaggcggatgcccgatgtgaaagtggatatccagttccagtacagctgtttgcacatcaccacaactgcgcacgtctgtccagaatgggacctgtggtaggttcccctctgcccacacccgcctttaacctttgcaccgtgaaacgttcctgcacatgcgctcatgtgtgagcccgcctccactcccagctcccctgagcaagcctccacagcaagggtgtttccttttacgaagatttagaaatcagcaaggctctctacacagggaggaagaaatggctacacagaaaccactcattccagtcctagccaaaatcaaactgtcatatctgaactacaaggttacctttgctaggtctttttattttaacatttcaaccaaagtacgttttcgctaaacatgtgactttccaaagcagcaggtgtctaatataatcaagggcacaaaatatatttaaatgtttaactcaaattctgccacttcatgtcctcctaatttaaatatgccaaattatttaaaagaagacgtatgttccaggctagaattgaccttttaatctaagataactaacagggggtagcaagggggtggattaaatacactaataattgggctaaaccaaaagaaaactttatgcctactgctagataataaagcttttattaccaccagtttatatgaaaagagtattactcttctacaaaaacttaagcttcaattaaatgactcatctaattccagtttgtaacataaaaaaggccattcttgcagtatccccaactctggatctggtagggacaccaaaattgtgtaaataatttaacaatttctgtaaacacagagctgctgccttcccccatctgtccactggagcgctctcacttgcccttccctctccattccccaagggggtgcaatgttttgaggagagagggaggtacccctttattatcagtgtgaggctgggaatgtggggagaagagatggctttctggcatttgaacattttcccacagaaacactacagtaagtaattccattcattagggattaaaagttacatgatgaaagaggtatgaaagaatgaattcacatgctccacaacagagagagcatgaatttaaggactagagaaaatcatgttcgtggagcacctattgtgctagactctgacctgagccttatgtcgttacctcctttggtccccacaatccatccttcaaagtagaaaacaatatacccactctgcagatgaaaaaataagcctcagataagcctcaggttaagaggcaaaagcaccgggcaggaacagcgagtgaagcataaagacagaaaagaatgacatgggttgagatgtgacggaagtaacgacagccctcaactaattcctccctaaattcccaaagtttatgggtaagtttttaaaaacgggaacttggttttccaaagaaatgaagctacaagtccacaaacttttaacccaaaacccttggactggagtagaatgtgttttggaattctgaatttttctgattttagaaaagtattagtacatatatgtgtatagtacatgcatgtgtatagccctagtaggatttggagcagcactccataatcagacacactaaaatttctttagcaaagcatatgaatattcacattaactggcataagtaaggaatacaaatagtctcacatcagctcagatcatgtttttgtcagtaactcagttcaggtcaagtgggactttattgcaaaatgagttagaaaaggccgggcgtggtggctcacgcctgtaatcccagcactctgggaggctgaggtgggcggatcacgaggtcaggagatcgagaccatcctggctaacaaggtgaaaccccatctctactaaaaatacaaaaaattagctgaggagcttggtggcgggcacctgtagtcccagctactcagaggctgaggcaggagaatggggtgaacccaggaggcagagcttgcaatgagcccagatcgcgccactgcactccagcctgggtgacagagccagactgtctcgaaaaaaaaaaaaaaaaaaaaagttggaaaagtttctttccattctccaaagaagatatacagatggccaataagctcatgaaaagatgctcaacatcactaataattaggaaaatgtaaatcaaaccacaatcagatactacttcacacccattaggatggttattatttttaaatgcaaaacaccagaaaataacagatgttggtgaagatgtggaaaaatcagaacccttgtcccattgctggcgggaatacaaaatggcacagctgctgtggaaaacagtatgatggttcctcaaaaaagtaaacagaattaccacataatctagcaattccactgctgattatagaccccacagaactgaaagcagttctttgtatatgggtatctatttgcatactcatgttcatagcagcactatttacaacccaagtatccactgacagatgaatggataaaccaaatgtggtacatacgtacaatggaatattctccagccttaaaaaggaaggcaatggttgggcgctggtggctcacgcctgtaatcccagcactctgggaggccaaggtgggcagatcatgaggtcaagagattgagaccatcctggccaacgtggtgaaaccccgtctctactaaaaatacaataattagctgggtgtatggcacatgcctgtagtcccagctactcgggaggctgaggcagaagaaacacttgaacccgggaggcagaggttgcagtgagccaagatcgcgcaactgcactccagcctgggcaacagtgcaagactctgtctttaaagaaaaaaaaaaaaaatacaaggaaggcaattctgacacaggctaaaatacatatgaaccttggggacattatgctaagtgaaacagccagacacaaaaggacaaatattgtataattctacttatggtacctagagtagacaaattaataaaggcagaagacagaatgatgcttaccaggggtgggggtaggggtggggggttgggagttgtttaatgggtacagagttccagttttgcaagataaaaaagttctggaaatagatgatggtgatgattgcacaacaaggtgaatgtctttaatgccactgaattgtacacttaaaaatggtctggttaggccgggcgcagtggctcatgcctgtaatcccagcactttgggaggccaaggccggcggatcacgatcgagaccatcctggctagcaaggtgaaaccccgtctctactaaaaatacaaagaatggcgagaacccgggaggcggagcttgcagtgagccaagatgacgccgctgtactccagcctgggtgacagagtaagactccgtctcaaaaaaaaaaaaaaaaaaaagtctggttaaaataacttttacattatgtatattttaccacaattattttttttcaaattttcaggactccttaaatttcaggattctggatattgtgacctatctttcccttttcctaagcctttttgctctacactcagacttctctttatccatctcctttgctaattcttttaccattaaatattgacaaaatctagaattctgtcctcggccatcttaccttttccatccggaggacccataatccagtgcttccatcagctttccactctccccacaccctcctttctctctacgcagcttagattctaaggtctttttccctgtaattccaccctttgcatagacctttaactctctagtttctcttctaatttcacaacaaaatcctaacccctgttaaattcaactcttcacataatcgaagttattaccttaatgtgaatatgggtggagaaaaacagagaatcatgctacccagtctcacattatacacctacccacaaacctcaagcaggtcctgatgcttcctactccattcactctcccgttctgaaagacaactgcaccctttctcctctgctcaagcctccaacactgcttactccaccttcactttcagccaatgcttttgcttcctactgcactaaactggacaaaatcaaaagaaaacttctgcaatttttcccacccacatctgtctgcctccacctttgtgccacacatcctgcctttcaccaatactatggctaaagattgagctcctaagcccacggcttccgtttgtgcatgagataacatcttcctgctccctagccaaagaacatcacccagcagttcccctcctatcttctgcatcatcagctttccctctaccagagcattccatcagcatacaaacagctgttattcattccatattttaaaaagggggagaggggtgtgtgggcatggtggctcacccctgtaatcctaacactttgggaggccaaggtgggcgggtcacaaggtcaagagatcgagaccatcctggccaacatggtgaaaccctgtccctactaaaaatagaaaaattagttgggagtggtggcgcacacctgtagtaccagctactcgggaggctgaggcaggagaatcccttgaacccgggacgtggcggttgcaatgagccgagatggtgccactgcactccagcctggtgacagagcgagactccatctcaaaaaaaaaaaaaaaaaaaaaagtatcttctttagccctcacagctctatccaactctccctttctctgctcctaattactgtaaaaaacctcaaaacaatggccacatattactactataaccaatttctccttccattctttcttgaaaccactccaattatctcttcaccctcccctgtccccatcatggaaacagtttctcaagattacttccttgttgctaagctggacagtcaattttcagttctcttcttacttggcctatttgcagaatttaaaaactgatccttccttcttacaacacattcttcacttagcttctaaggaactacaccttcatgttttttttcctacttcactggccattccttctcagtttctccaatctctaaaagttggaataacctagactcaaagttcttctcttctcccttggtgatctcatctagtctcatttttcaaaaaaacaacctacttgctggtgagtcctgaattgaaaatttcagcccagacctgttctttgaactccagagacacatatcccactatctacttgatatcccctctcacatcaggtttaacacatccaaaatcaaactcctaaatcttttccccaaatgtgctcttcctatttccccatctcagtagatggcaactccgtcttccaactgtgttctggcatcgtctcggactccctgctttcacaatgcatcaacatatcccaatgggtctaccttcaaaacatactcagaattccaattccaccactaccaccatgatccaaacaccatgtctcttacttcaataatttcaagagtttcccaaagttctccctgcttgtatactgccccccgccccctcaatctacacaggagccagagaaatcctgttaaaaccaaagtcattcttctgctcaaaaccctcccagggttcccatctcattcagagtaaaagtcaaagtccttacaatggccaagaagaccctacaaaagccagccttccattacccttctgtccttgtcatctgctattttgagccttatgtatttggctctagtcacactggcctccttgtacttccttgatcatgccaagcacaaattgtgactcgggtctttgcatttcctgttcctatgcctggaatgctattcccccgttacctacatgtttcatcccctcacctccttcaagtttttgctaaatgtcagagagacagtccccacctgaccaatttaatactgcatacattaatcctctccctctgaattctccctcttcctcccctgctttttctccataacactaccacatggcataccatttattttaacccattccaacccaaactaaactgtaagctcccaagaggaagacattttttatttaatgttttgttcactgctaaatctctagtgcttggaacatggtagccagtatttagtaatatttattattagataaatattatctttgataaaaattttaaacaatcacatgtgctggtaacacagcaaatctcccacccaaggtctcctgtatatacatgtacacaaccatctaccaaagttctccactttagatttcacacaatcccacaactgtgtaagcatggtctcttcttccatctaaataagcttcttttcctatattcctacatgtaataccatcatctactccaaatagaacactagaagacctacttggttctgccctctccttcaatcctaactcccaatccaacagcagtcttttccattctatcttaagtctttctcaaaacgattatctatctctgtctcctatctatctcttctaccttcatttaggccccagtcacttttcattttgactactgtaatcatctgactggtcccttgctcaggtgttcctcaatccattgctgacaatatcaccagacttgagtttctaaaatacaaatatgatgtcatccactttttagaaattctttagcagttcctcaagagctatttagctactacttaactactttaaagagctactttacctgcaagattaagtacaaactccttaatatgaaacacaaaatcttcatgatctagtacccctccaatatcatctcttgtttgaactccaaccaactgcacacagctccgagaatacacgatttctcacacccaaacttgctactagaaatgccttctcactcttctccaatagtaaacttactcatcccttcagcaccctacacaaatgtcacctcctctacaaagacttaaaattttagttaaccacaataactaaaaatagaacaataacatccctagatgtcttcctgttcattctcactgcaatttatgcatatctccacagtaatactatatcataaattaagcagttaaggccatggagtcagaataccagggttcaaatattgactctgaaacttaacaatttataactctaggtaaaacaatccttctaatgtttccatttcttcatttgtaagatgaggccaagtaattaataataaagttgtattaaatgaaacaaattaatatataatgctgaatatagtattttacatataataagagggtatctattactaaccacatggctttaattacttgtttattcaatagtcccccttatccacccactgggaatacacctttccaaaacctacagtgaatacctgaaaactgcagatagtattaaatgttatacaagttgagtatccctaatctgaaaatctgaaacctgaaatgctccaaaatctgaaacgttttgagcactaatgatactcaaacgaaatgctcgtaagaacactgcagattttgaattcaggatgctcgacggctaagcatatgatgcaaatattccaaaatctgaaaaaaaaaaaaaaaaaaaatcaaaatccaaaacacttctggtcccaagcattttggataagggatagtcaacctgtatatactatgttttttcctattcatccatacccatgatatttaatttataaattaggcacagtaagagattaacaacaataactaaaaacagaacaattaaaacgatgtactgtaataacagttacgtgaatgtggtctctctcaaaatatcctattgcatggtatgcacccttctgatgatgatgaggaggaggagacgatgataataaaattcagaccttggcaagccaagggtaactgaaaccatggaaagcaaaaccacagataaaagggggattactgtaaatacaggagatagggtgattattggcccatcagatcaacaaatatttgaggacctactacatgcaagtcacactgtggagatgatatagaaaacacagtatctgcccataaaggtgttgtaagacaggcagtccttgtttttgatggcactgtgttaatggaaacaggtacacatcagaattgtgtccgtgcttctgaggtgacagatttgaccttagttctgatatgcatgggttttttgtatgttgtaataaaactttatttacgaacgctaacatttttcacataattttcacatgtccataaatattattctttttatttttgtccaactgtttaaaaatattaaaaccatcctcagcttgcaggtcatacaaaacaggctgtggatgggactgggccacaggccatattttgccaaccctaacacaggtgaagcagtttctaagctgtatctatgccctcaaaaatgactttctgcattacctttatgagtctttttattattcaaaacatcctcttatctagccaagatgaactttcccaactggcttcaaaccactttttttattacagcgtcagagaacctggaagtcatctttgatcatctcctgttccttcaatctactttagtttgataagcatgggtttcagttaacattgcaccatgcaaagtgaggaatagctggagtttagtttgagataagacagggtggaacatctgttgggcaatggtaatacactgaattactagtattaagctgcattttggagcattttgaaagctagtaacaagatgtcagtttcggcatgacgggattttaaggtacccccatgacatctttttgctgttaagtgatgtctccttgatgctgctgaaagtaggaatggtaggtggggcgatgtttactgtgttaaggcatttacccattaaatataagtcacatattaaaggccgcatagatgtatttttagttcattggataatttagcacaacttattaaaatagtagttaagagcctgggaactagaaaaggctagcacagttcaaatcctatctcggctgaatcaccttagttgggcaagtcactatcagatttgttgaaaagcttaaacgagttgatatttgcacagaacttacagcactatgccattcatgcagtgagtgccaaataaatgtgagcttctgcttgctatctcagtggcaggttcttggaatacacagataatacgtctttgccctccagctggaattatttatagtagtctccccttatccccagctttgcttttcgaggttctagttacctgtcgtcagcctcggtgcaaattttatcatctcacaccgtcagaagagttagtacagtacaatagtacaataagagatttagagagagacagactacattcatgtaacacaatacagtacatacagggttcagtacagtccacggtttcaggcatctactggggatcttggagcgtatcactggtggatacgcggggactcctgtatagtagtcattgcttcctcaaagctgaagttaatgttgtttactccatctgataagccctagttctctccatctacctaaatcctcatcattccttaggactgctgcttctgtgatcatctcaggttgcgccaattctcacacatcttagtatactgtgaacatctgagacaagtctgaatcatttaatacagcaatgcactatgtttcattggtactctaagctattgtctgctgtgtatcttcctatgcacctttacctgcctgcacttagcacatgcctaatgattttgctacccccatgacatcccgtatacagaataatgcaggatgttattgtgattaagggtacagaattagaagtcacatggcctaagttttaatttcggctccactaacataaaaacttacaggaagtcactgaactaatagtgttggtttcctcatatgtaaaatggggtaacacctctacatcatggggttaataaagttgttgaaactagcttactgtatttttaataatgatttaactcttcacgcaaagaaattttaataacccgcacagatttcaaaaatgctctgtaactttccagaaccatacaaaaaccaaaggaatccttcagaatcagaaagcattaaaatctgtatgaaaatacaatgtgctctttgatattttatgtaaaaatcattctatatatttcaagaaggtggtcatgctccactggaatgaactgaatacaaacgcgtctttctttttttaaaaaaaaaaatttatttatttatttatttatttatttatttttattatactttaagttttagggtacatgtgcacaatgtgcaggttagttacatatgtatacatgtgacatgctggtgcgctgcacccactaactcgtcatctagcattaggtatatctcccaatgctatccctcctccctccccccaccccacaacagtcctcagagtgtgatgttccccttcctgtgtccatgtgttctcactgttcaattcccacctatgagtgagaatatgcagtgtttggttttttgttcttgcgatagtttactgagaatgatgatttccaatttcatccatgtccctacaaaggacatgaactcatcattttttatggctacatagtattccatggtgtatatgtgccgcattttcttaacccggtctatcattgttggacatttgggttggttccaagtctttgctattgtgaatagtgccacaataaacatacgtgtgcatgtgacagagatatagatcaatggaacagaacagagccctcagaaataacgtcgcatatctacaactatctgatctttgacaaacctgagaaaaacaagcaatggggaaaggattccctatttaataaatggtgctgggaaaactggctacccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaacggcaacaaaagccaaaattgacaaatgggatctaattaaactaaagagcttctgcacagcaaaagaaactaccatcagagtgaacaggcaacccacaaaatgggacaaaatttttgcaacctactcttctgacaaagggctaatatacagaatctacaatgaactcaaacaaatttacaagaaaaaaacaaacaaccccatgaaaaagtgggcaaaggacatgaacagacacttctcaaaagaagacatttatgcagccaaaaaacacatgaaaaaatgctcaccatcactggccatcagagaaatgcaaatcaaaaccacagtgagatatcatctcacaccagttagaatggcaatcattaaaaagtcaggaaacaacaggtgctggagaggatgtggagaaataggaacacttttacactgttggtgggactgtaaactagttcaaccactgtggaagtcagtgtggcgattcctcagggatctagagctagaaataccatttgacccagccatcccattactgggtatatacccaaaggactataaatcatgctgctataaagacacatgcacacaaatgcttctttctactgacagagtcttttaagaaaaatagtttctccaagctcgtaagatcatagttgaaataaaattctagaacaaaaacctatactactaatttttttatgcttccacttttgtattcagaggtggctctttttcatggaagtgtatgttgtatagctaatgatggaacacagtactaggcaaactacatccatacttaccctactgcctgcaataattttttaaaaaaattaaaaccaataagtggctgactccttttgaaaaaaatcttgctaaatatttcaattatctttgacttagataatgttccatgcaaagtttgattattcaagatagtcccttccagactataagctctaagagaacagaaactatgtccttctgatagcccctccccgtaccatagtttctagaacatagcaggcactcaataaacaatgtgttattagttggatggattctaatattaattcctttatcatgtcttttgctgatgctgctgtaagactaccaaagacactgtaataaaatctacctgcaaaatttttgaaacacaggttcaagcatcatctaagctatatctatgctctcaaaaatgactttctgcactatatttatgaatcctttcattattcaaaatgtcctcttatctagtcaacatgaactttcccaagtggcttcaaaccactttctttattaaattaagtcagagaacctggaagtcatctttgatcatctcttgcttcctcaagctacacataaaactcatcactaagttctgctgattccaactccaaaatatatctaaatccatccacttctctcccatttctaccaccacccctctagtcctagctaacatcttctctcatcctgatcaccggaaaagcctgcaaagtggtttcccagcttccactcttgcttaattctaaaccactctttatgtagtagccaagaaaaaccattttttaatgaaacagatcttgctgtttccttgctaaaaaccattcaatgtcttcccactgcaattatgataaaaaccccaattctaacttctggcctcagtctatttccccagcttcaccttatgcaactcttctgttcactgtatttgagttacactgaacttcagttccttaagtttatcaacctctttcacacccttagacgtttacataggcaatccacttgtctctgaaatgttcttctctagctctttactctgctgacttttgaatactcttttggaactatgtataaattgttacttcttcaaaagtcttcccttctcataaacactccaaccccaaccctcagcaaggtagcccagcccgtcagaacccctcactgcattctcatttccttccgactatcagtttgtaagtacagttttatttttatgagtgtttattatctgtctgtttgtgaaactaaaagcttcatgaaggcagagtctgtgtctttttgtttgccctatagttctggtaccaaggcaggtgcatgatgctaaatgaataagcctcatggagaaatagcaccatcatcagaatttcagtgcactgccaacaaaaataagcatgaactagacttccaagatctagctgtttatttccttggtgccaatacacacacagacaatgctgagtttaatcaaatgctggaaagaaacataggattagcccgattactgtcaataagcatttacactgtctccccgagcctcagcagggctcagcaacccgtttaactctctttggtcatccttcttgcacctttctattatttcaactcctgccccatttctcccagaagaaaatttcattcaatatccattcattaaacaaatatttactgagcctttactatattccaagtactcagtagatagcagtgaccaaaaagaaaggcctcgttctcacttttacactgttggtgggactgcaaactagttcaagaatcatggaagacagtgtggcgaatccgcaaggatctagaactagaaataccatttgacccagtcatcccattactgggtgtatacccaaaggattataaatcatgctgctataaagacacatgcacatgtatgtttattgcggcactattcacaatagcaaagacttggaaccaacccaaatgtccagaaatgatagactggattaagaaaatgtggcacatatacaccagggaatactatgcagccataaaaaaggatgagtttatgttctttgtagggacatggatgaagctggaaatcatcattctcagcaaattattgtaaggacaaaaaaaccaaacaccgcatgttctcactcataggtgggaactgaacaatgagaacacatggacacaggaaggggaacatcacacaccggggcctgttgtggggtgggaggaggggggagggatagcattaggagatatatctaatgtaaatgacgagttaatgggtgcagcacaccaacatggcacatgtatacatatacgtaacaaacctgcacgttgtgcacatgtaccctaaaacttaaggtataatttaaaaaaaaaaaaaaaaagaaaggcctcgttctcaaggcacttacattctagaaataaaaaatttaaattcaagaggtggtaggtactatgcagaaaaagcaggcaggtcaggggatagagtgacacaatgggctgtaagctattttcgtgtggatatgagcaagacctaaatggaatgggcagtgaacctactaaatcatcgactctagaggaagggccatcgaggcaaggtgcagcgactgcaaaggcccaaggcaggcatgcttggtgtgtctgaggaagaggaggcggctgtggctggagtagcctgagagcaaaaagagcagccaaagagggaggcaggcacaaaatcatatacagccttggagatgagagaacagactctttttttttttttttaattctaaagaagactgtaagacatgaaaggttttctaagcaaggaagtggtataatccaacctacgttcaaaaataattaccctggccgctgtatgaagaaaatagactagagagtggggtggtggcaaaagcagaagcaagtttagtctggaggcaattatagcagcctaagccagagatgacagtgggttggcagtagcaaatacagacatattctgaaggcagaaccattaggatttgctgatggactgaatgtgaagtatgacagagaaaaaaaaaatcaagatgacatctctgtgggcctaagcaagtacaggatagagctaccatttactcttgttcaccactaaaagccagaatctatggctacaacagtaagagcctagaacatcttgctgtggccagaagtaaataaaaatgatgatgatgtgttaaaaggacagaggagcttctagaaaggagttcccctctgcctaaatttggaacaatttaagcatcaaaataaatactaatagcaatggattataaccataaaataatctatgagtttaaacaaaatgaataaacaaataggaagaagaaaaagcttctccttacaatagaatgccaattaataaatggcaaagaaatgatagaattagaaaataatgtttggccaccaacaaagtaaatgattcaggcaaaaatcatctctggatgctaaatgtggtagataaaagtttgatgaaaaacaggttatctgcatttctgtctcaaagtatgtccccccaagatacttaattataggtagaaagcaatgttagagaagaaacatggataccacctaaaccaggtggtcactgttagcagcacttgtgatgagaacttggatattacatgccttctgatgtgacacactgaggaggacacagcacacctgtggaattttctaatcatgaaaaataaaacaagctcaaagtgatgacattctataaatgacctgtgcacttcaaaactgtcaaggtcatgaaagataaagactgaggaactgttcccaattggaaggagactagagagacgtgacaactaaattagataatagtacttaatttgtgttaaattcctgatttgatgattggaccatggtcatgtatgagaacatttctgtttttaggaaatacacacaaaaaattaggagtaaagggatattaacacattatgtctgcaacttactcgggaggagaaaaaaaaattctttcagtcaggaagaacataactactgcctcctttcagttcccactgaagtccatgtagatttctactagagtacctataataactcactagcatgaaaggaaacaagctttgagggcaacctgcccaaaggagaagttagtaaatgacagatcaagacttgaacccagatccacctgaatcaaagccaatattttgttaaatcataatacagcagaatgctgagtaaatgcgtgctgagtatttgtactgctgttttatttttccaaaagtactcacataatgaccgacatcaacagtctattcaccaccactgggtctcttaatatgaagagttttccctagaaccctcggcatcagccttagaatttttttttttttttgagatggagtctcactctgttgcccaggctggagtggtgtggcacgatctcggctcactgcaacctccacctcccggattcaagtgattcttctgcctcagcctcccgagtagctgggaccacaggcgtgtgccaccggctaatttttgtatttttagtagagacggggtttcaccatgctggccaggctggtctcgaattcctgacctcaagtgatccacccgcctcggcctcccaatgtgctgggattacaggggtgagccaccgtgcccagcctagaaattcttcttttcaagataaaagagaacttggcttacatggtacatttgttggtggcaaagaaggaaaagacaaaaaataaatgaacataatctggaagagcctttatgatctagcccctgcacttttccaacctcacctcctgccattctccacaccctatattctttatcctgagccattttaattcccacaattaagcatgttttcccctatcttcaagtctattccaccttcacttctgttccttctgattatataagaaccaactccctacatatccctttaagggatatgtacaactcctacatatcctttaaggcccctcaatgaatcctcctctgacctccccaggcagaagtagaagctggcttccctattctcccaaaacatcaagtattctataattgaacttttcatattaatgacattacttattcacaaatctctcctatagttcagggaaagaattcagtcattcactggcatctccagcatgtggcacatagactctgtctatatatttacgatcttgccatgtgtcacaaagaattgcaatttttttttttttggaagacagggtctcactctgtcacccaggctggagtacagtggcatgatctcaggtcactgcaacctccatttccccagctcaagcaattctcctgcctcagcctcctaaatagctgtgactacaggtgtgcaccaacatacctggctaatttttctattttttttttgagatggggttttgccattttgccccagctggtctcaaactcccagactcaagcaatccacccaccttggcaaagtgctaggattacaggcatgaaatacttcttgaattaataaatataggtgttttatcactcatgagaagcttgttttttgtttgtttttggtcaaatcccaaattcttcttcatacagtaagacaaaaaataaaccaagcttatttaatattgatagtcaaagccatgtgcttatctgcaaaaccaaagcagttatcatgggtttgaaaggaatattataaacagcagaactacatatacacacaaaccacaactattctgagattaggcaaactgctgttactgcttaacccacaatgtaattaatctgctgtttctcagccatgaacaagttgcttgattgtctaacctgaatatccaactttacctgcagtgcttgttcttggatatcacgaaataattccatatctttctcagtcatgatttcctggctcccaaaaagtcgctcctcattttcttgtttgccatcccagccatcctgattgtctacatataaaaaaagagctcacatgttaactgtccccagattaatacatgaactagaaaaaatttcaggtctttatttcaatttgaagaacttaatatataacgaagaatatagcattaaactgactcttagaagaatgctactcaataaataatatttatgtattaaatctgccttatagtggaaatcctgaattgtcttaaagcttcctaaaaatattatataactaaatttaaacttcattaaagattacattttaatacacagaaaggcagacagaaaaatgatataaggaatataaatttcattttgaaatagtataaatttgacacttttagtataggtttaatgcatcaacgttcaaaaaaacctcttgagtagctaccttaactgatgtcagcagtactaactcccatcacattctgggtgcccttttaaagttaaagcacaaactttaaaacactgtccttttaaagcacaaactctatttacccagatgataatcatctgggtaaatatgaaaacgtatgataattatctactaaatgatggaacttcctcaagttggcaaaaaactagtgaagagagtatttgggacttatgaagatcattatcctttgcatttgaagatgacactgctgttgggctcatttgctctctttataagtatggctgaaaagaccaattggtgacagttctcaagtcaactgcacatatgggccatctgttattaacttaacacaagaagaaaaaagtcaaggactcactgttgacaacattctcaaactggaagaaaaaagtacaatctaaaggtactatgtgactttaatgccccctagtgcatgatgcatgcacctctctaatacagcattcggtacttaaactttataattcataaagaaaatgacagagcctattaaagcaaacgctcacaccactgtcaaaaattcaatattggttctccatatacttgatacacttgctctaacaatttctatttcaaaagctttctagtagattcttctaataaaccgtctccagtacaaatggttaattcaaaaatgtctttcattaggatttgctctgagattctttcctagtttaatctaaacggattgcatattttcttagataaacatgctcagatcaggaacttatctacaggttgataaagacatgaagagtcttgaatgcttaaagagtaattagttgatcatcactatggtaaaagaccaatcaataaagcatacaaaggggactctgacaattacaaggactttctctcctgcactggacaatcaaccacgaatgagagcagtgaatacactctccctcaccaaggagacattcagggaggaaaccaaggtcagggaattctcttgtagtagatgagacactacacctctggcccttgtggtccaaaagagttcattctcattctactttcttcaagccctttctacttccttcacagggttagtatctctaaattcaaggctcagcaataagactattttaagctttaatttattggacagttaatcaaattcttctcctctgacttgaatgatttgccacattattaagtcctctccacagatgttttctactttgaaaattagggaacttagcctgatacataagcagcctggagctgtggttctgtctctccctttttaagtgcaatccatgacttacaactatatttgtcaagatctgaagtagaaaagtcaatgacctcatcacatctgcaaatattttggtcttttttttatgcttagatcaacagcatttcacccagttctattctttccagtttccttcctggaataagcaggcatcataacattcaccatatgatttctttagtaatttgtgaaatgtaaagtaatcctcaaggttacaccccaagtttctctaggcagattctttgtggttctacaaaaaagcagcttccttttgcctaagagttcctactgtcccattctgcaactttatttccatcctctaaattcctgccacagttatcacctcagtatcatctacatgttttttcaatgtgttcttatattctataaccaattgttaataatcaaatataaatccattatagataattagtgttatcccgaataatacatgtacagaatactatttgtttctaagtctgttctaaactcttacctgtgggccaatctgaagtgcttgatttcctgttgcccctctttctgattcgatattgctcagagtagtccaccacttccccccgagctttccgcccatcaggggaaggggtaaaaaatttggtaaggccatcaatgagccctttggttttcttgttgaacttcaaggagacattgctatctctgcagaagtccaagccatctatccgctctaaatatccttcttctgatgatgatgatgctgattggctggaaagagtgatttttcgtttcctaccccttccagggccagttcgaactttgctgaagggaccttttgatctaaacaattaaacaggggaaagggtaagtattaaaaaagatacttgtaaggttcctttttaatacataacatataattagtaagtaacctacagctttattaaaatctatattattaagaatattctgcaaactataaatagtactctgtgaatgaaaattaatattattattagaaacatctattgccaggaagcctacttatagtgcaaagaatgacaggccaggagtcagaagacttgttctagtcataattctctcttactagctgtacgacttggacaaatcacattttttctaaacatatgtcagtgccttcatctgtaaaatgagaactggactaagaacaactaagatccttccaggtataaagttctactacactgtgatctctgcaccaactgaaagttatacttttatctctaaaacacaaggatgggttattcttcgaaggccaggaatcaaaagatcattttataggaaaatcaaagcttgatttaagattttgaatatagactacaatattggttctgtacatttcaggctgctaatgcccattcatttcagttatatcaccttcaagatagtcttacgtgtaaaaaaagtaagtaaaacttttgataataaagggaggttgacaagcctgaagacgtttacatatcatcaaaggtgagttactacagacatttttaaaaagacaaaactagctactgaatcttgccccacctcctccagacatagcccagctttctagtccacaatttctgatttctgctaatagatgaaaacattcaaattattttacatccaaagaacacaaaaatgggacttagccatcacctcaataggaagaacctatccagtgatttgtacacctaatagatattaacaactgagacaagatcaggagagtgacatgtgaaatgtcacagtaacaactttttctttcctgtttttatataagagaagcaacataaagcaatggttaagagtcagactttggtgccagactactcggattttcatcccagttcaacatttactatgccttagtttcttcctttgaaaaatgaaagtaacagcagcagctatatttcactgggttgttggcagaattaaacaattcaatgcatataaagcacttagaatagtgtctggcacttattaagggctgaataagtgttagccattattattatataaaagtgccagatatgacaatggaatttttttcatagagaaaacaagtgaatcctacactatagagaagaccctatccttttctcccctcaccttgccacaagtacaacttacaccgtgttttgtttctttaacctgttttttggacgtcctattggattagtatagcgccgttttatctgtgctgccttcttttgtagaagttttcgtccttttttcctaggtcgacatatttgacatatccacatgcctataaaaaaataaaattccacatagaagtgtgacagacataaatacactgaaaggtttcagatagtcttaagtcaggatcttaactttttcaggtaaaagactgtcattagaaaatctgatgaataccccctccaatccaaaataaacattaaaacatatacacacaaaattctacaaataattggaagagactcacatacaccttcaagcctgcactggaagtccactgactgcacttgaagtccactgaggctgaggcgggtggatcacctgaggtcaggagtttaagaccagcctggccaacatggtgaaaccctgtctctactaaaaatacaaaaattagctgggcatggtggtacgtgcctgtagtcccagctactcgggaggctaaggcaggagaatcgtttgaacccaggaggcggaggttgcagtgagccgagattgcaccactgcattccagcctgggcgacagagtgagactccgtctcaaaaaaaaagtttcctgcctaaagctgctatataatctcttttgtagaagttaaacacacaagaaaggagtcctaaggaaatgtttcttgactgggcacagtggctcatgcctgtaatcccatcactttggggggctgaggtgggcggattacctgaggtcaggagtttgagacaagcctggccaacatggtgaaactgcatctctacaaaaaacattagctgcaagccaggcatggtggctcacgcctgtaatcccaacactttgggaggccaaggtgggctccagcctgggcaacagagtgagattccaactccaaaaaaaaaacctttcttaggactcttagaaggccccttgctcagacttcacataaatggaaaaagtgggtatttattctttagtatttataaattgaagacgtttcaaaaagtaacaatcagtaagtgaattcaggctgggcgcggtggctcatgcctgtaatcccagcactttgggaggccgaggcgaacagatcacttgaggccaggagttcaagacgagcctggccaacatggcaaaaccccatctctactaaaaatacaaaaattagccaggtgtcgtggtacgcctgtagtcccagctacatgggaggctgaggcagagaatcgctttgaacctgataggtggaggctgcagtgagccaagatcctgggcgacagagtgagactccatgggtgagggggtggaataagtgaattcaagtaaaaacctaaagtgttaacatgactacaaagtacggttaagtcattttctatcaacaggaaatttttttccaaacaaatattatgaaatatcctataggcattttacttaagaagcctataaattataaaatcagagttaaaatggaatttgtgataggacaaaaagaggggtctggctgaagttttttttaaagaacctataagcatatgaatatggaagtccaaccatgaggcaactatgcccaaactaaatacctctcaatgaacaggaatcaaaagaaaagagtaacattaagctgcgcccttacaatctggacacttatttgttcagaatgtatttcattaaaacaacaacaacaacaacaaaaaacctttttatttcataaagtatttcataaaaaggttttttttttaagttttgaataaaccatatctctatagctctagggccctcaaaagtgctaagcagtgatataatcaacacgacctaatactattttatttcctcctttcaataaagagatatttcaagatatatttaaggcaagtattttatcttctagctagagactggcaaatatgtataaatgaaccacttcaccattgatggatgcctagatattgaaaataacaataaatccgtatcatgtaagaatgttaagatgcccactcagaaagactatccccccaccttttaaggtgacagttctcttcctacttatacaacctcaaaaagaaagatccaattattatttcatttaacaaagtagataaaatgtgctttcactaacatcctcctttatattcccagttttatttcagaaagtatttctcaccttttggcatacgggtgagtggcggatcacaacactccatgtgaaaacctcggtcacatgaatcacaaaagagcatgttatcctattagaaaaaagaaaggacagttttgcttaaccttatgaagcagaaacatgttacgatcatgactgcataaaacctagaaagcttcagggatcttaaaaaaagagataagccaggcgcaatggctcacgcctgtaatcccaacactctgggaggtcgaggcgggtggatcatgaggtcaggagttcgagactagcctgaccaacatggtgaaaccctgtccctactaaaaatacaaaaattagacgggcatggtggcatgtgcctgtaatcccagctactcagaaggctgaggcaggagaactgcttgaaccagagaggcagaggttgcagtgagccaagatcgtgccactgcactccagcctgggcgacagagtgagactccttctcaaaaaaaataaataaataaaagagatgagtgaccataatattaaaagtttccttaatttgtattaactatgtaaatagagttagcaaaaagttatgttccagccaatctttgataaagaactaaagtttcattagtttcaagtatatccaataaccagaaataagctaaccctggtctgctttaataatgagaaaagggcgacttgtaattaatatatcaactgaccatcctaaatgaatgcctctgtactgctcaaagaaatttggggagtatttctttaatgtggcttagtctctctgcaaatatataattaagtgctttacaaattacctagacataactgaagtctaaattagcaagcattctaaactaatgacatgtagtttaaagagactaccggctattctaaatgctactggaccaagtgtctgaaaaataaccagtcatacttagatgaaaatgctggtcgtacattctactactaaatgaaacacccatattagaaggcagagatactcaccgcatttttgccttgatctcgacaggagctgcatgttttacactcgatgcactgccaccgtaaggccttcactcgaaccgttagttcaggggaaaactttaaacaggatggatggcctaatacgagggagaacattcatgaatgaaacaatcaagaactattttgctattatagtactaaagaaatgatgtagaaaaaggcaatcatcttaaatacaaaatatatatcaaataaagcaagatgcaccaggaagcctgccacacatttctcatcaggacttggcaccacaattcagttttattaatgttaaagagaagttaggacccctccccacaatttgattattaaaaaaaacttgacaaactccaaacttttattaagcctacatcaaagcattatgtgtgtacatatccggtatatatgtatatatatgaatacatatatgttcatatatgagaaatgctcatatatgcattactgaatatacaaaaaagctgtttacactgataacatcctagaaaactgagctatatatatcaagaaggattttatgtctcagtttatacccttttgtgctgtcattttttaaatgacaatgttttacttttgtaatttaaaaaatacagttagtccccttatccgcagttttgctttctgaggctttagttacccacagtctactgcagtgtgaaaatattaaacaagcaactcctaagttttaagccgcacactgttctgagtagcataatgagatctgctgtcccagctgggctgcgatcacccacactgcatacactacccatttgttagtcacttagtggttgtctgggttatcagactgttgctggtatcaccatgctagtgttattatcatgcttgtgttggagtcacccttattttacttcataatggtcccaaagcacaaaactagtgatggtggcatgttgttataattgttctattttgttatctattattcttaacctcttactgtgcctaatttataaattaaactttattatatgtatgtatgcacatgcacagggaaaaacatagcaccatatacagagttcggttttatccaaggtttcaagcatccactgggggtcttgaaacctccaagaataagggggactcctgtatataataaaaataccatcacttaaagtgagttatctgctcacaatttaaggcatgcaagctaaaactaaaaccaaaagcagtatttctactgtgctcagaatgaatagcaagagaaaaaaatgcttcctcttccaagagtcagttatcagtctgattctcaaaaattaagggtagccaatttcccctcaactgaaaagagctgtccctctcctctaaaagttggtcgtgcttatttttctttggtgagagaaagggcttgttaaatcttctcctctcttttctattcctaaaggattttctcttttatgagatagcaagtttattatcaaaacatcactaacactgaaggaaaatccaagaggtgtgaaaatttcacccacaatcctatcatcctagaataatagccatttttatgttagactttcctgtttaaactagctgaaagctctgcatgactgtaattttagcaaacatacagtttttgttttattttaaattttaagtaaactttatattccttaaactgatcatattccactgactgatatactataacctgcatgaacatttccctattgttaaatactgagactacggaacactaaaatgaattatttcatgtttacagattctttacttcttttaatcccttagaatgaattcctgaaagtgggattggtgagtcaaatgtattaaacatttttatagcttgatatgcactgccaaaacattttccaaaaactatgatataatatgcagtgccaccagcaaaagaacaagtgttttagcacaactacatgagctctaggtctgttatatttcaattgtgattattataaacgctatacaatgatacttcactgctactgtggtatgtgttcctattactacttgagtaaaacacttttcataggctcaactattagttttctttcatataaattgccagttcacaggctctgctctttggacttcatgcttagaaatgtaaacatgttctttatacttatatagcttttggccctttgccatatttaaagcagttattttcccccaaattattcttgctctactttaagcatgttactttttaatttagaaaatatcaacgttcatgtatccagctatgcccatgctgttcttctttggctattgtgacagccagtctccaggctgctccctaggcattcttgcctcctgctagtcatactcttacaactccctctcataatgaactgggttgatctgcataaccaagaagatattgctgaaataacacagtgtgactctaaggccaggttataaaacacactgcagattccacctcactctctctcagacactcatcgggggaggccagctgccatgctgcaggcatgcatgcagtcctgtgaagatgtccacatggcacggaactgaagcttcttgtcgacaagcccgtggcagcagcaacttgccagccaggtaaatgagccatcgtggaagccttcagatgactgcagcaccagttaaaatcttggcagcaacctcatgaaagataccaagtcaaaaccacccagataagcaactcccaaattcctgacctacagaaacagtatgaagtaaaaaatgttttgttgctttaagctgctaagatttagagtaatttatttctgcagcaacagataactagtagttaattgttctacaatttctttaaaagttaccgctacaggggctgggcacagtggttcacgcctgtaatcccaacactttgggaggccaaggcgggaggatcacgaggtcaggagatcgagaccatcctggtgaagtagagatggtgaaaccccacctctactaaaaataccaaaaattagccgggcgtggtggcaggcacctgtaatcccagctactccggaggctgaggcaggagaatggcgtgaacccgggaggcagagcttgcagtgagccgagatcacgccactgcactccagcctgggcaacagagtgagactgtctcaaaaaaaaaaaaaaaaagttaccgctacagtaatagttttcaaattatgctcatccttagcttagagagacgcacagaccacctcaaatataatgctacttagacggcagggctgcagacacaacacttcctctcctcggtttcattcccaccccacctagaacaactcattctatgttttatatatttgggttttaattagggaatttggaaataactgcattgtatggcatgccattatattttcatctaatctttcatgatttacggtttatatttaactatgaaatccatccagagttcattctggtttgtgacaacacgctggatatgactacctagcactcaagatctgttctcaccttctactatgcataaaaactgaaaagctaaaaaatcatacttcttaagactcctttgcagctaggctctaagttctgacaagtggatgtgttctccagggatattcgaaaggtaaaaacaaagcaaagatcatcctcctcctagtactattttctaatgataagcaaagtcatggtaacaaccgtatccatgcttctccctcgtaggtatctagagctattgtaatgatggccaaacttagcacttcagcaccaactacagagcgcaactgttgtgcagtggactcccccctgcttgcacctcttccagatagaggcagacacagtaactcctcagatgggtcagttctgcagtgaccccagagtcagtccttaaagcccaacctccagcttgcttcttcagccctgacaatgatttcacaaatacctaattcttatacttaacttccttcctcttgaagtatgtagtgtggtttctgttttctgaactaaatcatggttgttatcactataaaacactgaaaattaagccaatggtcaaagataatgctggtttgctaaggccttcctgtaaggtcttgtaagttttttttttgtttgtttgtttgttttaatttaagacagagtctcgctctgttgccaggctggagtgcagtgacgccatctcagctcaccacaacctctgcctcctggattcaagcaattatcctgcctcagtctcctgagtagctgggactacaggtgcgaaccaccacgcccagctaatttttgtatttttagtagtgatggggtttcaccatgttggccaggatggtctcgatctcttgaccttgtgatctgcccgcctcggcctcccaaaatgctgggattacaggcgtaagccactgcgcctggccgatcttgtgagttcttgaaatgtagagcaagaatatctctggaactggcaaattaggagattctgcaaaatctttcttagggcctagaatttcacattgctcgctagactgcagtatcaacactatttcccaatgtgacatatgtaagtttccatcaagaaaaacaaatctgttatcatcctggttctattcatcaagcctgaggcataaatcaagaaagacgaagtagcgattattaaagaaaccagcaataacttcaaactgattgctgtgatttaagcagatgttaaatactgaaatgtaaagaccaagaggaaaaaataaacccacagaaagtgttttatatatataaaaaaaaactaagacctgatttaaattaactgaattacacatttcagctatatattcaaatccctccctagtacagaagctcatctcagtcacctaaaaccataatcaaattaaaatacagtcatgcaccacacaatgacgtttcaatcaaatacagcccacatatggccgggtgtggtggctcacatctgtaatatcagcactttgggaggccaaggcaggcagatcacctgaggtcgggagtttgagaccagcctggccaatatggtgaaaccttgtctctactaaaaatataaaaattagccaggtgtggtggcaggcacctgtaatcccacctactcgggaggctgaggctggaaaattgcttgaactcaggaggcagaggttgcagtgaaccaagatcacgccactacactccagcctgggtgacagaggaagactctgtctcaaaaacaaacaacaaaaaaccagaccacatatgactgtagccccgtaaggtcatactactgtatttttactgtaccttttctacatttagatatgtttagatacacaaatattcaccagtgttacaactgcctacaatattcagtactgtacgggtttgagcctatgagcaacagactacaccacataacccagatgtgtagtaggccatccctcttggtttgtgtcagaacactcgatgatgttcacacgatgatgaaaccttctaaagacatgtttctcagaacttatcccccataattaaaagatgtatgactgtattaatctcataaggatcaaggatacaaactcaagtcaacatactttccgcttgccttcgtaacacattttagaagaaaaacagaaggaaatcacataccactgttgccacagtcggcacaggagatgagttcctctggcttcttttctcggttttgttcttttgtaccaagacagaaactacagatggggattggttcagcaaccggctgtgaagaaaaacacaattcattccagtactaatacttttatttagtattactacaaagacatcaaaattatagttttaaattcctaccagagtaagtttaggacaattgtattactctcctaaattccagctaagtaggtgagtttttacaaagcctgctctggctgggcctttacaactggtccttgttatgaccatttagaaactttactccaaaaaatcctatcccagtcatgttcatcacttagaacctaaatgatacagtgtggattttaaaaagcaaacccttaagattgaaaaattcaactggaataagttcaagaagacacagtgtaagcgctgaaaaagcatgtgatctagtacaagagcagtaagatatatacaagtaaacagacacagtgactcctcggcagaagacattaagtgagagaaacagtaagtgttttctagcagtacgaaaaagaaattccaactgtggtgtggaggaagggaaaggttgaaaggggaaaacaacatgtactaagcatcagtattatgttttgggatctttagaaacttgtccaaggacagtagctaacaaatgttaagagtggtttgtttaatctatgttcctcctaagagtgatggagagaaggcaatagaggtagtataagtagcatagacttaggtgtgcagtctggtaaggccaatgcttaaagcacatagcttctgctataagggaggggaaaaaaaataaaagaaagaagctagataagttcgtgaagactgccaccgaaggtaaagaagttggactctcaaactcattaaaatgtatacattaaatatttgctttttatatatcaattatacctaaatacagctttaaaacgaaaataaatttttttaaaattggactttatcctataggcaagtttacagaaccaggagataatcacttggagaaaaataattattgtagcaatatcaaagacaaacggggaaaactccaaagataggtaaaacatttaaacagtggttacaatgatctggtgaagacaagatgagaacttgaaccaaagctaaggaaatgaaatagaagaaatagcaatgggcttaaaaccagttttgagagtagcagaaaaacaaagtgagttaaatatgactaagtgaactgaaaagatggtgacgctatcaactgtgcacagcaagtcattttaaagcagaaagtttggaggaaagcaatttggaggaaactggtgagttccattttaaatgtgtttagttggaggtaccctcagtcacctctcaactgtttatgctaggcactgtgcaggatggcaatggaaaaccctcaagatgcattcattcattggttcattgatttgcttgcttccccaaggacaaagtatcgagatgcttttagtctactggggagaacagataaagtacaataaaatgtttgtaggtaccatgatagaactatagtaatagaaaacaggaggaaagtggggaaggaggtactttcacaaaagtaccctttgacttaagtttttccagaagtatttaacaggcagccccaccaggttcaaaaaggtgttcaaaaaggtagaaaatacacaatcaggtttgggaagggaaggtgagcttagtttggggcttactgagcttaaaaatgcttatgtagccgggcacagtggctcacgcttgtaatcccagcactttgggaggccgaggcgggcggatcacctgaggtcaggagtttgagaccagcatggccaacatggtgaaaccctgtctctattaaaaatacaaaaattagccaggcgtggtgacatgcatctgtaatcccagctactcgggagactgaagcagaagaatcgcttgaacccgggaggtagaggttgtagtgagccgagatcgcaccattgcactccagcctgggtgacaagagcaagagtccatctcggaaaaataacataacgtaacgtgacgtgacgtgacgtgacgtgacgtgacgtaacataacataactaaaataaaaaataaaaaatacttatgtaacattcatgtagcaatacccactgacaatataatacagagagatctgaaatttaagacagagactggtctggatttaaaaatctagaagtcatatacatacaaaatggcattaaagccatcagaattgatgagttttctcacggagaaaggtatgaagaagagagctaaggtgagaataccaataattaagtggctggcagagaataagccagaaaagcaaacagattaatgagagagttgggtggaacaccaatatcaaaacatccaacacaaataagctaacagtagtgctcagccaagagactgagagatgaacggctagttgtcttaataattatggcttaatcataattaagactaccacatcctttcctcaaaaaggagtatgaaaaaagaactggggaagtaagtcaggaaagactttatccagcagtaaaaatctggggaaaaaaaaaaacccaacaactctaaagaaggcctaggaagaaggtagaagccagtcatgagatttgagctttattctgtagcctctaaggtacaactgggagattttaggcagaggaatagtacggccaagatttaaattttagaaaagtcattctgtaagcagttaaaaactgattgcaagggatgtgatctataatccaggccatgagcaaagaaggactgtattaaggcgctgagcaaagaaatggagaaaagaagataaaagatattaaaagataaaattgtcaggacttgatggctaattgctttggggagagaagcatagtaaggaagacaagagactgggaagacagcactaagaaaatgaaaaggcaagccacagaatgtaagacattaacaacaaatttaaccaacaaatggcccatatccagcataaagaactttttacattgcagtaaggaagaggcggacagttcaacagagatggcaaagacttccacaggtactttcccacagaaaatacatgaataacacatgaaaggccaacaaacataaggaaagatgttcaacctcattagtcaccaagaaaatagactttcgagaatggctaaaattatgaagaccactgatattaagggttgattaaaaagtggaacaacagccaagtgcagtggctcacacctgtaatcccagcactttggcaggccaaggcgggcggatcacaaggtcaggagttcaagaccagcctggccaacatggtaaaaccccgtctctactaaaaacacacaaaaaattagctgggcatggtggcgggcatctgtaatcccagctagtcaggaggctgaggcagaagaatcatttgaacctgggaggcagaggttgcagtgagccaagattgtgccattgcactccagcctgggtgacagggcgagactccgtctcaaaaaaaaaaaaaaaaaaaaaaaaaggtggaacaacacatgcactgctgacaggaatataaatataaattgacaagaccaatttgaaaatgttgacgttatctactaaaattgaacatgtccataccacatgatccagcacttccactcctagctatatacacaattgaagtacatattaataaaacatacaccaaaatgttcagagcagcattattcataataatacattttattcaaacaaaatttacccaaataattaggtggttaaacagataaactgtgctgtattcatacagtagaatgttaaacagtaataaaaataaacaaatgctgccaacaacatggatgaatatcacaaactatattgaaagaacagaaaaaagaatacatcctgtacatttttttaatgtaatgttcaaatatagttctacattgttatgtcaggaaagtggtcacctttggaaaggaaggaaacagtagtgaattgtaaacagactactgaggtgctggtaatgttctctttcaggacctggatggtggtttcatggatgttaattatgtgtagttaaggtgtacacttataatctgtgcattttctgtatgtatattttaattagagttaaatttaaattaatcaaaaaatatagtataggaccatggtacctttggaatattcttcaagaaacatcaatagtgatttggacattaaagtttggaacttaggaaacaggctgaagatggactgaaaagatatcaacatacaggtgataactgacagcactcagaacgtggagggggcagaaaagggtagaaagtaaggagaggggagtacagaaatgggataaagactgagagaagcataccaacattcaggagcacctgagaaaaaaaaggagaccacaaaggaccaatctaagagaaaacagaaacaaaagaagtaatgacacaagaacttcaacaagtagaaagtaatcaataatcaattttggaaagataaagtatctactggagcctgggcaacaagcaaaaccccatctctacaaaaaatacaaaaattatccgggtacggtggtgagcacctgtagtcccagctacttgagagggtgaggtgggaggatcgcttgagcccaggaagtcaaggctgcggtgagccatgatcatgccactgcaccccagcctagcaacagagcgagactgtctttaaaaaaaaaagaaaaaaaaaggtatttactagattctgcaactgagaaatagttgaaggcatcactgtgagagagcccttgtcagtgacagaataagaactaaagtcacaggaccaacaaactgccatgaacggacagagagcagacaaaaggtagctaaaaagaaattgcaataggttttaatgtattctaagtgttcaagatgggaaagactaaacctatttaaatgtagaagagaagacaaatgtaataaaagagattggacctattagaggcagtgaagatcaaatgatgtgtcaactcttcttcctgggcctctctccactacaccatcttttataaaacaggggtgagagcatggaaaagtcattctcctcgagggatatgtacacaattcaatgtaatgacctatgaatggcaggtcacagtaccaggttcacatataaagctcattgtatcactttagcagtctggattaaaaaaaggaacaaagttgggtttagagcaatcactgaagagaagcctactttaggacagggaagctagagggaagactgagaacagtatcgcaactcaaactaaattaccaaaattaacatatttaagtatagcaaagtacttggccaatctactatacttctcagggacagattagatcactttattactacttaacgaagcaaacataaaagggaaaaaaaggagaaagtctggaaaacaaattattgttattcttcagcataggaaacctgtcttcaaacatgtgtctttatcatccagaacaagacagtaaagtttctaactgcaaaaaaaatggtattcaaaatcataactaagaaaccgctagcaaaattgtccctctatgtccctgtatattccctgtaatattactactgttaacacttcttttatatatgatcagtttcacattactagactttgtctaccccaaaccaaattagcttcagccattcaaacctattcatcaaagtgaagggttgaggcacagtgattcagaccaactggctgtgttgttacttagagctggatagacagtttaaccaaattattctagcacttatcaaataatcccagtcttagaccgtgcttactcatgacacaaaacaatttgctgattagtcccaataatgacaagtttatacaatattgatatttacagtgtgaaaataaagctgaaaagcaatttgttaagccaaataaaggcgttattccaaacagagtcaagctgtataaaaacagttttcagtcacacatggcatgctccccactgaagatgcatattctttggccaagcataaaaataataaacttttcagctaccaaaccaaagtgaatccacagagatatactattactgacaatgatcatgacattttaactaagtgataatttcagtttgttttttaagtgcaatttgggaaagagtaacagtaccttgggggtttaagtcatttcagctgatgagctacagcaacaaatggtttaaataaatcatctaggttaagacacagtctatcagttttctttaatttattggtcaaatagcactgctaatcagtacaccatgatttgttttacaatatgccaaactatattgttaaaagcatttaaaaattataactccaggtcactctcattcccaaactattaatgagcatgaaaaccagtgaggtagggctaaaactatattgggttcaccataagatttgaatctgaaatgcactaaggtggttataggaaaaatagaagagatattcaaagcattttccaagaaaaactctacaagctgatttcaattgctctgtatcacaaagacaaaaactactgataatcagtgaaaaaatctgtgcagagacagaaaatatgccatatatttctctcagacctatccaagcttctttcttataccttattgttcccatgatctatataaagtaaacctgttcctacaactaataaaagaaaaaaggttgtagcaaatgactttacacaccattaaacacagcagccacagtgaatctgttaaaaggtaaatcaaagcatgtcattcagctgcccccaactctccagtccaattgcttccatctcagattaaatgccacatgaactacaaggtactgtgtgatctgtactcccctgctttccccctcagttacctgcctgacctcatcttctattgctctctccctctacactccactccagcttccttgcttaggttttcaaggcagtggttacaggcacagggcctttgcatttgctttccttctatatctagaatgttcgtcccaagatctttcagatctctactcaggaagtcaccttctcagtaaggctttttttgaacaccccatctagcatttcaaagcaacccaccaaccccaataattcacaagttccttccctgctttgttttttccccttaacccttttcactaattaacatgtgtgtatgtatatcttattatttattcttaactaaatgtaacttctatgaagactctgattttcacctgttttttaggaccatattcttactactaaaagcaatgcctaggctgggcacggtggctcacacctgtaatcccagcactttgggaggctgaggcaggtggatcacgaggtcaggagttcaagagcagcctggccaacgtggtgaaaccccgtctctattaaaaatacaaaaattagccaggcatggtggcaggcacctgtaatcccagctactcaaaaggctgacgcaggagaatcgcttggacccaggaggcagaggttgcagtgagccaagaacgtgctactgcactccagcctgggcaacaagagcgagactccatctcaaaaaaaaaataaaaataaaaataaaaacaatgcctagtatatagaagtcactcaataagtattactgaataattaattgaattaccttgtagaactagatataataagagtaccttacatagaaagaacaatgagttgggtatgagcctgataaaaagccatgtgtagtgcagtaataatcacagcagtacagaaatgctctattgtttacaaagcaatctcacaaagtgatttcatggccataactaagtaagatttctgccatagcaactcaaaagcagagggagatttgaggcagagggcaccaatattgtgtaccttgtgtcgtcggttgccctacatctcctttaagcaccctgttgagatctctataataatcaccagatggcagtattgaggcaaacacagggtggatgattcggtaacaagcaggcattctgacttgaacttttaaaaacaggaacagtaaaaattttgcccaatgctctctgttgaagtttataccatgaaataatttttaatcataaccatttagaatatcttaaataatgacattttctagatacacagatatatcatctgagatattcccatctaaaaagtccaattttcatttctttttttttttttttttttgagatggagttttgctcttgttgcccaggcgggagtgcaatgaggtgatctcagctcactgcaacctccatctcctggttcaagtgattctcttgcctcagcctctcgagtagctgggattacaggcatgtgccaccacacccagctaattttgtatctttagttgagacgggggtttcactaggttggtcaggctggtctcgaactcttaaccacaggtgattcacccaccttggcctcccagactgctgggattacaggagtgagccaccacgcccggtcccaattttcatttctttcccccaatactgtctttaattttttaaaggccataaaccttatctctattttctaatatcttctgaggcactcaaatctaactttattttgtctctattcttaaacactgacaaaaagaacagtcaagaacctgttttattatatgcaattatttctagttaagactgaattgaatgataaattctataatttgtcaccactgaaattttcatggaaaaaaactgcacttgtaaactcaaactcataactttggaaacctctaagagatcacttaataagcaatcaggcaatacaggtatgtggtttctaaaagctacaaaatttctcaagttttacagccactggaaattactgagacacactggcatatccaattaaaagagtatggaagaagtacacatataattcatgtaatactccctataacactcaaacatgcactaagcaacaaaaaaggataatgagcacatcctaccatagatttaaatacaaaacatctataaagtatctatggtttcaatgtcccctccaagtctggtgttgttaagaggtgggggctttcggaaggtaattgggccatgagggctccaccctcatgactagattaatgctgttatcaggggagtgggctagttatcgttggaatttggcccccttttcctctctgtcttgcgtgctcgcttctgtcttctgcccttatgccatgttatagcactgcaagaaggccctcacagagagatgaggccccttgatcttagacttctcagtctccaaaactatgaaccaaataaacatattttctttataaattacccagtgtgtagcattctgttacaacagcagaaaacagactaaggcatacacaaaacttatgttcaactataattattgcaactcgtttctttaaaatctagtagtgtaccacaaaaggacatatattatatattatatgattccatttatatgaggtacctagaatagacaaattcatagagacagaaaataaaacaggttaccaaaggccatgggaagtggagaatgggaagttattgtttaatggatacagagtctgtttgagatgatggaaacgttctgaatggatggaaaagaaattgatggtatcacgacagtgtgaatgtacttaatgccactgaattatacacttaaatagttaaaatggtaaatttttatataaattttacaatataaaaatgaacaaaaccaattagtatagatttttcatattctcacaaatcagatgatttaagtaataggtcaaaacccatgcaatgaaaagcaactactataatttgttctcatcttgaaacctgtatttttaaccattcctgtggaaccctaggaatatgttaaatctggtatgcagtaaacagaattagaaatataattgtagcccatcaaaaatggaaaaaaaagttactaataacaattatatttggctactgaatttaaatgttagccattttattttcactgtacctacatggaagttagttatcttttaatccaattgcataaaaacaactcactttgtcttaagaaaaatttttaagaattaaatctatagatcaaacacttttcagtctcaaacaaaaaattctttctgaccaccatatatcttatccatccaggttactctgagcataaaccaccataagcttctctcaaatctatccctctacaactacaacctagactgcctctccagtcctctagtggctcccaggtacttcatcctactcccttcttctataatcaagtaaagtaaatttaacttgaaattaactttcttcggtgggtatttgtttcacagaacttgaaacaaataattttcagcagagacattatctataagctgataaacatctactgacaagcactctactatacaaatacctgaaggattaagaggagttaagtcttaagcttagaagggtggaaaattggactattttcaggcatggtatagtgaaggaaaccaaaatgatgctcaatgactgggcatgaggaaaacgagtattgctaggttgtcaaaatataacccaatacacagtaagaagtctagtaaatgttactccttggtgggcattttaacataacataaaaatttgaatcaatcaaagaaaaggttgtactcacattttcaaagcacttataaatgtcagtcaattcaaagacaaaatccacacaaaacaattagaaaccaattaagtaccattcatattttcactcacacaccaaaaaagtaagccttctggaagaatctctgcaaaattcgttatttccaatatcataagagtaacaaactgcacacatattccctttaggaaactcatcctttgttggaaagtgttcatactttgagaaagctgaatgttctaaaacgtatggttctcttccactcaggcaagctcttcatgtcaattttaccaagtttttcattctttcactaataatagcctttgatgaactcatgctctgaccaaatcctttctgacagttttgaattccatttttagccaccttttccaaactgatatcctaggtgagcagatatcaccacttaattcacctatgccttgcacttagtatatactaagtaagcgtttgttgaaattaaaatgcaatgaaaccatgcttagctccatttatcattacttactcagagcctttcctcctagattctatatcttcaaggaaactatatctgggtggactttaatctctttaaattcttcagcatcccatatactatcaagtactctatggctgcttattaaacatttttaaggataagctgttctcaaaagtacacacctgcaaaagatttataataattaaaaaaaaaatgaatggcctgggaaaagacctataatttccattacttatagtatataactttctataattttaatcaattccaacataacccattagccattacaaaactttaatagggatgctaaattgaattcatttttattatgatgagttcattcaatgacttctacaattagacatcaataagattactggtgaaagttaatgatataattggatcagtaatgataaacttcaatttccacttttactatgtatgtagattattggaaattcagataagaaatcaatcatctattaagatactctaacaatcttctatttcttaatcagaagtgacatcaaaaatgacaatatccatatttgctgaatttaaattctaagttaagaaactgcaaagcgttatcttcctttcacaggtttagtggttatttgaaagctccactttctatttgtcagtgatacatttcctcattcatccaaatactggatgatatttacaaattattattgcctctcccttcctttgtggtccttttctttctactttagtttcttttacatgtttgtacctctctcctgactcagtcatgtcaccatatgcaatctcctccatagactgactccctctactctttctttgacttttttctgcatattgctaccagattaatcctccttaaatactatttttatccagtcatttgcctggctcaaaacttataaaatatatctcaactgtcaactcccacaggctggcattcaattccctcctttatatactaaactacctttctcactctatcttcctctattcccaatctactcattcatcttcagaaatcatactttacgctcattctccagggtattttaccccttctctcaaagtcgtttgtatctccacctacaagaatcacctcagcagcacttagaaacaaactgggttctgccactgtggcatcactttaagcaagttacttaagtgttgaaaagtacaacatacctgcctttcaagttaatgtgaagattaacagataaagttatggctgtgtaattcaaatgtaagaaacacctagtaagtgctagtttctgctacacctttttcaaaactgtatctatccttcaaagcttatttttgttaactgactgattgccacttcttaactcagggcaagttttagttctattttaacttcctgaaataggcaagttcattaaaatttcctgtggcctaagaaattttctatatatggtatttacttatgcaactgcattaagagttttaaagtctttgtacatacacatttgccacactgcatattacccacttaaaaaaataatttagtggtacttgagtataagagcattagcaaaagaatatttctatgctaaaatatatacagaagtgatggttgccaggcccggtggctcacgcctgtaatcccagcactttgggaggctgatgcgggtgcatcatctgaggtcaggactttgagacctgcctggccaacctggtgaagcctcgtctctaccaaaaatacaaaaattagcggggtgtggtggcaagcgcctgtaatcccagctactctagaggctgaggcaggagaatcacttgaacccaggaagcagaggttgcagtgagccgagatcacaccattgcactccagcctgggcaacagagcaagactccatctcaaaaaaacagaagaaaaaaaaaagaaaaaaaagtgatgttttagaagaagatgttcaacaagactttcatgttcattaaatttttaaaatattgttattgtaggcatttatttcggccaaaggtttaagaacacgtgaacaaatcggcatatagcatcattttcttcaagacctatgaagaacaataactgatacatatctgatagaatgcaaggttctgctatcagaatcatgatgtttggaactgaaagggatctgcaaaaatcattatacgctcctcagttaaacaaagaaaaaaaatcactgtcaaacggtgcacatgactagtaaagtgacaaaagtgacattcaaagtcaggtagatattctgactccaagttcataactctaaatacattatgcagttttcaactcagttgctcaagtgaacaatctatagataaaacgtgagggagggagaggaaggagggaaggaaggaggaggaaggaggctttacaggtagaaaatgctcggtttctattattggtaaatagtgatactaacataatatagtgtagaatggtttaaacttggatatttaaaacaaatactgaccagaggttctctgctgccttcctcaaagaacagcattattcatagcaaaaagaaatcaatctttactccctttttccactcccagagaattattaagaaaggggaaaagatagacaaaaatatggaaccaaagcaggttcctaaatgtaactaataagaccttttattttaacacagcacattagtgtctctgtaactaagtaagacaaaaacttttctgcctaagaaactaagacaaggcattgagagggtcaagaaaggtggaaggaggttgaaatgtagagtaagtggcagctagtgacaagttcctaaaggcaacatggtcaagggacttttcaaaaaactgtctaagactacattctaaaatttttctatgctacaataaaaatcttgaaacttgcagcccactaaaaaaacaagtatgtcatttttcagtaattttttaaaaggcatggggcttaagtttgattctgtgcagtgcagagcagagggaagagacacacccaaagagctagggcaaaagtaagatgaaggccttgggaacctagccagaagtaagcttaacaatgcaagttcctgaggatctgtacagatcttgagaagaatgaaattctcctacaacaaggaataggggcttgtcaaaagacaagcctcagttgtcagctatatctaggctgcagcaggaaatgcttggttacctataaagagagcatcttagagttctaggtctcctacatgtatgcaaagatacttagtacgtctttgtctgcttcattgtttttagttttaatggaaaagcttcactatttaccccaattataaaatcgtaacattcatactaaaatttttataataaaacgagagataagactaaaattctctcctaatcttttgcttcctcctcttaatagccagcatctactgagaacttaatcacaagcactgttctatatgctctacaggtattaacaccttcagacctcacaactgtcctatggggaaggtaatatcatcaccactttccagataggaaacatccccagaaagattaatttgggttacccaagtcataaagatgtaagtggcacagcccagatacaaacccaggcagtctggctccagagcctgcattcttcaacctgatgtactgtctcttttcctgtatattgttttcagctttttctttacatagatttaaaacaaaacaaaacaaaacaatcagcctggcaaacacggcaaaaccccatctcttctaaaaatacaaaaattagccaagcatggtggtgtgtgcctgtaatcccagctactcgggaggctgaagcacgagtatcacttgaacctggggggtggaggttgcagtgagccaagacagcatcactgcactccagcctgggtgacagagtgagactctgctcaaaaacaaacaacaaaaacagaacgaaacaaaacaaaacaaaaaacccacacataaacacagacgagtccacagcaggatggagtataatctgtttttttgttaaatttctatttccacatcaacaaatccaaatcaatatcatctttcttaaggctatataacacttcactaaatgctataaggtaatttgaccaatcccatattgatgaacatttaaattctaattttttattatatgcaatattgcagtcaaacagctttgtacttacatctttactactttttggattatttccttaggacatattccttgaactggaattactgggccaaaaggtatgcacatttctaagatttttgatccatactgccaaagtgaatttcagggaggctgtactcctgccaataatagtaccatctattaagctgctgtgtctcaagtccaagttcactcttctctaccgggccttatgatgtggggctcagattctgcacacttcatttctcctgtcaggcggcttcccattcatctccaccagccgggaacacactagaggaagactagaacgtaaaggtgacaaaagaacggacttgctccttgctatctcctatcctgccactggaaccctagcattggccctttccgaggagaaacggttgtttccagtcttcagcttccttcagctctcagaactagacttcccatgcgccctcagaaagcccaacagcagcagggcaagacatctttttgagagatctgagacccaactttgtggggcctctcgctcaagtctttgaaagcaatcaggcagcgggccttcctcctaagtctgaatctcagctctgtggagcccctcctccaagcttccaataattcaaacctctttttttttttttttgtttccccagcccatggggttgtagctgattcaggaagttattaccttggtgttacttcaattttccattttgcatttcagttctccagcatctgctttatcaattccctatacatcattttctttactgaagtatctagtgtggattctatttaatatcttagcaacttggcatacctacctatcttcaggaggtcattgttacaggctaaattttgctccctgaaaaattcatatggtgaagccctaattcctcaatgtgactctatttggagagaaggcctttaacagaggtaattgaggttaaatagatcataaagctggggccctaatccaataggactggtatccttataagagaaagagaaatcaggagtgtactcgcagagaaaagctcgtgtggacacagcaaaaaggtgaccatctgcaagacaaggagagaggataaccttgccggtgccttgatttgcaacttccagtttccagaattgtaagaaaacaaatttctgttgcttaagccatttagtctacggtattctgtaataacagccctagcatactagtagtcagctagtgaaatcacctcatactattcatatcctcaatgttacctacacagaccattatctttagtatttattgtgtataaggatatttagttaggtgctagagaaacaaatatataataaaactagctccctgctgctgggtcttatgatctagttgtaaaattaagacgtgtgcattaacattacaatacaggatagcatatgctaagtaacaaacataatgaaaatattacaggtaagttgcccaaataactgattcaaattaatggttcctaaactgtataagcctgaaggattcaggaaaaaaagaagtaggagcacacttattttttaagtaactacataaagctttagtaagcaaagccctttttttagacatggattcaagcactctcaccagactctgcaaagaatgaaaagctaattcttccctctaaaaccactgacacattttgcagtctagatactcaactttataaaaaatcttgaaaataagaaccccaactttcaagatcctacattaccttctttaattcaatagactagtaaatgagatcattttttctagaaatgactattcacaatgctgatcgacagttaaaaatcactacttcggccgggtgcggtgactcacacctgtaatcccagcactttgggaggctgaggcgaacagatcacctgaggtcaggagtttgagagcagcctggccaacatggtgaaaccctatctctaataaaaatacaaaaatattagccgggtgtggtggtgtgcgcctgtagtcacagctactcaagaggctaaggcaggagaatcacttgaacctgggaggcagaggttgcaatgagccgagatcacgccattgcactccagcctgggcgacaagagtgaaactccgtctctaaaaaaaaaaaaggcactatttctgcatataaatggaatcatacagtcagtagccttgtaagtctagcttcttttgcttagcagattacatctgaaattcattcatgttaatggctgtgtcatagtttgttacttctcatcgccagtaacaatccattgtatgactaggccacagtccattccccatttgaggaacatttgaattgtttccagattttgattcttataaagccattataaatattcgtgtttaaaaaaaatcagtacttttctgtcttcaaagtcctttcagaagatattcttttctacactaccctaatgttgcccagaaacacacaaaagcatactctaagttaatattgcatcaaattaaaatttctgacttaaatatatttcatcttcaatactacctccgtaacagtataaataaagccttaagtgtttaacgagtttgaagcctgaggacagtagctttcaaaagaaaagccagtgtgataagggtggagaacatagtgacgtaatgctcaataaggaaaaccctgacaaatgcagactgcacacacacaataagagatcaggaaagcgaggctgaagcagccagcttggtttcatgctgcaaatttttggcagacattcaactccttctgctgttttcctagccagcacatttatctatgtaatgtcaccagatccagagagggagtgaggttggaaggagggggaagaggagaaaaactgttttacaggctgccagcccttccacacatgctgttactatacaaaggatgtctagaaagccaatgtgctgcacatattcaaatgctgcaagcaaatacacacacacacacacacacacacacacacacacactcactctctttctccccatccatccatccatccaaagaacaactgcagaaaagggaactgcctttgaaaaaaagcccataattaaagtcttgatccagaagcaatgactcccttctgaaaatgatttcagttcttgggggaagaaggtggggatactaaccctatggggaaataacctgtattctgcaaaaaagcctgagctgatctggtccctgacaactacaagcatatgctaccacagaaataaacaaagtttctgtgaagcaaaagtataccatcaaataacaattaccttattaatacctaatatacacccaccactttgccaaggactaggaggaataaaaacgaattttaagaaacagtttagggaccctagaagagtctagccttgtctgcacctaggacagtttcctgttcttagcactcttgtaagtaggtgtctgggagtatgttatgtgtgtgtgtgcaggtgcacatgtgtgtacacaatagtaatatcaaaaccaaaactgtacctggaatgtaaaactagagatcaaaactctatagctcatagaaacagtcaggcctatttgcttctataaatggacactccaactccgtaacatcttacgttacgtcacctcaggttgggtatcccttatctctgaaatgcttgggacaagaagtgtttcagatttcagatgttttttggattttggaatatttgcattatactcactggttgagcatcccaaatccaaaaattcaaaatcaaaaatgctccaatgagcatttcctttgagagtcatgtggacgcccaaagagtttcagactttggaactttttggatttgggatgctcaacctgtactagcaagtataataaatgaagatataaaccaggagtatttatttaacctaagaaatcagttgactgggcacagtgtcatgcctgtaatcccagcactttaggaggccgaggtgggcggatcacctgaggtcaggagttcgagaccagactggccaacgtggtgaaaccctgtttctactaaaaatacaaaaattagctgggcatggtgatgcacacctgtaatcccagctacttgggaggctgaggcacaagaatcacttgaacccgggaggcagaggttgcagtgagtcaagatcatgccactgcactccagcctggatgacagagcaagactccatctcaaaaaaaaaaaaaaaaaaaaatcagtcaacttactctaatctaaaaccaaaaatgcctttttcataatactgtatctccaaaactatcatgcaatttgcccctaagaacacgtcataagaaacaaataggaaataccgtgtgctgaaatcaggagttataaataactttattattctacaatgacacagtttatatagacaatatagaatcctcaacatagagtagtgctgagaacttccttcagattaatttaacaatcaaccaataaagtagatagtctgatgaaaggctagttctttaatcctaattctccaaatatggggaactgacttaacctgcctgggttcttcatttgtaaaatgaaaatatttgacatgactagctctaaagtctctttcagttcttaatttctaaaattatagtataaaacagggtttcttactttcaaggacctcattatctagttaaagataatcataaatgaattagtaaattatgtaagacagtgactggtccagagcagttacttaagaaatgtgtggactgagttctataaggcactaaactgagcttttaagggctgaggagtctagagaatgagagatgaagttgagttaactttaaaacacagcaaaggtttctcctgggactaggactagaaagttcattaaaatttttattgttggccgggcgcagtggctcaagcctgtaatcccagggctttgggaggccaaagcgggtggatcacgaggtcaggagattgagaacaccctgactaacatggtgaaaccccgtctctactaaaaatacaaaaaattagccgggtgtgatggcgggcgcctgtagtcccagctactcaggaggctgaggcaggagaatggcgtgaaccagggaggcggagcttgcagtgagctgagatcgtgccactgtactccagcctgggcgacagagcgagactccgtctcaaaaaaaaaaaaaaaaaaaaaaaaaatttttattgttaacttcataatcccaatcaattaattcaaattccatatagtcagtatctcattacttcattttattgataaggaaaagatactaagcatcaaggctttaactacataaaacaaacatttgcaaattctgtactacttaaccccccaaaaaaaaccctcagccaagtatggctgatatatacagagccagagagactagtaaaagattaggcagagtgtgaacatgacaggcttgatccacagacagtaactcacaaagctcccctcattaggataatccaaagctaacattttcaactccaaaaatcctagagcctaaaaactgaaaccctatccttaagtaatattttctttttttgagacagggtctcactctgtcgcccaggctggagtgcagtggcacaatcttggctcactgcaacctctgcctcctgggttcaagcgattctcctgcctcatcctcccaagtagctgggattacaggcgtgcaccaccacacccagctaagttttatatattttttgagtagagacggggtttcacgttgcccaggctggtctcgaactcctgacctcaagtgatccgcctgcctctgccttggccttccaaagtgctgggattacaggcatgagacactgcgcctggcccctcgagtgacatttttttaacactgttctcaagaacagtgccatctagtagaactttctgggatgatgaaatgttctatatctctgttgtccaatactgtaaccactagccacatgtgagctagtgggtacttgaaatgtgctagtggttatcattactttaactttaattaatttaaatttaaatagctacatgcacctaatggcaactgtactggtttagttctagaaagtctatatatagaagacattttaaaattgtaatttaaaagttggtgaataaagcaatataaaagatgaagagagcaattttttaccttgaaaatcaatttttaatgtaaactctacagtaaatgactctgcatacacagcacccctgtacaaggctggctttcataccaagtgtctcaaatcacatatcatcattcaccttttaatatcacgctctcaagttttagtttaattcgttgcggaaaatacattagtgagaacattgcatataaataactagctacatcagagagaaaatcagttagttaactacaatgtgtctctttccttgaccataaaatggggataacagtaactagatctgcagaacttgaataaaagaacaggaaccataaagtaatctgaagtaaaatattaaaaggtaatgctattagtttatatgaaaataaaaattttaaatattatcttatgctgttatcttaggaaacttcacaggaactggattcttgctgaacaaccatatacagcaccactgtgctaggtgcagataatctagtatgtaagtttaaaaagaaaaaaacaccctacataaaagaccataacaagtatcttcatggaaaaggtgacatgtgaccctgagacgactaatgggtgcatgtgggtgcattttacattcttcacaaaacctttaattttttttctgtttttccacaacatattaaacattaacatcctttgtcaggccaggtgcagtggctcatgcctgtaatctcagcatttggggaggctgaggtgggagggttgcttgagcccaggagttcaagaccagcctgggaaacatatgaagaccttgtctctacaaaaaattttaagtattagctgggcatggtgacatgcacctgtggtcccagctacataaaaggctgaggtgaaaggattacttgagcccagaaaacagaggctacagtgagccatgatcacagcacctacagcctggcgacaggacaaagccctgtctcaaaaaaaaaaaaaaaaaaaacaaaaaaaaacaaaaccacaatcctttgtaaaaagcacaggtctcattaaagaaaaagtacagatttacccaacagaaaaaaataaataaataaataaaacaggatagtcgcagtagctcacacctgtaatcgcagcactttgggaggccaaggcagaggcagatggatcacttgaggtcaggagttcaagaccagtctggcaaacattgtgaaaccctgtctctactaaaaatacaaaaattagcttggtgtggtcgcgcacgcatgtagtcccagctactctggaggctgaggcaagagaatcgcttgaacccaggaggcagaggttgcagtgagccaagatcgcaccactgcactccagcctgggtgactggtattgtcaataccatctattgacaataggccagaagactgcagatcagacactctatgtacttgttgagtaaacattgtatcagagcacagaactagtttcctatgagaaagtagaaattgggttcagattctaggacttcaactttatccataaagcaataacatttactaattagggcagatctacagaaatcttgggttgcctcaaaaagattcaagaaaacccagagctctgcctggctttcttccacacacacgtaggcaagtctcttcacgattccaaaccctcagcctcagggcgccctactgtgcaacaagtctgattatcacctccccatcactggggtatgtgagacagcccaagtttacatctgttgtcctagtacttcccttcatctcaaaagtgatctggcttgtgtaacaaatcttatggcccacaccttcactaacccagcagtcactcccagccagcattataaactgtttgtgctctactatgtgcccaaccattcttgacaccagattcttctttgcttccccagggtttcctaagcctactggcaaagaaggtcccttttcttcctctggggtcactaaaatagaaggatacgagtcctaaaacaccagcaaccatgatcccaatcatttggagaaaactcatctgagacaggaaacaatgtaatcaattcaaagagagagcagagataagaggagataatccaggcaataatctaattcccagatcagttgtccccaaaaaccaattccatccctatcattccttacagtttggtcctatgcactaacaaatcgccctttttactcaagggcttcagtcacttgcaaccccagacctaacatgccccttacatgttaatttagattatattttattttctgagaaagtctatcaaaagccagaaaagaacccaagtctaatatacctagttttagaaactcagaatgaaaagctaattcttccctctaaaaccactgacacattttgcagtctagatactcaactttataaaaaatcttgaaaataagaaccccaactttcaagttcctacattaccttctttaattcaatagactagtaaatgagaccatttgttctagaaatgagtattcacaatgctgatcgacagttaaaaatcactacttcggccgggtgcggtgactcacacctgtaatcccagcactttgggaggctgaggtgggtggatcacctgaggtcaggagttcgagactagcctgaccaacatggagaaaccccgtctctactaaaaacacagaaaaatcagctgggtgtggtgatgcatgcctgtaatcccagctacgcaggaggctgaggcaggagaatcgcttgaacccaggaagcagaggttgtggtgagctgagattgtgccattgcactccagcctgggcaacaagagtgaaactccatctcagaaaaaaaaaaaagaataagaaactcagaacaagtttgtggcaaggaaatattgaggcatacagaggattataaaagcacaaatatcttcccaattccctggagcccaaaactaactttaggaagaacagaggtgtggggaaaaaaagaagaggaaaaaaaaaaaaaaagaataacaaagaggaaatccaaccccctgaaaaagataggcaaactacttgaagagacacttcaccaaagaagatatgtacataaaacacatgaaaagatgcttcacacaaccaatcgttagggaaatgcaaattaaaatcacaatgaaataccactatctattagaacggctttttaaaatgacaatatcaagtaccagtgaggagtctgaataaatgagatactcatacatagctggtaagcatgcaaaacagtacagccactatggaaaacagcttagcagtttcttataaaagttaaacataccattaccatacaacccagcaacacacctcctaggtatctgcccaagtcaaatgaaaacctagagtagtagactgaaatcccccacagacagctcatcctaatccttcgaacctgtaaaggataattttatttgggaaaagggtcttcacaagtgtgattaaattaagaattttgagatgggggggttatcctggattatctaagcaggccatacatgttgtgacaagtgtccctagagaagcagaggaacaggtgacacacacacaaaggagaagacatgatgtgaagaggcagagatgggagtgatgctgctgctgaccacaagccaagaaatgccaagagccaccagaagctcagaatgcctgcaggggcaatgtgtccctgccaacactttgagttcagtccagaaatactaatttcagacttccgaccctcaggatagtgagggaataaatttctgctgttttaaagctatccagtttcgcaattttttacagcagccacaggaaactactgtactatattcacacaaaaacctatatatgaatgtttatagaaagcttattcataattgccaaaaactgaaaccaaatgtccctcaataggggaagagataaacaaactatggtgtacctaccacaccatggagtactactcagcaacaaaaaggaacaaactattgacaactacatggatgaatcccaaatgcatgatgccaaatgaaataagccaaacttaaaaaactatacttgattccatttatatgacagtctggaaaatgtaatattatagggagaataatagctcagtggtttgccagggttgggggagggtgatgactacaaaagtcaagtttttttttttttttagtggataatggatctttcctatatcttgattgtggtgattggttatataactctatccatttatcaaaactcataaaagtagacacagaaaagaatgcattattgcatgtaaatttatagataaataaatatagcaatacagagggaggtggctctgtcatttttctttctttctttttttttttttttagatggagtctcgctctgttgccaggctggagtgcagtggcgcgatcttggctcactgcaacctccgcctcccgggttcaagcgattctcctgtctcagccgcgcatgccaccaaacccagctaatttttgtattttttagtagagttggggtttcaccatgttggccaggatggtctccatctcttgacctcatgatccacccgccttggcctcccaaagtgctgggattacaggcgtaagccaccacgcccggccttggctctgctttttttcaattacaaatgctcatgcacacatatgtatggtcacttctgtattcatcagcatttaaacacaatatatggggttccttgctcctatcctaaccaagattaatggtccttctataattttcattcaaaactgtccttgatatttacttatttattaacctattttatctaaacagagggtggtttactttctaaaaagatcactccactgactgcagatttaaagggacaagaacagaagcaaggagttcaattaggaggcaagaacaatgacttagtcaagagggaagtaaaaagtgctagattctggatatacaacagagcagggtttggcaaactgtttgtaaagaccagacagtaaatatattcagttctgaggtcacagggtctctgttaaaaccactcaagtctgccgcggtaccgtgaaagaagccttggacaacacagaaacgaaaacaagtgtggctgtgctccaatacaactttacttatggacactgaaatctgaattacatatgatttgcatgtgtttgaaatattattttaatatttttcaaccatttagaattgttaaaaaaaaaacatttttagctcatgaactataaagaggtgggggccataatttgctaacccctgttctaaggggcagagccaaaaggatttgctactgtactagacgtgatgtgtgagaaaagagatgccagatatgctattaaagttaactatgcttttgctacagttaattttcataccaaactgttccatacacagtacaaagcaaaagaatttctgggccatactctgtaatcagctattataagccattcacaatcatctatacccatactatatatatccaaggccaaactccacagaaaaatcaattgaagataaaataccagttaaatgaaccacatttttggcttgagatcaagaggctatgctctcttttaaaacacacacgcagaaatgcctcaggcaaccagtttcttaaaacacatagataattaagtcaacaaatataccttcaatccactgtatgatcaataaggggcagcaggttacagcaataagacaaggacagatcggggggctaaagagaagcaaggaaaataagaaaacagaaaaagattaaatggggctcggaggacagcatattagcacttttttaataaataaaggaagaaattcagagatattactcaactagaataagtgacctcatatacaagggaggtagaaactgaagtagaagctggagcagtatgtgatccaatgaaatacttcggtacatgcagttattacatgtagttacaggttcaggattacttgaaatacttcggtacatgcagttattaaatgtagttacaggttcaggattacgctaggaaaggatagattatgggttcagttctctaaggagctgagaaatcactgtccataactgttcaactactcctcatctttaagcctccagaaacactatttcaaatgggataaccagtgcatgaagggagatagtaaggcagaagagaggagaacaatataacagagtaggctataatgtcaaagtcagaggttgtctgccaatgttatccacaaaaacttctcaaagctcacaagtaatatgtccaatgtggtctcatgccccttctgtgctaaaaagaatccggactaccaagctggcagccctatgctacagtaagcagagttgcaatctatagccagatcccttcaacatggatgagctggggggaaagcagaactaggaagccaagaggacagacagataaggaggtaactatgcaaacaactttccagataccacgacagcacttaaaagcagatcctatacaaagtctttcttgccttaagttcagaatacaaattactgccactcataaaacagcatttgcctgtgggcaatacaaagatgtaagagacactgaacacttaccttcaaggcgcttacaaattagtgatctagaaagcttttgctgccaaaccacaacctcctatacagtcgtataaatttcaatgtatagataaatttcaactcctggcatatgtactattctatcctttcagcagagaaacaggtaataaagggtgagctaaatatgtatgttgaaggatatttttcatttgaaaatttaggttttcaaaaagcattttgatttcataattttgtagtaaccatctttttgtcccatgcaatgctatgaacaactgagctgaacatcaatttatctattcctactgcaataagccaaaacagccaaaaaatctgacgttcacacagggatttaaaaatagcaaagtttgctcatgcatatagacacactctagacatagacttttccaattgaaacagactagctcatttttccccttgaagtaactcccacagacattttaatgcaaatgcagatgaggcaaagactcttaactcccattaaataaccaaaaggcaaggtaccaggacatcagagccccagaaactgcacgttaacagcagtgcttcccaaacaggtcttaagggaggcaagagatgagggaagggaggttgtcctcccttacacaaataagttaagttagcaaagttaaacaggtgtagaggtgggaattccacagttccttcgctatgtttatgtgaaatatgaatatgtaccatttgctatgcttattctgccttggaatccactgttctctgaacacattcaggaactgcgtgccaaggaagcaatttgagaaacacaactctcttcttactgttttaaaattactattaaatgcaggcaatataaaaattaatagcaaagttcatttcaattagttaaacctttcccttataacaaatttgcacacaatgtatattctaacagttgttttcaaaataatatatttatatttggtatatccaaggatatttgtataatcatatttgaaaaaccatcatgaagtacacaaaacacttaacatgtccacataaacataaaacaggttgagagattaacagttgtaaatacaaaagtcaaactgtaatatccataaaataagggtcaaagagaactgtaatgtgagaacaactaaatctactgtttaaaaaagggggacatatatgatacagagatatacaagtagatggctttactataaagagaggagggagatagaagaaatttttctccaagggtagcacttacaggtcaaaactttgttcttaattagaaaaataaaattttatcagccttcacatttttaaagatactaaaaacttaacaaacacagtttttcaaaatatattttatatattactaaactatccaaatgactctggatctctgagggatgcaaaaaaaaattagcactacatacacttttattttccccaaatttttatcaatatctcttcaatagtttaagccactacttcaataaaaagatactctcaacacttgtttagatacttgatagagactacttattagttttctaataaatatataaaaaatttaaaagacagtatgctgtgaaaataaggaagctgtcagccttacagtggactcatctgaggacagattatctatgtatctctatcactggcacatagtaataagcactccactaatttaaagggttactgaatgaatcccccgcacgttgtcaggttgacagcattgagatagtagaagtctgggctattcattcatttgttcaattaatatttcaaaccactatgagccaggccccttgagagacactgaaaaataaacaaaaaagcagcctttgcctttaattctagtaggacaggcagataaatgaacagactatcataatacagggagaaaaacgtcatagtatcagtatgcctaatggaccatgagaatatatttgtttataaaggaagggagtcatggcaccaaagcagagaggtagtagtgggtaagtcaaagaggcttaaaagatgaatattcgctatttttgtttttgtttgttggggtggggggatctaaaggaatgaatttgcagacagaaatatatgtataaaaatgttaagacagtgtggtgccaacaagggactacagtgtgctggaaggcagagggttaagaagagcatggcaagagatgaagttgcaataaaggcaaggaagcccgaaccttgtccaaaagacaatagaaacccactccacttgcacttgaggattctgaacactgggaggacatattttagagatagcactcagacaaaagtagagagggaagctctcaaagtacagagctagagtctgctaaataataagctccacgagggcagggaggttgatccatctgtttactgctgaactcaccgcacttagaagtacctatcatgtgtcaccacttatttattgaatgactaaagggaaaccatctgaaagacaactacaataacccaagaaagaaaagacgagggcatgaaccaaggcaaaatgagacagatataggaggcatgactaaagctgccaaagagcaattactttatattttttgcttgtcagtatttaatgtcacctttcctttctactaatacaactcaaagagactaacagtattgtaaattctaagctctgtaaagaaattccaagttagtttaactacagagctacaaaaatgtcacagaaaattgttcctagtggcaatattaaagaaataaaaattattaggccaggcacggtggctcacacctgtaatccttgcactttgggaggctgaggtgggcggatcacctgtggtcaggagttcaaacccagtctctactaaaatacaaaaattagccaggtgtggtggcacatgcctgttaattccagctacttgagaggctgaagtaggagaatcgcttgaacccaggaggtggaggctgcagtaagccgagattgtgccactgcactccagcctgggcaacaagagcaaaactatctcaaaagagtaaataaataaataaaaattatttaatttacagtcagacctatgaatagctactaaccatctctgttaaggccagaaaattatatgtatcaacacttcctaagtattaaaaacacatagaacaggctgggcgaggtggctcatgcctgtaatcccaacactttgagaggccgaggtggatggatcacctgaggtcagaagttcgagacccgcctggccaacatggtgaaaccccatctctactaaaattacaaaattagctgggcgtggtggccacccctataatcccagctactcgggaggctgaggccggagaatagcctgaactggggaggcagaggttgcagtgagccaagatcgcaccactgcactccagcctggcgacagagcgagactctgcctcaaattaaaaaaaaacaaaaacaaacaaacaaaaaaaccatgtagaacaagttgttcggtgcttaaactgaaacggatgaatttaacttaaattcctaaccaagaggcaacagcatctggttaatcaatgaatgttagagaataaattctccacacaaaaaggcaacatatcagcatttagggaaagtcatttgatctcatctgtaaaaataagggtttgaatttaaagaagtcctaagacttttagttctacaactaaatgatatttttacctgtttgagatacctctattgagaggccttacattggtttgcatgttattttgaaagtgttcctctttatttttatatacaactccaagaaaattttaagattcttatgtgccaggaacatttttttcctcaatttccttcagtacattagtatattgctcaattttaagattcttatgtgccaggaacatttttttcctcagtttccttcagtacattagtaaactgcactgcaggcaggtcagaagagaagaaaagtaacatctatagaaggctcactattttctagtgctatactagttgctatcaaatatagtgtgttttttataattttcaaaagtatgttgcagtatcattatcccatgaagaaactgagggcaaagaggttaactactctgccaaattcacacgagttaagtgatgaaaccaaaaggtaaactccagagcccaaattatattcattaccctaaatgatggtaactgattgagtatccagggatgtcctcttctggtctggggattacacagttttcaatattgtccagaaaaagcaatttacagatatgcttcactgcatacctatactcaaattctataactccttctatgtatcatggtttctttcccccatataatagaagggaaaaatgggcatttgtgcagctctttaggagttctaactaaagttccaagcaatagaccttaacccttttttttcctccaatgatatacaagacaaatgacaatcacatgtataatatattctcaggggtatccttaggtatataaacaactaatgttccaagatagcatattcaaatgcaaatgaatcagtgatgcagtgatgttatcaatgtaattaccttctttttttaaataaatcattcctttaaactattttcatatcttataagtgaagagtgatatgctgccaatctagaactatagcctgcaagccaaatccagtctaccacctggttttgtaaataaagtctttctggaacacacaatcatttacatgttacctggttcgcagacttgagtaatcagcagagactgtatggcccgcaaagcctaaaatatttactaccctgccttttatttacagaaagagtttgccaacaaccattctagactgatatccaatgaatatcccccattctacgtctattgggaacctagatgtcacggtatcagataaactaggttcactgtcttcataaatctgtcaaaaagcaatttttgtgcttaagattatcagctccctggactttcccatcaccagttacatatactttgttgttatttctttggcttccccacttgcctgacagcagactatctacccagcatccctagtaaccccagtacctagcatagtgtcagggacatagacgttcagcagaaatctgctgaatgaatgtctgaaaataagcatatgatttaagataattactcaagagtaaaagatgggttagtgctacagaaacgtgctactcaaaactgtgttttgtgcagcactgtaatactggggagctttttaaaaatgcaaaatctcagacctcaccaaaaatctggaacttcattttagcaaaatccccaaaggaaaacttgagaagcagtgctatacaacacagtgcttaattacattacagtcactagtttcattcctaatatgaaccaggccactttgcatggggaaaaaacagctctgtaacttgatccttaccctaatcttgagctttcaagatataaaataaagacttattttaacaacttaacaatggggggggtactctgcttgttgttgttgttgttgttttttatgaggaagtttgctgtccttgttactgttcttttattgaggaaagagagatatactgttacttccaaatagggccaaactgagggggaataggaatattgtttaaatattttgcctttcccaaaggaatatgatccaaaaaatccatcctaatttaaatagattataaaacgtgacaaatggttttatgttatctgtctacttctatgtcatattaaaatttatgtgttcatgaaaatttcaaatggtcttaaaatgtgatggcaatattttgtgagttaacaaactgatactttgttttgtcttgttttactggagaaaagagaaggaagtcagcactatttcttgctctctatttttgaaacaggctaaaaaaccactgcaacaatgacatgatcaggctaaacacaatctttaaaaaggtaaggttgctttatgaattttgtaatttaggtactattataatactatccctcttttacagaaaaggaaactgaagctcatggagaattaagtaatttaaagatcaaataacaagtaaatggtgagactggaatctctgctcttaatactcttaactcaagtcctaaactaatgagaatttgtgttgtaaaaaactcagggagtactttagaccaggcacagtggcacacacctgtaatcccagcactttgggaggccaaggcaggtagattgtttgaagccaggagttcaagaccagcctggccaacgtggagaaaccccatctctactaaaaatacaaaaattaggctggctaattagacacctgtagtcccagctactctgcagattgaagtacaagaatcgcttgaacctgggaggcagaggctgcagtgagcagagatcgtgccactgcactctaacctgaacagagtaagactctgtctcaaaaacaaaacaaaacaaaacaaaactcagttaatacttttaattattgcacaagtttaacaatttcagtttatctcaactccaaatgtgtatttttctcttttaatgactctaccagcatctacattctaatatactacggcaaatcgtttgacctctatgagccttcaacacagacaatcttctttaaagagttgctgtgatctaaatataatacctagcatataatatgtattcaaaattatacaggttttcaaatacaggtactacataatgggcacttaaaaagactgacaaacctatcagtatcaaacctgatactgtatcaggtttgtaaaatactgtacgtaaaaagttacactgtggtaaggttaacagaaatttatcaggtcactgctttcaaatcagacccagcaaaaaaacctagatatttctaaagcaacatagtaacagtttaaaaaaaaaaatttgattacctctaagaactgtacattttttttggaaaatcagggttaaaacagcctaacagtacaaatacaaattagatgttgtctttggtcattaggctggaagagcaaactcccctgtgagtgaaagcatgtagtcaaaagtgggtaacgatttttcacttgtcagactgccaaaaataaaaaaatttacagtgtgttgcaaagggtatagggaagcagttactctcacatactggtgatgactctctatggagaaaaatacaggaatatcaaaattataacgccataacactctttaacccaataattccacttctagggacttataagtgaaatgatatacaaatgaggttattaatgcagcactatttgtcatcacaaaaaaaattagaaacaaatgtccattaacaaggggctacatataaaaatgtataaattatgatacactcatacaatgaaacattactaagcctaatgtactgatatgaaacatcctttaagatacagtcatgtgtcgcttaatgatggggattcatgctgagaaatatgtcattagacaatttcatcattgtgcaacatcataaagtgtacttacacatacctagactgtatagcttactacacacctaggctatatggtataggctacagctcctagctacaaacctgtacaacatgttactatactgaatattgaaggcaattgtaacacaatggtaagattttgagtatctaaacatagaaaaggaacagtaaaaatacaatatataagatttttttaaattagtacacctgtatggggcacttaccacaaatggagcttgcaggactagaagttgccccaagaaagtcagtgaatgagtggtgagtgaacacaaaagcctagcacattactatacactaatacaaactttataaacactgaacacctaggctacactaaatttggaaaaaaatttctatcttcaataatgttaaccttaccacaatgtaactttttacattataaactttttaatttcttttactttaaaaattcttttgtaataacacttcactcaaaacacacattgtacagtacagctgtacaaatatatttacttttttttttaagacagggtcacactctgttgcccaggctggagtgcagtggcatgatcttggctcactgcagcctcaaccttccaggctcaagtgatcctcccacctcagcctcccaagtagctgggactataggcgcgcgccaccatgtccagctaatttttgtatttttgtaaagacggggttttgtcatgttgcccaagttggttgcaaactcctgggctccagtgatccacctgccttggcctcccaaactgctgcgactacaggtgtgagccaccacgcccagcctacttactttatatccttattctacaaacttttctctatccaaaaaaaaaaaaaaaaattttcttttactttttgttaagcattaaaaaacaaacattaaacattagcctaagcctacacagggtcaggatcatcaatatcactgtattccactgtccccatctttccccactggaaagtggggtgataccacatatggagctgtcatctcctgtggtaacaatgccttcttttggaatacttcctgagggacctgtctgggactgttttaccgtaaactctttttaataagaaggagtacactctaaaataatgataacaactataataaatacataaagcagtaacaggtagttgcttataatcaagtattatgtagtatacataatagtatgtgctaagctctcataagactggcagcacaggtttacaccaatatcaccacaaacatgctgagtagtgcacactatgtacactataatgtctatgacatcactaggtgtagaaactgttcagcgccactgtaataatttttaatatattcataattgtacatctttatgaggtacacgtgatattttgatacctgcatacaatgcgtaatgatcaaatcagggtatttaggatatccatcacctcaaacatttatcatttgtgttggttaacacttgaaatcttctaactattttgaaatatgcaatatattgctgttaactacagttaccccactaagcaatgaaattagaacttattccttctaactgtatgtttgtacccattaacctctcttcatccaccccacccctcgcccatctcagactttggtaactatcattctattctctacctccatgagtcaactgtttttactcccacatataagtgagaacgtgacagctgtcattctgtggctggcttatatcatttaaaataatggctttcagttccatccgtgttgctgcaaatgatagagtttcattcttttttgatagctgagtagtattccatggtgtgtatatatacatatacatttataaaattttctttatccatttaacaactcatagatacttaggttgattccatatcttggctattgtgaatggtgttgcaataaatatgggggtataagtatccctttgatatgctgattctccttcctttagataaacacctaatagtggaactgctggatcatatggcaattctactttcagtttttgagaaatctccatactgttctccataatggctgtactaatttacattctcacaacgatgtataagagttcccttttctccctatcctcaccagcacttattttttgtctttttgacaacagccattctaacaaggtagaatggtatcttattatagttttgatttgtatttcccagatgattagtgatgctgaggtttttttttgttttgttttgtttttgagatggagtttccctcttgttgcccaggctggagtgcagtggcatgatctcggctcactgcaacctccacctcccaggttcaagtgattctccagcctcagccttccgagtagctgggattacaggtgcccaccaccatgcctggctaattttttgtatttttagtagagacggggtttcgccatgttgggtaggctggtctcgaactcctacacctcaggtgatccgccctcctcagcctcccaaagtgctgggattacaggtgtgagccactgcacttttggctgggcatttttttatacacctgttggccatttgtatgtattcttttgagaaatgtctattcagatcctttgccaacttgttaataggattatttggttttcttgtctttgagttgagttccttgtacattctagatattagtcccttgttggatgaatagtttgcaaatattttctcccaatctacaggttgtctcttcattctgctgattgttttctttgttgggcagtagctccttagtttaatatattcccatttgtctattgtttgtttttgttatccatgctttcgaggtcttaaccataaaatctttgcctgtatcaatgtccttaagctttcttgttttcttgtagcttcttgtcttatgttttcttcaagtagttttacagtttcagaccttacatttaagtctttaatccattctgagctgacttttgcataaagtgagaaataggggtctagtttcattcttctgcttatggacatccagctttcccagcatcatttattaaagagattgtcctttcaccagtgtatgctcttggcacctttactgaaacagttggctgtaaatacatggatttatttctgagttctctattctgtcccagtggtctgtctgtttttataccaataccttgctgaattggttactacagctttgtaatatattttcaagtcaagtagtgtgatgcccccagctttgttctttttgatcaggattgctttggctactcagggtcttttgtggttccgtaaaaattttaggattgttttttctatttctgtgaacaatgttgatggtatttttatggggattacatttaatctgtagattgctttgggtaatatggtcatttcaacaacagtaattcttccaatccatgaacaggggatgtcttcccatttgtttgtgtcctccaatttttttttaatcactgttacagtttcccttatagaggtcttccacctccttggttaaatttataactaggttttgtgtgattgtcttggtagctttgtaagtgggattgctttatttttccattcttttgttattggtgtatggaaacactactgatttttgtatgttgattttgtatcctgcaactttattgaatttgtgttatcagttctaaaagtttttttgtagagccttcatgtttttctacatatgagatcatgttgtctgcaaagagggacaatctgacttcctcttttccaatctggatgccttttttttctttctcttgcctgaatgctccggttgggatttccagtactacgctgaatacgagttgtgagagtgggtaaccttgccttattccaattcttagagaaaaggctttcagcttttccccacttagtataacgttagctgtgggtttgtcatggatggcccttattaatgttgaagtatgctccttttatgcctaatttgttgagaggttttatcatgaaaagatgttgaattttatcaaatgctttttctgcatctattgaaattatcaagatatttgtccactctattgatgcaatgtatcacatttattgatttgcataggttgaacatgaacatatttgaatatgcatccctaggataaaccccaattaatcatggtgtgttatctttttgattgttgctggattgtttggattgtctatcagtattttgttgaggatttttgcatgtatgttcatcaggactattggcctgtagttttcttttgttgttgttgttgtattcttatctggatttggtattgggataatgctggccttgtagagtgagttaggaagaattccctcctctttaattttttggaatagtttgagaaaaactggtgttagttcttcttcttaagtttggtaaaattcagcaggtagaattgagaggaaagccatctggtcctaggcttttctctttttggaaactttttatttctgattcaattgtgttactcattattgggtgttcaggtattgtttcttcctgattcaattttggtaggttgtacgtgtccagtaatgtatccatttcctctggttttccaatttgttagcatacagttgttcataatagttgctgacgatcctttgtacttctgtggtatcagttgtaatgtctcctttttcatttctaatttatttgggtcttctctcttttttcttggtttgcctcgctagcagtttatcaattttgtctttttaaaaaacttttcattttgttgattctttgtattttttcagtttctattttatttctgctcctgcctttattatttctttctttctactaatttgaggatttagtttgttcttaacttttctagttccctgaggtgcagcattaggtagtttatgtgatatctttctacttttttaatggaggcacttattggctgtaaacttccctcttaactctgcttttgctatatcccatttgttgtaagaaattttttttatttcattcttagtatcttcattgacccagtgattgttcgggagcatgctgtttaatttccttgtatttatatagtttccaaagttcctcttcttctggatatctagttttattccattttggtctaagaaaatacatgatatgattttggttttaaaaaatttgttgagacttgtttggtctatcctagagaatgatccatgtgctgatgagaagaatgtgtattctctggctgctggataaaatgttctgtaaataccagtcaggtccatttggtgtaaagtgtggtttaaatccacagtttttgctgattttctgcacagctgacctgcccaattctgagcgtgaagtgttgaagtccccaactattaccatattggagttgttctctccctttagatctaataacatttgctttatgtatctgggtgctcctatattgggtgcgtatatatttaccattgttatatcctcttgctgtactgatccctttatcactatgtaatgacccatgttatctctttttgcagttttcgacttaatgtccactttatctaatagaagtatagtactcctaatcacttttggtttccatttgcataaaatatcttgttccatcccttcactttcggtctatatgtcttcataggtgaagtaagtttcttgtaggcagtatataattgggtcttaaaaaaaatcagtttatctacatattttaagtgtggaatttaatctgattcaagattattattgacagctgaagacttatcctgtattttgttaaccttctggttgttttgtgtatccttgttcctttcttcctctctcattggttgtcactgcagtttggtaatttcctgtggtaatatttgggtcctttctctttttcatttgtatgtctgctcttctagtgagttttatgtatttgcatgttttcatggcggtacatattgccctttcactttcagatttagaactcccttaagcatttcttgtagggccatctagtgttgataaattcccttgatttttttcttatctgggaaagaatttatttatctttcattctaaaaagacagctttgttaggtgtagtattcttggccagtagtttcattcttccagtattttgaatatatcatcccattctctcctggcctataagatttctgctgttagtctgatggggcttcccttatattgtgattcactgctttcctcctgctatttttagaattctctgtctttgtgacagtttgactataatgtgccatggagaacaccttatggactgaatctattttgaaatcttttagttttctaaatctgtatgtctgtatcttttgtaagattcgaaaacttttcagttattatttcagtaataattctatgcctttgcccctctattcttctggaatacccaacactcaaatatttggtcacattatggtgtccctcccatatgtcacatatgctttcttatttttttgtatgacaattatttcaaaagatctgtcttcaaattcagatgtcctttcttctgcttgatctagtctatagttaaaagcactcacagttgtagtttttttttgtttttttttttttgaaacaggttctcactctgttgcccagactggagtgcagtggcatgatcacagttcaagagacaggggtctcaccatgttgcccaggctgatctcaaactcctgggttcaagcgatcctcccgccttggtctcccaaaatgctgggattgattacaggcatgagccaccatgaccacctcaattatagcttttatttcattagttgaattcttcagttctacaatttctgtttcttgtttatgttatctgttaaatttctcattcagatcatgaattatttttctgatttctttacattgtgtacccttgtatttcactgagcttctttaatattattttgaactgtttctcaggcatttttctttttttccactggactctttctggagaattaatatgctctgcactgctgggtccagctggcattgtgatgctgcagccctctggatggacacaggaacatgtcatcagagcactacggatatggagattcaagggcaattgggcgccagagaaagatgtggtctaataggggctggactgtcaaaatggcaccctgctgcagctcattgggtctcggacaagggggctccaggcagctccctattttcctattctagtatcagggcccatgaaggccaagaagctctcctgaggccagattacaggagtccatggtgggaacacagatcactggggatctgtctcttacctgttctccacactggggactttctcccggctccaagccaatcccagccaggccagctgttcacttccctctcttcctgtgcctcagaggttcctcatcctttccgtgtttaatttcagtgttctctcttaaatgctgcattcaaaatgtgattatctactggctgttttggtccacctttgtggagaaggtgaatgttggggtcctctagtcacccatctttaagcctccttaatttcacctctctccattaaaattttattttattttattattattttttttttgagacacagttttgttctgtcacccaggctggagtgcagtggcgggatcttggttcaccgcaaactctgcctcccaggttccagtgatactcgtgcctcagcttctcaaggagctgggattacagaagcctgccaccacacctgacaaattttttgttgttgttgttgtatttttagtagagacagggtttcaccatgttggtcaggctggacttgaactcctgacctcaagtgatctgcttgcctcagtctcacaaagtgctggaattacaggggttaaccactgtgctccgcctctccgttaaaatcttatgggacaacttttgtatatgtggtctactgttgactgcaacattgttatgaagtgcatgagcatatattgttaagtggtgagaaaaaaaaagtaagatgcaaaagagtatgttaaggtatgctgccaaatgcaaaaaaaaaaaaggggggggggacaggagaaatgtatacataaagtgatcatttgtatacacatacaatcatttcaaaaggtacaaaagaaacatacagctcaccggctgcctcccagaggggagccaagtagctagggaataagacttagaataatacttttcacagaattctcgtttttgtactttttgaattttacacagtgatgaatacattacctattcagaaaagtgtttttaacttttaaaaatattatatgggtaatacaaaacaaatactatcttgaaggaagtggcaaatggtacttttcagctgaggtatcaagcatttctagaatacatctgataccctattttctccttttcatctagaggctataaattttgagaggataaagagagctgaataatttttttaatcaacctaatttctatcatcccccttctagttcaaacatgatggtttcaattataaaaacactctatgggcatcgttagaaagtgctgcaagctggatccaaagatgaataatacctatgatttgataaatggtttcacagatctatgaaataaatattgaaggagcattcactttttttttttttttttttttttttttttggagacggagtctagctctgtcgcccaggctgaagtgcagtggtgtgatcttggctcaccgcaacctccacctcccgggttcaagcaattctccctgcctcagcctcccaagtagctgggattacagacacccatcatcacaactggctaatttttgtatttttagtagagatagggttttgtcatgttggccaggctggtcttgaactcctgacctcaggtgatccacccacctcagcctcccaaagtcctaggattacaggcgtgagccaccatgcctggtcgtactttttttttttttgagacggagtctcactctatcgcccaggctagaatgcagtggcccgatctcagctcactgcaagcttcacctcccgggttcacgccgttctcctgcctcagcctcccgagtagctgggactacaggcgcctgccaccatgcctggctaattttctgtatttttagtagagacagggttttgccgtgttagccaggagtacttgttttttaatgcttgtcattttcatgaactgtagtcttgcacaacaggcagcttgatgtggctcaaggagtactaagattgaacagacctaggctctagttccatttattaccttaactatataattctgactaagtaaaacttggcaatcatagcacctggactgcctatcttttgtacctatgtacaaaattgttatatcaaaaaatatatgtatgtgaaagcaaaattcttcaatatctgaaatatttcaatattaccatccatataaagttttaggggaacagattttatttccctttttccttcttctctaggtttgtcccgattggctaaagttatgagaaacaaaactgtatttttatcagtcttctttcaaagttaataaattatgaagacaacccatttgcaaagcaatcaaagagagcaaaaggtgagtttttattttactaaaaattatataaagtctcaaaaagacaaaagcaaatattcagtagcaaattaatagttggagcttacacagcacattaacgaatgccacgttactcttacaatggagggctaatgagaacaggaagtgggatggcatcaacaagagcaaaaagagccaatacacagtgaggctaaaaaagtgacaacagttgtggctggcacactggctgccttcagccttcctaatgatatgctttctcaatggtctaatgcttatttaaaaccttggctttttttttttttttttttttttttgagatggagtcttgctctgttgcccaggctggagtgcagtggtggtcatctcagctcacggcaaactctgcctcccaggttcaagtgattcttctgcctcagcctccaagtagctgggattacaggcacctaccaccacactcggctaatttttgtatttttagtagagacgttcaccatgttggccagggtggtctcgaactcctgacctcatgatctgcctgtctcggcctcccaaagtgctgggattacaggcgtgagccactgtgcctggccaaaccttggctattcttactcaataagagtaatgtgtttacctctgtcaccactgatgtgttcctggccctgtggaataattttcagacaaaacaaatccttttttctgctttaaaaggcagtaagtaaaaagatgtatcctgctggcttggaagttaccctatcacaccataaccatctactcaaagtgtgatatcaagtatgaaaactgctttaaaaatacagaagcatataaaatgcaatgtttgctgggaagggtgatgtcttcgaaaccgagagctaagttagacatgtgatttttaaaattcatatccaattaaacagttactatgtgcatacaatgttttgcttctaggcctttgtacatgctgttcccttttcaggaactactctctttcccaccgcacccatttgcttccccacttcactaacttcacatgtgacttcctctgaacagacttccctgactttttccaccccctcctctgtgtttccacagtgctctattttacttcatcagagcacttatcaccatgtgtatttattacagagacgatgtctgctttacctactctgtcactcctaatcactgtgccggcccctggaagatgcttaatacatatgaaacaacccaaacaaaacagttaaaaattttttaattaaaaaaattaaaaataaacaaaacaatcagatactgccagatagatggaaatacaaagacgaaaaacaagaacctaaattcactaataggagacaggctaaaaaagtactatgtaaaatggtctatgatgcaagtgtgtacggacatatgcagcatggagattaagacaggtcttgaagtcagcctgggagcagggtgggtgataaggaggaagaaacagaaagaaacttgactaaactaagtctgcaaggttgaagagctaatttatgaggaagaaaaaatggataacaatcattccagacaggagaaaaatataggggcaagggaaaacaagatagatctgaggaactgcagggagactgatgcagtacaatggctctcgaactcaagcgtgcatcagaatcgcctggaggacttactaacatacgggttgcaaagccccaaattcagtttctgattgaataggcctgaaatatggctcaagaatctgcattttaaacaagtttttgggggatactattgctggtgctgtcctctacatccacactttgagaactggtacagtggaacacagagggcattatgaagaagtggcaattgacaagtttggagcaacgcacgggaatgggttacaactcatatatactatatcgcagaatttggtactgaaggattttaagcagagaagtttaattttagaaagatggtaataacagttaacatttatggagcacttatgtgctaaacactatttctaaggactttacatattctgtactgtccattatagcagctactagccacatgtggctatttcaattaaattataactaaataaaatttaaaattcagctcctcactcaactggccatattgcaagagctcaatagctacacatggctctggctatcacagagggcagtacagatatagaacatttccatcattgcacaaagttctgtcagcccagatgtatattaactcattaaattctcacaacttcactatgagataagcactgtattatccccattttatagaagaaaatgtggcaaagaatggttaagcaaattacccaaggtcataaagcaagtagtcccagtgtgggatagaaagcccagatggtctggtctttgcgcttgtgttcttaatcatttcttagtaagatcattttggcaataatgtggactagacgaagatgatactggaggaaggaaaatcaatgaagaaactactaaggtaatcaggagagaaatgatgaggacctgctctaacagaggacctcgaatacagaagaggttaaataagagatgttaaaaagtgtaagagagaagacatgggatggaatagaactgaatccaaaagacagacaagtgaggtatggaagatgacaccaaagtttccattttaagcatcagaatcgatggcaatggctcttaccactgtaagaaatgacagccggttaaaggaagttgataaattccatctgagccattgtgaatctgaagagactgacataaaatactacacaatggaatatacaagtccagagatcagaagagagctctcaaattaagatatgaaattagagtcatcagtaaagaacacagaggtctagaaataactcaggaaagttatctctagataactctctagaaaacagtaagaaatgagtgaagaacagaaccttagggaatccaacatctagatacaggcaaaagataaaacgccaataaactgaaaaggaattaccagaaagatgggaggaagggggagacatctaagaattatcccagaggaaagggaagaatggtcaacaaatgctaaatgcagctgagaactcaggtaaaataagactgaaaactgtccacaagagcagtttcaaatagtgctgctctagggccaaaagccagattgcagcagacgtggaatgaatatagacttttttcaagaagtttaaaaatgaatggaaacagacagggtatacatagaaagaaggatctgcagtggttttttggttgtttttactctaacgggagagtcttctgcctgctaaggactaaaaagtgagcgagaaagatgatagagtcaaaaaatgggactatttttgatggcacacggcccctgaggtagcagagaatggggtcctgaaaaagaatggagagatgagcctttcacacttctttcactgtcctatgacaaggtagcaaagcgggcagaaataagcacagatgtatttaggatggcatgagaggggtataaactcaatgagctcaattggacagattccattatctctatgatgtagcatatgggagtatctactgaaaatgagaaaaaaaggtgggaagaaatactgaatttctgcagacagaacagactatacacagacatacatcttcaagcagagggcagagctcagattggaggccacaaatttgtaagtggcatcccaccacatggtcatgagattttccccaaagttaaagcagagaggttgggcacgatggctcatgcctgtaatcccagcactttgggaggccaaggtgggcagatcacctgaggtcaggagttcaagaccagcctagccaacatgatgaaaccccgtctccactaaaaaaatacaaaaattagccaggggtggtagcaggcacctgtaatcccagctgcttgggaggctgaggcagaagaatcgcttgaacccaggagatggaggttgcagtgagcagagatcgcaccactgcactccagcctgggtgacagagcaagactccaactcaaaaaaaaaaggagaaggtggtaaatggctggagtttgccaacatgatgcaggagtagtgagtgagtgagaatgtgccataaggccaagcaatgagaacagcattagagtgatggcagggcacctgtcggaatcatgcaggtaactttctcgcaactatataccacacaagatcttcttgagataaagcagtgagggtaaggagaaagaaaggtggaagattagagtagttatagccagggaggacaataaaacagaatgtacatttccagaagtacactgtcctgggtccaaagtgtgttcatgagggtgtgtgtgaagcatgctatttcatcatttgtttgaatgtcaattatgaggttaaaaagtacctgcttcttctgtcttctgactctcttagccagtccccactacagagatgttggttctaagcattagagcaatggttctcaaccccagctgcacatcagataaacattcttaaaaaaataaaaaataaaaaaaactgaaacctgggcctcactactagtcaaatttaattagtttggtatttattttttaagcttcctcaggtaatgctaaagtgaatttagtgccaagtaccactgctttccaaagaataaggctttggatttatgttacagaattaaagaaaaactgagtggcatggaaaaaagtaaggcaggaaaatggtgaaagagggtttaaatagtaagttagatatttaaagatgccctgaatagaaaaattgggaaactattaaagtacagaatcacactccacacacaaaaatagtaataatgtttctgagagttctgttaaaggttctagaaaactcaggagttaaatgcttcactgtacccaatgactaagaaaaaaggaacctagactttactaagctcaaagaattaaaaaccaacacttagcagctcttcaggtcaactacagttcacaattccctggaggaaaacgcagcccatagtacaagtctgacaacacctctagatctgcggaatcacctattctacataaaaggtaaacggcaaaagaagcaactatcttctttaacacattgaaagctttttttttttttttggctgccagattttatttccacaccagttatcttcttcttaacaagttacacctataatcttaaaatcgcccagttattttacaaacatctgtcctcaatcttaatctttatttgccactatcctaatgtacttgctaagttttacagcaaagcagaagtgatgcagagatgaagtgttagtcataaagaccaataaagacaaaaaatgatgtgctgtctgcggtcttccccacacggtctgtttacaagtaacattacaaatctctcaagctcctcccagacactatgtttatagaagtgctagactatacacttttggtccacccatatttaatgtctttggtaaaaattacttcattaattaatagaaaggtttgtaccttgctatctctagctcagtctcaagaattttaaattctaaccaatgatccaagtcactcagaggtcatttgtgttgcagacctactgaaaattagacttacctttaaatggactttttttcccaaaactcaaggagtactttttcttccagcattaaggtagctcaacatgttccccttctaatatttagccaacaacataagaaaaccttgattcctctaacttgggccataagaaagcagtcttttcccaaaaagttgtttcaaaactctaacaagagtgtatagctattttcacacactgaaatagcagatttatatatttgtggtttacgataccaccaatattctctagacaaggtttattctatggtttccattaaggaagagaattctaactaaattattttaggctcactgctctctaatactataaagcagtactacagcataatgaaaaaagcacaaaattgagaagggcctgaccaattcttccagatggtattaactggctgtgtggcactggacaagacacttcaacctctttggctctcaaatttccctattatttgtgaaatcagattagaatcactgtgatccaagattgctactggctgaacattctacacaatgcagaagatacaagtctttttttctaataatctatgtttcgtaagcataatacaattcaaccataaaagatacctcaatcaacactacagccagacttacttttccttagcagtctttttttttctttaaattgctgacagttaaaaactattttgacccagaatggcatactactataatctctatgcttaatttcaactcctaataaaatagtgccacactacaaatggtttcttcacctgttccctaatgaagttgaaaataattccttggccttgaatttacagatacatgtacagggctgatgaaagccatctgctgggaactatgactttcatatgaaaggaaaaaaccagaaggaactgctttcattttcctgggaaccagctgcagctgaatgagtcctaatcctgctccagctgggacaagcagaagggtgaagttactcctggtctaattcattcgctgcagatcctttgtgaaatgactccacccctgagtagccaagtggtaaataactttatcagagtgaagctcttaataattcctatacataaatcagagcatgaaaagtattcattattataattttaagaaacactctccaggtcaccagaaaaaaataaatttttaattctatttaaaccagcaaactccgcacctagatttagtcctcttacatagctaagaaccaagtcagtatgacaaagatattttctccaaaactttaaatgcaaagagaaaataaatctaatagatgttaaggagattcttacagcttcaggaagactgaatgatataaattttctttccagattcatcacagttcctgttatgtatttgctctcctagtattaaacataacaaaaaagtattggcccacaagtccaggatgaactaaagaaaaaacaggcagcaagggtaaaaagaaatttaatgtattttgcatttccttatattcattttccatttggttttctataagacataatgaaaacttgtattattattattaatttttgtttttttttgagacggagtctcactctgtcacccaggctggagtgcagtagcgcaatctcggctcactgcaagctccacctcccgggttcacgccattctcctgccttagcctcccaagtagctgggactacaggcgcccaccacaatgcctggctaatattttttttttttcttttgtattttttagtggagacgggctttcaccacgttagccaggatggtctcgatctcctgacctcgagatccgcctgcctcggcttcccaaagtgctgggattataggcgtgagccaccgcgccctgccgaaaatttgtatgattaaatactattaaatacctattatataaatatattatgcctataaaatttaatcatatagaattcttttgagacttcaataagaaagtacatgttaaaacacttaaaaaaaaaagtccctaacacatcatcagcccttaacaaatgttagctattaataggtttctataagcaactctttacgttcccttagcctattgatacagagcaaagaaaaaacgaggttaagaccattagaacctctggatttctattcctgaagccatttgtggtacccgatgtcttcattaattccttccctttatttcaccaattggaaggtagaccaagaaagagtaaagtacttattcgctagaaaaatgtctaggttgtaagcataagaaaaattggtggctgggcatggtggctcacacctgtaatcccagcactttgggaggccaaggcgggtggatcacctgaggtcaggagttcgagaccagcctggccaacgtggcaaaaccctgtctctactaaaaatacaaaaaattagccaggcgtggtggcgggtgcatgtaaacccagctactcgggaggctgaggcaggagaatcgcctgaacccaggaggcggaggctgcagtgagccgagatcgcaccattgcactccagcctaagtgacaagagcaagactctgtctcaaaaaaaaaaaaaaaaaaaaaaaaagaaagaaagaaagaaaagaaaaattggtttggtatagaactttggattagtaatggctaacccaagctttagtagctcagtagctttatttcgaggtatgtcatgcactgaaaattaccaaaaatcattgtgctcataggtgaaccagaagatcaaaaaaatctgcacagttggccaggtacagtggctcacacctataatcccagcactttgggaagccaatcaggagtttgagattcgtctggccaacacagtgaagccccatctttactaaaaatacaaaaattagccaggcatggtggcgcatgcctgtaatcccagctatttgggagactgaggcaggagaatcacttgaacctgggaggcagaggttgcagtgagccaaggttgcgccactgcactccagtctgggcaagagtgagattccgtctcaaaaaaaaaaaaaaaaaaaaactgtgcagctgattgtacttaaacagatactattttacaaacatatctctgagttatttttaaatttctgaatttttgaagaataaatctgctaagacaaaattaattcctaaccagatttacaattaatccacctcaatgacttgttagtaacaaatttttatttctaggccactgctcctggtacatttggagtcacaaacaaatggtataaacaatgatgtcagaaatgtacggcatgggccgggcatggtggctgacgcctgtaatcctagcactttgggaggcggaggtgggcggatcacctgaggtcaggagttcgagaacacaactggccaacatggtgaaaccccatttctattaaaaatacaaaaattaggtaggtatggtggcacacgcctgtaatcgcagacagcaggaggggagaggcagtagaattgcttcaacctggaaggcggaggttgcagtgagctgaaactgggccaccgcactccagcctaagcaacagagcaagactccatctcaaaaaaaaaaaagaaaagaaatgcatgtcataaaaaatgtttaaattattaaatataacaattactgagatcaatccatttcacacttgataatagctacattttccacgtcactgtatcctcaatattttatcttttgccttcagaagattttttgttttttttgtttttccaaagtgaacaatcattctgtcaagcagtccacatagccctgaatttaatagcatggacaactatttattgcctttttatacagtatcaacgcaacagagtaattgaaattgaaatttccaagcttatattggttaacaattttcttataaaataccaccattctaacatataaaatgtgcaactattctactataaaggtcatttccaaatagctaaatcaaaacttcatcactcttaactttcagtaacttaaaaacatatccctggccgggcacggtggctcacgcctataatcccagcactctgggaggccgaggcaggcggatcatgaggtcaggagttcgagaccagcctggccaacctggtgaaaccccatctctactaaaaatataaaaattagccgggcatggtggcatgcgcctataatcccagcttactcgggaggctgaggcaggagaatcgcttgaacccaggaggtggaggttgcaccactgcactccagcctgggcaacaaagcaagactccatctctcaaaaaaaaaaaaaaaatccccattttaatcagtatctctacatcgaaaatttaaattctaaattcctgtcaaagctctacttcctctataatttaaaatataaattccaataaaacaaaataatttggactctactaagagttgaccaaattgagatgtaacttagagtagaaggcaagagatttatcattggatctttctgctccaggttacccagctgggagtaacctgaacaataacattagttgacaatacctactcttccctgtccaactgaacgctttagcaaattataattctgttccaaaatactatgccaccaaataacaatacttttaatgatctggctgattaccatgaaagagaatatttttctgggctagtaatacagaacacaaactatatatattcaagtaaattatgtcagtgtgtaaaaatgaactcagaagtttgaaatcaaggtgaaaactattcttgaaaggaaattgaatctttccaagactcactatataaagataattttttaaatggaccatcacagtctcaaataattgccttgcccactaaacatattattatttctgagtcatgatacttaattgttatgaaaaaataataatgtaaaaaaattacagttcataaactaaaaaaggctttcaaaaaatttattttgtatctctattctgtctgctttaatcccctcacaggacctaaatcttaaatccactgttcatggcaggcattcaaatgtttgctaaataaataatgaataactgaagtaaatggaacaaattaccttacagtaatatctatatttcaaaaagaaatttacaaagaggaagatgctatttaagccagttacacactcttctcctcacctataatcccatgattcaaggaaaacagtatttctgtcccaaattaaagcactctggtatagcaatacaactgatccctaccttgcctatcagaaaatgttagtgacaactgaaatgaaaattagttagcacagaaattatctttaagggaaaaaaatggcatgtaggtgaaacttttttttaatggacctcagatatacaaaactagattactcctaatctttggttcctaacacattcttatcactggtccaaagtgaattttcaaatctgttctgcaaaaaaagaaaaatggacacaatgaagacgggcgggaatttgtcctttaacaattaggaaatgtgctatgaagttaacaccaaggacattcacgattctgtacttgagtgcagtgatagccatcatacattactgctcctaagaggtggtcagtatggctattacaaagactctggagccagactgcccaaattcaaatcccagctctgccacctaatatttgtgtgacttcagcaagttactgaaatctcttttatgcctcagtttcttcacctgtaaaataacagtagctatttcactgctggtactgttatgttattaataactaactaacctaacagtagctagttatgttagaggattaaatgagttaatatatatacagcattaaaataacgcctggcacatagtaaataaacactttaataaataaactcaccattaactaccacactctaaagttagctcaaaaatttcccttataacatgggtaaaaacttttttttttttttttttttgagatggagtcttgctctgttgcccaggctggagtgcagtggcacaatctaggctcgctacaacctccgcctcctgggttcaagcgattatcctgcctcagcctaccgagtagctgggattacaggcacccaccatcatgccgggctgatttttgtattctgtagagatggggtttcaccatattggccaggctggtcctgaactcctgacctcaggtgatccacccccccctcggcatcccaaagtgctgggattacaggcctgagccaccaggcctggcctaaaaacttttaatcacagtatcccatggattctcctcagtacttatcaatgtgaaaagaacacactaaagttccaatgtcttcacaaaaactcctcttaaacgtattccaacacagttgatctcccaaaaggatcaaaaccactcagctgccgaaaatctaacatacagttccttccaaaggttaatatcaccaaaaaaaaacaaaaagttagaattgataccagaaaaagtaaagaggaacttgctcgggttactccacgcagtctttgaatttcatcttcaccttacagttggccaggtcaatagaaatacctgcattagcatcccagagaagacagaactgtttctgttccaagcagagtgcctggcccacagtaggtgctcaatgactatatgctgaaccaattaattcctaaaagtgaaactactcctgacctatacaccttcctttctccatcactgtcaaataaactctggataattcttttctttttttgagaacatctaggttcgtaacagcaaactatcaattctgcatagcaactgactgcgtagttcgaaggagaggaaagaaaatagttaaaatacaataaaaggagcagacataatctgttcaaaggaataatctctcatcctagagttcactgtattacgatttttaatgtaaacttttcatatctttgggggaagtcacacaggaaattcactactgaaaataagactccatttaaaaatatagaacagagctcaccaactctaattgaatagatactatcatgaaattagttttccaatgagattagtacatatacaagtctacctgaagaaacaaactctattttccaacatgtctaaatttagttacttcagttaacactataggcagggtggctcatgcctgtaatgccagcactttgggaggccaaggtgggcggatcacctgaggttgggagttcgagatgagcctgaccaacagggagaaaccccgtctctactaaaaatacaaaattagccaggcatggtggtcagcatgcctgtaatcccagctacatgggaggctgagaaggaagaattgcttgaacctgggcagcggaggctgcagtaagccaagatcgtgccactgcactccagcctgggcaacaagagcgaaattccatctcaaaaaaaaaaaaaaaacaaaaaaacactatatatgaaagctatgtaagcaaatgggcatttctttttcattttttcaattattaaatcacttttgtttttcttgctttatttctccaaaatcaaatgtggccaggtgcggtggatcattcctataatcttggcactttgagagaccgaggtgggcaggtcgcttgaggtcaggagttgagaccagcctagccaacatggtgaaaccctgtctctactaaaaatacaaaaaaaaaaaaaaaaaagtagccacacgtggtggcgcaaacctataatcccagctactcaggaggttgaggcagaagaatcgcttgaacccgggaggcgaaggttgcagtgagctgagatcacaccactgcactccagtcaaagcaaaacagcacatctctactgaattaaacttttcttaatgcaaaggtgctatgaaatggtctcaacaaaggtccttagctcagctgcaaaataaggacttggattagacggttctcagggtcccttccaaaagtaaaatctcagggttctaggacttggatttgtcttgcactgtactatatttactaccttttaaaaatatgctcaaatgacatttttatatagctaatattttttaaaattatctattgataattcaagcaagtgtaattacaataaaagcaaacaacaggccaggcacggtggctcaagcctgtaatcccaacactttgggaggcagaggcgggtggatcactcgaggtcaggagttcgagaccagcctggccaacaaggtgaaaccccgtctctactaaaaatacaaaaattagccgggcgtggtggtgcatgtctgtaatcccagctacttgggaggctgaggcaagagaatcgcttgaacctgggaggcggaggttgcagtgagactgcaccactgcactccagcctgggtgacagaacgagattctgtctcaaaaataaataaataaaagcaaacaggtggcctaacaggaacttataacatccaattcacaggtatggcactgaactgatctaactataaattatttcctgtttccaggcagttaacctgttagatcatttaataattgtagaaatccgataactgtatttaaattcagccacatgtgataaagtttctacaggtaagagttcttacagcacttaaatatagaataaagcattttaattacttgtctaccctgaatttttaatatatacttttaataaatgctcaaattacatagagccattttatgaatgagattctctatcaattcatgactgtatgagaatcatttcaagggtaataacagtaagattatgttttatttcaatgttcacagggaaaattgaaccctgaaatagatctctaaaaatttcatcaaagaaaaataccgttaattttcaattgttaaagaaaaatctacaggtattcagtgggctgctaataatacaacaaattgagatcaaatctccaattttcaaaatacattcaatgttaactttaccatctttccaccctaggagtatcctccatcatcttaagcaaaatgaagatcattttacttatgtctaccaaggtgtgcagcaacttaaagcatcactgctctccaaggaactataattcagagcaccttaagtaaatttacagctaagatactaggtcaatgtaaaaaacaggtactaacaaaattctcctaatctccaaatatctatttaagcaccaaaatttactgtttaagaagtcataatttcaactatatacaataacatcctaaaacacaacagagtaaagtacacatctgggcatcaaaactcccaactctccagaactttacctttctttttgtttttagaacagggtctcagttgtccaggctggagtgcagtggtgacagcatagctcactggagcctcagacacctgtactcaagcaatcctccccgacacagcctcccaagtagctaggactacaggcgcgcccatacctggctaatttttctatttttggtggacgtggggtctcgctatattgctcaggctgggctcaaactcctaggctcaagacatcctcctgtcccagcctcccaaagcgctgggattacaggcatgaactactgttccagaccctccagaacttttctagtttaggatactgtattcctgtcccatgcaactacagctgtcataaatagcatttaggacttcatcatatgcaaagccataatacatgacagaaagctataatacaaacagcagaaacaagaattgctaagtttgcttagttgcgcctatgggtcatgagaatctgtctcatttctgtctaacgagtaatctgcaacaaaatggaaaacagaaaaatgttctcagagtcatctgcttgtttcaaattcaagtctccatgatttggctgctcatcaacttccagtagtaaggtgttctaagaacctttagttaaagttttaaagtctcacgctggagtactcctcaagcaaaataataaaaaaaaatttaaaaaaaagttttaaactcatatgtcactttttcattgtaatgtaaataagttcttttagtcagattaacattctacatttttaatcttaggcttcaaatatttcaaagtaccagaacaaatctatgaagctctcatagctacaactcaccaataaaaaaccagaggtgatcactccacagaagtccccaaacaaaaaacttgaatataacttcccagaaatgtgaatttgtagcatcctatatcatcagctctataaaccccgaagcatatgccattcttaccttatccttttcatgtggaagaagggacactggaggtaaacaggaaagagactcacaactctctttcccatccacgttggttgctttagtgttgagccgataaagaggtccatctttaaggagtctgccgtggccaatggcacgtttgatagccaatcgtaactgctggtgaaagccagaggcagcactgcctccgaataatgcagacacatccttctgacctttcaaaaaacgttcaatgcttttcaaagttgagccaccagactctgccaagccctcaactgcccgctttatcagtttattccaatccacattttgtttattatccaattttccatggttccgaggcttaggaagtgctattcgcccaggattatcaggatctttataggaattgagtcctttatttgagacttttaaaattgttccatctttaacactcaactccaattgttctaaaacagttttacgatccaagccatgggatgaagacacagcattgcatatcctttcttctgaaggacgctgtttctgctttttcacttttttgatggcctccaaaatccactcagtataaagcgggtttgcgagttttaccatggtgaaggattctgtatatccatagagtcgttatcccttatcctgatgctgagtaagttttacaccatggaaaacaagattctcggaggctgggaaccagttaaccatagcatatgagttttctggcctaagtccttcctcctttcacaaaacagaatgccaccccaattgtactatagaaaccaaaacaacctgttgattgaaatgtcttccaacttcccaatgaatttctcaatagcaccacacatgggtctcgtcataaagttgtaagaactcaagaatatttcattcccggctccagagcagaaaaatgtgcatcttatgcctgaaaagcaatgaaaataaggtcagttttctaccaagacctatttcgaatgaaaataagcatcctcatcataaagcaatcaaacagcaagtgtttactaggcacccttaagaatttccaaacttatctattaatattccaaaacaatcatgtatgtaaaccattgggataaaaaagaaaaaaaaagaaaagaaaaaaaaaagatgagtaattaggatacaatgaggaaacacgatgacatgttctaagaatgacctttaagctaccactaaccagagtgggtgatggctattctgtactccgcaatctctgctcaccagtctaggaatttcaactcttccttgacatctttccccaagaaactagtcagcacttcaacaagtatctggattagtagaaagaatcctgcaatgaaagtaaaagtgaatctttcatctttcaaaattctagacattcagagtagacaaaaacagtcaataaggcagaaaacgactgagaaaattttagttcttacatgaaaagaatgaatacaatatgcacacccagtttataatttaagtacagtattaccttaatctctcctaatggaaacaaaaatactattgaaaatagcctagagtaaaagtgcttactgaatttaacaataatccactttcattcaaattttaagaattacatgctgatagcttctcctaacccaaactaagatgtttctattcatatgctgaagagagtcacaactgtcaaactgcgtgtaagtaattcagacaggaaaactagaaatgaggaaggcccagaatcactggggtcaacgcacatactacatatcaaacggacggtacagaaaaagaaatacactggctacttgtaggactaaagagaagcccaaataataaagatataaattcaagattgctgtcctgaaacgaacattaataaaacataaacagaaatgtactgtctctctgaatcaaagtcagtatccctataaaagaatctggtagatgcaatcttgtttaatcactaaagtactgaattctgaatctaactcttttgcctccaaaaataagtttaactgaagtgttttttagaacttctgctctcattctggagatcatttgcattacaatataaacaatgctagacaaatggctcccacagcaactattcttggtagtgacattaaaatcaaacggaaaactaatacacactaggaaagagatattactattaactctgataggaaagaaaagagtgaagcaaacattcaaacctgagccaagatttgtttttaaatcagctgcctaaaaagaagccccctgggagaatcatgcttcaatttggtgagggtctcaagaggatagaaatcagagtatcattactccaagtaagctcattatacagatattaagtctaaactaaatgagaagctacatcctgagtttaacaagctgggaacgaacgtcctaattgactaagcttcgcaggtaaaagaatgagtgacagtcactcattgtctttccagtcgggattgtcatcagtctccaggtcttcggaaagtcaagcgcctgcagcctcggatcttaactcccggaaagtacacgagcggctagagcgagcgcaactcgcttccgacagtccttcccgtccccattccccacccctaaacacgtcttcgcgctctcttttcaaagagcgagaaactttaaaaacttggatctgcacagcccggcagctcgccgacggggcgctgcaccgtttccacgcgatggaaacagaccccgagcacaagttaacaatgaaatcacgtgaaggagttcagagcggtgcatagccccggcccagctccgcaccctaagctctgggggccggctcgagggcggcgcgggttgctgggagcctgacagtcgcgcaccgggccaagccgcgaggttgacaggcgcccggcctcccctcggcggctgggctgacagcccggcagacacaacaccacacgtgctgcgcctcgcaccacaacacccgccggcctgtcagccccgctcgccgcctcagccccgctcggatccccgcgcccccggccggagccaaagccggagccggaacccgagcccgagcccgaacccgagcgcccgcgagcgcggggagaagcggcccggcccggcacagccggcacgcgcgcggcgggcgggtgggcgcgccccgagggagagcgggctcgccggctccgccagcccgaggctccgcggcctgggccgctcgccgcccgcccacccgccggctcccccagggcgggcccggccggcgggatcgggggcgcggggcccgcgagcgcggggccgggcggcggcgcgcgggccgcgggccggggcagccgggcgccgaacaagcgagcaagcgagcgagcgagcgggcgggcgcgagggggcggccacggcgccccagcccgaggcctggcgcagagcagcgggaggcggcgcaggccgcggcggggcctgcagcggcccgccgaccccgcgaggcagcggagtgggccctggagcggctcggcctcgggctgggcggccgggggcggccgggaacggcccctcggctacttaccgggaggaaggacagccgagatcccggggccccgggccggaccgcggagatgccccaaactgacacggccgccatcttggagacagtgagctccagccggggggaggggaggcaaggcggcggaac

SEQ ID NO: 28 - DNA, 22190 bp, Homo Sapiens
ggcaagtcatatgcgcccttaagcattcctgcttttggtccaagcttcctgcgtgggaatactgcggtcctcctttcaggcagctgtgaatgacaaacggtcgctggctgccgtgacacccattgtcccgcgagagtgccctagctgggccccagtgcactcgaggcggtccctgctcgggtgcccctcccacaggcaggcgccgttgccgaccaaacgcccaggttcacccaacgccagaggctcgtcctcaattcccgcgaggcccccggaggtgctggggtccctgcagggccgggccacctgccgtggagctcaggccgcgccagaatcggatccgggaagctgcgcgccatgagcagctccctgcggccgggccccagccgctggcggcgggcggccagcatcgtcctggcggctggctggtcgcgcccggagaccgccaccccgccgtcgcgcccgccgccggccgagggcttccggctgctgctgctgcagcgctccccgcaccaaggcttcatgccgggcgcgcacgtcttctccggcggagtgctggatgcggccgaccgctcggcggactggctgggcctcttcgcgccgcaccacgggccgccgcgcttcggcctgggcccggcgccattcagccgcaccgctttcccgtcgctgcccgacaccgatgaccacaagaccgacaacactgggacgctgcctgaggacgtagccttccgcatctgcgccgtgcgggaggcctttgaggaggcgggcgtgctgctgctgcggcccaggacttccccaccaggcccagcacccgggcctggcctcgccctggagccaccgccgggcctggcctcctggcgcgaccgcgtgcgccaggacccgcgccacttcctgcggctgtgcgcccacctcgactgcacacccgacatctgggcgctgcacaactggagcgcctggctcacccctttcttgcggggcaccactcgccgctttgacacggccttcttcctgtgctgcctgcgcgagccgccgcccgtctaccccgacttggcggaggtggtgggctaccaggtaaggcctgctcagggccttgctgcggaccgccaggacgtgagagggaggacccctcccagcggcccaggcccccaagggacccccgcataggccaagcccagagagattaagcagcaaggaacgcttagacgggctggaaactctcacccctgtagaccaaagccatgctcttggtgaagtgctctctgctttcctaggctttggggtctcaaggcctggagcctgtctctccacgtggttcctccagcgtggccactgtgtaagcacttgtacatgtgtagacatagtacatctccacagccgtttaatttggttttcttggagaacagacttaatatgatccagtcttcctatttttatttatttttggtacagatgggggtcttgtctctctgtgttgcacacccaggctcgtctccagctcctggtgtgtccagaattggttccttccagtgggttcttggtctcgctgactttaagaataaagccgcggaccctcgaagtgagtgttacagttcttaaagatggtgtgtccagtttcttccttcagatgttcagatgtgtctggagtttcttccttctggtaggttcgtggtctcgctgacttcaggattgaagccgcagaccttcgcagtgagtgttacagctcttaaaggtggtgcgtcaggagttgtttgttcctcttggtgggtttgtggtctcgctggcttcaggagcgaagctgcagacatttgtggtcagtgttacagcttataaaggtagtgcggacccaaggagtgagcagcagcaagatttattgcaaagagcaaaagaacaaacctcccacagcggaaggggatcagagcaggttgggtgctggtggctgggtggccagcttttattcccttatttggccctgcccatgtcctgctgattggtccattttgcagagtgctgattggtccatttttacagagtgcggattggtgcgtttacaaatctttagctagacagagcactgattggtgcgtttttacatagtactgattggtgcatttacaaacctttagctagacacagagcactgattggtgcgtttttacagagtgctgattggtgcatttacaaatctttagctagacagaaaagttctccaagtccccactggacccaggaagtccaggggcttcacctctcaatcccgcctctaaacagggcaccccatctgctgttgggaattgggcaatgactgctctagctacttcctgctggacaggggcaaagaaggggccctgcagttgtagtgtcctccagaggggaactctctaggccagtgaaagggccagtgggtcggtccaggggtcctcggtagaagttgttagttgagctcatttgggtttccgtttgtaagaccatctgtagtttgatggccttgattctagaggaaacaaatttgacaaggaggttaaaaatacagggcccgaaggcgagtaatagtaaaacggctgtcacaggatgtagaaaggggagaagccatgttgcccaactccagaggttggtataagagtttgaaaggcgttgtctgatttcagaaaccttttcctgtaaatgccgggcggcatcttgcactatccctgacttgttagtgtaaaaacaacactcttcccctaaggtgcaaagtcctcctttctcagcagtgaggaggtctaggcctcgggggttttggagagtcactgctgccagagtctatttgggattgtagttactatccttactgaatagattttgttatttcttgcaaactgtctgagaaatactttgagagtgtgtggtagtaagataatgaagtagataaactggctattccggttcctgtagcagtggccatttctagccctataagtaggggtatcagttgtatggccctgtgctgatggacttgagctttgaggggcactgatagggtctgatgtccataagattagaagttaggataatatgtgttacactgttaacttttagcaaactttacttttgttgaaaaccttaagtttgggatttcaattattctttgctattaataagacctcgttcagtccatattcacttaaaattggtatagatggctccttcctgattctgtaagtactttaaggtttggctgagtgcaaacagcttgcacatttgagcagaccaattattaggcaattttcctaactctgcttctgtaagagtttccttatcacgtactgagtacccattgtgtctttttccttaatcgcccaggaggaaacatctatcatcctgtcctgaagggggttcctcctatgtctggtcagaccttcagatttagatcccctgttaggaacctgctgggttaaggatttttgataggaaggctacaggttgtcagtggcctcagtgcttttgggctatgcccttgtttacactgacaacaaggtggtattggagtgttacagggttacagagaagaccttcaattatcaattgtaggttttatttttcatttttatttttttggagatggagtcttgccctgtcacccaggctggagtgcagtggcatgatctaggctcaccgcaacctctgcttcccgggttcaagcaattctcctgcctcagcctctggagtagctggaattacaggcgcccgccaccacacctggctaatttttgtatttttagtagagacggggtttcaccatgttggccaagttggtctcaaactcctgacctcatgatctgcccgccttggcctcccaaagtgctgggattacaggcatgaattatatattttaaatttaccctggcttttaaaggaatagggtgcactgttttttctttactacttctatctctttctctctgactcctttgtctcttcctctctttccttctgtctttgactttgcctctttctctctgctggtctttccctgcctctgccagccgcttatgctgccgttctcccttctccttcccctttttgatggcttcggcagtgtaagactgccacctccttgggtttttgcattgagtgcaataactccatgatttccttgtggtatttaatgggggttcccccagaggttaggaacgctctttctttacatattgcagcatgggcatgtaggattagataagcatacttgctatctgtatacacgttttttcttttttcctttcccagttctaaggctcgggtaagtgccactagttctgctaactgggtgctggtccctgggggaagaggtttactttcaagtacggttacatcactaactgtggcataacctgcccttcgtatcccattttccacaaatgaacttccatcggtatataggttaaggtcaggattagctaacgggacttctaagagatcctttcaggcggcataagtctggactactacctgttggcagccatgcttgacccgctccctatcctctgggagaaaagtggcagggctgagggccacacatgtatgcacttgaagcactggtcactcaaggagtagtgcctggtatctaagcaggtggttttctgatagccataaacttcctttggcacctagtttgccatttacatcatgagtagtccagacagtgagatcctttccttgtattattttgatagcctctgacactaagacagccactgccacaactacccctaaacagttagtctagccttttgctactgtatcagtttccttaggtatgccactggttgtggagttgtcccatgagtctgagtaaggaccccaagagctattcctgctctctctgtgacgtttaaagaaaagtttcgtcctgtgggaaggcttaaggctagagcttgagtttgttccttccaatgcccagacttcagggttgattccctccccaagcaggggacaacaaatgggtaacttgttccccatattcatgtagataatagctccagctttggctaatatatccctccctaataagggtgtgggactttcaggcataacaagaaaggcatgtgaaaggagcaaagtctcccaattacaactgaggaggtgggagaaatacctggttacagcctgtcccaggattcctcggatggtaacagaccttgaggacagctccaagacaggaaattaacactgagaaagccacgccagtgtccaggaggaagtcaatttcctggccctcaatggttatacatacccaggactcagtgagagtgatgacatgagctggtgctttccctgggcaccctcagtcttgttgcatcatctggttggtggcttctgtcccagagaacctttgtcctctggggcagtgtgtcttccagtgattgcctcggcatagtggacatgggcgagggggcagcttgtttctcataggacaatcttttttttaaaaagtgtccttgtaaaccacactgataacaagccctaccaggtgattggcctgctccattctctgtcccctctgaaccaccaaggtttgtttgtctgagggccatgactaagtctgcggcctttctattatctcacttttacttttgggcctgtccatcttggtccctattatagaacactgaggttgccaggtttaataatgcttccagagtttgttcagggcccagggctcgcttttggagctttctcctgatatccacagatgattgggtaataaacttgtcttttaggatcaattgaccctcaagtgagtcgggtgacaggggagtgtattttcttaaggcctcccgtagctgctcgtggaaggcagaagcattttcttcctttccctgagttatggtggacatcattgaataattcatgggctttttcctaatactccttagtccttctagaacacaagtcagcagatgtttacgactccagtccccatgatctgagtcgaggtcccagtggggatccatactgacttactgacatacggcttgctgactagtaaggaatttgtccctttcttcaactgtcattctatcatttactggactaagataccaggtatctccaaactcttgggctgcagctaaagccacattcttttcattaaaggccagggtttgatctaacactagcatgacatctctccaagtgagatagaaggtttgccctcgaccctgtaggacatctgtatacctatcaagatcatctgaaagcttcccaaggtctgccttgatctgcttaaaatcagagagggagaagggaacatgtacctaggttgggccaaattccgctccccctacagcttgaaggggacataaccgatagcccgggaagggggcgtttgtgatcctttggagatttctttgcttatttccttctgggcagcggacattagaggaggattatcattaataggaaggggagctatagggaggctaggatatggaggtaagctgagaggtcctcctgtgggatgtaaattgcaagctttgcatacttgggtattctccttcaatgaaaagaaaacttagacataaggtatttcactccatttgccttccctcttacagaaaaggtcaggctgcaggatagtactgtagtttatacttccctcaggtggccatttttccccatcagagagagaaattggggccaggctgtagtatagaaaaaaatgagccacctctttttcagggtttgtgggtcaaattggtcccagtggcttaggatgcatttcaagggtgagcctgttgatgcctgagtgtttcccatctgaaagacaaaaccgcctgtggttttggtttgtttgtttctccccctgcccaagaacctgcaacggtccctggaccctgctgatcggaatagttgtgctcaccaatgcagcagcagaaacacctcttgcccaagaacctgcaacagtccccggaccctgctgattggagtagttgtgctcaccaacgcagcagcagaaacaacccctgcccaagaacccgcaacagtccctggaccctgctgatcagaatggttgtgctcactgacacagcagcagaaacactagttctcctagaccacaaggaggaatgaggaaggtcagatttcgtggcccttaccaacacattctcgaaaacctgcgccctttcctgtcctcctagacctcaaagaggactgagaaaaatcagatttagtggcccttactgatgcattcttggaaaactgttggagtcctaagcattctcctgttagtattgggaccttacccatgtcctataaagatgttatgcccccaaaatgaagtggagggccataccctgagggagggaagggatctccagagttggaagagtgaagccttttatccccagttatatgaataggaaggatacaatttctgaggctcccgatatcctagtttcaggaatagcttttgttaggcctgcttttctgaggagggattctaaaattccagataatcccccctacgatggggctttgagcaaaaactgtgtctttctgattggtgagcccgggtgtctaaagaaggtaacagagtcctgaagtttatcctagaaatcattcttacaggagaaactagaaaagcaccagagatggagtggtttttagaagtgggactagcctcaaagaaaggcgagaggaagtttgtctgacaggcattaggacccaggaggcaagggtcaggatagataggatagatgggtgagtctcgcctgtgcgacgtgactttcagagttccattcatggctgcagggtcaaccaacttgttgtcgggaccccggagctgaatggctttcctcgctgtcgaccctcggctcagcccagaagtacaggaaaagcagaagctggttccaggcaaaccaacgctccccactccgaagagtcgggggttgttagccctttcccagaaagcctgacacccgtgtctttagttcagcagccacactagtcgcttttaactggccaacatgtccccatatttagctctcaaattctaaggaaaaataggacagaatagcaagcgaaaggggtccaaaggcactcaccgcttagtgataggtaatagtcccttcgtggtcaccaaaatgtgtccagaattggttccttctggtgggttcttggtttcgctgacttcaagaatgaagctgcagacccttgcggtgagtgttacagttcttaaagatggtgtgtctggagtttgttccttcagatattcagatgtgtccggagtttctttcgttgggttcgtggtctcactgactttaggagtgaagccacagacctttgcagtgagtgttacagctcttaaaggtggcatgtctggagttgtttgttcctcctggtgcgttcctggtctcgctggcttggagtgaagctgcagaccttcgcggtgagtgttacagctcataaaggtagtgtaaacccaaagagtgagcagcagcaagatttattgcgaagagcaaaagaacagagcttccacagcatggaaagggacccgagcgggttgctgctgctggcttgggtggccagcttttattcccttatttggccctgcccacatcctgctgattggtccattttacagagcgctgattggtccattttacagagtgctgagtggtccattttacacagtgctgattggtccgtttttacagagtgctaattggtgtatttacaaacctttagctagacacagagtgctgattggtgcgtttttacagagtactgattggtgcgtttacaaaccttgagctagacacagagtgctgattggtgcatttttacagagtgctgattggtgcatttacaaacctttagctagacagaaaagttctccaagtccccactcgacccaggaagtccagctggcttcacctctcactgggctgaagtgattctcgtctcagcttcccgggtagctgggcccacaggcacctgcaaccacgcttggctaattgttttattttttgtagagaccggatctcactatgttgctcagggaggtcttgaactcctggcctcaagcgaccgtccagcttcagcctcccaaagtcttggggattattggcataagctactgtgcctggccagtttcagtcttttaaaatttattggccagtacagtgactgatacctataatctcagcattttgggagaagaaggccagaggatcaattgagctcaagaactcaagacctgcctggactgtaacatactaagacctcatatctagaaaaaattttaaaacttagctgggcatggtggtacatgcctgtggttcctgttactgaggaagctgaggtgagaggatcccttgagcctgggaggttgaggctgcagtgagctatgatcacaccactgcacttcagcctggacaacagagtcaggccctttctcaaaaaaaaaaaaaaattattgagacttgttttatggccatgaatatgttctatcttggtgaatgttccctttgcacctaagaagaatatgtattctgctatttgttggtattttggtaaaaatgtaaaattaggttgagttgttcatagcatcttgcaggttttttttttttttttttttttttgaaacagagtcttgctctgtcacccaggctggaatgcagtggtctgatcttggctcactgaaacctctgcctcccaggttcaagcgattctccttcctcagtctcccaagcagctgggattacgggcgcctgccaccatgcctagctaatttttgtatttttagtagggacgggtttcactgggttggtcaggccaactcctgacctcaggtgatccacctgtctgggcctcccaaagtgctgggattacaggcgtgagccactgtgcctggccagtcttgcaagtcttctatatcatttccttgtttcatcaggtgctgagagaggaatgtggaaatcttcaactaataattgtggagttgtctttttcaccttttagttctatcagatttggcttcatgtattttgaagctcccatgtaaggtactgactgtatctacatttaggacttttaaaagttcatggattaactctttgatgattatgaaatatccttctttattcctggttataatctttattctgaaatctgaagtttactctgtttgatattaatatagcccctctgactttcttttgattcatgttagtatatttttctatccttttaaactatctgtgtctttattatttaaagtgtgtttctggctgggtgcagtggcttacacctataatcccaacactttgggaggccaaggagggctgatcacctgagttcaggagtttgagaccagcccagcaacatagcgaaaccccatctatattaaaaatacaaaaattatccaggtgtgcgggggtctgtcctgcagaccctgacccaatgatggatgaataacgtgcactgatacagatactctgctttgccagtctgactgagcatcagggctacttacagactcccaggagagtgctgtaaaaagttgcgacctgggccttgaccagccagccagactcatgtttattcagtaaagattaattgacaaaggcttgagtcaacaccattagagggtaattgaccttgcagacatcccagatagaaagcaattaagcacctgcggtagatccaaggttagtcttaggaccacatgagtaaacaagctagttagataaactccccacattcctttgtatctactttaatttatttaattaaaggtaagcggactaggctgccttcagccagatctgttaccgaagttatgcaactctcaggccttccaagagggtttctggctattataactaaattttttcccaccagcctgactgaaccctcacacaggtggagacaggagaattgcttgaacccaggaggcagcggtagcagtgagccaagatcatgccactgcactccagcctgggtgacagagcgagactccatctccaaaaagagaaaaaaaagtgtgtttcttgcaggcagcatatagtcttgctttttatccaatataaaaacttttgctttttagttggagtgtttatttaaatttgttattgtcaataaggttagattcatatctaccatcttactgctcattttttgttcccatctatttgtactgtttttcttatgactgttttatttccattattaacttattaactatgtctctttgtagttgctctaaaatttgcaatatacatttttcatttcgtttatagagttagaaccttgcagcaatatacttatttgttccctcctgtcctttatgctattgttgtcatacatttgacttttattataaactctacaatacactgtgattatttttgctttagaccatcaatttttttttttgagacagtgtttcactcttgttgcccaggttagagtgcagtggcatgatcttggctcactgcaacctccacctcctgggttcaagtgattctcctgcctcagcttccccagtagctgggattgtaggcatacgccaccacgcccagctgattttgtatttttaggagaaacgggttttctccgtgttggtcaggctgctgtcgaactcccaacctcaggtaatccgcacacctcggcctcccaaagtgctgggattacaggcatcagccaccacacccagcctagaccatcagtcttaatgagaaaaaatgtcttatgtttacctgcatatttactatttttttattgagatggagtttcattcttgttccccaggctgcagtgcaatggtgccatctcagctcaccacagcctctgccttctgggttcaagtgattctcctgcctcagcctcccaggtagctaggattacaggcatgcacccaccatggccagccaattttgtattttcagtagagatggggtttctccatgttggtcaggctggtcttgaactcctgacctcaggtgatccacctgcctcagcctcccaaaatgttgagatcacaggtgtgggccactgtgcccagccttttttttttttttttttttttttttttttttgagacggagtctcactctgtcacccaggctggagtgcagtggcatgatcttggctcactacaacctccgcctctctggttcaagtgattctcctgcctcagcctcccgagtagctgagattacaggcacccaccaccatgcccagctactttttgtacttttagtagagatgagttttcaccatgttggccaggctgatctcaaactcctgacctcaggtgatccacccagctgggcctcccaaagtgctgggatcacaggcatgagccaccatgcccagccacatatttactatttttagcactctttattcctttgtgtagctctaaatctatctctggtatccttctgcctaaagaagtttctctaatatttcttgtagtatagatcctgtgacaatgaatcctctaacttttgcttgcttgaaaataactattttgcctttgtttttgaaagatactttggctaggtataaaattctaggttgataggtttttttccttatgtacctaaaaatattgctcccttatttgctagtttgcataaatttcttaggagaggtctgttaccactcttgcaggtaactttttttttttttttagacagagtcttgctctgccgcccaggctggagtgcaatggcacgatcttggctcactgcaacctctgcctcccagattcaagcaattctcctgcctcagcctcctgagtagctgggattacaggcgcatgccaccatgcccagctaagttttgcatttttagtagagacggggtttcgccatgttggtcaggctggtctcgaactcctgaccttgtgatccgcctgccttggcctcccaaagtactgggattacaggcgtgagccaccatgcccagcctcttgcaggtaatattttttatttctttcatcatgttgatcttttcctttgtatctttacagcattgtttttaatgcccttttctgctaacttaatccttgctataatttctgggtctgtttctgttgacttattttttttctagttttggatgacgttttcccacttcatcatgtcttgcaatttttattgaatgttggatattgtgactttatgttgttgagtgctgaatcttgtcacattccttaaagagtattggactttgggccgggcatggtggttcacacctataatcccagcactttgggaggccaaggcgggtagatcacctgaggtcagaagttctagaccagcctggccaacatggtgaaaccccgtctcaagtaaaaatacaaaaattagctgggcatggtggcaggcacctgtaatcccagctacttggggggccaaggcagaagaatcggttgaacctgggaggcagagatgcagtgagccgagatcacgccatcgcactccagcctgggggacaagagcaagacttcatctcaaaaaaaaaaaaaaaaaaaaaagtattggaacttggctgggtgcagtgactcacgcctgtaactccagcactttgggaggccaaggtgggtggatcacgaggtcagcagttcaagaccagccttgccaacattgtgaaaccccatttctactaaaaataccaaaaaaattagccagtcatggtggtgggcgcctatagttctagctactctggaggctgaagcaggagaatcgcttgaacccaggaggcagaggttgcagtgagatgagatcacagcactgcactccagcctgggtgacagagcgagactctgtctcaaaaaaaaaaaagaaaaacaaaaagagagtattggacatttcctagcaagcagttaagtgattgcaaattaccttaattgtcttgaggtttaattttaaatgattttaagtgattttagcatgggcctatagtagcctttattctagagctaatttagctgcactttttttttttttttgagacatactttcactctgccacccaggctggagtgcagtggcgtggtcttggctcactgcaacctcctcctccctggttcaggtgattctcatgccttagcctcctgagtagctgggattgcaggcacatgccaccatgcctggctaatttttgtatttttagtagagtccgagtttcaccatgttggccaggttggtcttgaactcctgacctcaggtgatccacccacctctgcctcccaaagtgctgggattacaggcatgagccactgcacctggtcattagctgcacttctaaatgtatgaccctcataaggtctacttgagtgctgcttgtgttcaacatgatctctccactgtgattggaaggaattcgaataatccttggccccaggtgacctctgggagtttaatcttaaggctctcaggtaattgttctttcttcagaaatcattctctccttatgtatacaatggtgaataaagtaaaatactaataataggaaaaaaaagaggcatcattctttcctggtctcatgtggtttcaccttatgcatacatagataagtgttgagcaaagattcaagtgcaccctacacagatttctagagctctactctgtaggtctttcctctcaggtacagctttatccctggtttctctttccatggtttgagttaccctcagtcaaccaaggtctgaaaatattaagatatttggagagagagagagagaccacattcaccaacttttactacacgaattgttatcattgttctagtttattataagttattgttggctgagcacggtggctcatgcctgtaatcccaaccccttgggggccgaggcgggcagattacctgaggtcgggagttcgagaccagcctgaccaacaggaataaaccccgtctctactaaaaatacaaaattagccaggtgtagtggcaaatgcctgtaatcccagctactcgggaggctgagacaggaaaatcgcttgaacccaggaggtggagtttgcagtgagcagagatcacgccattgcactccagcctgggtaacaaaagcgaaactccatctcaaaatgataataataataagttattgttaatatcttactgggcctaattcatcaattaaattttatcataggtgtgtatgtgtaggaagagcatagtttgtataaggcttagcacttccttgatttcatgcgtccactagggatctgggaaagtattcctcttgcataaggggagactactgtatgctgcttcccaaattctgctgtatgggcttcccaaaattcaagctgtgtctcaagtcagtgaaaatcccaggctctgattagtctcttgctccttgggttgcagtctgggaattccctttaagcagtaaccctggccatggtaggactcacctcccattgtagcctcccaggtggctgtgattacaggcgtgagccactgcactcagcaggaaagcattgcattttgtacaatgctttactagtaagaagtaatcagtaagtgataaggtattgtaacctgtggtctggactcacctgaacaggttggattaagtgggttgatgcctgccatttaaccctttgtcttcgttgttatcactgaactcatacggttgccttggaaataacatagagagattgggtggtcctttgaggcccagggctctgttttttaaatgccattttggccacctgcagaatgattaggggactcactgaactcatagattgctggacaccataccagggccctgggaatgtgaaggcttcacagacttctcagtcaatgtttaagcatgtacgagcttgcaaacctttgacctacagtcatctaaagcagaaatcaattccaaatcccagggcttgggggcgagaatcagtttctcctaggtgtataagtggatatttagtaaaccaagtaaagaacaaccttatggccaggcgcggtggctcacacctgtaatcccagcactttgggaggccgaggtgggtggatcacgaggtcaggatttcaagaccagcctggccaagatggtgaaatgccatctctactaaagatacaaaaattaggccgggcgcggtggctcacgcctgtaatcccagcactttgagaggccgaggcgggtggatcacaaagtcaggagatcgagaccatcctggtgaacacggtgaaaccccgtctctactaaaaatacaaaaaattagccgggcgtggtggcaggcacctgtagtcccagctactcgggaggctgaggcaggagaatggcatgaacccaggaggcagagcttgcagtgagctgagatcacaccactgcagtccagcctgggagacagagcaagactccgtttcaaaaaaaaaaaaaagatacaaaaattagccacgatggtggcgggtgcctgtagttccagctacttgggaggctgaggcagagaattgcttgaacccgggaagtagaggttgcagtgagccaagattgcgctactgcactccagcctgggcgacagagagtactcggtcaaaaaaaaaaaaaaaatcacgactgtaatcccagcactttgggaggccgaggcgggtggatcatggggtcaggagatcgagaccatcctggctaacacagtgagaccccgtctctactgaaaatacaaaaaattagccgggtgtggtggtgggcgcctgtagtcccagttacttgggaggctgaggcaggagaatggcgtgaacccaggaggtggagcttgcagtgagccgagatcgggccactgcactccagcctgggtgacagagcgagactccgtctcaaaaaaaaaaaaaaagaacaacctttgaggttattccatatccattgaatcagctctttttatctaaatgtctatggaaagaaggctcaggaaggagaggaggttgtagaatgaagccactgaagttttccgggcaaatactgcctggctgaaaccctaccaagttattactctcttgactgtaggctgagtcatgccaggtgacttcctgaaagctgctgttgctcctgatgcttcaccgccgttgtaccatgtggcacacatcaccacatcacaaagcattttggttgctgaagtccccatagggcctaggagagctttgtggtgtccatcattatatcctcaggatctagccaagtacccatttcccagaggaatgaacaggcaccaaattctccatctactgtgatgagtttacccttcagagtctttcttctttcagcagggaccggaaccaccttaccctctctgcatctcccacctcttatgctgaacagctctcccaggtcaagcctcaggggtctgccctggtttatttactagttctgaggatcagtgtcctaataagcaacctcttaagaggatcaacccagctttcttcactgaatcttttcatgttgtctttgagggatctcacagggcgcattaatgaattcattttacacattcagttctaccttaggtactggtctgactgtctcaagtctcacattgtctatggcataaaccttaagaaaccctgcctttgtctttcacagtggtcatctccatcagaggcaactgaaagtttcttatcaaaagaaatttggttgccacccccacagttctacgaagtgagaagacttgcaaactttgcctctctctctgacttgcacaaattttgtttgggtcgtgcattagaaggactggaaaggtggctgccgatcatcttgttaactgctgatgggatggtccatcttttaccaggtaaaccagtgaagcatcggtgcttttgttagtattcacattcagtgccctgggctgcatggctgtattgcccaacgtagagacaggaattacagtctgtgttttgtaatctacagggtattagctaagtaagatcaaagcctataaaatatccatattattataaccagaaattctgcataatgtcatatacatacacatacatttatattaatatatttcctagacattgacaaaggtctttctcatataatttctcactttttttttttttttctgagacagtttccctctgtcacccaggctggagtgcagtggcacaatcttggctcactgcaacctccacctcccaggttcaagcaattctctgcctcagcctcccaagaagctgggattacaggtgcccaccactgtgcccggctaatctttgtattttttttttagtagatacggggtttcaccatcttggccaggctggtcttgaactcttgaccttgtgatccacccgccttggcctcccaaagtgctgggattacagtcatgagccaccatgcctggctgatttctcacttttttgcattttaagtttgaattacgagaactcgtaagttgtcatctaatttgaattagggagctttttttttgagacagagttttgctcttgtcacccaggctggagtgcaatctgggctcactgcaacctttgcctcctgggttcaagcgatacttctgcctcagcctcccgagtagctggaattacaggcatgtgccaccacgcctggctaatttttttgtattattagtagagacagggtttcaccatgttggccaggctggtcttgaactcctgacctcaggtgatccgcccgcctcagcctccccaaattctgggattataggcatgagccactgtgcccagccaactttgtttttttttttcagttggacataatttcaattgaaattatgaattatgaaattatgaagaaaataaagtaaaatgttaactctatctcaactgaaaatacaaaaaaaaaaaaaaaaaacaaattagccaggcatggtggcacacacctgtaatcccagctgctcaggaggctgaggcaggagaatcacttgaacccaggaggtagaggttgcagtgagccaagatcatgccactgcactctaacctgggcgacagagcgacactctctgtcaaaaacaaaacaaaacaaaaggctgggcgcggtggctcacacgtgtaatctcagcactttgggaggctgaggcgggtggatcacctaagggcgagagttcgagaccggcctgaccaacatggagaaatcccgtctctactaataatacaaaattagctgggcatgggggcgcatgcctataatcccagctacttgggaggctgaggcaggagaatcacttgaacccaggaggcagaggttgtggtgagctgagattgcgccattgcactccagcctgggcaacaagagcgaaactccatctcaaaaaaaaaaaagatttattactcaacctacagtgggaaaatttagcagttttgatggaatttctctaaattaacctgaagatgataagaacagcccactttgaaacatcaaaagtatatgaatatcaaggccaatcttaatatcagtattgaatagaataaagagagtcatgaactggtataatagttacagttcacagtggaaacataccagtcacagatgtttatgggcccaaagaaaactcttggctggggtgttgtaaggggatattaaaaacacaagaaagaggacaggcgcagtagttcacgcctgtaatcccagcactttgggaggccgaggtgggtgaatcatttgaggtcaggagtttgagaccagcctggtaaacatggcgaaacctgtctctactaacaatacaaaaattaaccaggcgtggtggcagacacctgtgatcccagttactcgggaggctgaggcatgagaattgcttgagcccaagaggtggaggttgcaatgagccgagatcgcgccactgcactctagcctgggcaacagagtgagactccatctcaaaaaacagataaaaaaacacaataaagaaattgaggtaagctcatagaattagattagttaacaactatctcagttccaaacatattaaatagatcaaaataaatactgatttaacaactatctcagttccaaacatatgaaatagataaaaatactgatttgtatttcattagtatattggagtgatttataaaataatactcgatggaattaaaattttatactttctgccatggtgaaaaataattttgtatttaaaaataaaatcagattttttcctttttcaggtgatgagctatatttagaagattcagactttttggaaaatcttatgtctactgaaaaaaagactgaggaaatcatgaaggaaggcaagcagtttcaccggatagtgacataccatcgccacctttatgatatccacgtgactgttcagccaaagtataaacacgtttatcctaagaactctgtagtaagaaaaagccatttgtagggtgcttaagcttgtttgtaaaatggcctacttgaagtcctcatgaataatgagggttgactttcatttgcttgaaacttaaggaagtttgtgcctataaaagttactgcaattcagtatttctttatttttttcgagacagagtctcaatctgtcgcccaggctggagtgcagtggcatgatataggctcactggaagctctgcctcaggggttcatgccattctcctgcctcagcctcccgagtagctgggactacaggcgcccgccaccatgcccagctaatttttttttgtatttttagtagagacgggttttcaccgtgttagccaggatggtctcaatctcttgacctcgtgatacgcccgccttggcctcccaaagtgctgggattacaggtgtgggccaccacacccagcctttttttttttttttttttttttttttgagacagagtgtctcactcttgcccagaacccaggctggagtgcagtggcccaatctcggctcactgcaacctccacctcccaggttccagcgattctcatgcctcagcctcctgagtagctgggactataggcatgcaccaccatgccccactaaattttgtatttttagtagaaacagagtttcaccatgttggccaggctggtctcgatctcctgacctcatgatctgcccgccttggcctcccaaagtgtgggattacaggcgtgagccactgtgcccagcatggtgtttcttatatcaggtgttttagggagctcgcttgcttattccattctttaatccttacagtgtgccacacgtataaagtttataacgtattaatgatctcattacccaaaaccagaacataatttcacaagggttcctacttctgtattgttttattatctcaaaaatttaaataacatgttctgctgtttattgttcttgttatccactgtattagcaccttccctgatgtgctttggaggttgatcaatgaatttctgagactttctgctggaattactttaagggtgtcttattagatgatgaaaagttggctgagacacccttcaagtgaccatgtcattgttttcttgctatgtctttagcttaatgattaagatacaattctttttaaaatcaaatggtattagttattatgtttcccaaattagaaatcgattttagttaacattttattttattttattctattttatttatttttgagacagagtctcgctctgttgcccaggctggagtacaatggcgcaatctcagctcactccaatctccgcctcccaggttcaagcgatttttctgcctcagcctcccgagtagctgggattacaggcacccactaccatgcccagctaatctttgtatttttagtagagacggggtttcaccatgttggccagtccggtctcgaacttctgacctgaggtgatctgcccaccttggcctcacaaagtgctgagattacaggcttgagccaccacgcctggcctagttagcattttaaagaaacacaaagccataacaaaaaccatcattgtttgtattccacactgttaatgaatgtaaagaggttagaaatgtagtgtttgattaatgatgtttatttttactgtatttaatatgagtaatttttcatcatctttcaagaggaataatgtttattgattaaaggtgagaaatgatagttaagacaccaattccatgtccagatctttgactgtatcatgcattgtacaattgatttcatattttatgaaatgccttaattttcctactataacataaagacaatgatgaataaagtttatgtgtatgattaaatcca

SEQ ID NO: 29 - DNA, 47410 bp, Homo Sapiens
tagagaaggcatctgcatttttaatcgagtattactattagcccttgggtaagtatatttgtggtagagttttaatttggaagacaaaagtgcccataagaaagtcaagaatttcaaatgcaacttttaatactacatatttcaagagctcccatgttcagtattcctggagaaggaaagctctttttgtttctaagtatgagaaattgttagcgttccttcctttggtcttcccacacccctcaccacaagaggcaaacaaaaaaaactaaaaaggggacaataagtgcaagataaaaaagaaaatctaaatagtatgaaattagtttttatttttaactaaaaataaatgcttaacatctttccaaaatcaaaactaaagacgaacacttagaaaaaagggtggaagtgtatttttccttccctggggaaaccagtaaggcagacattctaacgaagcttggttttttccataggactagtctatgcaacagaatctctctccagccttttctctatgtcagttttatctacctggcaagaaaaaacaaaaacaaccccaaaacaacccctccccacagacacaacacaaaacaagggacttgagaagttagagaaaacctttaacacgtttctgtaaaatcctttctgaggtggtttagtacaggtactacccatcagcaacttagcggccaggtgagttggtgcagaagcgcttcgggtgaattcataccagagccaccgggtgtgactcggctacctctcccaattaccacagggaggtcttaaaattgaatttcagtttcagcagatacttcagatttacctgagcaatatcatagacaatgtacctgaggggaagcttgttaaggagccaacagccatacaacagagggtatgtacatgtgcctcatctcccccaggctggcaggacgctcagtgccagcctgaaagtcactctaaggcctcttcatggggctgggttgcctcatctccccggggctggcaggatgctcaatgccagcctgaaagttactctaagtcttcttcaggcagactgaggagaggagatcatcctctggaaactgggggaaggctcataccctgtaagccaggctatgcacagggagggaccacagaagggaaacagtcaccatgggacacactacaggacagcctctaatccttgtctgccccaggtaatctgacagcacataagtgactctgtagctcgagaacatccctttgtgctcacacagcatactcaagaaaggatactcgttatatagtagagaggtgtcattcacaccagatgaaatcccggtcccaagaggaacgtctacaccatccagactaatgttagctgaaggatcaggggtagttttgcccaaacctgaaaaacagaagtcacaagtgacatgaactgtgagtacagatgtggcaaagcttccagggagatgagctctatttgatgttgggtccatgtggtctttcttttttttttttttcctttttgagatggagtctcactgtcgcccaggccggagtgcaatggtgtgacttcagctcagtgcaacctccgcctcccggattcaagcaattctcgtgcctcagcctcctgagtagctgggattacaggtgcgcgccaccacacccagctaattttctgtattttagtagagacagggtttcaccatgttggccaggatggtctcgaactcctgacctcaggtgatccaccacacccagcctcatgtgctcattttaaagacatgctctatctttcttcagatataaaactaaggcaataaaccaaagttcccagggcatcaaccttcactgagtttaatgagaacagtggcagtaccctccctacaggatcacatttcggctcaatagaatttcaaagcggccacttcaaccaggcagtggaaggttctaaatcatatgctgcaaattctagcaatccaagatgctccaggcactactatgtcacgagaggtccctcactgctgtagctacaagttaggttaaagccgaaacccgtgcatctggttactggtgcctgcaccaagattctcctgtggcatctgtgataccagctgcagccacagagagtgaactgtttttaaaaatgaacctcctgctatagagcttgcctattttttttttttttttacaaaaataaataaaatgaacctccaatcatggtcagttgcagcatattaaccaccaccaccaccccccaaacaacaacaacaacgcacacacacccctcgaaaagataaaatgaatctccagctgtttgacagccagccacaaggcagccttctcaggacagcaagcccccggcttctgtgctgtccagggtgcctcgggctgtagcaacagctttggaaacactttacctttgacactgtgcttgcccttgggtaacttgctgatatgtgaagcgtgcttcagttcatacctattcaaaagaggacagtctcagaagaggccttcacactgggctctcgaaaccaacagtttgattaggagaataagatcagatacagagatgagataaaagtccacaaaacccagaccatctaaactgctcaggctccctcctgagtttctggaactgttccagaacctgaaactgcagttgcggctgaacatagtttgtgcccagcgatcactgctatggggccattttcaaggcaaggccctatttggagtggtggtcagcagctctaggtttccgtccacattccacagtccccagacccctggccttttacatgaccttgtgcttttggttacagttcacaggactagggtcgatgtccaaatcaagctggactaatcagatctttctctatggagaatctggaagtggaattaaaattccagttccatttgggttggtctaagaaaactgaaacactggtgagtggaggaggcggcctgggggatcatcctttgtgcaactcaatctctctgcttcccagtccatggagagaagacactgccagctctggaggcctggctgcgttcctgcccttgcatttcctgaagtatccttgtatctcccttgttcccttaacttgaattggattctgctacttataagaaaagaatcctaattggtgcgtccagtaactgcagtggggaatttctactctcccagccaaggggagttctgcctatagcccattccacctgtccccatgaaatgccatcagtcccagagccaggtttactcacatgtttccaagggcaacttctcccaacaggattaagcctattgggtctccctgagacgtatggcagtagttggcactcttggagaccatgtcagcgaaatagatccctttaccaaacatgtagcctgtctggaaggtcggaaaagggagagctgagaatcttctgatgggaaattaggagcagctgttcactgagtgccaacttgagcaagccacccagctaagtgctgcaatccatcacttctaattctcacaatgcccatggtgaggaaataccaaagttttagctcacaagccaggctgtcagatcctagctctgccaggtgccaaggagctgcaagaagctacgtaacctctctggactctacttgcctcttttctcaaatggggaacacagtctcatggagctgccatgaggacggaatgagctcatcagtgttacttaaactagcgcctgtcaacacccaaggaatgcaggctggtatttttattcccttttgtaaatgaaacacgaggttcacaaagggtaggccatttgcccgttatacactactgcacagccccagagagaatcatttaaacttctctcctcctcattctacaactgtgaaacaagaggcttagaaggtcctgtccaggtggacccatctagaatccagcaggtggcatcacgatccctcgtgtctaggtaaagccttactcattcatcgctacgttttcctgctgaagacactgacactcagaggtggcccggctgggaagtggtagagataagcctggactcagcttggcctgtagccacgtgtctgttctttgcttgtcaacacacccgattagcatctgcagcaggccctggcctggatgctctgcctcctttgttccagaaactgtgtttgaaacccctgacagggttagggtcaggaggataaaagggtgaaggcccaaagaaaggatgtctggcagaatccccctaaaccaactagacctcttgctcaaagttctttatggagacacctgcagagacaggcattgcccacccctcgccaggccaggcacataccacgggcgcttcaggcggggctatccgaagaccctgggacaggatcccagcaaagttggtggtcctggacccgtgccacagcaatcttcggttatgaagctgcttaaagggcttgtaacgctggcattcgccttcacgctctatcttaaagatctggttggagtagtaaacaaagggaaggacaaaagaagccatttgttactctggttgactgaaagacaggactggatacacgagaaatgaccggctgtccctaaggctagaagacttaaggtctgctgcaatgtaaaaagtgttttccacaaggctgggatggaaggtccaggtcctgcccagcagcgcccagccattgctggttagtattactgtgcagcagatgtgcacttgaggaactttatcttggacatctgataatctatgttctgagaccaggtttggggacaggaaatgtcctttaaaacagaataaaaagccatccccaaactactgtataagactgctaattttataatcccagcactttgggaggccaacgcaggcggatcatctgaggtcaggagttcaagaccagcctggccaacatagtgaatccctatctctactaaaaatacaaaaattagcagagtgtggtggctcacgcctgtaatcccagctactctggaggctgagacaggagaatcacttgaacccaggaggcagaggctgcagcaggccgggattgcaccactgcactccagcctgggtgatagagtgagactccatgtcaaaaaaaaaaacaaaaaacaaacaaacaaaaaaaaaactactaatttttctgctgaacaaatgagtcacttctttgggttatttaaagtaaataaactgctcttttctacccaggcccaggttggaggagtgggcagggaagagctggcaggacacagaaggaagtgggggaagaagggattcttacatcgatgacttccaagtcatacgcattgtgtgtggttgcatgagtgttcttaacatacttcctgatgatctcggcttcttcagaatctctgtcaaccacctggataaacagaatcttgggattagcacaaaagagacccaggagagctacagaggaggaatgctcaggctcagtcaatgcatagctcaacaccacactcctcaaaggaagccgggcatgaccgagagcctgtgtcccaggcctgtgggctgggcagatcctgggccagtggctccacttacctaagcctccacctcttcatctacttgggctgctagagaatctcagggttcctttttgtcttaaaattctatgttttgggatatcagggaagctagaatgtgggattcactgtcagtgaacagggcatctccagaacaagcaattggctcctggaagagagtccagctcagcatgagttaaaacacaatgggccagaggaagtcacagctatgatgtgcaatgaaaattatccctggctcagagcacaggcctaacaagcatctgtcaaatagctgatgtaatctatgctcagtaagcctgagtattacggaggagactagttatgttttattttcatatttatattcaaacttcagaaaacctagaatgctggtctacctccctgtcttttaattaaaaggcttcagaattgtaaaaagagaataagaatcccttcacgaagaaccacacctacagttttcccatcaggaaggtgctctaggggcaaaacaaatgacatgtggtgtcttaccctgcttggacccataggtctatactttgtcctaggaaagaagccaaggctctttctttagcgatgtaaacacctggtaccagactcaacatactctcgcccacccaaacccctgcaacactgcagggaatgggctgaggacaatggggcacatgagtgtggagataggctcaaggaccgggccatctagaagctgaggcaaaaatccctcctctagttggtctaagcggggtgttcagagactgtgtgtgccaacacagtccacttcagcaccagagaaaaatgaacgcaagcattgtgtttttattacaggtgccatcaagcatttccacttctgaaatggacaccggtaataagtcttctaaaagttcacgctacaagggtttagaaaaacagagctcctctctagattaaggagaggaaacaaacaaacaaacaaacaaaaaagaacttttggtaagaccctcaaaaataaatttgtacgccaagctgaggtgctggcttggaaggctgccttgcaaacaaggtgcattatctacacgtgaaacgcccaaaggttctcaaaggaccaccagcagcaatgtccgggaacttgttagaaaagtgaattattgggcgccagccacctgtgttttaacaagctttccaggagatcctaacacacatggaagtttgggaccgctgctctcaggatgagaggttaagatgcttgaggaaggcctgaccctgttaccttaatgtcagttttgagcttctcatagttgacatcgatgggatccttgctgctatcatcagaccctcccctgagcagactgtaggccacctcgatgtccagcaggttgtcaagcatttccaccttggcctggaggagcaaaagaaagcccccgacttaggtatcatggtgaatgagacagactcacccaggtggcagagaaaacctacatgcagagaaggtccaacacagtgaatggcaaaccctcctgctggtcagggccagcctgttacctgctgcacatattgagagctcataaggactttctggaatgttaacaaggccttgtggcctgggggagttgagaggtggaagaactgtctttcctctcgtacatgctgacatttgggacctacagtgaaggtactttagacaaatgggtcctgagccaggagctgtcttaaaaggcagggagggaaaatggggaggaagatgctgttatgagggagaggctgtccctctccaacagctctttccccagtggatttggtagaacaggggcaggaaaaacagctctgcctccatcaatgtgggtagaaacccaacttcaaaacaagggcaagagggtggccctcccagcattggtgctgccctcagggatcatgatggggagggacggctgcaaggtagtcacaccccagcccagcagacctgcagtcccttctgaacccttgcgctacctgcacactgtctgcattgttcaggagcggaggcttcttcatcccaaagtcgtgggggatcagggtgtaaaagcgatttgagagatccaggatctgagagtcgctgctgccctgagacaccgcctggagaggaggggacagaaggaatgcaagactgagggagcagctccaagcccccggccaggctttctcttttagcaggtgggtgctgcagcaggtccagaagtagcgtggtatgtgcacatgccaggacacatgggaaacgaccagaagaccatcttcctgttaaagagcagggcaggacccccatcctctaaaagcactgctcaacacgtgatgggcttctcccatgaagtttcatttgtacaaagaactgtgcagttacagacatttgaaaccccgccacaactatgcaaaatgttaactgtaaaatctaggtggtgggctaatgactattgctgtaaaattccttcaactttttgtatgtttgaaacattttcataataaaatgttgggaggaggttgcccatcgctataaaattcagtcaggctccctgcctccactgaccttcattggaattagtttttactgtacctggaggttgaggtggccaggcacagaaaggctaagcaatccttacactcactgccagtgtcacttggtgctctatatgcaaagggtgcacaaaaaatgcacagagatggaagagcggggccactgggattccaggaatttcgcagacagcctaggtgaccacaggaaggtcaagggaatatgaagtggcacccagcaggtccgaagccccacgcctgcttctcgctgtgacatggacttcaccaagttgtacaacttccatctgtgctgcccaggtggctctggcaatgggtaaggatgctattccagctcttcttcctgaagactattgcatgggaagaagctggggccgaggaaagccttgtaagttctcagtcagtaaggaacaaggagagaggttcactgctcagagccagctgtaactgaagttgacagatccggttcagcgccttttctccagcaccagccagaaagcccgctgcctgggcccacttctgcttcctgtgtgctttccttctttctacaggccaggcctgcacccacccacaaatataagcggaaccctccagcccctccaggatgtagctggaaggctccgggactggtagaccttgaaagatgctcaaagaatgttgaaataacatgaatgaaagaggcttccatttgatgacttcctagtaactgcaaaataaactctgcctaactcttaaggacacataaaataaaaaccacaacacaggtgacccttgaacaatcgatttgaagtatgcgggtccacttatacacagatgttttcaataaatacagttagctctctacacctgtgggctctgcagttgagaattcaaccaaactcagataaaaaatatagtattctcaggccaggtgtggtggctcatgcctgtaatcccagcactttgggaggctgaggcaggcggatcacttgaacccaggagtttgagaccagtctggccaacatagtgaaaccccacctctactaaaaatacaaaaaaattagccgggtgtggtggcccatgcttgcaaccccagctacttgggagtctgaggcacgagaaccgcttgaacctggggatggaggttgcagtgagctgagattgtgacactgcactccagcctgggggacagagcaagactctgtctcaaaaaagaaaaagaaagaaaaatcccaccaaaaaaaaaaaaaaaaaatctcaggatgcgagacccacagatgtgcagggccaacttttctcctccatgggttctgcagggcactctaggacttgagcatgagtgaattttagtaaccccgagggagtcctggaaccaatccccgaggatacagagggatgacttcacttttaacagagagggtaaccaacgtcttcaagtttatggtcagtttactaagtatctgacaactgaaaaatgttgctcttcattagttttgtgataaacttttgtaagtagcaggcacttgtcatttattgaactgaaaaaaatcgaaaccctcgtgaagtgcagttcagtacttccagtttcttaaccttgagtaaatgttacccctgccacccccaggtctcaccccctaagtcggccagaggagggttccaggaggcccctggtagccctgtgcttacctgctggacctcactgaggatggagtatgcggcctggatctgccttttgctcagcttccccaagggcatcttctgaaggtcgatctgaggagacaggggatttcgctctgaaagctgggcactgtgcagtgtgatcgcaggagagctggaccgggcagcccaccctcaggcccccaacaggagcagtcaggagcctgctgggatttcctgaggacaccagtgacccaaatccagagtctgtagccccaccccaccatgagggatggcagtgtgtctgaagattcttgctcacttcctttacggctgggcttagccaaccatgtctcctctgcccctatgcccagtttcaaacagtccagcacgtctggacgaagatatagcataattcccatccaattctgatgtgcagatgagggctcataaatcatgctgaccaccccacccagcggccttccctggggtcccagagccaaggcagttagttaagtgcacccctgggttcccacctggaaaagaaccaagagttttcaagtgttgaacactatttttaaaaaggacacactcctgaacttatggacttacattcaaatcaatgctgtccctttcagatcagtcacctccaacaaatattgctactgctcatatcttgggaactgcctgccatcaagagaagctgcagtggaagaagcatgagatctgcagccttcattttccatttgttaagtggggccaccttccttaaaaggcactcactcccttttgcgagcagccctgcctatttggctcagcccctgcgtggagacacctgtgtaccaatgggccccacactctgtatcctgagacatcgtctctggggctttgccaatagacccttctgagctccctgggggccgtgactgcgcctttccatttctgcatgtccagcacttcctgcagtgcttggaacaaagaactgaacaagaatcttagaaatggaactgctatggtgataaaattaaataaaaggatgtgaaaagtgctcacagctcatcagacacctaccaggagccaacagcttctaataacatccacaagccctggcatgggcttccctgtaccctcaacactgcaaactccatcctaagggaagatctgatttctggcaagaattaagtagccggagccacatctggggaagaaggtggataatctatttcaagccaagaacaaggtacaataaaagaacagagtgactttggtatggaccctcaatcagctctgaaagcaattctcaagaaggaatcccaaaagaagttctgacggcagagcatggccagagtgagggcagagctctgaagggcgcgacattttccacgctgtataattctggtgtttatgtaaaaaaaagaaaatacctagtttccctaattgtacacccctcaaaacatacgcacagactaaaaataagaggtgggctccatccacacaggccgccctcactactggaaaagaaactcaggcacagcgctggacagcgggctgggagcagtggctccacagctgcccagttgagagagaaacagaaaagtgggagaaacaccttggcactggggacccacgagccccagctgcagccaggaggaggcttctagggctgcagcctggaaccctgccccctgccatgtgtcgtgactgcccggaacccattcccttctggactcaggatgtgccctcctcacagggagagtcaggttcccctggtgctggggatgaagccccgagggccactgtgtctacttctccacatggttaccccaatcccacgtggaccccgctgaggtcaggagtgggcaccccgctttccacacacttccagctagctgccttttagcttgtttcagcaagcagcgcccctgtcccttttcttcctgctaaactagttacctgtccagtgaaaaacattaaaatgtcatttcaggctgggggccatggctcatgcctgtaatcccagcactttgggaggctgaggcaggtggatcatctgaggttaggagttcaagaccagcctggccaaaatggtgaaaccccatctctactaaaaataaaaaaacaattagccaggcacagtcgtgcacgcctgtagtcccagctactcgggaggctgaggcaggagaatcgcttgaacccaggaggcagaggttacaatgagccgagatcgtgcattgcactccagcccaggcgaagagagtgaaactccgtctcaaaccaaaccaaaccaaaccaaacacaaaacaacaacaaaaacaacatttcacaggaaaggacttgggtttgagaatagctgagaacgtctatgaatcacagatagaccaaggtgtgggagactggaaatgaagtgcaggacttcaaaacgtgaatgaaacgagcccctcttctcccttaccgtagcacctctcaacctttccctccacctccgtccctcattctcagtgagcccacccataagttgttcacactagtgacctcataaacaaaagtcagatcacacagcgatttcaacaagcacagcgaacaagccctggccattttttaaacccgttagaggatgtaactcaacactccactctacaacagcacaggcgtgagcattcctgccaggctgagctcttggcagggagatacggggttggccctgatgtccatgcggcttaggctgccagtggtttatactgcccagttttgaccccctgtcctcccagctctaaggcaggccaggaggttctaggaggaaggacttgggaagacagcagaacgtgagcgtgaagggagcaaccccatggagaagggtggaatgcttaaggctgatctgagactcttaacctccactggttcctaggagcctagaacaaagggaataaccaaatgcatcacagctgcttgtttttcagagcagcctgaagcttctgggttcagcagctagggtagagaggagagggtgtttgctggccaggtgggaccacctctgctctgaaggcccccagggtcagtacttaagagctctgatgctaggagcagcaagaacaagggggccgcccttttgcactcatctcccgggcggagagcggagatgagaaggagaacagacaggaaacacggagcctctgcctgcagtctctgccattctgccctggacagaagcatgactaatccagcaaccaccacccccaccccactgccaaccttttaaaaactggtatgaattttatcttacgaatcaagcgtcacagcaattttcttttactctaagtgggctatcttgcacttcccatggtaactccagttggttggtttggttgggccacaaaggaagcatggctaatacaccttgccacagcatgaagaaggggaaaaatacaaagggtgggccgggcacgatggctcacacctatattcctagcatttggggagactgaggtgggtggatcacttgagctcagcagttggagaccagcttgggcaacaacatggtgagactctgtctcagaaaaaaagtacaaaggggactagggaccaggaacaactctctccaacacaacacatgcttcactgcaaatcaaacaaccctctgcaaaagtgcaaccactccaggccccaacactcacacaatttaagattgaaggacaggtacaagaagctgacagccaatgtattgtttttgaaacagaaacaagaacaggcagacagctcttcactagctcagcaaataatcatccacagcaaatgctcacagataaaatgataaagcgcaataacctcatactccaccatggctttcttcatactttccacatcaaagatcatcttgatgaggtcctgaactggcttggggagcttggacttggtgccaggatttactgtcagcttcttcactgcctcttcatccttcaggaaaaaagcacattgctaagagacccaaatcaacaactcaagcaaggtatctgcgtctgtggggctggactgcagacaaaggacacaggctagagtgccaccagcaaaaaaagctgagtgttaatcaaaaaggtgtggaaaacagtggccaggatgagtgtgcctgatgctgcacatgggtcagactcttcctgtgcctgccctgaagttctcttggctgctccagattcttattctagttgccactgcagcgtctgcatgggctgacccaccctggggttgctggtccctgcctgggaacctgtctagtgcccactcatgcccaacctggaagtgctgggcagctgtagaagcaaactttggagcaatgggacatgaaactgatggacaaattccttctcttttctcttacacttcctcacacaagggccagttgcaagactaagtttatatagccttctctaaattcccaaagtaccaagcaaccagtcccatgcgctgccagccaggctgacagtgttaaagcacatcgtagcattagctgtccgtcctcttcctaagctgcctaatagactattgagactccaccccccactgtctgaagaacccaggttatatcaagatcacactgtactgaaactgctttaactctttagacttgaactgtatgagggtatagacggtgctctgtccagcacagtgtccctagcaactaaaacggaatttggtatttggagtgaaaggaattggcactgggctttgaacctggaatcagactggcttacccaagagctaacttgcgttgttagtgttcatggctgctgctgtcaccttcatagtagacctactctcagtgttgaaacaccatcttaaatgtactctgttatcttctgggtgtaacttcattggagggcaaagtatctatgtgttcaaaacccctatttaagtgcatctaccttatgacccagtacctacttgtaatgacaacaatcacagaggcacacaaatatttaaatgtatatcagcatcattacagtaaatgcccagaatcaatctaaatgactaacaggaggcaggaagctgttctgattaatgataaattccagcccacgcacaggacgggattcaatgcagccttaaataatgctctggactggtgcagccagtggccaatacagtagccactggccaaactgaggtgtgctgtaggtgcaaaatatacaccagatttcaaagacttagtagagaaaaaactaaaagggaaattttctcattaataattttattggtattgatcaggtgttgaaattagaatattttggatatacggggttaaataatgccaagattaatttcattggcttcttgctttttaaaatgtggctataaaaaactttaaatgtattgaaatggcttgaattataattctattggacagcactgctctagaagacataaggaaatgctcctggtacattagggcaaaaagcagatggttgtaacatggtacatatggtggtgggaaacgtacatatgcagtgaaagctgactgaaaaagatatctaccattactttaactgtggttaattccgggcaatcttagttttttgtgccttagtattaatatttctcaaaaatttttaaagtatttaactcagtaaggggcgctaccgagtcaggccaaatctgtcctgaaagtctactgtctgagcctcatcattgtataagcaagatgtaaatcctatttttaatatggagagttcatgaggccctctgtaaactaaagaattccccctacgagacatgctaggcctcaaagatttagaattaaaatctctacccacctacagatctttttgtaaaataaatgttttcttttatctgattaaaaaagtgataaattttcatttttaaaaaggcaagcattttgcaaagaaaaaagacaaaacagaaaagttaaaaatgtcaaccaatagacaaatgaatgctgtgtgctaacagatgtaaggagacgcccaaaactacagagacagcactaggaaataatttgggactaataaagtgtgacctagcagagcaggtcaagttactataattctgtcatgacagaccagtcacatgatcaagggtgaccatgggttcagataaaaagccttatctggaatctctgaattacgtcctattgtttcaggagtaactgaaaagactgttcctcctcgatatctcaaagatgctaccacaattctcatttaagctctatctcatacttcaaggtgttgactgtattaaatgctttttctgccatctactgagatgatcatgtggtttttgtcctccattctattcatatattacattgatttttaaatgtcgaaccaaccttacattcctgggataaatcccacttgggagtggtgtatagatccgtctatgctgctggattcggtttgttaggattttgtatctctattcatagggtttctgcatgtctattcacaggaaactgctctgtagttctcctgtgctgctttggctctggtatcagggtggtactggccttcatgcaatgagctgggaagtattttcttctatttttgggggagaatttgtgaaggactattattctcctttcaacatttggtagtatgtttactatgatgccacctgatccacgatgtggattttctagaataaggtgtcccttccttttcctagaagcagacagtgtaagggcattatgtggttacctggccatagtcaatctccagggggtagaactttttgggatacttcgtgaaatttttggagtgccaagcgttcccggttttttcttcatataatttcatgaagtgctcaatggcatcctccttggacggcatctgttccagtttgttgctaccgatcaccgtacccacacggccccaggacctgaatatccaatacctgcagtgggaaggagggtgtcagatacacatgtgtgggtcagctgtcccatttcaggagctcccctttcctgccattacattcacgtggggaagaattttacacaccccaaaaggatggtgattaacacagaacaaacacaactgctataacaataaagggtctttattttacttttcattaaactttcaaatcatattgactacaaaaaatgccaaagaatagtttaaacttggttctggcagccaagcctgaggactgaatcctggagtctggagacctttgcataaaaatgattctagtcctctccccaaagaaatacaaagtactatctggaagtcatgtgttcaaggagtcaacccttacagctgtaccctaaaaataatgaaactttcaactcagatccaaggccaagacatgatgaaatgaggggggcagtggcaatggctcctcaggtccggtgacctagagatgcaggctgtcatgttcaaattccatctcaattgagggtacacatcacacacacccagctgctgtgctgctcagctttggatgagctaatttttgattaactcaaagcagaggtaatgcaacacttaattgtcatttcataataaatatatatatatcataaacccacatacaagatttgtgtacattttaaagatagaactacagatttcaaagaaaatttgggactccctggccattctctgggctactgaacaggggtataaaaattcattctctgcttggtttttcctgtgaaaatttttgagaagcactaccttgatctacgttgaaaattttttctgaccctaacagcctacaccaccctttcacttaacaccaggaaatctaagccaccagaaaaatgtccacatccacaatcaacgttagaatttagtaagagttccttccacatgcctttacactgacacataaatgctattttgtggtggctgtactgaggggcaatgaactcactagataaggaccactctgcctagaaacataaggacaaaagccagcccaacctctcaccacctcccagctgctgtaccccaccatccacactccaaccttgcctgtctcaccatgttaaaaaaaaaaaaaggcaaatccaacctctttagttactagggagtttgaacattaaagagtaagttcaacgcttgccaacctttatttgcttcaaagttttaaaacatatgtaaaatcagaaaatcttgattcaagtagctgaaagaaaagccagctggggctgggtgcagaggctcatgcctgtaatcccagcactttgagaggctgaggcgggaggatcacttgagtccaggagtttgagaccagtctgggcaacacagcgaggcccgtctccataaaaaataaggcatggtggtgcgcacctatagtcccagttactcaggaggctgaggtgggaggattgcttgagcctgggaggtcaaggctccgctgagctgtgattacgccactgcactccagcctgggtaacagagcgagactatttcaaaaaacaaaacaaatagttgcaaaacaacaacaaaaaacaaaacaccaaacaaaaagaaaagccagcagaagaatatgtgaaaccataccttgggacaactgtacaaggacagcaacgctactggttagtaagtggcttctttctcccctttaagcaaaggccttataatttgtttttgatctctgtgattagatttcattccccaggcactgggcctaacgggtttcacaaggctgatggcacagcactaaccaatgcaggacgggcccatgtctctgcacaaccaggctacacctgcagaactcacctgttttccttgtcgtcctccagaagctgcagcttgtagtaggagttggttcctttaacgatgtccaccaggccaagggtggcactgaagaccttcccacctttctccaggacatgcgcagagtgttccagtcctgtcccagaggaaaagcacctacagttttctctccccttgaggtgctagcactctcacggagaagggatctgcaggcctgaggttcacgcctcttggatacactaccaccaccctcgggaggctccccacaaatgtgtgttctcaggactgggggagctggtgaaggaggcctgagtgaggacaaaggcacgaccacactgccccaggtatgctgcgggcatttggatgtgtgctcctagtcagctgggggttggggggcggcacagcccactttgctggcagtcctgtttgcttaccagaatcaggatccacagctgctcctcctttaagagttaatttcattctcttttcagatttgttgataccttggaggagaacagaaaaatgtaaacatgaagttaaatgtaactaaaaagtaaggggaaggtagaaggcaaatgagttgttctcattcccatcatctgtcaactcggcatctatatacacactactcccgccaccccaaagcgcctgccattctgtgtcctgctctgcagcactcaacaggccatgtcagggacacaaagggagaggttccgtggacaacaacctggccaccaatgtccctggcttttggccctggagggggcagcttggggccctcaccttcctccttgacctggcccttgctttttttggagagcgcagcccctgacttccctcttggggccacaacttcaacaggctctgccttcacctctgccccccaaggggacaagatgtgcgctaagaacaactcctgaaggctcttggtggaggcggagacgtcctggaggaagtcctcagacacaactcggatgttggcttcctttacttcctccatcttcttattcatcttttccacctcctctgttcaaattgaaaggaaaaaaaaccaaaatacaagtttaaaacaaaactgaaacttcaaattactacagttatatttagtgtgtacttccaaaccctcagcattcacagctctcctttgcttccaagtctaatgctcccaagagtgtttttatcagcaacattcccccttttctaaggtatgatgagccagggcagccttctccaaaccattctacagcacgatgttaacaaacactccaaagaaaaaacaccctgatgtcaaatatgtatgggaaatcctgtattctatttctctggttcctgaagacctacagtggtaatcagcataataaacccacacagaaacctgtttagctttgttttaccctaccttttccaaacatacttgaaccttgaacttctgttttggcagatatctatgcacatcttacagagcagtgcgaagtgatgagaatacaggttgagcagcttcccttatccgagatgcttgagaccagaaacctttcagaccttaaaatacttgcttcatatttactgactgagcatctaatccaaaactctgaaatctgaaatgctccaatgaacatttcctttgagcatcatgttgtcactcaaaaagtgttgaattttgaggcaatttgtttgggcttcgggactagggagactcaacctatagtagcttaccgtctttagttgagaacacgcaatgcatgtgaatctacagtacaaagcagcaacactgagagcaaatactggtttcccttcataaagaaccacagcgatgatgatgttaagatccagtttttcagcgctgtgttcgactcttcctcacttactcgtcatcacaatcataagatacagaagcattgtccctgttgcacaaattcagattcaactcacttttggtgctgatgcacagggaagccttgttggccgtccccgtcaacttccccccgagtttctcaatcatggccttcacttcatccttgttccgggacagcttcccgagagtcaggatcttcatgttggataatggcttatctgggatgaaaggagagaatcattcagcaaggccagctctggtgctgctccccagtaaggggaggtggaggagcaggtgagccaagcagcgagctcctgggaaaagcctatgaaaatacactcgcgagaaaacaggacgggacagcaagctgccacctgagtacctacagatgtccctcagcacagaaaggactgggcagggagcaagccacaaaatgccactccatggccaggccagcctcgcggcgtgagccaggcagctgcgggttaccccaggtccgcgccaaggtcaggctaggaaggctgcatctgcggacgagggaccaggaggctggagtcggatgggaagaggggtaaggtcacatgaacccccaattccttctgttattctcccaaacaaactgcaattcttatgaattaaccccattttaaaatgagacatgtccatgatagtccctcaaagcagtggccagcacaatcacacggagctgagctaactgattctaggagaaaagcagcagcctggtgtgcactgacccaggccagaaaggcctggacaggggtgtgccttctgttcacagcaaacaacacagtgcaggtgacacccgtccagaactggagtagctgcaaggaaaagtccttcctgccttccctgtgagggcaaacaactaggaaacactgacagtttaactgaaactgctgaggtctccagagaacaaaattattgactcatgctgaactgcaagtcaggggaaagcagaggagggaaccctccatggaggggtcagaatgccagcccccaactggcccttcatgtgggcacctggacccaggctgccagcagcacagtggactcgggatgaccaccagcacacactgcagtgaccactggtcccctctcaggatatgaaaaggaagtcaataacaggtttatgttcaaggaaggaaccctcatcctccacccaccaaactgtgaccttcaccaatagactatgccacatgtctctgagtaaacaagcagcgggtcacttctcctgccaaaaaaatacgttgctctcactgtcttggttggcttggggcatttctcactagtgctgattagtaactccctctgcatacaacagagacttgagcatcacaccagggcccggatgactggtgggcgcagggcagcctggagagtgaggcctgggatgctcctctgcagtgcagtcaggcaggagaccctgcgcccaactccaggtaaggctgtcgacctagcctttcttaggagcccctctcctagcctcccagagtaagagctgcttgttcttctacaatgtttattttatttttagagatagggtatcactccatcgcccaagctggtgtgcattagcgtgatcatagctcagtgcagccttgacctcccaggctcaagggatcctccgcctcagcctcctgagtatctagggctaaaggcacatactcggattaattttaaacatttttgtagagatggggtctcactacattgcccaggttggtctcaaactcctggcctcagcaattcttttgcctcagcttcctaaagtgctgggattacaggtgtgagtcactgctcccagccgatgctatgttcttaacactctcccaccttgctgtggtcaggggtgtaacaagccaagagaagaggcctatcccctgcagggcaaggcttccccatggtggggtcagcaaagagagacccttgacggatactttcttcaccagctccacaccaccagcaagtagtgggcaaacaattcctgcaaagcagctctaagaccggggtcccaaatgctgtacctgctgaagcagaggagttcacagcagcaggagccgaggctgtggagggcggaggcgtggccgccacggaggcgctggtttctggggggaatatacggtcctgttttttaaccttcaatttcttgaggtaagagatttctcggaattcctaaaaaatattaagttttagttaagaagccagctctcccttgaggtaaccaccccatagaccaaagaggatttggcttgtccaaatcaaataatctctttttttcttcttacaataaagagtaacaaaaaatagaaaaatgtgaggctttaaggatgaaagacagtattattgctgctacagtacttatttccggtacttttacatttataatagggctaatattgtggctgctttaagagaaaaatctttccctaaaaaaaacaaaaacagaaaccagtggccaattcggtcagggaaccaccactggaactgctgtatgactacaacctccctggcctcattcctgagttgctcccttcgagagttaataggcctctgtgggatcacatgcctactccagaactccaagaccccgaatactatatacacactgggagattattacccaaaaggaaatcacagtatttgctttcctttttagaagaaggaaaaatgaatgcagggagccctatggtattcactataaattcttccatcagcacaattcactcttcactctgactgatttacaaggggccttgctctaaatggtcactcaataagtatcaaatacatgaagctcagggaaagatactgtgctcccaggtcttcatccaatcaagaaactgccctttccagctatgcctgtgttcaggatgtcagttagatacaagaggtcacagattgcttccgacacacacagaccacctaatatgtgctaccaaccatagtctggttaaaaagacagtttctgctcttcagaaagtatctcattcgtgactgagcatcagctataggaaggtgaactttaacaaaggagctaagctatgccagaggtgtgccaaggtgatgtgagacagggaatgctagcatgcacttggaggcagtgatctgctaagcccactgggagctgaaaacacaggggactgcctaagcacagccatctgagtagcacacggtggcatgtggggtgccctggctaggcgccctattgctaggtactcctaaaaagaatgagcaagactggcggtggggtggggagaggggtatgtgagaaggaagaaaagggtggcagaaaaaggctgcagaaggccagcaaagccgcatcacagagggctctgaggacaagctacagagctggccttgattctgtgggacaagtgcctgggggcaacagtgtcactgcctgggcagcaagcactgccagaccaaaaacttgtctcgcacatgcacataacctttaaaaatgtatatagatgctctacaattgatatataaaatacaaggaatggcacattgcttattgccatcttactatttccccatcaaagatagtaaaagaaatacaaataccacgtaagggtctgtaagatttgcatacccagaaaaatcggggaatcagtctaagattttaagggtgggggaagtgacaaggtcagatttattttagaggaaccactcaaacgcacagagagaaaattaggagggatcatgcaatcatggcagtgaacaagtgagccaggggccagtggaaatggagttcagttgtaggtgtagagcgagtaatgtcgatagttactcaggtaacgattcctgagtgtgtactgtgtgccgctgttccaagtgcaacagcgagggaagcagcttggtgagtggcagagctctgcacctacccaggctgctgggcctgggtcctgctgagtctgagggagcacaggcaaaggcctcggagcagccagccccacaaagatactgctagaaccccaccagccggctccaaaggaggctccccatggaggtattttgcgttgagaattccataagcagttccattaaaaaaagagagaacgtgcgatactaggagatacgtgaaccctggatccaattctcctgctagcactaaggcaaggaaatgtccttgaaaaaaccttgtatcagaaagcaggaattactatccatttcttcaccatatgtccctcaagcctagaactgtgcctggcacataggaggcattcaatagataaaaactattcatggtctttgcaagcaacattttacaccaaatggacctctactccatacttagaggagcttcggttctacatttgcgtagtttgcaaacatgtaattttatattctggtaaacaggatgacgcagctgtaaagaagtctgaggaacatggccctgcaatctcagggacctgaagtataaacaagcgcagaaagtggggccaggtttttctcccaacagatcccaggatcttcccctaccccttacctttggggttacccactccttccggttgggtgtctgtgtcttgaccatacacttggtccaggcagtgacgtccccagtgcagtaataggcatcgctcttgaagaccagctgacccgagcattcctcgcagggaaggagggcaccgaacaccatgccatcagctactcggtccaagatctgcagccagtggagaaacatgtcagagggcaaatgcgggactacaaaaaaggacacttactaatgtgggatggaggaacttgcacagattccactcactacaaagaagagaggcttcttgctgtgggcttgctatggggctcttaacaccccacccacccttggtttacaatggagcttggattcttgtaggagaccttatttccaagtgttcctgcagcgcccccaaccctcagtgatttagaaatgaagggaaagcaaccactggcattgcagaaagtacagtgccaagccaactcccaagaatgacagcagagaagggccagctggggacactgatgggaaaccatcatgccacccctcaggagggggctctcctctcttcacaggcctggcactctagagcaagcactaacatgtggaagatgtctggtggggcgtgtgaatgccggccccatccaccccggaaaaatggtgaccacgatggtggtgatgaccgtgcaacacaaccacgatttatactccttgcaattaataccagcaggtgttcacacggagggcctcccacactccattgggacagtcactccacaacgacggggtcggcctcacatgcgtgtcccacttaacacaaaggcagctcaccgccgactccccagaaggcacttgctgcttgttgaagatgagtagctccttcaggtcattagttgaacacactttctttagctcgtccttgatgttccagatcaggtcgttctgagcctatggacaagacccagtggctgagaggctagctcttttcaaaggaagaatccaactggaggaggagccctggtcatgctgagcctccagttatacccttgtgcaccagcgagctgcccctgcaaatctgggtgattagcacaggatttgactcccagtcatgctcctgtggacaccaaattaaacctgctgtgtggtctctcagagaatactgtggaaggtgatgaggaagccctaagggtgtgggggagactgcaccaaggctcctggaaccaaccctcagaaatcaatccccagaaacaccaggtaagagcctggaggtgctaggctgagcccacggcccacgtttatcagcaactagaggaggcagggtatggccattctccaccaatcttagagtaggaatgattcgcaaacaccaatttccttgatggtatattatattcagtatcatgcaggaatgtatttaagctcttctgaaaatggaagttttaatctttattaagtgcctactcttggttggatgcttttacgtgtcttctaacttattttttctttgagatggagtctcactctgttgcccagactggagtgcaatgatgcggtctcagctcactgcaacctccaccttctgggttcaagcaattctcctgcctcagtctcctgagtagctgggattacaggtgtgcaccaccacgcccagctaatttttgtatttttaatagaaacggtgtttcaccatgttggccaggctagtctcaaactcctggcctcaagtgatccgcctgcctcggccttccaaagtgctgggattacaggtgctcaagccactgcacccggcctcatctcatttattctcataacaatcaagcttgctgaggaagctatcagcctctccattttaaaggctgaggtaagtctcctccttccccaggaaaatgggcaagttattcgccatctctgctcagattccacctctgcaaaatggagacaaaaatgccagccctatcatatcctatagggttgctattagtatcaaaagaggattttaactccactggcaaaggtacaggcacacacgtctgcacctgtttcccagcttcatttttaaggggtctctcgacatctcctctccatcacacacagcatacactgggacaccaggaatggagacatgagaggatgaggaaaaggtctagtgatacagggttaaatggaagaagtacaacaatgtcacctgggtgaccaaggggggagagccaacagacacagatgtgccacagtgggaacgctgaggggcattttaattttctgactctctatacatctctgataccactagggaagagagaaggacactaatctcaccaaatggccaatgtgaagtggcaccacagttctcctgcagccagttttggtgcatgacagacacttttttaccataagacaattgaacaaaatgtgtgattcttatttagcaactagaaccatatcagaaactgcttttaattttagtaccactagtaaaaactgaatactcatagaagagacacaagcagatggttcatagaaatcatgttctcaagagagaccaactgttctccctcaatttcccagacatccagcattttctgattaataatttttgctttgcttcaacatgtacataatcaacacagggatgaatctttctggtcaaggaccactgatttaatggatagttttcttctgtcattatcagtctattccttttttaaaaatgaagatcttcatttaaaaaatgtggagacacttgatctcttcaagccatttgtctatgctaagaatctttggcatcctctaagtattcagtttccaaagtttgcaagtgaccacaaaggtgcagggtgtacagttgtgcataatttggccaaagcatgaatctctgtcatcccagtatgaggctggtgagcggaaacagagcactcagcccttgctcaagcctggctgcaggtcagacacctacagcctaatgtggattctcttccaaataaaaatggtttcttttggaggaggaaaaagaatctggggaaaagccatgctatttaataactgccatcaatttgctaaaggtcttaataagtgggacacaactccttgaattgtcttcccagaatgagaaagagaatccagacagcagaatgtcgaaaggagacacagagctgagaactcacctttagggctttttcaagcttactatccttgtctttttcttttttagatttcttcttcgccacttcatccactccatccacctcatcgccttttctctttctgaaggagacacaggatatgagagacagccagagccattaaaagtctgacacccaatgacttgcggtgatgcagtatcttaatgtcattctatcaactccctgtagggcctactcacacttgtcactccctaacccctgccccactcagtgcccttaggcgatcactgtctactcagggagtacttgcagccaagatggcagaagacaccatccaattcagaacatactctcccagccagggagaggggctagggttgttccagggactcagaacaacccattacaagaatccagggctcagaccccgtctgaggttaaaaaaaaaaaagaaacccatgtatctcctggcctggaaggttctagccgggactaggctagaggtaagcccatggctagggggtagggattgcagaaagacaaagcacaagtccagggagctaggccttttgagctaaaacacagagcaagggaaagaggctgctcacagaggtggggctgtactgccatataaagccctgacaagaagtgacagtcaaagcagtgctaaccagcctgccccagctggctcagcaaacacagctctgaggctatcacctgcccccaaaatacaggcgcaggacagccgcagtggtctgtcagtctcagctatcacatagacctgagcacaaacccttgcactttcctcatccataaaatagggaaaagaataccatctgcctcacagaactctggtgatgggcaaatgaaacagtccaaatacagggcttcatatagtgtctggcatacgaaatgtgctcaacacattctggcagttatcatggcataagtgggagctgatgaactccaacacctatatcacatgctgcaatgccctgtggcctttttgacccatggcctgatttttcagttttcttccacattctagagccccatgtgctgctgcaatgaacaggcgttatgaactgagataatgtgtgatggctgcttgatggttgcccagtcaccgttcaaggagcagggtgcataccaggctctgccacaccacccctggtgtgcttgttaacaagcagttctccagactgaggctgagggaccagcagagggtaaactggagagaccaagaggtgtccatggattcaagacagtcactgatggtccttcccattctaaattttaacaccatgcaaaacccttatcattctcaactctaagccaggaaaattatccactgcccatcccctaactaaaaatggtcaccattctcccagcattgttccgaatagtgatcaacccaggcacaacaaatacccagggaaggaaggtggtcttttaagtatctaaagggttgtggtgggaaagtgtagttagcctgtccatggagctcagatgttggaaggggaatagaccaccaggaagcaggtctcacaggggagagggctctcagcagaggccatgggaacccctggctgtctttccctaccctgtcctttgcccccacatctctgctgtcaccattcctcagtttgcatctccctggcttactgacagtcagcgaagggaaacagaggagtggtatggaacctgtagggcctttgggcctcccttgaacccctcactgaacccccagggcaaccccgcagtgctccacccacccttcactcttgactcctgggagctgcttcttcagggcttctttatcctctgtagcaaggaggctgaagcccttgagctgactcgcactgtactcgggccggaaacccagctcctccctgttcttgacaaagcagcctggatggtaccagcggtcaatcatgcctagctgtggcttctccgggtccaccatcttcttggacaggcgcacctggccctgcaggaaaaaccatatgtggtaccaagggagcgacaagcaaggatagtgaacatgatacgggcagcctgtgctccagccagtgaggagctgagggtccaagccaaggcctgcccgccaacttgaagactcatgagcttttgagaggtttagctctctcaggtcatcaaggattgtgtgttacccaccctcaagactcagggttccttaaattccaaatggctggcaacctacctacctgcctggacatgtgaagaattgctaacattccccttaagatgtttctgctgacctggggcaggcataaaaacacatggtatggtgtgctgggcagagctagagccttgcacacctgcgtgggcttccaatgcagcactttttttttttttttttttgagacagggtcttgctttgttgcctaggctggagtgcagtgacttgatctgagctcactgcaacttctgcctcccaggcttaagtgaccctcctacctcggccttgcctggctaatttttttgcagagatgaggtctcactatgttgcccgggctggtccagaactcctggactcaagcaatactcctgcctcagcctaccaccccaccgtgcccagcccccaatgcagcacttttgtactagcagggactttctgtccactcccaccctcctatggcctccttagtctctttacagatgacaccccctaaggagtaataaacccacaggcaagaatccagtcctgccagcctgcccaggtccccagtccccaggcctgatattcccaggagagttccaggcctgggaggctcaatccagagaatgcagcaggaggggttcctggcattacataaaaccagtaacccagcagcacataccatccggcattccccttgaggtaaagaggatcttaatgtttgccttaaatttttggtggttgaaggtagctggagaagatacagcaattccatgtttttcttttctaaatacccattggctcacctcagttttctgtacaatacctccgggaggcagagactttcaattaatgccttaaatgaatcaattaatatgtgcatgtcacattagagaagggtgagaaggctgcggggcacaagccttcccttctacctgtgtgtccatccattttctctgactggctgtcagccttcaagggctagaactggtgggaaagcctggttaatgaagttcctttgattaaacagaaggctggaggctcataacagggtaaacacactccttatacctaattctaccataaaacacagacaaacagtctctccccagccactgctgggtccaaaagagactccttttgttaacattttccaagagcagatgcatacatacatgagaactggaccgtgataaggaggaccagacctgtctggaagtcactgacgtatctggtcaatactaatgtcttcactttatttttaatcacttacgttgagctagcaccctaaagcccccatttcttcttttctcttgagatagccaataacatcattgcaagcaatccataaagttcagggatctgggcccccaagatcttaccttttctatcttctccatacaccccttgcacgtacttctgttggacttggcatactctgctgcaaagtcacccagagtcttctctgccttgctaccaattccatcctggcctttgcctggagaatcaaacagacagcaatgctcatctcaacagccccaaaatgcagctcagaggagccccgtcctcttctacctccccaggatccttccactaggacaccttatgccttgggagactacgattggtccatctcatctgtctgtttgtaacaaccgtggtcagctaatagagcttcttttctggagataaatgacccttctcagactgagctccttgaaagagcagcatatcagggggtggtcagctgtctgacattccatctcctcccctttctctggaggcccctcccacactttagaaagcacttattaggtgcttaccttaaaagcctggaagcatactgacgtctcactaaggcttctaatttccattatacttctatttaccaaagtgttgaattaaaggaaatattttgatataagtcagacacaagtatatgtaagaattaaatatgtactaaaggtatcatttcaaattagtgggaaaaggttgaattattcaataaagagttctggggatcactggctagccatttgggacaaaaactggattcttctcttattataaaaataaattcccaggttgaatgtttcttgcctaagattaggaataagacgaagctatcttcccatcacttctattccacatggtattggaggttctagtaagtgcattaaggaaagaaaaagaaacacaaggtgtaagtttggaaaatagtaagtaaagccatctctacttgtagatgattctatttgatattcctaagagatatcttaagaaatctattttaaaacctactaaattaagtgaatttagcaaatacgcagggcacactgtcaatatacaaacatacaaaaatgtctaatactagcaataaacatactggaaaaggcaaggacactggtatttaaacagcgttaagatacataaaacacttagataaatttaacaaaagatgtgcaagatctctacactaaaagctgtaagactttgctgaaatcaaagaagacctaaataaatgaagagatgcatcatgttcatggactgttaagatgtcaattatctgcaatttgatccatggatccagtgagatgccaatcaaattcctagcagctgtatttgtaatagccccaaactggcaacaaccccaaagtcacctacagaaaaatggataaacaaatggatatatccaaacaaagcactactccccagaaataaaaagaactaatgacacacaagatgacctggatgaatctcacaggcattgctctgagtgaagaaagcgtgtaagagggtatacaattccttttcttcctgaaattctaaatcaggcaaaattaatctatggggatagaaatcagaacagtggttacctgagtcagggaaaaaagactagaaaaactacaagggaacttcacagggtgacagaaatgtctataactcaacggggtctatgctagatatgtataagcatttgtcaaaactcactgaactgtatacgtaagatctgtgcatgtaactatgtaaatcatttttaatattccagatataataccaaagacacaccacaaatgagaagacagacatgactacacaaacgttagtgaaagatgaaactttaatgaggcaaaaaaatacaatagacaaaactaaaagaaaatgtcaaacttggaaaaatatttgtaaaaacatgttatgacaaagaatcagtatcttttacatttccttaagaaaaacacaaggccaggcatggtaatcccacctcacacctgtaatcccagcactctgcgaggatgaggcaggaggatcacttgagcccaggagttcaagaccagcctgggcaacatagagacctcctccatttaaggaagaaacaaacaaaacaaccaaaccccagcatggtggcgcacgcctgtactcctagctacttaggaagctaaggtaagaagattgcttaagtctaggagttcaaggctacagtgagctaggatcgtgcaactccactctagccttgggtgacagagtgagaccctgactccaaaaaaaggaaacacttaggaatggtatgttagtagagaaatgggtatattatatactgctggtatagtatgtgcaattgaagcaaccttttctggaaggcaatttggcacatacatagaaagccttaaaattgttcatctctttgaacagtaactgcacatcttagaattaaagaaataactgtacaggtgcgtgggatgtacaagaagtttgcagcagctctacgtgtaatataactaaaaggttaaaattctagtctcaaagaaagacagggctgggtgcggtagctcacgcttgtagtcccagctgctcagcagactggaggattgcttaagcccaggaggccaaggctggagtgtaggctgtgatcgttccactgcactccagcctgggtgacagagcaagatgttgtcttgaaaaaaaagaaaaaaagacagactggatttgaatcctggctcaggaatttactaccagtataaccttgggtcagttacctaacttctctgtgcctgaacttcctcacctgtaaaaactgacaaatgacacgattaaattaatatgtcaagtacttggaatactggatgaaatttagcaaaacctcactaaatgactactgtgcacttgaatctgtaacttttaacatgagaagagtaaatatcaagttgtaaaagtactaacaggtcaacatcactagtcgttagggaaatgaaaatcaaaaaccacagtgagatactacttcacacacattaggatggctattatttaaaaaaaaaaaaagtgttcatacgaatgaggacaaattggaacccccttgtcttgctggtggaaatggaagagctgttatagaaaacaggatggaggctactcaaaaaattaagcatggaattaccatgattcagtgatttcacttctgggtatacacagcagacaagtgaaagcaaggtctgtaacatatatctgtataccgatgttcattatagcattattaataatattcattatcattattatgaatattatgaataccattcataatagccaaaatgcagaaacctggccgtgtgcagtggctcacgcctgtaatcccagcctggcccatgtggtgaaaccttgtctccactaaaaatacaaaaaatttaggtggatgtggtggtgcatgcctataatcccagctactcgggaggctgaggcaggagaattacctgaacccaggaggtggaggttgcagtgagctgagattgcaccactgcactccagcctgggcaagagtgagactctgtctcaaaaaaaacaaaaaacaaagtgcagaaaccacctaaatttccacagacatacaaatgggcaaatgaaatatggcatattcgtgcaattaatgtttattatgtctttaaaaagaaggaaattcagacacatgctgcaacacggacgaacccagaagaactatgctgagtgaagtaagccagacacaaaaggacaaatactgtctaactccacttacatgaggtgctagagttgtcaacttcacagagacagaagcaacagcggtcatgaggggcagggagaacaggcagttattgcttaatggattgggagtttcagtttgggaagatgaaaaagttctggagctggatgatggtaatgtttgcctaacaatgtgaatctacttcatgccactgaactctacacttaaaaatggttaagacaggccaggcgcagtggctcacgcctataatcccagcactttgggaggccgaggcaggtagatcacctgaggtcaggagttcaagaccagcctggccaacacagtgaaaccccatctctactaaaaatacaaaaattagccagacgtggtggcgcacacctgtaatcccagctacttgggaggctgaggcagaagaatcgcctgaacccgggagacagaggatgcagtgagccatgattgcgccactgtactccaacctgggcgacagagcaagaccctgtctcaaaaaaatttttttttaaaaaaagaaaagggttaaggtaaattttatgttatgcctattttgccaccaaaaaaaaaaaaaaatcaagtaagaaaagtgatacttagagtaggatctcaattctgcaggaaagaaagaaaatcaagcacactcacaagcaaattagtattttctatggagatatcccacatgttaataagtcatttctgaattagaggatttgggatgaattaaacttttcatatatctaaaaatagtaagttaggctctctggatgaaaaatccctggacaattagtaggtagtatcctaactgtatggttatgatggtttcacaaaaagacacattttcagtaaaatcattatgccttttcatattataaaattacacttaggtcagcctggccaatatggcaaaactctatctctactaaaaatacccagccaggtgtggtggcacacacctgtaatcccagcaacccgggaggcagaggttgcagtgagctgagatggcaccactgcactccagcctgggtgacagagattatctatgtactcaggtatatttaaattataactagatataacatatctatgcccctaaacctacaacttcccctatcctgaatacaaaagagaaaacagccacagaacaacaaaaatgtcagccaggtgtatttgctcatgcctataaaccctgtgctttgggaggcagaggtgagattgtttgaagccaagagtttgagaccagcctggggtcttgccaagcaagatcccttgggcaacacagtgagactctgtctctatcttaaaaaaaaaaaaaaaaaaaaagttaaaaaattagttgggcaactgtagtcctagcttctccagaggctgacgtgggaggattgcttgagcccaggagttagaaactgcagtgagctaagatcatgccggtacattccagcctaggcaacagaatgagagctgtcctctgttaaatctgacatactcaccctctgaaccctttcttggcaaatttatttactttttaaaattcccaattctgagccgttactaacctgtttgcagtaagcagctagtcagacataccaacagctgcaaggaccagctgctgcaagggcagacagtgatatggtttggatctgtgtccccactaaatctcctatcaaattataatcccgaatgttggaggtggggcctggtgggaggtcactggatcaccgggacagatttctcccttggtgctgtgtcatgatacttgtgagttctcctgagatctggttgttgaaaaatgtgtagcacctcccctttcactctcttcctcctgctccggccatgtcaactgccggcttctcctctgccttctgccatgacagtaacaaggttggaggactgacactacccaacctaaagacttactatgaagccacagcagtcaacacagtgtggtactggcaaaaggatacgtagatcagtgggacagaacagggagcccagaaacagagccacacaagcacagtccactgatctttgacaaaaaagtaaaggcaaaaatggagaaaagatagtcttttcaacaaacggagctgtaacaactggacatccacatgcgaaaaaaaaaaaagaaaaaaaataaaggaatctagacacagaccttacacccttcacaaaaagtaaccaaaatggataacagacctaaatgtaagacacaaaactgttaaacttctagaagaaaatctatatgaccttgggtctggtgatgactttttacaaacaccaaaagcccaatccactaaagaagtaactgattaactagacttcacaaaattaagaacttctgctctgcggaagaccagccacacactgagaaaaaatattttcaaaagacatatgacaaagggctgttatccaaaatataccaagaactcttaggactcaacagtaagaaaacaaacaatgtgattttaaaaagagcaaaaccaggagtttgagaccagtctgggcaacaaggtggggccctgtctctacaaaaaatttaaaaaaattagccaggcatggtggtgcgcacctgtagtcccagctactcaagaggctgaggtgggagacagaggtcaaggctgcagcgaactgtgatcacaccactgcactctagcctgggcgacggagcaagacagtcttaaaaaaaaaaaaaaaaagtgggggtaggggcaggcaaaagacatttcaccaaagatatacagatggtaaataaacgtatgagaagatgttcaagataattacagtattagggaaatgcaaattaaaacaataataaaatactatatatctattggaatggccaaaatccaaaacaatgataacaccaaatgctggcaaagatgtataatgatacgaactctcatctattgctggtgggaatggaaaatgattcagctttttgaaagacagcttggcagtttcttacaaaactaaatatactcttaccacatgatccagcaattgtactccttgattacccaaaggagttgaaaacttatgtccccataaaaacctgcacatggtgggtgtttctagcagctttgttcataatcaccaaaacttggaagcaatcaagatgtccttcagcaggtcaatgaataaacaaactgtggtaatccagacaatggaatattattcagtaataaaaagaaatgagctatcaatacgacaagacatggaggaatctttttttttttttttttttgagatggagtttcgctctgttgccaggctggagtgcagtggcatgatctcggctcactgcaacctccgcctcccagtacaaccaattctcctgtctcggcctcccgagtagctgggactacaggtgcacaccaccacaccggctaatttttgtatttttaatagagacagggtttcaccatattggccaggctggtctcgaactcctgacctcgtaatctgctgggctcggcctcccaaagtgctgggattacagatgtgagccaccgtgcccggctcgacatggaggaatcttaagagcacattgctagtgagagaagccaatctgaaaaggctaccttctgtatgattccaactatattatattctggaaaaggaaaaactatggagaaagcaaaaagatcagtggttactggaggttagaggggagggaggaatgactaggcaaagcacagagatttcccaggcagtgaaaggactctggaggctaccataaaggtacatgcatgtcaatgtatgtttgttaaaactgacagaatgtacaatgcaaagagtgagccctcatgtaaactacagacctcgagggataacgatgtgtcaatgtggctcatcagttataaccatggaccactccgataacgatgtgtcaatgtagctcatcagctataaccatggaccactctggtggcgatgttgattgtggacaaaagtctgtgtatgtgtggggtgggtagggctagcgggtatatggaaactctgtactttactcaattttgctgtgaacctaaaactgctataagaaaaaaagtctacatacagaagaatgtcatgaacctgggaggcggagcttacggtgagccgagatcacaccactgcaccccagcttgggtgacagagcgagaatccgtctccaacaacaacgaaaaaagtttacatataaaaaaaggttaaacagacaatggaacagaaatttttaaaaggaccccaaaatacagagattttgtgcatgatacaagacacctctcaatgggggagatgaataagccaataaacaaagtacaaaaaattagctgggcatggtggcaggcaccacgctactcgggaggctgaggcaggagaatcgcctgaacccgggaggcggaggtggcagtgagccaagaccatgccacagcactccagcctgggcaacagagtgagactccatctcgaaaacaaaacaaaaacaaaaacaacaacaaaaaaacaaagtagggaaactagatcatcatctggaaaaaaataaaactggagtcacgcctcacaccacacatcagcacacaccgggataactctcaaatagagtaaacatttagatgttaaaagaaataaggaaccataaaattacacgtactggatgtagttcatctgtatccccagggtgggctacctgacagtggctgctggtgccacagccttgttccctagcactgtcactgcctcagggtaagggccacaccctggcatacccaccctgtagtgaccaccacagtaacaaacacagcactgtcaccaacaggccaactctttcaaaaccagggactgagagtcctcccgccacttccagatctagaggcagctctggctgcagggcgtgactgtgcagaggccaggaacacagtctggaagtgcagagaaccacagcacctccagcgagctaaaaccaatgagaaacaagaggcagaaagaaccaatggataatgctgctcccttcctcctgctccgaggggcttttctgaagcttagtggcaaaggacttgcgtgagggcatcctgcatgaccaagccattggctgtttctcatgaagccatggccagcttgacagcgtatggcactgtgcttgccctcctgcctccccttcctccctctctcttgctgccctaggattacctctcctaataaagcttttaatagctttgctttctgctctgctatgtcacctgacgtgacctgtactaagacatgggagaagacataaaaggagaaaactgtggagacagtaaaaagagcagtggttgtcaggaattaggagggataaacaggggatttttagagcagtgaaactgatgcagggcaggccagccctaaattggggattggcctgggcgggtccttggcttcgctctggaaagcatttaagagcgagctcgtggtagaagaaagcagctttattgaggcagcagtgttatggctctgtgactgctcctgcagagcagggctaccccacaggcactgtgctgagagcagcagctcaaaggcagttctgaagtcatatttacacccacttttaattatatgcaaattaaggggcagactatgcagacatgttaagaaacggggtggtaacttttaggtcatcagattgttgtcacagaaaggggtggtaacttccgggtattgccatggcaatggtaaactgatatggcacactggtgggtgttttatggaaagctgcttcgtccctgtccctgctttagttagtcctcggtttggtttggtgtctgagccccacctcctacctcattcccctctcagagatgagctattcttccttaatcttaagggggctgcagaagggtgcaggtctgaaactactctgtatgatactataatggcagatgcatgtcatcatacatttgtccaaacccatagaatgtagagcatcaggagtttctggactctgggcaataatgatgtgtcagtgtaggttcctcaattataacaaatgtactactctggtgggaggtgttgacaaggaagagcctgtgtggtgggagggggagggggtactggaaactctttgttctttgcttacttttgccatgaacaaaaataaagtatattaaaaacaaaacaactttaaaggctacattccaagcacctggaaaaacaaaataccaaatatcatgcaacagatgatgctgagtccaggaggtgttgctgaaataacatgggcaccatacgcttgatctgcacatgtgggagagggcaagctgggggaggtttgctttgctctctgagacgaggccctcctgggagcttcagggtgggggctgaatgcccatgctgccccagtatgtacacacctgtcactcctccagcttccgctgtcttcttgactttctgctggtcatcccaccgaagctcagagaacccatccacctcaacgtcagggtgccggatggagtggcccaccttccagaagcaggagaagtggtaccagtgtgggacttttccatcaaacatgggcgactagaaggaagagaaacagagggaagtaagtaagcagttaacttttgacttagacccactagaccttgaccttgacctcgaccccagtcccagccccagcagtgggatagcacatgaaacttttgttctcctatctgtgaaaggaggacagcctccgctctcacatgaagagctgcagcatccttctcacgatcttccccaagggtcagaagactgtagcccactgttcttgagctcattctcttaggacaccaaacacagccacgagaaaggtggccttttaccactgagctctgccccacgtcccttttgaccacacactgctacatttagtggtgagctgcctcatggcctagtgaaatgcacagaagacacttgtgcagagtcacaatcctgcagcatctgctgggaatggccagacaactgctccaggcttgcctggactcaaagggcctgtgtgccccagaaaagggctctttaagtgcctctgcagttaagaataacaaggaacaagtcccagataatgagcaaagcagagaaagtgtgtcagaaaaaagtgtcaagcttgcagcagccacacagatgggagtggaatgaatggaggtctttgaggcaactgtgacagcggatggttcggggcagcatgcctagagctggagtcagctgctcactggccttctggggcgcagtttcccaggcgtaggacctgagaagtctggccacagggaacacagttcccctctccaggtggtttgcttcccactaggcctttcattgtgacagggtcaggttctgctcccaggcctcgagcactgtctggctttgtttttgagaccgagtcttgcactgagtgcagtggtgcgatctcagctcactgcaacctctgtctcctgggttcaagcgattctcctgcctcggcctcctgagtagctgggactacaggcacgtgccacccatgcctggctaatttttgtattgttagtagcaatggggcttcaccatgttggccaggctggtctcgaacttctgacctcgtgacccgcccgcctcggcttcccgaagtgctgggattacaggcatgaaccactgcacccagtcctggctttacagagtggacggtgacagcgattgggaagaaggggaagacacagtatgtagtgtgtgtccctgctcctttcataagccatcctgtgtaatcccacaatctgcctctgggtgggaaccagccctttcattcacagatggagacagtggggctggaaatccttgcctggggggttgggagtcacagaggcagcaaatgaatgatttgacactatgattcctcccaccacactccactgcccggcaggaagagctacttaaaaatacaccaactgtgatctgactaaagtaagggaagtcccaaacatctgcttttatagaacataaagctaaatgtcacacagatgcaataagactattaaaacagcattaaaagtaaatgtgctgaatttttaggatggagttgcggggacagggaaaatactctggaaaagcaatgataaggtaccccactatctctctccactgtgagtggcctctttctggatgtgatgtattaaaatgcacagctaagactatggcagcacaaggactcctcaacatcagctttcccctgggtctggaatgctctccagccctgttcagagcactccctcagatctcccaatgctccttccacagctcccctcactaagaactatgcatttggtgattatttcataagggcctatcttgctattctctagcaacatgtcacagagggcacgcagtgtttgcttagggctccaagtcagatggaacaaaaaaggaaggatggggaaattcctgctgtagaagagacaacaaatggcatttctgagagcatactcatgttccaactctcaaacgttccaccagatctcaattaggctgctgatacagatccctaagcatctggctatcatggaatatttgcaatggcctcgacctggctctgcctgcttgtctaccccttgtctacccttcctgtgcaatgttccagttacccttgtataaagagcacaggtaatggctatggcacttcttcctggctctgccaggggccccagacctgctgccctttggtctgggtgctgtctcccccaaccaccggcacagtgctggacaccctggaggtgctgcccaatggtgcaatcacagcacaagcttagaggacaagagcctcagcagaagcacccctgaccaaagcaatgctttgccctaaactcaggactgagaatgatgtggcagaaaggcaccaaaccaaggtcacaagactatcgactccatttgttagctgcacagctgaggcaaggcacagaatctttggctgtgcacccaagcaaaaactgagcacctaacataccagggtcctcacccaaccagcagctggtgaactgggttcccttctgtgcagaacaggccatgctacctgtccacctaggccacagagagaatgaactgacctcactgcatgcctccgggtgctcaaaccctcccaggacagagcaactcaaaggtctaccgccatcctcctcccaccaaaatgctggagggcccagctcatccctcccaagatgccccaggcatgagggctaaagtgtcaggtatcagatactcagagaacaatactcccatgtaaatgtaaaagaaggtatttaaattcaagcaagtgaaaaggcttctttctttttggccttcaccagctcagtctaccagaccaactttaaattctgaattaaaactctgaatccacccttaatcaccattacataaaaatcacagttacttttaataataaagagtttctttcactatcaagtataccaaaggaaagcccagaatgttgttattactattttttttttcagacagggtctgggtctgggtctgggtctgtcgcccaggctggagtgcagtggcactatctcagctcactgcaacctccacctcccaggctcaagcaatcttccagcttcagcctccggagtagctgggacttaacaggcacgcaccaccacgacccgctaatcattgcatttttttgtagagacaggtttcaccatgttggccaggctggtctcaaactgctgagcttaagtaatctgcccaccccagcctcccaaagtgctgagattacaagcatgcgccaccaagcccggccccagaatgctaaacttgatcaggttcagtttcctccatccggcctcccccacagctaagcctcctctaacttcctccacagcggtgttgttctagcctcaacacagtctggacttgggttttgtttgtctttccaccagaacacggtactctgcccacctgttaaggcgcctggatgtccctttctcagaataacatttaaaaatgcgtaataaaaaggctcgcaaatggccagtcacggtggctcatgcctgtaaccctagcactttgtggggccgaggtgcatggatcgcttgagctcaggagtttgagaccagcctgggcaacatagtgagaccccatctcaaaaaacaaaacaaacaaaaaggctcgaaaaggaaacactgagataattatcaaaacatttgaaaggtaatttgggtacagtaacccgtgagcttttaagcattaaataacaagatctagtacagcctctaataactgtgatttttgtagcaatgagagtaaattatattttgaaaaacttccaactgtaaagtgatatgaaaatatctgtaattatcactggtgaaaaaaaaatagggactgctaatatgcctttgctttgctgcttacatttatgattagaggaaataattttatctagaggttagtggagatggagatatcaattttttcttatctaaactcatggacctcttgccttctacctaccatcccacagaccctgggttaagagctcctgcaccaggagtgagaacttcataacaggctgccttgtatattcaaagtaagttctaggttccttagtgggcaacaaggctcttcaaattgtaggccctgtctacttccctattctcatctttctgctccacttctgtgaattaacgactcctaatcaagcttccacccttagctgggtcatctcggactcctaggcacacaatgcctagagcacagctccatcaggtggcatccatcctctcttacggtaacgtttgtttaccagtcatttcccgtttaaccaaactggaaattcccaaaggtggattctgtgtccttaaaacctaacagagtgcttagaacttaaaaaatgcctaccaaataagcactgtgtgccacgtactgacttaggtatgccccgaggacaccaagatgacaggcatattgtgaaataagataacggaagtacacctggcacttgggtatccactcggtaaatgtcgccctcccttgtactaagtactgaaaatccactgagggatatctggtcattcctaaaacacattacagctcatggaagggaggaaaatcaagctaccttgaccatgagcactaagcttgggtaatatgttggaagcgaggaggaacagggcagatgagaaccagaattattaatacaaaggtagacatcggcaaactggaagctggaggcaggagcccctgggaaatgacaggggccttcaagcccaccacctcacagaaggctcaggaaacctcagaaggggattcaatctatcaaaaagcccacatgagaaacccccctggagccactcttactcaaaccagacagctgcaaatgcaccaagagaacgcgtctgtgaatctggaaaatttggggaaaatgttactttaaagcacaaattaggctcaaagtgaatgtactgtacagaaatgacacctttctgcatagttctgcctaattaaaataaaaaatgagagtgagcgtttaaatgacgtgttgaaatgactgccaaaaataggtttaacaaaaaaaaaaaaaacccacatgtcagtcgccaccatccatgtagaacaaaaaccctccagaacaagataggtcaaaatcagattagcttaaagagaccatgtacaattcccccccaacccctgaggcgaacggcagtaataaaacaccgccacccagaaaggagaagagaagaggctcctcgttttcacaaagcgaaaggcaacaccagctgcagactttatttcccgggcttttcctgcaacatcagcaaaaccttccggaagggtcggccgggccgctcgggaggaggggcggccgcggccccataggccccaagtgccgctccgagggcccgggcccgctcgctccctgggcccgccctcccccagccttcccggacacagttaacccggggcgccgcgtccccgccccgccgcccgcacagcggcccgcacctgcaccatgatggccatccggagcgagtccttggggatgctctcgctgcatttcttgcaagaggcgcgcccgctcttggcgtactcgactcgatagagcttatccgaagactccgccatcctcccctagctgccgccaaagctccggaagcccgacgccacgacctagaaacacgctgccgcctcgccgcctcgcgtgcgctcacccagccgcaggcgcctgagcggccagagccgccaccgaacacgccgcaccggccaccgccgttccctgatagattgctgatgcct

SEQ ID NO: 30 - DNA, 1117166 bp, Homo Sapiens
tatcttaggaaaacatgaatctcagggtcacagctttattgtatagattttttaacacagccatgttacaaacattgtcagggaacatttacaagaataaataagatggacttgcaggtgtaaaaagattacacttcactgtaatgtacagtcaaaaaatatatctgatattcattgacctgacattatttaccttctgcttttctgagctagaattgaaaagaaaaaaaaaacattgacagcacagtgctggcttttttaaaaagttgatttattttgttttctcttctcatacgtgctttatctatcaaacacccaaactgtacaagtgcaggccattgggattcatggaggaggctgcaaagagtgtggagactttggtctcatgcaatattatatgcccagtggatgtgaagatgtcagcctccctggagttgagcgggaaccttgggatagcttgtgagggtgtccagaagccaaggcaatggtagaggccacaactctttgtctttgattggctagtagaatgtagggtgaaaagtgcttttgagtatgattaccaatatgggttaacccggatttacatgggctagctcaggatccacctggtgatgaaatgtgtgcactggaaatgattataatcatgtgtaaattgagttactgtgcttttgcttttgcagtgtgctccaacaggccttgaatagggagtggggtagaaataacctctggagataatgtgtatggtaagaaaagccctgctctgtgtcctacttggaccttcactggttctggctgtcactcatggccctgttggtcagtgggtctgagttatggctgctctcatgagagatctacatgggtattgggtctatggcaaagcagctgttccctatggtttgctgtttggtgataaccagcctggatcagcccagtatatgtggccacaacagcatgttggcctgctcagtgggggcacttgggtgggagagcagggggcttcagcctgtacagaccaaacacaatctacttggattcgtgctctacaggtatgaatgagttcaaacatgatcccagctccacaagatctcacccatctggaatggaagtgacctgaaatccatttcaccaatgcttctcttccctttaaagagacacctgccttcttttagacagctgctgagatgggcagcttatcctctctggcagacagcaggttcttccttacagctattaagtttcactcatgggtcctagttatactcagaggagtgacctgggtctagcaaactgtgcttgacttcatccaagaatctgcagagctatggaagatatggacaccatattctgcctgacccctcagaagcctaactttacatggaatgacaccactctgccctctaagcctccagactgccctggggcctttgacccaaagaacacctgacattattcatcttccatgggagatacagggacagggtggacactgagagtttgttggaccatcatagagaaggcccactgatttgtattcataagcccaaaggcactgaagtaattgtacagagactcaattttgtaattttggtggtttacttcctatgaccctttctcctccacatccaagagtcctgctcactaaggaaccatgaactacattaattaccctgagctccaggcttttatactgatacttttctgtccaacacttcaaggccaccagacactcattctccgaacattccaattaaggatcagagtccacatctcaccacccagagcagttctcagatatagaaggaagccccataatgatcaagcccctaaaactcttcccaatagattttctttcatcctgagcccttgcacttcccttgtatctgccccagtggaccacccctgagctcttagataggtgggatgctaggtttggaggctaccattgtgagtgttgatgcctccttttagagacctaacattcatgagtggatttcagttggtgaatgccctttgatgaccttttcccatctcttctggaggtgggcaggtgggatgcaaaagactggcttgatctctacaagacatctctatagtcagtgccatgcaaaagcccatccctggttactaaaaaactagaagagtctgctcatgtgcacaaatatggcttagatatctctgctgtgcttcggaggatcagatccatgatcctgaaaaatgtgtcagaagaaactggagctagaacagctccccccacactccaccactaacctctctccctgctgttcagtctatgacctcaaaggcagatccctgcaagacaaagccaaggccttgcattctatcacttctagacatgtatacatggaaaacctccaacagggaaactttgcatgggaggagtaaacaaatctgaatctcagcttgtctcttctagttggatttacttttcctatttccttgttttacttggctgtgatttgaagctggtcacaggctaagaaggagctcagactgttaagtaatggggaagccaagtcagggatttgagatgacatgactatccacgtttatgttttttttcttctaacctaccctccagttgggttgaccatttttttccctggggatcctggcccagcacaacctgttgacatgacttaggaacagcgtcctgttcatgcttcctcttgggctcacccatgtcttccagagtgttactcctggttgagcttggtgctgatgacctgtttacccagcccaggagtggcaagctgcagcctaaggaagggtggctttcttcattttgtcccaaggcagtgaggtaccaaggaattatcatttccttcaatgtctctggatctgggttgggcagtcactcctgcagaggtaacaggataagggcctggctgctactccctgggcctcacttctgttgtgtagagcagtcttactggactgatacctctatgtactctaaggggttcccaccagcgacgaggaaatgtagatcctggtgaggacttacagcaagagctagtgtggcaatggggagtggaggatgaataaacatgatgggtcagagggaaatgcatcatcttttgccccagacactgagatttgcccttgttccaagtggctctggcaagctgttacccatcctttctccagctatgtcacagaagtgaccattttgctaaataagtcatctgcatcctcggttctgagtattcactgggttccagtttcctggccttgcgttcctgttttcctgcctaaagtgctccaaatctaccccttctaatgttgatgagggtccttttttcatgtatgtttttcatgtatgtatgttttcgttcaaactaaagactgagctctgtccaccacaaccccatgccttacccaggaattaattgtgccatagtaatctcgatttcctaatagtgccccctccaaggtgctaggtgctgtaggcacccagtaattatgtgtggctagggtaaagtgaggagccttccagaccccagctgctcatgaagtgtgtcctcagacttgcccacattagcaaccatgtgactccacttggacaacaggcaccactttccagcctagcattcaggaatctgctgagtacagctgtgtccagcttctcttttccctttagggttttgtgggctcatccttctccacgccagatgagcaaatcctcatcattctagtgtgagttaatgggttccttccagcacccaactggaagatgccttagttgaggtcccctcatgaacagtgaggtcagagcacccacacaccaaaggagctgcctaggagaaggtcagttggtcttgatcttgagcctataactggctctgggaggcagcagggtcactgctcctagagtcaattctagggtcaagctgaagaccagctgacctagggtccgtcatagcggggtgaacagaacagaacaacatgaggaacagagcacatttttttttgaaatattcatagagtcatattaaaaccaacaaggctaaatcagaaagtggaatgcaaattttgcatgaattgtgaacgtaaaacatgagactatgaaggaattttaagcttactgttgtttgctttgagctttatccactgacgtatctgttccactctagtctcttctgttatgggtaacctcctgggaaaaatgtgagatacaatggtggaaaaatattgtctctgtagtgagaaaaaaccggtttaaatcctggttcattcactcactagctgtggaactgtgggcaagtgatttctcccctaggagccttagtttcctcatcagtaaatggtgacaatcacaaaccctcctttagaatgctggaagaatttaatgagctcacatgttagagtccccagcatagggtctgttggttcctttgcaggccacacccacagagagggccagcactaaaagcaaactgtccccttccattcccacaaagagaggcctactgtggccttctagaggcccaaggacccctggttggcccagattcttcaccccagaaaggatgcaatgttggagtgcagctaagatacatcctgaagctatttaggccataaacacaggtggagaaatttcctgggcttctcattacttccttgcatcttccccaaacagagcccacatctatgaggtaagagctcctgttgtaaagactcagagagcattaataatattttcctctgctcatgacaggctgagctcaccctgtaaatggggtggggtggggagaccccctgggggtggtggtgttggctccggagatttcctgggtaaaggaaaatgttcaaattcctgggcactggtgccccatctcatccaagccttgccacatccttgtcccatgggatcttagggaagtcatccccatccataagcctcaatttcttcctgtgtgcactggcctaagacctattcactgtcctgctttagagaatggttgggttgtgggaaaataaggggatgagctgggggaaatcatcactggcccttgctgggttaccccaacatggcctgagattttttttttttgcaagtttgtttctccctgaagtcacaccttaaattcctaccatttaaaatgataaaagccactgtcttttgtatctgccagctatttcaccccttcctgagcagaaaaaaatcttaggatttgtgttaaatagctctccctccaccctcatcctgtctggatgtaccaagatctaagaaaatagcatacagcaggcagatttgccatgctacaggctccttgcaggctggggaaggccagctggggcattgggctggagccgagggaggccagcaggcccagtgggggtgggtccccggggtctgctgaaatacacctggggagaggctcatcaaaggaaaagagcaagttcatcgtggggttcctttgcttgcctttgctttgaggcacttccttttgaacctctaaagtgacagcccttccttgatcaagtctggtgtccctggacttctggacagctccagagcccatgccaatggaagcaacttttgtcggctcctttcatgttccatcctcatgggcctggagatctgggttggtgaccctgctccgtggtaaagcagagaccctgggtttctcatagaatctgagtctcatgatccattgcatatttagttccagcaacaaaacaatgagcagacagacaaatagatgtgatattaaaaagtgcacgcttaagggaatgttttcacagtgtctgatgaaaggaaaagaggcagccccattggcccagaaggagtcttggccaacacgaagctgagtgcatctctctaaagctccatggactccttgttgccaataggacaaagtctgtactcgcgatgggcatctgtctcctggaccctggctcatctcttgctgctccccgtgttgtgctgtgcccgcactgggctggcctcccccagactgcttctcccaatgccttttcacatttctttgccattgcacatatggatccctttgcctgagtttcctttttttcctttttatgcttgttaagacccagcaggaatggacgtccccttctccaggaagcccgaggccgaagagactttcttgctcctaggctcatggaacactcatccactccacactactgcaccatggttccatttccccagcatacagtgggctcttgagggccaaagctgtaccttcttgaattctctgcccctcatgccctgtctggggctagaccagccttcaagatggagcttcctaggtcccagcccacctgaggctgtcagatattgggcctaagcactggctagagatcaaggtcgagagtttccctggctggtccattcatagcctgaaggaacagggaattgtttttactgactaagaaattagatgagactggctttcctggggagctgggaatgtgttactaaaatatatctgaaattctgcgcttcccagaagaactggcatcaggaagaaagtactaaatttccatttgtggagttatctgctcagaagtttctggccttattttccctccataaaataattgcttggcttagagaagatgaagaaaacagcacggagaagtctcattgccattacctgcccctttggaacccaggatttcattactaaggaaggtgcgtgggtttcctcattggaggagatgatcaaatggagatgataacaagtcagtagctctctcctgggggttctaaggactgtgtgaaatgtcctatggaaagtgccaagcatgatccctggcatacagtagagacttagcaaatgttggttccctctcattgactcactcacactttggacaagaccctagatctccaggcctgattctcttggcctattttaaatcaaagtataatgggctccacaatggcctttttcaaggtggctgctgggtttctttaggaaggagttcaaatttggacatccaaattatgcacaaagctggtgctctatttgccccagaaaccaaagggaccatcttcaggctcacccatctctccttgctcagtggcatgctgtcccagggtgggagcttttaaggacattgccaggaaaaaataaaaggcccgagagatttgtcttagaggtacatactcaaactcccccgcccccttctttttgacataagagactaagattttacaccctccaaaagaaagtttcttttcacatacactttggaaaataatcaaatcttatcttgtttgtctcttccaaagaaagctaccaccaaagaaacacaggggttacatcctacaggtcagcccaagccctgccccagggaggtggtccctttttacaaagacaaggaggagcagagaagttccctgcagttccaccccctcccactgaccacacaaaaaagcaaagaacacctttatcaaaaactgctgtggacacagctggccggccagtgaatgctggacggtcaaggcccaggctggggaaggggtacagaatggttgtgggcgaagccccatgcaggttaggtgtgaggatggggggcctctcttgtggcctagggaacatcgtaaggtcacactggtccagactgcaaatgtctggtgccagaggcccctgaaggaggttgcagggggcagcagagcagtgacccccaagagcctcaatcttttccatgacgtagaggagcagaacacacatctcctccactcctaaggagaaggagggcaggggagcctcccactccccagcacctgcacagttggcttgccaagagatccacaaactcagaacaaaagcaggtggtctgggagccagaaatccaaggccttgcttgtgggtgtacttctgcttgggcccttggctgtggctggttaggttgaaaaggaagcctgggccttttggagcagcatctcccacggcaacaggagacccctcagaaggtgcagagccccccgtggaacacagggccaccagtcttctccttggagtcaggcagggtgccacctcagagctcctgagcccagttactgccattcacacaaaagggggcttggtcacagcagcctctggactccggcaggttccccatcccattgagctaaaaggagcttaaatattccagtgccacctcgtatacaaatttatactgttcctgagaggcggagaggagcagaggcagagagggagaagaggagacgagagagatgaaaaaggaaagggaaaatgcatttagtttagagatacagattttggagaaaactttttctatatccatattatgtcaactcaaaattacccatatctggacatccttcaaaattctgcttgatgcctgcttctacccaagcttcctcgaatgcccagctggcatcattccctttcttttttactgttttgtacaacagggcttctcaaactgtaacgtgcatacaaggcagccagaaatctttttaaaatgcacattctgattcagtaaatctggagtggggctcaagattctgcatttctaacaagctcccagataatgatgctgctgctggtctgtgacccacacgttaatatggcctcattttgactaagaccactattcgagtaggtttaaagacttatattaaagctcctcgtgcatggtgcggtggtccaccatggtaccaggtcttatcacccggggctctgcccacacactctctttatcacactttcctccatagtactctctactataaatgctctctattgtaaaaattaccataaattaattggaatataattggactgaattgaaaacatacttcacattctactaatccagcatcctttcctttaggcctgaattaatgacactgtcttaaggaatgggcagaaagtgaagcaaagtaggtgtaccaggattagtaattggattttcctgcaagaaagaaaagttggggaggttggaaggggaagacacaggacagacaacagtgcataccaagggcacagaatgcaggtatacaattagcagccaggtgttgagtgatgttactatttgatgtcattttctccaggtcaagggaactagtcagccctggctgttggagaacagtccttgggatactcaccagggtctccaccatgttggatttgttgttacgcagtgttttcacgatgtggaacacgtcaatgatgttttgctgctggatcatctcacacacactgcagatggcacagaaggttccactacggcctcccccatttctaaacacagagcaaagaggtgagccatgttcctaggtcccttccaggcacctgatgattctaaagctacatcagtaggagtagggatcagctgtctgggcagatgcaaggcaaggcaatggtgaaggctttagcctgagccatgagttatggtttgagtcccatctgtgccattaacttgctttgaccttggccaagtcacttcctctgtctgggccccaagttccccacttgtataatgaaggggttggactagatgacctttgagagttcaattagcttgatgttttcttggttctatgagcatgttacagtcactcagggcacactcacccaaaccccaagggcaggatggtactgtgtctttgtacatgtgacacctgcatccttgctgatgcttgcatccatgtccaaaagaatgctctgggtccacttaaacatccaataaagacaatgaaaatttccaagtgattttcctactagttcttcccatcctccactaaggacagcaatgctctgttagcctagggtcagccagcccaagcttggaggtaggaacttggagggaggaactggtcctgataggctttatcttaaaatgacaggtctctactatacactttggtttaagcaagatgctactgatcttgagtctagggatacagggttggtggcagaactgtgtctctgttactcctttctgaaactccataaatcatcttcatggaaacacccttcaaactctttacagacagtccctgtaggaatatgcctgattcagaactcctgggcgtgttgccaagagcaactaatgatttcatgtaatggtctgtgtctaaagaacatctggacagaaactaaggcactcagtcaatctcccagatgttttatctacaggacatgcagtgaccagatgtttcaagtacagagagttgctttccattcactgactggtgcctgcatttcaaggtctgttatggtgtctgtggccctcaaggaaaccaagttccctgttggtaaaagaatgcccctgtaccttcctttggctcaaactactggccaccttggctggaaaggacatagataaaaagacactagtgcaaaaaaaaaaaaaaaaaagcaggctaaaaaacaaacatgagagagagagagaggagagaaaggtctcctatgaaagacggttctatcatttctgaagcaagaataacagcgtccaaaaggaagaggtgagtagacacagggtctcagggcctggtggtgtgagaccctgaaagatgggtgctaaggtaaggtcacctgaatgtgtgggaggcatctgggcatctggaggcagcagctattagctggcaggaaaccagctgctagtttctgggatgtgggcagagccagctgggcttggctgatgtcacccatcagcctgacttgggacactacgcagcatcttcctgaactctagcctgaggtttgcttcctctggagaagaatttttgctgcaggtggtggccctgaagctctgtgtgtgcatctctatgtgtctgtgtgtttaacctcctttaagctctttgacttgcctaacatgtgcatgcaccacctgtttgagagggagaataattagctggttttgaaaagactgacctcaattctgaggtcagtcagatgttatcagtgcctccactagctccagaaatatttgttgtaagaaagagaagaccttcgttcaaatttcctttaacataacattttaaaagagagaggccttctcaatgacttttcctcaaatcgttgaagttctaagaagcaaagtgagtgtgaatcaaatatttcacacatagctgttatggctgcagatttgttttgggtgtgagactttgtagaatcctctgtggtcactctatactcccaggatagattctgtgacacttgctcttttaagtaattacatttacgtttgcatatttgctaccatgacattcttggtctctatgttggcagataaagtgtgttcactttctatttcatgccaaagcactataaggtctgaagattgtctaattccacatacccaatgaacagacgaggaaactcaggcttataaaattcagtgattttcttgacgttgcacagcttgtcagccactgtcctctcgaggtcctgacctccacccagcgtaatgacaccagaattcattagactggacaatgtccattcgaagacaggaggtaaagtctccagttcaccccagcaatgggggtataaacacagctggtctggagctcactgtgcccctgcacaatagtgttcctagagtccttcacatccatctatcagcccctgagggcagtgcctttccctcatgctctttttgtcctatgatccctttaagcccattgtagagaagcaggcaacctcctctcatgtttgtggaaagaccactaggttttgcatcaataatatgtcatatattagttcaggacaacaaactggcagccccgttccattaaaggatcataattcctttgaatgtactgccactagcctttgagggatgttgagttgtggtatagccaggcctgcctaggactggggtatgtggccagcagcatctgcaaggatgctctatcacccaccaccctattgccctggtgacacctccctagtactcacaggcagtggaccacagtacgtccctccctcccgtcatactgctcctgccacttctccagtcgtcggaccactttgagcagagagcgcttggaggggggcgtgtcccggtaggcaggccagccaatgtactggaggtgctggactatacgataaccatcctgtggctgagaacagagaggctgttagggctgttctgctggggatgcttgcgtacatgcaccttgcagataccccggggactgcagcatcatggtggaagacagaccaaatgggatctaagccatgtcctcacggggagagtccccatgactacttctattccttcgtgtacacagattctcttgccgtgactgccctgaacccccttttgtacctgaaaaactcctgctcagccttcaaaacccaatttaaatgtccctttctttaggaaagccttccctgactctgttgggcagagttttttctccctgaggctcatgtgccagaacatgtctcactgtctcagtggacagtgaactctgagcaggggggtaggggaggtgctgagctcctttcatcctgggccccaagtagtgaccaaagctgcattagttagcaaccatttcatagattgctaatctgcccctcccacccactactctgctcagccagtgaacatcctcatggaagtaagtaatcacttttcatctaggtgttggcagtgcctggcccaaagcttatgggatccaatcaaaggctgcatcaactcatgccagtacagagacacagtggggaagagctaatgtctaagaagttttgtctacacggcagcaagtgtgtcaggaaacaggcagatggcaggttggatgtcgctcgttgcatctctatgtgttggagtcattgctgagtctggagccggaatcagcacaggcatcacttcctcaaggaagaaattatcaggagagcacaacacagactcttggctggctcagcgggatcctctctcggcagcctccatctgtcttggggaggaggggctcagcaagcaatggcggccgtgtacttacccgggccatgttacagatgcggaatattctgtggatgatgtcctcgtcgatgtctgcggagacgaactccacctggatgggcccatagcacccggaggtcttctcaggccagtactgcatacagaactgagataaggaaagaggtcacagaaggagctcaaaggcagggggcgggtatcaaagtctcatttatcaacaagcttttcttttctttttttctttttcttttttttttttgagatggagcatcactcttgttgcccagcctggagtgcattggcacgattttggctcactgcaacctctgcctcccaggttcaagtgattctcctgcctcagcctcccaagtagctgggattataggcacctgccaccatgtctggctatttttagtaaagatggggtttcgccgtgttggccaggctagtcttgaactcctgacctcgggtgatccacctgtcccagcctcccagagtgctaggattataggtgtgagccactgtgcccagccgtcaccaagctttttttatggctggaaggacacattggccagaaaggtagagtattatgtaggaaattagactcagtttcccctttagggagcagccatccactttttctggtgttgaaatatcaaggctttgagcacagaaacactgggcttgcaaatctttgctatgttgatttcaaaccatttgttaggtttgcttaacctgagtttcctcatctgtaaaatggggagaataatatctacctctaagccccgctgtcaggattagatagaacatgctaaagaaagggcaagtaccatctatttttcttttcaccacgcaaatcatcacaagctcttcctcattccaggaaaaccttcatagtgttcattcatgatcagatcagaagtagtgtaaaaaatataggggtttcgggaggcggagcttgcagtgagctgagatcgcgccactgcactccagcctgggtgacacagcgagactccatctcaaaaaaaaaaaaaaaaaaaaaaaaaaaatatatatatatatgggtttgacctcaggcggccttgggtccaaatctggtctcaggtgctcactagctgtgcagcccaggcctcagttttctcataggtaaagtggggataattatgcttactttgcaccaaaagttaatgtcacatggtgctgacagatcttgcctatgattctttctatttatctggaattggaaattagaacctacagctgagagcaaaaggcagtgattgaccttctgtttaagacagtggttctcagtctgagactgttttgtttcccagagggcatctgggcaatgtctgaagacattttgattgtcacacctgcgggttgctatgggcatttagtgagtagaggagaggatgctactcaacatcctgcagtgcacagattagctccccccgagagttatgtggccccaaatatccatagtgcagagactgagaaaacctagtataaaatcattataattattattattattatttttgagacggagtctcactctgttacctaggcgggagtgcagtggtgcgatcttggcttgctgcaacctctgcctcccgggttcaagtggttctcctgcctcagcctcccaagtagttgtgactacaggcatgtgccatcacacccggctattttattttttttatttttattttgtgtttttagtagagacagagcctcaccgtgttagccaggatggtcttgatctcctgacctcgtgatccacccaccttggcctcccaaagtgccgggattacaggtgtgagccactgcacctggccataaattattctttaagcttcaggggtcattgagaagaagagatggaggctgggtgcggtggcttacgcctgtaatcccagcactttgggaggccaaggtgggtggatcgtgaggtcaggagttcgagaccagcttggccaagatggtgaaacccgtctccactaaaaatacaaaaattagccgggtatggtggtgggcacctgtaatcccagctactcaggaggctgaggcaggagaatcacttgaacccagggggcagaggttgtagtgggtggagatcacgccactgtactccaacctgggaaacagagcaagactccatttcaaaaaaaaaaaaaaaaaaaaaaatagaagaagaagaagagatggatatcttgtttcttgtatctttgtctctgttaagccactagataactttagctgaggagagaatgttgaggtggggggtggggtgtgtggctgcagagaggagcaaggcatgctccctccagttcctggttcccaaggggcacaagatggatcctgcctaggtctacaggtcccattgctggggtacagaggggagacaagattgcggctgcaggctcgctggggaccaccccaacatgaacaaagaagtcatgtgttagacccttcatctgggggttaccctgaagatatagccaagattcacaaagaaagacccaccgaggcttctgagagcagtttgggattgagtctctcctcagcgggggtctggttcaggctaccccaggcttgcaaatagggggctagatggacagaagtgacccaccccctacagatgcagggttttcatcgaagggggtgcttgctctccacttcgtggccgaagaacagccatctcaccctgagaagtcacatgtgaaaataccttcattctctccttcctccagaactagaattagaagggaagagcagcgagcaggaaggatgtaggagatggaaactcatgtctcccaccttcttagctgtggaaaccccaagttctagcttaggaatattcaccttatagcagcagttggcatactattgcccacaagccaacccagccagctgcctatttttgcatataaagctttgctgaaacacagctacacttattcatttatgtattgtccacagttgctttcatgcatcacccacagagttgggtagttgtaacaaagaccatatagcctgcaaaacctgaaatatttcctatctggctctttacagaaaaagtttggcaacccctactttatagggttgttctgaggataaaggacataattcatgtaaataaacccttaccacagtgccaggcatggaataagcatttactaaattccagtgattcataccattgttgaatccatcagtgctcaacaaaaataataatagtaatagctatgatatataaatttgaaggattcttcttatcgcccctcataaatagcataagtatgcaaggttaagcttcagaacgcaatgatgccttgctttcctggcgtctccactgggggttaaccaagcatagtgagaaaggagctctgagtgtgtgtgagtgtgtgtgtgtgtgtgtgtgtcttgtcgggcgctggtcacgggcctccatggctggacaaccatctgctgagctgtgcaatgatgacaaatccacaatttgaacttcatttctctttgccattggctcttccgccttgcaaccttcacagtaatgagagattggtacaaataagtctatggttggtcagagaaaccagaattaatcagaactgcccattaaaaaaaataattgcctttatcacctgcactgaatttagggttcctagagtttggctgtgatcctgacacaaggtgcatggatccaaggtatcagggaagtcctattatccccaatatcttcagtctggagagaatgtggaatgatttgtctcttttaataagatttccagaccaatttctcaagctgatagattctactacgcctcaaacaagactcctatatttcgggacacttctctgcattcgattttctgggtcactctctcataatgcccagagggctggggaaggttgcaggcttttctaatcctaaatcagagtcatcctttcacttggatgccctaatttgtgagactacagcagcagcagaatgggtgaattcagcagggtgatgtgctggcaaatgtggtgtttgagctgccagggatcatcagggtctctctgcagcccgggacactgcatatattctagccatgggaaataagagaaagaaagcaggggggccatgttttctcttcccactgaccctttggggctcagaaatgactctcatcaataagaaacatcctctgtggtttagctcaagactgtcctggtgttcaagtgctgtagctgcacctgaatggatgctaccattttggtttgcttatgttgtgtagcaaaaggtgcgaaaatgcattggggtttcttcttgaagctccctggattcaaatcgtggctctatcactttctagtttgaatggcttggctacatctcttagcttctccagtttgttatgagtggctgtgaattttaatgtctacttagcatagggatctgtatctagcaagtactcaattaatgtaagctgtgattattaggcagtatgggggagggttcctcaaaccaagatggataaatagatgatttttttcctccacttagtagcttttatgaaaatttctctttaggataatactcaaaggactgcccgtgtggaaattctggatcagccagcttggggtagctgtgaagatgagtagcatcctagatatgggatactgcatgtcaaaatacagagatctgtgggttgctccgatgagctgaatgacccagaagataaaagaggaaggttgagatcactgtagaagcagtgaggtataaaaggcaactcagtgtgtcacataaccctgctcctaaactctgaaatatgccataaactcataatagcatgtaaaatgcatactgtgcatgtatttcttgcagaaaccagcaagaaactgagctcggctccctggctcacatagacatggaacagagatcacatctgtgagtggaggagccagacttttcatataagcacgtaagcatctgcgatttatacaactcctggggagggaaagcttatggtttcttaaggctcaggaaatgggaattctaggaagcctacttgcctctttaagatcacgaggacgtagctgacctaaaggccacacttaccctgaatgcaaccttgacattttcttccttagatgtaaaacttttgaagttggctgatccaagaatagattcaaattcttcagccaagagtctagaccaactgactttttccacttcattgcctagtaagtactctctcctaccctttcttttccagtggtctgagggtgaaaggtgatactgcctgaagggagggctttgccactgcagatacatacaggtagtggcgatgaacacaccggggagaggaagtcagtccagttgttgttaatgatttagaaataatcatgcttcttccaaaaaaacagaggggacttttgttgtcttttgtcagaacaagttaaaccaagcaaaggttgtgaagcctgtgtggatagccctggaacagctgccatacattattccacctagtgctctccatggctgtttgggccatgaaaagatgtccttggggggtgcaagttcacgtgtgatatataacaaatgcagaggtagcctcacgcattaaacgtctttttcttgctgatggaatcagaaagcttgttatcactggaataaacatgctccgatgagttgaatgaaaactagcatatgggtctatttttggaataaacatttttagagcatatttcagtgcaccttagttatgcctttcttttattaaaaatactttgataaaatggaaaggccaagtaatatcatcacgttagaaataaaggactttatttattaaggcccctgcgacccagagtgaagaaatcaatcccaggccacctaaaggtgaagtgaattggtattttaaagagagaaatgtaagtttcctgaattgcttttaaaattcagcatcagtgattataaaattcctttaaacagattctataaagatccaaaaatatataattggctttgatactatgtccagttaaggaaggcagactgtgaatgaaggcataaagaagacagggacagagggagaaagagagggagagagaggggggagagagagagagattcacacatctctcctcattgtatccttccagtagtcccatgaagctccataatacaatctccacatagtgggtggaaacttactcttaaaacagctgcatcagagtttgtttcagggaaggaagggttggagtttaggaacttacctacagaagagtcttggggtgggaggcaaggctcagagcaggtttaagaaagacgtactaaggagatggctagattttgcagcttaagaaaggaacaacttttggggagagggtggaagagctgagaagggagggatgggaaaggaggtaaatgggaagaaaatggtttgggcaacagggtcaggggaagatgtgttactgctagtgagagctgaggaggcaaggtgaggcttcagaaagaggatgtgtgatgttcaacttgaagtcatgggcattgctgggatatgaagctcatatctctccgactaaagcctcagctgaaacttggaagtaaacatgagaagacaaccccctcagaattctcagaaatgttggggatggacattgggttttcccataggatggggagtagggaacagagcaaattttatttaaatcttcaaagacagaatgaacttggctaacatctaggttatagtaatctaacaaatgataacattaagacttggagaaagtaaaggaactggctcagggcaacacagtgagtaagtaccaaggctacaatttgaactcaggtctcttgaccccaggtttcttttttactgttacccctaccattctggtggggacagaaacagagacacagccccttgcaaagtcagacctgaggctggctgagatgcaggttgggtattttgcatattttgctggtgtgttaggctgtgttttcacaagcccagactaaaaatggggatattaggagttgctatttgccctagaggcacaatggcagcaagagacatctctgaaatagcaccctgcttttctcctgggagaatgaggagcttgcctctctcacttccatgggaatccatcacagcccccattatccttgcactcaggcaccctcacctttccaaaaggctttgcatccctgatctctcaggctttccacagtgggagccccagaacagagcaactcagcttttatgtaagttgtggactcttatttgttttaaaggaaagaaacatccttgtatgctccatacaccaggtgccatagcacattcataggtctcaggggttaggatgtggacatctctggtggggccacgattctggctaccacacagccccaccctttggctggcatgcaggatctcctgagctctctaaacagtatggtgagtatggcatgactgcaaggagggcttctttctggtgtctttctggtggtccgtagagaccacaaagagggaaaagatcttgtcaatgctgttggatgtggttgaaaatgttctttctgctgagtctgagaagtgacagcatgctttgctggctggcgtggttctaggattttaccccgcaaatctgaccacagacatttggagtcctaaagagttagaaaaatctgtaaggttgaatgcagaagtttgaatgcctttattttgagccctcattgatcataattacctttgaacagcaaccactgcaggaatgaaagaaaatttggggctgactaaatgaagtagtgtaagattctgagcaggggcagatttggccagcagtgcaaaaaaaataaggccctgtgagagcttacaccctcttcttattttgctgcagcttacaggtagccctgcccaatccccaacgtacgctcttatggttcccaggcaaaccacaggagatggcatcggtcctctcaggagtgacctagcaatgctcaggtcctaaggcagacctgtccatgttgccaggctgggctagcttggaggctgccttggcatgagcacgcaggcagacagatgctgacgccgcttcaaagaaccgcccctccaggtgctgagggcggcttttctgatgctcatcctgtgtcattgtttattttcataaggcgcccagctgctgcggtgatgatatttatatcaataagtgctctattcatctgccggtttcagggaatgcttgccagctgcgtatggcagccaacctcagggtacttctgagcctgatgtttttgcatttagagaatcagttctcaaactctgtaccaacatctgggcctgaaagattcttcattcacccaggacccaccctgaaagggggagctatagccaatgaccttgacctttgtttcaaaggttttatatgtcccgaagtgaagttctttgaaagtcatcctctgtgcctgagctctggttttgcagaaagggatgttgaaaaagagaagagcaaacagggttttgcaggccagacttcatgcccaggctcatgagctgagttcattcttttatttcttcagccaaaagcgtagggtggtgatgccttcagactccaaaactctgcagggaatgttccagaactctctgttttatgagaattcatttattttttatagttatctcagtttctaaccttctattgctcaggccccaatcattgacattatccttcattcctctttctttttttgacagggtcttactctgtcgccctaggctagagtactgtggtgtgatcacagttctccacagctttgatctcctgggctcaagtgatcctcctgcctcagcctcccaagtagctaggattacaggcatggaccaccatgcccagttcatttaaaattattttgtaggactgggtgcagtggctcatgcctataaccccagcactttgggaggccaagatcagcagatcacctgagatcaggagatcaagaccagtctggccaacattgggaaaccccatctctactaaacatacaaaaattagctggctgtggtggctcacccctgtaatcccagctacttgggaggctgaggcaggagaatcgcttgaacccaggaggcggcagagttgagatcgcgccactgcactccagcctgggcgacagagtgagactccatctcaaaataaaaattcttttgtagagacagggtgtcactgtgttgtccaggatggtctttaactcgtggcctcaactcctgacctcaagtgatcctgcttccttggcttctcaaagtgctaggtaagattacaggcatgcctggcccttgattcctctttctctctcttattccatagtcaatctctctggatgtgttgttggctttaccttcagaatctaccccccagttcaaccaacctcacctgccacctgaattatcacagtagtctcttgtctgttctctctgcttccatttcagaaaccactcttccccatccttgcaccaacaatctattctcaacacagcagccagagggatgcttttattaaaaaaggcaaattatgttgctcctctgcttcaaacatgtgcatggctctctgtttctctgagagtgaaagcccaagttcttctatgtcttccatggccctctgacctcaccttctgctgctttccccacagttgtgctgctctgcccatggcctctgtgctgttcctcaagggcaccaggtgcatgcctaccctgcagcctgggtgcaggtgttccctctgcctgtgatgcccccctgagagtcacatggctcactctctcacctccttcacgtctgtgttcaaatgtgttcttctccatagggcccaccttgacaatcctattgcaatgacattctatgtcccagatccaacgttctgatctttactaccctgccttcttgtttgcctttttccaaacactcgtgtcagccttctaacttataattgagcacattagagaatgtgtgttgcttattatctgtctcctgctttagaagagaagttgcatgagagatggcaatttttttttatgcctcgctttgtctgtgttgctcagtgatgcattccaagcacctagaatagcttccagcaaatagcagatgcccaacaaatatgggttgcctgaatcaatagactctctccggaacgtctctcacaggcacatcccaaggtgcactcaatttcatcccctgttcatctgctcttctcgctgccttcccctaccttcctgactttcatattttccccagttatatccccagttgcctaattgcccagactcaacttcctgccattatctgcaactttccttcttattcacctcccacctgcacctgctccctaaaccttggggacttaagtctggaaatgttttcacgtccaattccagtcctctcacctcctggccacttctgcagttcagataactacctttattgtctacacatttgcaacattctcctccccggtctcctggtttccaggtctttcctccggccttttacctgcactgatccccagacctggctttctttttattcttaccctttttttgcaatttttattttttttattttttaagagatggggtcagccagatgtggttgctcacgcctgtaatcccagcacttcaggaggccgaggcagggggaacacttgaggtcaagagtttgagaccagcctggccaatatggtgaaaccccatctctactaaaaatacaaaaattagtcgggcatgttggcacacgcctgtaatcccagctacatgggaggctgaggcatgagaatcacttgaacctgggaggcggaggttgcagtcagccaagatcgcaccactgttactccagtcgggatgacacagtaagagtcagtaaaaaaaaaatgggttcttgcactgtcacccaggctggaatgcagtggtgggatcatagctcacttgagccttgcagtgctcaagcaatcctcccgcctcagcctcctgagtaactgggactatagacacatggcaccatgcctggctaattaaaattttttttttttttttttttttttgtagagacagggtctcatggtgttgcccaggctgggcttgaactcttggcctcccaaagtgctgggattacaggcatgagccaccatgcccagcctctagacccatctttctaacaggaaccctggctgtgttataccactgtcaaccctccagtgtttcaccttcctgcacagaaagtatttctaactgtgctcctccaaactccagtggtcccacaaaggactgacccctctaagggcaccaggagaaaatgagacagcagtgtgggtggaagcccaacccctgcctactgcttcatcatgagcagcttttggtcatccctatttcatacattgggcttgcatgaaagcttttattcatagaaaggattctgtcgcttacaaagtagaagtctgaagcttgctatgctgccaaccaagacccaagctccttagcctggcacagggacctctctgcaagctgggctctgctgcatttttcagcctcactacattcttctcctcctgatattcctctaggtcccagccacactggaacataaactgttccgcaaataagtctgtgtatattcatcccctgcctcgcctttgcctctgctgttccctctgcctgaaatgccttttcccagtgagttcagcctccatatgcctaaagctcctctgccttcttcaaggccaaagtcaccttctttttgaagtcttccctcaccctctgggcagaattcattgctccctgctcctggccaacacagcacttcactgctgacctctattataacacagccacatgaggttgggacaatgtgctcatctgtctctggagcaagaccatgcgcttttggagggctgaaactatagctcaggtctgtttaaaaaatttttaaattcccatccaaggcctgcacaaggccagctctcatatgggaattcaatgttactttaagttttatttaaggcagtgaaaggataggtttttaaaaatctgaaggaccattctcagctcttccaccccagaatggctgccctggcatagaaactgttccaagatacacgtcctgtgtcctgagtatggggatatgctgtaggcacgtgatgcttggagctatcagaacagaggggctaaggcaggaagcctgccggggaacaaaggtcaaccgtgaggaactggggcttggtggggtggtcagtgggtaatgtgtccaaggttcaagtcccaggctctgtctgtacaggctgcattgcagagggggaagggaggtgagtgtggccgggcatctgggtatttttcagggctgcaggtgctcagtgctgggggaggaagcctcctggctctgcaagatctgtgtgatttggagcaagacaataatcaatgcttgtgagatggagcaacagagtctggtcccgggcggggagttggacaaagcccataggcagggggagtctttgctggaggtctggggggtgacaggaccctctgtaggtagcagaatggcttgtctgatgctcgtggccagacactgcttattacaagacagctggctggggcagatgtggcaggcaccggctgtcaagggatctccctccaggtttagagcatggcccccctgacccacctagggcttggcttggcctcctcctacctgggcagtgtccatctcattcagcatcaccacagaggagcagttgtaatcgaacaccagcctccagaagtctgccacggtgttgggtagagggtgctgggtgaccacgaaggcggcaggctgcttgtggctctgacaaaggaatgacacaggcttcgtaaattacacatccatcagtgatattctgatgatgatgaggcctggactgaggccagaggctccagagcctgccaaatagattatacaaaacacctgcctgttcttttatctctccacgccctggcggcaaaggggaccttctcataatgaacacaatctcctccaaactaagacatttcattaggaaagtgtcactgggatgggattatccaaataaattatttatgcctcggagctcagcaaataatcataattacaatacgaaatgaaagatttcagatgcagatttgttgctctactggtcaagacacctcttgggatataagggattggccgcatccctgtggccacgatgctgggcgaggttttgggtcggcctgaggccgagattctcccaaaggggcaggctcccttctgcctccaggctggagtgaggggctgagttgccctggcaaggtgggcactgtgtcatgtgagtcaatggggcagtggaaagtacacatgcattattaatagtccggtagacctggggttcaagtacagctttaccacttgtaagttatgagtcatccatctgtccatccatttgcccatttattcattcatccattcatccattcattcaaactttgtagagtgctttttttttggcggggtgggtgctaaatactggcaagttattagatgattccaaagctcatgttcttcacctggaaaacggaaatcataaatccaaaggaatgatgtcacacagattgaatgagatttacgtgtgaaaaggccagcaaacaagagccggaacgtaagcctactggcagggcagaaacacccctgactttgttttacgtccttggcactggtattgtcgctggcacatgctagacagtgccactccagtgaataaaacaataaattcagtcccgtgttgcagatagggaaacagaggcccagagaaaatggcctgggcggggggggggggggtggggtggtctggcagcttcatccagggccctatttattttctccccaccctgaagtcatgtatttgaaaagattgggaagattctccacttcatcagtggctcatgtgcttgatatgttttctcaagagatgatgatggtttctgtgggagttacagctgttttcagtgcagttacaagcaagagggaagagggcaaagaccctggaaaaagcaggacaaagccttgcaaacatggatatcatgcgtgcattggctgggggggcccttcttccgagggccttttcctggccagtagaatgttcagaagaggggtctgggtgggcataggcaaataatttattttccaaaagccaaactctctagctgtagacagcatcaactttgagccatttccagacatggaaaaacattgaggctttgagagttaacagacttggggctccaatccttggctcccatttctgagctacttgaccttgagcaagtgatgaatgaaaatactctgaccccgaggacctcatcagaaaatggggatgagaatacccacatgcaaaatgggacagtgcaagtccagggcccgacatggtgcccaacactcagtgaatgttagttttcttttctttttccctgtctctgtgataaacgctctattaggccagcacgcctgacaaagccttatctgaaaatatgttcgagatccgtgctcctgccgggtttcagggatcagccggcaatccatttcatggataacatcatcctttaccaggggaaacattaaaaattaacccagaggacttcatatttttctgctaggagcaaagctgctatggttaccagataatgcactgactgggctggaatacagataaggacgacttttttttgtttttaatatcagaaaggcaaaggccccagtgatggctcacaggagaaatgccctgtggacaaagagaatacaatcagcatcagagcttggcagaaggcatttgactccaggcagtatctaacctattaagtagaggccaggagcttatttgatctttgcctggatgaggaaggcagggagggggtgttgggagaagtgggagacaaagctaggaggaaattggaagtatgggcgcacccctaggctccatttctcatcacactcacacacataatgcacacctacatgcacacatacacatacatgcgctcattgactttagaaggctctaagctataagctaatgccaaaggtcttctctccacctctagctacttgctatgaccaagccaagactccctgattctgaacccagagctagggtttttacagaggatatgggcactctgtggacagaggccagggcaggcccctagagagctgggataggcattgaccttccatcatcaccctcctgcctctaacacccagacccttgggagaaacttcaagaggattagaggtcagagaagttgttggccttgaccccaggagaaagcatcccatgtttctgtctattctgagtgagataggagggccacatgggctagatggatgtgaactcagatgggctggggaggggaagctggaagggctcattatatcaggcaatggtgttcttggttttgagcctcaggaggtgagatgtttgcctcttattggatccaccaaattgcagggaggctcaagaaatgaattccagagtgtgacccaggagctctgtgtgtgggctgtgccactagctccctgggtgaccttgagcaagtctctttctctgtctggcctctgttttctctgctgaaaagtgcatggctggtagtagatggtccatagttccttcctactgcaaacacctgtacaccttggaggggaagtgatgataatcagaagtatccgaaaaacgcaggggagaagcttaggctcgctggaccaggaacatgaccctaatcccaaaccagggtagggtgaagccccttcctggacctgatgacaagaaagtggggggcagtggccctcacaggacagccaggaacacagcccgcttccaccccatgcttgttttactgcttcccactactttcccaataaccatttactgagcccctactgtgcgccatcctcatttttgtctctgctcaggagttatctggaaccttcatgggagctaccagagggcagaacctgtgtctgcaccgtcttgtgttcccacgctcaggccaaggcccagcacagaaaatacctgctttactaaacttcaggctgagagtcggctctgtggggaatggaagaggttgctaggcaggcctgtagacttgccatggtgacacgggagccaccttacgcttctggtctattctttccaggctctttgtatgagaaaaggagccaagagcccaccttgtgtctaggtttggaccagagcctgcaggggaacaaaggtccttgggactagtagatcagaagcagggggggctggctggtggggtcagggccctgaggtccagccacctccacctcaggaagaatatttgccctagaatgccagctaggagctttctgcccgggctcggcttacatccatcagtgctgcgttgatgtaattgctggattctccgtccactgagataaggaagggcaggcagcggtccagaggcagcacgtccatacttcgattcttatcatggttccggggcaggagcccaatgctgcagtcctcgggccgcacacggggtgtcacaatgttgagggtctgtggggcacaaaggtgaatagataggccctgctcatttggctgcccctgagcaaaagagacagtaatgttccaactcagcctaactcgcctatttccaccctctaagcgcagccccactctccctttcccgggacccatttctcttccacggtgatgttctgtcctctcctgctccctgctatagggtgtgtgagctgtgtgacaccttcaaaacgccaaggctgcagaagcagcgcatccacacacaggctcagacacagcctcatagtacctgccaaccagatgaactaagtcgttcagctcagccagtgctgctttaaagggtgggccagccaggagggcatacagaggggtgggggtagggaatccctactgagggctaaacatcacttgcgttgtcatggaatgggggaaatgatttaccagccctcttctcagagagaaagctgtctgagtatggaaggatgcctagatgacctgctcaggatagatgagagacctccgaggggcaaaccctaacaggtctgggaaattgctgtgtttggactttgccgagtacatcttgcaagtttgaggccagagctgaactgctctagccaatggactagatgttacgtgcaatgaccagtgttctgtaccctccatccttccctcattcagctctctgtctctacttcagatcaataatggctatttgttttagggattgctaaggtattggcctgcctgggatatctgcccgtggaacaatgggcctggcatttgcccactgacttgaagcaagacctggagcttccttgctttctcatacctggttctcagctcctgttgcccaggtgtaattctgacactggtcttgggataaagggctggactctggctttatcttacttagtgattcatgtccaggctccctagaccaatcaatgttgccacagctctgaccgcatgggcttccaggtgtggatctggtatacctgagctatgttctaggacagtacttctcaaagtttaacatgcatacaaatcactcagagatcttgttaacttgcaggctctcattcactatgtctgggccaggtccgagattctgcatttataacaagttcccaggtgaagccaatgctgctggtctccagactgcaggttttaaaattttatttattttattttttatgtttttgagatggagtctcactctgttgcccaggctggagtgcagtggcacaatctcggctcactgcaacctccgcctcccaggttcaagcaagtctcctgcctcagcctcctgagtagctgggattacaggtgcatgccaccatgcctggctcacttgttttgtatttttagtagagacagggtttcaccatgttggtcaggctgcagaccacacttttagcagtaagagtctactgaaaaattactgagaggacctgagtccctccagggatgaaggagcatgaaattcacacctgtttgtataaatttgtctccattcacaacttggactagaactgaataagacctcagttaaaaaacatattcacagttaaagacaagtaccagcaatccctgagtgagtgtgtagttgctcatggctgtgcattttgtgttctggaatagattctgcagcttcctagagaagcagacactgaaagtgcatagatcagttgtcccaaagaaaaccccacaaatgtgcacatagccactgaagttggttgggttactgttacggactaaatgttttcatccctcccaaaatccatgtcgtaatcttagcccccaatgtgatggtattaggaggttgggactttggaagacgtttcgatcatgagcatagaaccctcatgaacgggattagtgctcttataagaagaaacatgtagggccaggtgtggtggctcctgcctgtaatcccagcaatttgggagaccaaggtgggaggattccttgagcccaggagttgaagaccatcctgggcaacatagtgagatcctatctctataaaaagtaaaaaaaagaagaaatgtgagagcttgctgcttctactttccaccacgtgaatatgcaacgagaagacggctatctgcaagtcaggaagtgagccctccccagacactggatttactggaagcttgatgctgggcttctcagcctccagaaatgtaatgaataagtgtctgtcatttaaaccacccaatctatggaaatttgttataacaacccaaactgactaagatggtcaccgagcctgggatttgctcatacctgaaattcatctttgatttggctggagtttgtctgggggtccagcctgctgatattgtagtagagagaacggaactcacacacagggatggcagtgttgccacagaggcacgcttccaggatggcatcgtgcacaaacacatattgctcctgcaaagtcagaagagagggaatggggtgccaggtaagaacagtggcctgggaattagctgtccacatttagtgttgtggctatgaagaatagacatgatttatcaatatattacaggatccttactttttatactgtaacccaaagggccaaatttccatgtttcctaatgatcacctgagctatggtgggtcttgtttctgatagaagatgtaatagcatagtcatgataaaatgagaaacttctagacatgctgtcagcaggcgctcttggtgtccagcccatgtcccctcagctttcacctttacctgaggaaggctgcttgctgcaaacacctgtgattgtctgctgaaggcagaggggatacttgggctgtgtggaaaggaaccctcaagcaatgacagatggagagttgaggatagaaatctaagaaatctctccctttaggtggaatcacttggacacgcatgtgtctcagagttcgccagcagaattgggttccagttgtctacagtgtttaacaacttgttaaagtagcctttgtttgtttccttccctgctctgcctcactttcccattcaccagccactgtgtcttgggattaccttccaagcaaattatttgccggcaaatctttgtctcacgatctgctcccaaaacgtgtcatatcttctcctatctcaattctttgtacctgctgtactctcctcctgaaactccactccctcttttccatacctttaatgtttcattctttctggaaagccatctgttaatccaccaggcagaagttggtgttacttctaggccccagataaatgtttgttgagtgactttttctgcagaacttggtcagtttctctataaagagtacttttccagatgctatgtgatgcatctgcatttgaatatgtctccccatatgtctgactgcaaccagcaagcctggcttctgcatgcatggacctaggaatagataaagcagccctcttggctttagtgctagaagcctgaagactggcctgtgtgagttagctcagagcctatgtgtgtaaaccaatcaatggtggtattcactgcagattcagagaggctggctgtaccaaaaccatgggtcacttccctttgcaggattgatgatgtgcatagttccctatctgtcccagctctggtcgcccaggcacccagagccttcactagaacagaagatgggctcgttacaggaatgataagccaaggtacagagtgggataggcagaaaaggctgcttagtgagagtgtggttctggcgaaaaagcagaggcctttgggggtcacatggaccgaagttctaccacagtctggtatgtgaggtcttagggacacaatttcttagtttcttcttcattgataaattggagataatactaggagctacaccatagctggtttggaggagtagaaacaataccgtgactagaaagaatgtatgctgcctggctcacagtaggtacacaacaataaagattaattcctttcaatactcttaggtttgggctctccaactgcacagagagttgcctaaaggtctgcttctcccttgagggcagaggctgtgtgttacatctcttgaaatgcccagcacccagcttaagtactcaattactttgttgattaaaccattccctgcagtgactgaaccatcgcttggcacgtagtggtcactgaataaatgccagtccttctctttccttctctatcacttcacccaaggcaagaatactattccaataatccccgaaatttgtcattctgtccctgcttggatggcctcagagatggagaactcaccaccattcttcattggtggaactgcctgcactgtagacctccagggttggctggggcaccctagcttctacagtagtctcaccatagtaagccacgtgtctactccctcctgcttctctcacacccaggtcctttccataggatgcccctacctatgtgtctctccgttctatcatcatgtttctccttggtcagggctacaggtggccaactgtcttggccccctaggactcacctctgtctgtaccaggttgaccctttgggcccggagctcacgcacgcagttgaagatgtccaccaccccttcattctcggccatgtcaagcatggtgtcaatggcaatgaagcagccagtccgcccagccccagcactggaagagaggtatggtctgtgttaaggatcttcatggggggaacctgccctggggaggcccctagcattcagccctatccccaagggtcctgctgggaggctctagattatgtgttcccacatttcctttcttaatatgtatagtttgtaatgcatgtgcaaaccacacatatacatgccattgccttgtctgatggataaaataatacatccatatagcataaaacacctagcatggttcctggcatgctggagctgcctcatagatatgtctttcctattttctacccttcttttctcttcttttttcttcttcagcaaatgggttgacggatggaagcaaagaaggagaggagagagaacagaggggagatgaatgacaggacagaaacgagagtcctctgagctgtccccaagacagagagtggttggtggagcaccacgttcaaaggccggcatctggctccacctgcagctgttttcgcaggatcgtgaagcaagagtgtcatgaaactggagcagctgaccgtccggagacccttgtcagggatcaagtttcttgatacatacttacttgatttctggtcactagtggcttctttaggagaatctcagaccaagtataaaatggtaggggaactcaacgagactctatgggccttggccagccctttctagatcagtgctgggctctgaaacatcagtgctgaccaagaggcacgtaagacatgtgccttacacatgtgcagttttggatgggaaggccgggcagcctgtcaaggaggcccccttccgctgcgttttcacatcttgcctttctcatggaaacaagtgtctttgtctaacaatgtagatgtcaaaagacacacaaagaggaagagagatggaacaagacaaaaaagcaatattggctcatggtaaatccaaggggcacaggccagtgcggaccactacctacaacaatttggaaagtacacccattggaagcagagtcttcattcatgagaaactttcatggtttgaatgaagtctgacttaagtttgcttcagaacctactccccaaaatccagatgcggggactcaagagacttggcctctgtgtctgggagggagtatagggggggtcactcgtgtttttttcttcaatgttcatattcaccatgctttagtataaagaatcagcccaatttggttccaaattttggaacaactatcaatcaatcagcggtgaccaagttgcctagtgtccgtttgtttgttagcttcagatttctgatgcttttaacatacctccctgcagggtccttgtgaggacaaagctgtgtttatttcatttcagcatcacatagtaattgaacacaggatatttgaaaagaccccctaggattaaatcctggctctattacttattagctgcatgacctcgggcaaatgacttaacctctctgggtttcaatactcatctataaaatgatgttgataataattaaaatactcactcatctataaaatgatgttgataataattaatagatccacctcacagcattaatagcacaatatgtataaattggatgaaattacaattaaaatgcataatgcatacaaattgctttgtgcctggatacatagccattttttattgagaaattattactattatattcaacaaatatttattgaaaatctaagatgcagtagatgctggtattaggagtgggaatatgaaaacaaacaaacattgttcctgtcctgaaggattaataaataatctggggagggggagaaagaaaacattaagaggaggcagagaataatgatatattagagtgcttactatatgtcaggcattctctcttaggcacttagccaacccatttggtaataattttcagaatggccccaggagtgggtaccactctgctcagatgcattaagatgacctgctaaggagacacataccggcgtagagccatcatgcgccgaagtcctgatgataaacaaacatttgccattgtctttctttctttctccctaacccttgatctgggtgctctttgggatatagagatggggggcattaatgatccattgccctttgattgctatgagatataaagcaaagcagaaaatacatgcaaaacatttagagagtccaggattacctcctcatcctcacttgccttatctgtgaaatggggttgtgtagctactattgctgggaagataaataaatggatgctgtatgaggacggggctggctctgagacatccacagcttatggagtcttccatggtctcttgactgacacaaactgccagggcagggatgtgataactcaagcatccagggtctgaaaagatgggctgccccaaggtcatattggaagagagaggcgttgggaaggagggggatgccagctggccagccttcaggtcaggaaggccatcctcctccaattctggacacccttgacaggatacttcatctccatttgggaggattcaaagacatgccactcattctcaatgtgactttctaggtcagagctgaaaatatctcttcttcataataaggtaaaacctggtgctgtccatttctctctatgagggaccctgcaggctggcaagtgatcttgaaaataatatagaaatgaaaagaagcatgcttccaccaaggcgccctgctgccatgtcaaggagctgagggcaagtgtctggagaaaagcaggtgaaatatccccactctgtgtttacctcctcagcacttgagtttttgtatctgtaaaatgggaatgttaataatgcccacctctccagactggacgagaagtaaataatgtgggtaaaatgcacgtgacagacccagcagatgctgccagtgttcagcctgcctccctggtgactgacttcttcactgttttcaggcaacaacagtaacaatggccactactgctattccttttgttagctgaccttgtgaccaagtatcatcagaaagcactgggcatgggggggacacaggaagaggagtctctaagagtaaagccactagaaaagataacatgtccctcccaagaaagccgagctgcagaggcacactagggtaggtggaggactttttctttttttttttttttgagacagagtctcgctctgtcacccaggctggagtgcagtggcgcgatcttggctcactgcaacctcccgctcctgggttcaagcgattcctctgcctcagcctcccaggtagctgggattacagatgtatgccaccatgaccagctaagtttttgtatctttctttagtagagacgaggtttcaccacgttggccaggctggtctcgaactcctgacctcgtgatctgcccgcctcggcctcccaaggtgaaggacctttgacttacctgcagtggaccactatgggcccagcttccggggggttgaggaacttgacctggcggacgaagcccagaaggccagtggcatagcagggaacgccgtggtcaggccagctggtgaagtggaagaggcggagctcccggatctcatggtagcctttctgaggaaagaacgggcctctgttcttccagctgctgccctcgcatacccagcccagcaacacgtggagccatagctgctgcactgaggaacctcccgcagggacagggccctcacagtgtttgttaataggtgttactggatagagcgattctgtaatcagttacatttgggaaatatgggattgttaaaacgaaaccgatggctttattgcaggatttctcagagtcttgagtgtgctcatacacactctgaatgcccaagagggccacagagcaccctaggagaccttcttttgtttgcctaggggatcgtctttgacaaatgtttcataggaggtgtattgagtacggatttaaagaaatgttggccttaaggaccaagtcagtccaaattgtttccagtggaatctgaggcgttcagtgattgaggtctgatattctgtagtgttccagccttggctgtgatagtctgtgtggctttcaaagtttatataacttagtactgacttctttattaagtagattcttacttagaatgattacataagatgcgaaacaaacaaaggcagagcttctctgatctgatggagacagagtggggcctagagctctgagcggttcccctcccctttcacacccctccacccctcacagagacacactccgggcccagtagtggttttctgaccattccatggccaggtcacacttctaagccttcgcttagacagttcctgttccctactatttttctacttagcaatctcctgcagatacccagagaacactgaataggaagagtctgtttgattattcattcattccttcattgaaaaatcatttaccaagtgtgacctgtgcccagccttcccagccttgtgctaggtactaggaaggtgagaataaaagccacagctcctatccctggaacagctcatggccttgtcggggaggcagatgcccaagtgggtaattctattgaagtggataaaggagtgcctgctaacctgatctgaggagaagagaaatcccagaaggctttctggaggaggtgatgcttgacctccatcttgaaacagactaatagtgaaaataataactaacaaacattaactaagcatttactgtgtgccagtcactcttctgaacacttcaacatgctaacttacttaatcctgatataaatccctatatttttatctccatttgatggatcaggaaactgaggctaaacaaggttaagtgacacacccaaggtcacagtacaactcacaagttgtaaagggaccatgtgaaccctggctgtctgtctccacagtctgcactcttaatcattctaatatagtgatgtgtgagtattacccagttgacgggagaagaggaaggaatccaaggcagggggacagcatgggcacaggcctggggacagggcttagcatggtgtgtgcagagaatcactagcaacccagggcaatgctagaggcaagtggaagtcaggccatgggagaccacaggcctgggggtgcaggagaatagatgagagctggatcccagaaggccttgaatctacattaaggcctttggactttatctcaaaggcactgggaagctacagggagattacacagacggttccacacaagaggaagtgcatcattagacttgcattttaggaggctgcatcctgctacatgaaggatggattcaggtgggtggatcgggggttgcagagagggcactattggtgcccactcagatccccatcactgggccagtggactcattgccacctgctctgagtcgtggctgcacacagctcacagttaccctcttctgaagagaactgttctcagctgaacaggaacccccctcccctggggtgtggctgggtggggcagcatccttcagtgactgactgatagtagagggagagtgaccaactggcttgccacttgctcagtctgcccaggactgacgggttgcccggtacgtgggactttcagtgctaaaaccagtaatgttctgggaaaaacagaaattttttttacccttatggggggcacctgaggcccctttgcctcaaggttggaccaagtgtgcagtaccattcatgttccagggctcccatggggttaggtggaagcaagtctctgctgaggccacttcctcactcagctcctttccccaccccatcctggctctctcactgccttccccctgcaaactctccctaaacacatgagccagggcacccaaacgactgctgcttctggctctgcttctgggaaacccaaactaacataggggcaggactagaggcagacagtcctgttaggagggagaaatcagatgcccagatgaaggcagtgatgaatgagctgaagtgagagaggagaaagcttcaagaatacttggacttttttcacgccatcctccaaatcaattcagtcccaagaagccttccttcgagctcttcccacctgtgctgtgatgatttatcaaggatcctctctccccgatgcgtctgtgctgtcttcaagggcagacagcactccctgtttattatttccaggttcccagctcaggaaccgattttgagctaaaatcgcaggtaatgtttgctgagtgcctgcctgcatgctgtggagaggctggctaagcccagttaatcctcagaggcccttggggtcttttaagggcatctccctgtgagtaatatcttccctcgtggttgtttaaaagacaaagaaaatgtaacacgagaaaggaccttaatgcctcaacatggtttgctagctgcaattcctcaaggcctccctgcccgtgtcgccagtcactcatcccatcctcgggcattcaacacagatgtggcagatgagactggtacccctgggtcctcttccttgggcctgtgcttccaggcctgagctgcagggactgttggttgctactgcctttcaattgtccccttctctggagacacgccctcagctgacaggggctggcccaccctggaggttacccctcagtggatggtccacgatcagcagactgactgacgtgggagcacagaagtctggcttccacgccttaagggggacaactcactctgtggcatagtttatccttggaggttccctgtggatcagctctaggctagacttcactggagcctctgtccttggttggtgtctttccttccctctcctgcttcccactctctcttaggaatttctcctgggagagctcccctgatatacctcatgtttctgaatccttgcctcaggctctgcttctaaaaaacctgacctaaggcaacattgaagtaccgatggtttccttcctcttagtggagggagttcacaggcttcctgactttttcacccgagactgcagattcagatgaaaaagaccctgagactttaggagcctgggggttggagggggagcttccggggcaaacagtatgtcctaggccactctgtatgctggaacagtactgtgtgcatgccgggctctagtctgcagagcagcctgctttggcccttgcaaggacttgtcaaagcctcaagggcacagctctcaaagcatgtaagtccccagtgcttttgcatccttaggcctgtggccacattgtctattaaagtgattggttttagagaaatggaacctatggtgtaatggaaagagaaatgtgttacaggagccaaggtgtgaatcctggttgtaccaaccttgcagctgggcaactttggatgactgatttaaactctctgtgtctcagtttcttcatatgtaaaatggggataataatagtgcttaccttatagggttattgggaggattaactgagttactctacgcaaagcatttagaaaagtacctggtccagtaagtgctcagtaagtgttagctatcattatgatataatagtaatgatagaatagcaattattatgtaacatgttataaatatatttatttgcaatcacatccttgctcaccaagcttgtgcagccctggcctccttttaatgtccagaccagcatttctcaacctcgacactactgatgccttgggctggataatcctttgttgtcggaggctgtcctgtgcattgtggaatgtttataagcatctctggcctctccacccactaggtgccagtaccatcctaacccttctcccccaagttgtgtcaaccaaaaatgttgccagacatttacaaatattccttgggggatcaaaatgcccccggttgagaccacatgccttgaacaggttgagatcactttttcccctccagactgcatgttttttccttctgcctgggatagctcttctttcctttctacccttcactggttcctcctccctcattctctgcccaaatgcctcctctgctaagaggccctctcctaccaccccatcctactgtggatttctatctccatcctttgcatattcctgtgtggcttttatcacaatgtgttgttatttcattgatttgcttattgaattcagtttgccccacctactagatgtgggatccctggtagcaggacccatgtctgccctgattgctgatctgttgctggtgccaagtatggggctggacgtagagcagaccctcagttaccacatgttctggatgaacaaacaagctggctctcatggtggaccggctgcccacagcctccaagaagcttaccttctggactgtgaaggtgcgtatgacgtattctgccaggggctctgtttcaatcagggtgactttaatgtctccgtagacctccgtgtcatctggccagtatcgcacacatttcacctgtggccaagtgagagacagagacagagacagaacagagacaaggatgcataagcacatggctgagtgtgagcagctgtctcatctggtcgtcccatccaaataaacccaagggtgactttggtggcatttcagtccacagggttcacagctggccagggatcagcaagctgcacagggccaagctcactcccagaggcactggagccattagaaataattgtagtaccttcttttgcaaagctccttgtaactttccaatgcattatcacactatgtcatcaaatagaacaaggtgagataggtgggtgttattgtccccactttacagatgaaaataatactgaagttcagaggtttggtgacttgtccaaggccatgtggccagtttggggactgactgagtcccctttctgctctgtcagggtggagcagctgagtatcatcagctgagcaaagatgagaataaaaggtgggaaataggaggtggaagcagaagtggttgggagggggacatcattaagaggtggcagttgggggtctggaaggagaaaggctcttggttgggaaaaggatggtagctgctggactccaagggaagatgcgcagttcctctctgaccctggacgcgagcaagccattccccagtcgactgtttaagtcgcactcatggatgaaaaagagatcatggttttccccttaaaagaacaaaagcatgattaccattccgggggacgccgcacggcctagagtggcatttcccacagtgtgttccgctgggtgctaataggtgttaggtaaaaaacaagaaacaaaaaacaaacaaaaaaaggttttgtggtcaaatgagtttgggaaatgctgtattacacagttaaataggcagctttgctacaggactattcagcttctttctcatgctagtgctaatgtgttttgtgttttgcgactctccaaaaggggcacagaggacgcagcatttcccaaacgtatttaaccgtggaaccctcttctcactaatcatcctgcagactagcatcccatggaacccacttagggaaacactggtatagtgcaacagagcatgggggcaaatggattcattgtttggtcctaacactcagtatctgggtggcccaagaaagtgctgaaacctctctgagcctcagcttcctatcaataatgatagctaacatttactgactgtgtactctgtctaccacggctcacaaagtgttctgcgaatactttacatgtattaattctaatgacttatcaacacaactttatgaagtagatattatcatccccattttgcagacgaggaagcataggaaagctaagaaaattgcccaaggtcaactgttggtaagggatggggccaggatgcaaacccagggcacttgaataataactaggaacatgggctcctatgatggttgtaggtttcggtaatgcacaataagcacctggcacagtgtttggcactagcaggagcttatctaagagactgctttcctccccaaatccaatttagatttatggtctatccatcaagggaatctgtttccaatgggggatatattgtagaacaggctggaatttgcctctgaatccctgaatcctgggctggcctttatgtccacagtagctgcaccctgggcctgggtccctggggaacagtctgagtggagtgaccacaagcactggaatcagagtccagcgtcagattttgtgcctaggttttggctgagtgacgtcagggtaggtactctacccctttaggtctgtttcctcatctgtaaaattgagtgatggactagataagggtggactcatgggtaaagtctcacctggtcctaaattcccattaggccctgagatgtccatacccctttattggattacgaaagcccagattgtctccttcccatcgtcgcagaggccagaattcatctttatgaattatctgtttcttacccaaacaaaaacttacctgcccacattttagttagttcatatgatgtgtagagagcccttttaattctcgtgtttgtacaccttgcctttaaactcagcagcccacccacatgccagagttaactaagtaggcaaaagcaagctgggaatagcagtcccatttctaagccccaggagtagttgaggaccacttcagagagagttgagatggagcagagcaggagaccaagatctgagccctgaagaacatcaagatttagaggtcaggggaagaagagcgggtagcaaagggttggatgctgctgagattgagtaagatgagaagagagaagtggagactggatttgtcgacatgaagggtgcgagtgatattgacaatatcactattggtgggatggagggaggagctacgctgcggtgggtagaagagaacatgagtgaagaaacagagccaccctgtgagtctttaaagtttggcagaaaagagggaacaagaaaatactttttatttaccttttcctttctttttaagatggaaggtactgggcatgtttgtatgctaaggggaacaatttggcaatgagaaagagacttattttgcaagtgagaaagggaaaaatgaaaaaaattattgagtagaatctgtgatccaggcactatgcttgcctttggaagggcagagacatggcttctgttgtgttaggctgagccataggaaacagttgacattcgaccatttgggtcaacaaaaacagccatttcttatagtcaaatctgacagcagaggagaagaacaagaggacagttgtagatacaagtaggattgtggtgtgacaatgagggagtgaacgactgatggttttaatttcctcaaaatatatgagatgacatcatcaacggagagtgagggtgtaaaaagggatgaaggggatttgaagggaaaggacattgcttgaatgtggaataggagtgatgacacctcccttgtaggttgccgtgagggtgaaatactgactaggaggcacttagcacgatgcatggaacaaagagatgttcgagagtgcatctccagcatcctctgcccaggcgagtgcaggagaggcttaccctgcccacttccaccaggtttgtgaccatgacgatgctggcggagttctcctgccagatcattctccaaaagtcctttacagtctcctgcatcggacctgccaacagagaagacagtgaggttagagaatgcaagtgcaaagcagcagctgagaaggtttgtccccccggttggtcaagtctccacactggtgagcaggagtgaggccaggtgatccttgttaagacaccaagtatctgagacacgggcctgagacatgtgagcctgatggggacagattagggtatggatggggaaaggctcattccaagctctcacaatctgcagcatctactggaaatgttggcagcctctcctctcccttctgtcctcctcctgctcagaccctttctaccaactccacctatcaccttatctggactgtattatggcttaagggagttttcgaaaattggtctccagaacctccatgagagacaggaaggcaactggggtggggggtggagagagctgcagggtgccagacgctgagaacaaaaacaggagatgcctgattttgtgcttgacaaatgctggaggcattcctctagggcctcaacagaaaggaaggaaaaaaaaaaaaaaaaaaaaaaaaaaaagaccaggagcagaaaataggctctgacagtccaaagcaatttccttggaaattactctttcaatgtcctgggccttcatcatttttaaaattacaaaagtaatacatgtgtttgatataaaagtttgaataccatttttctatatttatatgtatatgtgtgtatttactgtaataagcatcagacctattatatgcattttctgatgcccttaaaaattcttaccaagcgtaacagttttaatagctgcgaagttttctataatatggcggtaacacactttatgtaaccaacgtaccaattgttgggcatttaagatttttcgcttttttattcctattatagataacaccgtgaataatgttcttatatgcgtcattgtctatatatataattatctgcaggatttttttccagaagggtttgaaaggtacgatcatttttaagccttctgaaaacgcactgccaagttactttctagggcagccagctgcatatctgttatgggcatgcacctatcgtggagataaggcaccatcagctccggccctggcaggtgttgatggcacctgcttgggcctctccctcctgaccaagtgaagctccttgctctgtcactcatgggcctttttcctatagtgaaacttgccaccattttccttcccaaataaacaaatgaacaatctcaaggacctctggagagtcttcagcctacccctccgtggcttctttgctggtggaaactcattcctctcctccagggctgtttagtgaaaaaggagggttggagtaacagatataggaggagaggacaagccttgcagttaagagagccctttcccctgggacccctgaagcctctctgaggcactaggtggagggagggcacttaccttgagtcgcaatgtagtgccgaggtcgatggtatccctggataacaggagaaaagcactgtgaagagtctgttgtcaaagcttgcaaacagcacaatattaataaacatcctctccaagtcttgattttctcatgggcaaaatgagaacagcatcagttattcccagagaagtggcaaaggttaaatgagatattgcacataaagtgtgtagtaagtcactaaatgctagctatttttatagttacttgtgaggtgcctacataggcttgccttggagccagtggcactgggagcaaagattggatgggcattgcttatccttatgcacccaaaaacaggtagagaaggagtttccaggtttatggggagcatcaaccaccaaaaagtctttcttgagccatgattatatgaagaacactgtacaagaccctatgggacacccagagaagaaaaaggaagaaaacaattcaattgttgacttcttccattagtaacaattagaaaaagaaaattgagaagcatcccacattgcttctctatgccaacattcctgggcttggaattgaagtcccaggtacggagaagaccttatggaaggctgacctgggagacccataaagatacctgcaaatacaaagaccagtttctaatttctctgtacatttcagagcactacagtaggccctgctgtactctggttggggagtaccctgctgccccataaccttcatcattggacaagaggttgaaggtgacccctcttttgcctggacatggcatacatggagtgtcctctttccagttacagtcatattgagtagaagtttaagttttggagacagacctgcatttagtgcagaacactgaatgcaattagtatttgttaaataaatacatgagtgaataaatgaatagatgaataaaatttttaaagaacacagatgccaattttagagcctatcaattgggagattgttgacagtcctgaaatccacttagcttttatggttaaccatgtccagagaaaataagtcctaaagtttgatgaacatctgtctttgtcttagatgttgctgaccagtctttttgccctgttgaggtagatgaactgcctcgaggccactttcttcaggaaatagaactgccatctgtatggtttatggtgccacagatgtggcatctctaaagttctagacccactttctgatacaaagacaagtttctgcgtcccttgtacatttctccacctttgtgtttcacttgctcgataatgattttgcaggcaccttccaattgctgggcctgctctagagttggaggttggcaccaatccaggggcaatgtcatgaccagaactgttggattaaccgcagagcaatcaacagccctactaaaactctgtgcttgaggactcctatgtacttagtgaggttgtcagtttcttaaggacaaacactccctactaagcttaaaattttttttgtcacagagctcagcacaatgtgagactcagagcaaatacccaataaacaagctgttgacaaaccaactaggcaggcaacacagcatggtggttatgcgtaccatggactccggaactcagctgcctgggtttgaacgctggctctgtcccttctagggtgtgtggtctagggcaagctacttagtctcattgtgcctcagttttaaaattcacaataacaaagatatgaaatcaacctatgtgtccatctcaatggatgactgaataaagaaattttttatatatatatatatatatagtattccatatatatatggatatatatgaagagatatatatatatagatgtagtattccatggtgtgtgtatatacatatatatgtgtaccatggaatactactaagccataaaaaataatgaaatcatgacttttgcagcaacatggatacatggatgggcctggaggccattatcttaagcaaaaaactcccagaaacagaaagtcaaataccgcatgttttcacttacagtgggagctaaataatgtgtacatatggatgtaaagtgtggaatcgtagacattggtgactcagaaggttggcagggtaggagggtggtgagagggatgagaaataatttaataggtgcaatgtatactattcaggtgatggttacactaaaagcctatacttcaccactgtgcaatacatacagtaacaaaactgcacttgtgctctctaaatctataaaattaaaaaattaatggggataatggtatttacctcatagtgttgttgaccagattaaatgagttgatatataacagttactatgtgccaggcactattctaagatttaacatatatgtctttgctattgttattttattgtttatttggcaaatatttatttactgagtgcctatcaagactaaaagtgtatgcaggcctctcaggggacactgggatgatgagaccttctttgtgttaatgtaataactgagcccttccctgtgacacaaggggtaggaagacctatcccttcctccaagtcaagtggacagggctgctcaggctaaaagaaagaattaaacccaagggttgtcttgagtagctttgggaatagaaaatagtcccctagatcctggaaagatgcagtttctcaagtctgccctcttctgccattcccatcactcattcccacagccctcatcctccctggctgaggccacagcaccaaccactagctggcttccctgcctgcagtttcactctgtagccttgctgcttcctaaccccatgagcttcctcttgcacactgagtgtgttatttccctgcttataagcctgcagtagctccctattgtctgcatggtaatgccaaatgccttaccttcggactagtcatctgtctccattttcatctccagcctcacctccagttgtccctctttgtccactcctacaaccccatgcaccctgtgcttcagcctcaccaagctgctcttgaaatatgctctcctctgggatacagagctgactcattcctcctgagtggcccagtagggctttgtatatgctcagtgaatgcaattccatgtgctgcagtaaatttttttgtacctttctcctcctgggacatgggacatgccacccagagctgggtgcagttttcagcagtctggttggtgaaatacatgtatgaatgtttttgagctgaagttggagcatcctcttaatgctcaggctggaagaaaaagagaccctggaggaagctgtgatttggaagattctaatgtgcttgaaattcagtgagataacattttgagcaagagattcacattttagttgtggagttagatggcttggattctctattttgtgaattcatttgtttgcacagttattcactgtcaatcaacaggtattaagcacctactactatgtacaaggcactggaaatacaaaagtggacccgatgaatgtggactttgcttttgagcaacttatagacatcaacagactggggtaaaggctactaatgggaagatgtggggactctgtggagtacccatgggaattgaacagccaaggagggtcccctcagaggaggtggtggttgattggctccttaaacctagtttgggcatcttgacacctcttgtcatttctatttcatcctttcagtgatgttcccagtttctctgccattctttcatcatccactggctcttgctcttcttcagagatagggatcacatgtccatccagaggccttagcactggccattccccgtgcctgctatgtctgcccccaggtacctgagtggcttgctctctcgctccatccaagcttctgctcagttgtcaatcacgtctgtggagagttcatctctgaccaccccatcagcttctttccactttctctggcttacttttcgttagataacctatcaccaaatagcacactattctttcttcatttacatgctcccccagttgaatgggagctccatgaagccagggctggcttgctcatggccatgtccccagcacctacaagtcagcctgggccattggccttgaaaaattcatattgactgaatgtacgcatgctgtgtgcctgttcccacgctgcatctgagtaaagagaccctccttggcttccaaaaacccacgcagtccccaaagagaaaacattctaaccacgagactcctcagcaaaggagataaaaggaaacgtactgctcaattggggctcctctggggattcgccaagagcgagtacagaaaacttcctaaccttaaaagaactttgagttcatttaagtcccacctacacagcacgcagattgactgcaaaccagcactgggcctgcctccatctgtctgtgagcaatgggaaagaggtttgcatccaaaacgcatttatctcactctgcactcatgcatctgttacttactggggacccagatacgatatttatttccaggctggtaattcataacagatttaagtggccaatacattttcgggtgtgcaaacaaacctgccagcgggatggttcagacagtaacagaccacggcctccggaggcagagacagggctggccccattcagctcattgtcccaatggagttattttaatgaatcgtcaagatccaattgtagagaaatgattctagcatgggcagttagctctttagagagccaggaaggattgtggctgcgttggagaccagggtgatggagtgaggacctagttagctgtctggagtactgttttgccaggaatccctatagagaccccaggaattttatctttgctggagtatgtagttggttcacaattaatggagttcctctactcttcaccctatagtggtaactgtgcaaggagttgcttgtggttggctttcttccctttgtccctccatttcccctttttccttccatggtctgctctgtatggatcgcgccatgggctcctattctttctgcttcaaattgggtttagtcaatggggaacaaaagcaggaactcagaggccaggaggaggttggggcatatgttcttctaggttcctccctgccaggtctccatgccttgcttgaccttgtcactcaatcaagggcttcagttcttgaagggcagccctctctcatagctactctcttcccttatctgggtctagggctggtaaggactccctactattgttagcctagtgatactgcaccctaccctactggtttctcttaatcctgttcacatccttattaaactttccctgggtacccactttggggaagcctatgtttccttttgggatcatgacagatactttacatcagtaattgcacacttgtggggtggcatcattatctcattttatagatatcagaatgattaagtaatttacccaagatcataaagctagtaatcaaaaaggcctggattcaacacaggtcttcaacacagaccagattcatgactttattggccctggattctaaccactgagattgagcctggagttcaatatcccataataagacagcatgaacagaggccatttgccctgtctgcctaacctattacagacagaagaagaaggtcgtggtgtgtcctaagtgggcagagaactgaagttcagttgtgtgaccttggacagtgctcttaacctacagctctggtttcctgtctttaaaggcttgaaacatgccttgcaatgataaaacaggaaatgaatcagaggcataattagcagttgtagagattaacttgcatttaaagcaatttcgtttgttgcctataaaataccaaagtgtatcttggccctgactgtagtcagatgctcattcaactttggagtgagtgcctatctaggaaaatgacttttgttgggggattctagtcaaatgatgaatgccagatacagaaactcaggcatgccagaccctgtgtggcctgtggtccttagggtcatatccatgcagccatagacaaggtcgaggagaaatggaaggaatcaattcaacctgcatcaatatatgctgactcggtccttgctgtgtgttggctacaaggcggtgtctgggagtggggggggggaggggaaggagaaagagtgctaaactgggagccattcaggtctggttcccatcctggttctgccactgaccagctgcatggcctgagacgtatttgtgatttctctaaaccttagccctccccatctggagaatgggaatgagaacacctaccttgaagggttgttaagaagttttgataagctgacttacttgagccacccatcataggaccccaagagtgactcattaagagccagttggtgttgtcattgctcactgtgattattaaagacagcagggtatggtgggagaggtactcttgactcaaatttctgctccctcctcccctacctcctagcagtataatcctggacaagttatataatcttaagagactcacttactcatctggaaatgggtagtagtggtacttaccttgtgaagttgtgatactagttaaggtgatgttggtacatgaaaggtgatcagtaattcttaggttactataaacccttcttgcctggctggctctaagtcatctttcaaggcagaactgagacatcacctcctccagggagccttcactggctacttccctttcccaccaacttgaagctttgattttcctttatggtcccacagcccctgctctgtgaaggtctattttcttatctgactccctcaccagatttgagtcccttttaggtcagagacctggtcttaaaagtcagtatttcccatacacagtggagggtctgctctgtgtttgtgaactgaatactggatgtatgaaggaaaggctgctggcatgatggatgtatgctcagagtgccttgctctgggctggagaaaagctattcagaactggctgtctcctgtgaacttttctggaagggctatggtggcagagacggtgttcatcttcaactccactgaagttgcagcctcagttcttggccatgtagtaggccctttgttaattagggtgtagttagggaaacagaaaccagtctatgtgtttcagacgaggcaattcagtatggggagttggttacacaagtgatggaggagccaagatgccaaacagagaatagtggggcaacccagagatcagggacaggactaggctgcaaccaacccttagaactagtgggagaacaggagagggagaaataactagagtccagagtccagaaataaccagagccccagtgggctgactggcaggagactggactatggcaggcctgcttgaggaaagatggagccacagacagggtacagccactgctggagttgctgcccaaggaagggagtgagatggagaatacactgcccttccatcatcctccagtgtctgtctgtctgtctgtctgtctctctctctttctctctctctctcacacacacacacaccctgcaatgcaaggcagaacagggaaggacacaaaatagatctgagggcaagcagtcagatgatcaatacaaggctcaataagtatttgttgagttaataactcacctggcttagtctagattaagggggaattcacaaactgcaccaccacactttatagcctatctataaatacatttgagagtctaggggaccagtatgaatctctgtgccattcttcaagacccatggactgtgagctgaggtcctgagatgcatggcttgaatcagtcacattgggttgtccttctgacctcagcagtcatgctcttgcttagcaaattctctcacttccatgcatacccttcttggctcctgtttgagtttagtcccttcctcagtcgtctctggaatattgaagcagcctctttccttattggttgtagttgtcttaattccagaatttcttccctcggatctgtcttatctttggtagcagataaatcatgccaaagctcagttctaagctggtcacctccttgataaaaaatttttaatagcttcctcttgtctatgggataaagtcccacttcctaagtctgagcatttaatcttcactgatgtagtcccaacaatattttccattattcctgttacatattctctgctcccctcaaatggagctgctatgtatctcctggccagttgctccatcttggcttgtgctattctctctaactagaggcccctctcccctctctttgattttaaatcatatctgtgcttgaagctttggttcacatcatattttgcattcctgatgggagaagtgatatttttccctacttctgaatctctgcagcatgttatctgtacttttgacacttaacaatttctactttgccctggaattattgatgtgcacattatctccctgctaaggttttaaagggtagagaccatggtattattagcattatggttcccatagcatctagtatacattttacagtaggcactttaaaatttttgtggcataaatggccatgcgtttatgtgaatgaatgaatggatcaacagacatatacacaaatgaataaatggggtgaatgagtaagactaacagttgtcctgaggccccatagagcaggctactacagctagcctgaaagtggatgcagtggtagatggacagtcaacttgggttacactagttccacatatcaaggaggatccagactgctctggaagggccaccttctggaggagagtttggggtaaaccacagatcttgagcctgcaaaagccagccccagcccccagccccattaagacactcacgtcaatgtagttggcattgatgtagtcagagtgcgggtctccatccagcaccagcagcctcacccgggaatggtcgtctgcagagagagcagaaatcaaggggatggttgataagaggccttacgcagctaatgtcctcctttagaactactgtttattaatgactgcatatcaggcattgtgctactctcatttaactctcaacaccaccctcagttactgctcccatttatagatgaggaagtggaggctcagggaggtaagcacttctcatttttctaccttcccttctgatttcgtcattacctaactggattagtcacctgtttctttaagtcttagtgacttaatcattaaaatggggatggaaatacttgcttcataggacaatgtgagagagaccatataaaaatgcttaggacaggagagtgttgcatctggattaatatactccattttcatgttgtttaaaaacagcaagtttacctatcttccacacatgcacaaattgcttttcatttgccccttggagtattgttagagatagattgtcagccatatattgttatcaatactatcattaaagtgaggctgactaaatcattataaaagaggtcatcaataactaaaaattgtgttatagaggatgccttttcaaacactatctagacataaacaagatttgcaggctttatttggtagcatgcttacttcaactaacaccaaataaaaaccattaaaagaaaaccagtacagcagaagaatcaggataatcctttacagttaattaagtgagctctgacacgctaatagacacacacaagtggaacattggttcggtctggttgggaggagggaccttggtttgctatccaggtcactgtgcacgtatcattgtgcagtcactgcatcctagttcaccttcctctagggcaggaatgggtccctaagatgtgggctggagagctctggacatccccaagggttttctgggagtcacggaggtcagatcagcttatcttcttagaattatacagcattctgcagtttacaaggcacatttattgcaattaaccaaaacccccttgagaactgggacattatgccttattccctgttccatcccctgcacctttaaaaggtcctgacatacagcaggtactcagtagtacatggaaaaggtataattggatgccctcattgggttctcacagtgaccctgtggaagagaagtaggatgggttcttttagcccttgttacaaatgaggaaactgaggctccagaaagcctgactggccacatggccagtgaatggtagagcacagaggagtgaagttctcttaactctgagttcggtcgctcctgtttccaaagggggtgtaagcacaatgttagaaaccacttcagatatacccagcagagggaattaactactgagaagtggttgcctgggttacaaagagttgagcagccagatagaagaaagtggagaaactcagagataagcagcaacaaggagacactgcctgcccttgggctgaagggatggagggaggtggtggagttggcagtgctcaggagctggggccacctgctggaacctgaagccacagtgggattctagtaggagctggaggcaaggaggtgcttcccttgctgctaaggaaggcaattgtagttgtaataccctggcttctccctttctccttctctccaatctcccagtgcatgtcattggctaaacctaaatagctgacaggagagcctgaaaaacacaacctgcaggggtaagttacctgcaatgcacactagagtgggagaaggtaaggaatgggtcctattatggacaaacaggcctagggctggtataagatacaccccatatctatccattcatttaagaatcattcactgagtatctgccatgtggcaggcaggcactgtgctagacagcaagttatactaaatgcgacttttcttactcatcagggggaagtttcagcagaagcaactagagggagcaggtgggtggtctaagcaatccctttgggtgagtgggagagtggaatgtgacatgggggaggagtttgaagttaacctttattggattcatggtaggtaagagaaactttacatgcattatctccttcaaccatttatgcctcaaaatagccatataggttattataaggataccagaatgatatggtattatgagtcttcccattttacagatgaagacactgaggctcagaaagattaagcaagcttccgaagttacgcatcatgtgtgtggcagagataggacttctcggttaggtttatctgaccctgaaaccctactctgcccacataacttgctgtcccagagtctcaggcatctcacaggcactacagctggagtgtgtgcaaacagctcttccccagttcctgcaggattctagccccagagaggacttcctgggggacagcccatccagcaggctggaattcagacaaagcctggcacctgactctcagcccagggcatcaagcctctgttaccagcagttccagaagctgtaggcctcaaaaaagtgaaaatgcacattgtgttttcactcagtggtctcattatgacttactgattcagaaatctcctttatttgttgagttatgcctgcccctggggcccatagcactggaaacagagattgtggtttaaaatgttgaaagggaatttttaaaatataaaatgaagttgaaaaaccggaaagcaaaaatgattaaaaacaaaacaaaaagaaacgaacttatttattctagttaagtgtacttatggatgaaagtgatctctagccaccagatgatggtgtttgacaacgtctctccttcatttattaagaatgtgtttactgcacacctactatgtgccaggctagttgaagggattaagaaagtgctatcaaatgtgatactcatgtttaaggagtttgtcaatttagtggagacagactgtatgcagaagcaaaacttccaaatctagaagatggggaatagagggctttgtgtagtgacatgtgaatgaggaattaaaaatgagtaaggtttggccagtgcacaatgaggaagtctttccatcagagggaatggctagagtgaaggcagatatcctgaaaaaagcaagcaccgtgggggagctgcaagggtctcctgtcctgggaaaacagagtgtgaggggaacagcgatgggaggggagacagaggaggcagcagcgggggtttcatttcagaaggctctccatgccctgtgaagccatgaagactcaaggaatcatgctgggctctgcagggcagcctaatacagtgtttcttttctgggacagtggaaaggtgctttattatgatgtaaccaaaattcatgcctacacagctaacttatgtcaagtgagataaacttttaatataagacgtgagatatggagctgtgatcagatttggcttcaaatcttagctccatcacctagcaagtcaattgatctctcttagctttggtttccttagcaaaatggagccaatactatatggcatgagaggattaaatgagaaaacataggtgtgaaaagtgctaggacattaagaaatgagaggataagccacagactgggaggaaatatttgccaaacacgtatctcagaaaggacttgtatcaaaaatacacaacaaactcttaaaactcagtaagaaagcaaatgacctgattaaaaaatgggagaaagatctgaacagacacctaatcaaggaagatatacagatggcaaataagcacatgaaaagatgtttaacatcatgtgttattaagaaattgcaaattaaaacaagataccactacatacatattaggatggccaaaatccaaaacactgacaccaccacaggctggggaggatgtggcacagcaagacctgtcattcattgctggtgggaatgcaaaatggtacagccactttggaagacagtttgacagtttcttacaagactaaacatacacttaccatactatatctagcaattgtacttcttggtatttacccaaatgaggtgaaaacttatgtccataggaaaacctgcacatggatgtttatagcagctttacttaaaactgcaaaaacttggaggcaaccaatatgtccttcaataggtgaatggataaacaaattgtggtgcagacggtccctcacttgggatgattagacttaggtttttttgactttatgatagttccaaagcaacatgcattcagtagaaaccttaatttgagtacacatataaacgttctgtttttaatttttggtacagtgttcaatcaattccctgacatattctacactttattataaaatgtactttgtattagatgattttgcccaactaatcatctaatataagtgttctgagcatgtttaacgtaggctaggctaagctatgatgtttgtcaggttaggtatattaaatgcatttttgacttatgatattttaaacttatgggtttatggggatataacctcactgtaagtgaaggagcattcattcgatatccatacaatggcctatggttcagtgagaagcagaaatgagttatcaagctgcaacagacatggaggaaacttaaatgcatatttctaagtgaaagaagccaatctgaaaaggctacatactgtacaattctgactatatgacattctggaaaaagataaaactctagacacaggagaaagatcagtagtttccaggggcttgggaggagggaaggatgaataggtgaagcatagaggatgtttaaggccgtgaaactattctatacaatagtgcaatagtagatatatgtcattgtacatttgtcaaatcctatagaactgtacaacataaaaagcaaacctgaataaactatggactttagctaataataataaatcaatattagctaattgtaatgaatgtaccacactaatgcaagatgttaataataggggaaacagtatgtgggtgggagggagtacatgggaatgaggtactttctgctcaacttttctgtaaacctaaaactgctctaaagaaaaatgctaggacaatgcctggtacacagcaggtgcttaataaatgatggttttggggctgaatgtgaggcaggcagtgagctaatagcagagatacttagaaacttggtgctctccacttgacctctgtaccaaatacagatccatctatctgcagaggcaaagaactattgtgtgtgttcactaaagggtggaattcagctgtaggtccaccacaaaggcactgcaaggagtggcagtgtcctcatggtttatttattccttttgggagatgctaatattattctgtgtccccttcttcttctaactttatataattagaaggataaaaaattgtgtttacccacatgcacatggagaaagatggggcggcaggcgatgtgaaggcgtttatacgaggtaatttacaagcagcctagaatgttcattatgctctatctacattttgcaagcttgaaaaacagctaatttggtactccttgtttgatattcaagacaaggagaggagttaagaagagtcatgtggaggagaagcaaactcctcaatgaggcgaggggaaggtgcagcctggctcccccggctctcagttgaggtgagagatgggcaagagctggctgtggcgaggagggaactggtggcagaaggtagaagggagacatggtaccaagacacataaattcaaagagctccctttaacacaagtctaggggaacatcatcactcagtttgcaatcaatctgctgttccttgcttgaggtcaaagaccactagtatgctggtaaatgtttaacatacagctccctgtgggaaaaaaggccctgatcagtaatgtctgctgatttctgtggtgtaaatactcccaccatgaccgatttcaagctaccaacatagcatcaaccacctcacaaaattcctgaaaatttaacaatctgcttttgcaagctggtatgagtcagctacagaacaccactgacagaggacaaagcctagcacaccctgcaatgtcttgcatgatctgatggtttgggacctacttctctctccagcttcacatactgctctgataactgtggtcttctttcagttgctcaaatgcactgtgttcactctgaccacagggcctttgcatgttcaaagaacacctccatccaagctggcagttgcgcctggatcctgggctccaattcttcctctcctcatagctgacccctcaccacacctgtagacccagcctatcccttccaaagactggcagccaattcttgcctttagcagaagggaggttatggattgggtggagtctgaaggcagacctgaggcttgtcacaccctaaccatatcacctggggtaggttaccacctcccctgagcctctgtttacccagctataacatccaaatcatatatagctgtgcagacttgctgcaaggattaaaagatgtaaaatatgaacccacctggtatgttgtaagaaattaacacaactatataaattcagttttgtttttattctagacctgggccaatggcatcagcagcacctgggaacttgtttgaaatggaaattcttgggccccagcccagactcactgaatcagaaactgtggggtggggcccatcaatatgcatttcaatatgccctccaggtgattctgatacacgttcaggtttgagtatacagaccaatgtttagtgacttagtgcagaggtgctctggttattcacttcaatctgtcttgggaaagaccagaagatcttactggaaatgggccataagactagagactcaccttgtgccaggtggtgggatacggaaatttagctgtgtgaaaagtgtaagatgttccaggcacttatcaaatgccatggggatgccatgccatttgattctcacagtaaccctgtgaggtctataccatcatcccatttcatgaatgagaaattcaaggctccaaaaagtttaataactcaggagaaggtatagggatgagggcttctttatagagttgtagggtcctcactcctcctggaacgctgagatccatgacctccatacccttctatgccacacttctccagcttccactttcctctaagttctcagtctccaacattggtcctcatcccactaaggtctcatggccacccgagagagagggttcactttcctctttcatacagttctaactctcagaacaaaccacaactccttctccctccctccatcaccaaagatagcccagtaaacctgtcatctcaacccacatccacttaaagagagaatcacttcaaagaggtggggctggggagagaatattatttggatacttgatattctttcttcctgtcttctgggcactacagagggtaaagaacagtgctttttttttttttttttttttttttcagagaaaagagatttgactcattacaatgaattgtggagctgaaaaaccatttcctacaagtattggaaatgttaatgccatcatcttgcaaaagtggataaggaggaggcaggtaattctgctgagactgcctgggtacctcactgaagctaaaggtctgcacattcaatcttgattgaattaccattatcaagagaggctggcttgggcatgatgcagagacagcccgacattctgtgtacctccttgtcctgccagatccatgctggctgaaattggaaaacgcccctttgtggggtcctgggaggagctgctccagtagatgcaacctttgaggggactgaaggggactggagttgagaggggcaagcaccaagagaggaccacctgtgtcctaaggatgccatccaggcactgccccactgaggggcctttctgaaggaagggagggaggtttcttatttggatttcttcaaaagaagaacatgagatatgtatttggatgcaagtagttgttgtcggggggtgatcccaggaaacaccagcaggggagtgggaagtgagacagagaaagaagaaatctaataggggtgtgtcattcagcaagttgccattgtagcaagttgaggcttaattcggctgaggagctctgggagtcattctacctaagcagagagggagctggggtatgtatatacccacttccatcagtcattaattgagggcaggttctggggacatttaatattctggctctttgggcctgccctgcaagaaggcagagaaggctctagtggccagaaaaagtccttaggaaaagaagcaaaggtgctggcaatttgaattagcactagcacacatgcaagtagtgagtgtttggggatatggcagggtaccaatggtttctgcaccacaaggcatctgtaggacccaggcaatggccaccctcagagacagtgaagaagaatggaggctgagagtcaggagcattgaataaggcacccactctgtcacccccagctctgtctccccaggaatcagcagagaaacctgctgtgaaaaaagtcctctgggttttgttttgaacctgagttcctcactaggagtgagggtcctctctgcactccatagccccacctccttctggaaaagatgggcctctctgaagagctcatctgctctgaggttgggccttagcaacacattctcccccaggaacatggatgtgacttgatgcagagaggactctttggtaaggaatatgtgccaccctaccctggcaggcaagagaccacagctctggtcatggctgttctacagacttgctgtgtgctctcgggcagggcacagtccatctctgggctctctcttcttgcctgtgaactcaaaaaggctacactaactcatctagacttaaaagtctgtgacttaaggggccacacaagattcagatttaataatcattcagcttaatttggcctctccatcctgagagctgccctagagccatctgatgggtgagaacctgaaggtgggtgaggtgaagtgattgtgctgaaggtaaacaacagaactgggatgaaaacctgggactgcctgacctcatgtctaagaccccaatacacctgagcccagtggcttttcctagattgggagaagataagtctcagaaaatgtgctgatatcctgtgtgcccgcagaccccctctccacttcatctggccctctaatccaggaggctgattgctatggccaagattggacattctcaaagttgcacatgcgtcaccatcacctagagggcttctagaaatacagattgctagactctgtcctcagaatttctgattcagtaagtctggggtggagcccaagaattagcacctctaatgagttcccaggtaacactaatgccactgctgtaggcattatactttgagaaccactggattaggtcaacagatctcctgttctctggattctggttggccccagccaatggaaagcacaggcagaagattgggtggagggaggagagtgtgatggaggtacttactcctccagcaccccttggtggggtcaccatgggtggctgccttgccaccaaaggtcgcacccacctctggtcaggtcatctctctttgggtcctggtaacccctcctacggaatccttcctggtctgaggatggaattttggtactgcactatcccttgtagtctttctacatctagattacacctttataaagaactgatcccagaagggggcctcattttgtaacatttgcaacccctgtgatcacttcagcttctcagtgtcagcaccttcctgccagtctaggaagcacctctaaaactttacatggagaatgctttgggattcttgaatttccccttgccaacagtcgctgccctagagttacttggaagcaaaggtctctttgttcttattttacccattcatttccttccctttcacttcctttccatttacactccctagaaaccccactgtctctattactaaattctaaatagaatcacttggaagaaaggagatatttcgccaaggtctcttgttgtttcttttgtaggcagtgccctccctcctacttgtcccctttaatcttttctgttctccctggcctgggcctttgtcctccactccagcctcacagtgctctgggttccttaagatgctaatcacagccagttttcttcttgcgccaagaatatttctatttatcaagcctcggcaggctttgcctttgggagggacgcatacaagggcaggaacactttccattccttggggctgtttcttttttacatatcccatttcaattccaggttgttttttttccatttccctttttttcttgattctcctttatgtcttgcgctgctttctgaattcactggttacctcggcactgtcttctttcagcactgaatgcagacctgctcttgccctgatctcttgcagaatgattgactcttaaattagaaaggagattctggtttatttaaacccatcaaggtggtatcgtcaaggtgcttcagttctctctgtctccatttgggttcctcagaagtagatctaagacagagattttagtccaagcagtttatgtaggaggagacaggaataccagtaggaaaggggtgatgtacgacagggaagagaaggcagcttattaagggtgagttttcaagcccattaggactgcaggtagctgtattctcatccctgtgggaactccagaaggaacttcaggagaacggtgaagaagctggggtatttcatggtggagggcttctcctgggggtattaacccttcaggatttgcaggctgcctgtgcctgggcaggggatcctttcccagctttggagaaagtcctcagtctaagagatgcaggcagggcagggctagggtgaagcaagctcagagtctcaggcataggctttatcagataagtgactatatattttagggtacagtgtccacagtgcaggagcagagaatgctggggaccagacagggcaagcagctccctgtggcagagtgggggctccccaggagcaggagctccacctcccagtgcccatcacagggcctgctttgaggaggcccacatgtcataagtcttaatacatgtttgctgactgtttgaatatcacttctcaacacttcacttgcaagaaatcttgctgtctgaattaccatcttccaagagagaaattataaatgttttctgattagttctaccattcatagcccattcctaaatcagcacaggaaacagctaagctaaaacttctgcctttttcttcctttacaatctgcctgtatcttactctttcttcctccaagttttttcttaggcaatgtctagacagttaaaacaaaacaaaacaaaacaaaactctgaattgtgctagaaataatttgtcattcaggatcctttttttttttcttttggatgaactgggttactctgtgagctgagacccagggatgttccccacaccattggtgagatgtcaaaaggtccaggttggttacactgagtcagacaaaggctgttgtagactcctgttctaattagaatacatgcttagcattttgcacgagataactttgtcttctctgtatttattttactttgaaggctgtacctacgaatatttggcagtgacaatacttgtgtgttacctatgcatgacattcagttctgtggcagtctctctcttcctcaccccccagaactgaataccatgcacctgtcacacacaagttattgtcactgtttgttcaggccccatcatcccttggtgagactactgcagtagtctgctgactgatccctctgctaccagcccttcccaatcaagtataccttccatatctgctgccctagtgatctttccaaaatggacatctgatcatgcccacctctccccaaccaacctgccttattctatgtccccacaggacatgtcctgagtacccagtgaatcctggttaataaaataaggtggaatgatagatccatgctgctcaccagtgacctcaagcaagtacccctgtggctaagagtaatggtgccaggcactgtagcaagagttttatgtacctttaaatgctcctcctattatcctcatcattgtaaaggggaggaatcaaaagtttacagaggtcaagtaactttcccagggccctacagttgggatagaaacctgggcagtttgactcccgagggcgctaactactctgcaccgctgacttcatcaatgagtcattcactgggggtgcctacaggaaaggtaaagctcattgttgagcaaaggcaatgtccttccttagctctgcgtaacatgccttcccctgcaggctcagtacctcccgaggtgcactgatgcagacctgagggcaggccctcacctcagagcccctgccctactatagtggggacaggtagaatctgtgttgccctaaactctgtctctcatactataggagtagccccgggctcctgtgaggcctgagctgggcataccccaagccccaggtgtatgccagagttactggcttcttctgagcatcagcctttacttccaagcatcagccagtgtgactccaccttcttggaggagcatcattctcttgcccgggttctcctagcccctccctcacaggctggggcccatgctcctcaccccaggttgctgccaaagtcctcctttgaattagaggagcttctgggaacacagagctcatctctttatccagctgtggggtcttccgcatgtcagcccttttggctgggcttcttccccgacctgaggaattgagcaggcaatgctcggtgagacccagccttcagaggttcttccccaagaggcttcatggttctgctctgccctgacccatctccctgcctgctccctctggctgagatcagccatgctctgtcatccagtctagggatggcagtaaggctgatataaagcttccatcttggcatgtagatacaaagctagagacagcaaagattatttgataacaaattccaggtaaataatagtaatagcctcttttcccctgcatcctcaacacctgaagcttaggagctcccagaagggcacctacaggatatgatgttcccatatcgattcttattgcggttttcatcctccttggctgtgtcccacgaagctgtctgcccctctggtaaggcctaaaaagcaaggacagagtggttagagtggcctgagataggagctttatggaagtggagatgaaccaacagggcaaagtaagacccactgcgatgggactcctagtggaaagggatagatgtccttggatggggcctggggaggacatagattttgtctgtccctggacctattctcttgttcattgtttcaaatgttattgatgtcttctgtgtcatgagttcacaatctagcccagtgggggaatcgcttgtccattcattgaattattcattcatacactcaacagatacttactgagcccctaacatgggctgggcactgttttaggtactagggatatagagaaacagacaagttccccttgagcttccagtcaactaggaaatatagtaaatgtgtaataaaagagtaaatgtgtaattttagatatgaaaaatgctatgatgaaaataaagcagaataaagggatagtgatgaggaatgagaattatttcagattatacactctgggagggcttctccaagaaggtaacattttagttacagtagtcctcccttatccttggaggatttgttcaaagaccccccagtgggggggctcctgaaaccatggatattaccgaaccctatacatactatgttttttcttatacatacatacctatgataaagttcaatttataaattaggcatagcaagagattaagaacaataataaaatagtatgacaacaatatactacaagttatataaatgcagtctttctctctctctctaaatatcttaatattttttgactgagattgaccttgggtaactgaaaccatgaaaaacaaaactgcagataagggggacttcattaatgatagatactataattccttcatgatactgtaattccttaatatgaaacagccagtcacaccaagaaaagtagaaagtgcttttcaggcagagggaacagcagatgcaaagatggtcaggcagcaaccaaatgaccatattcaaggactggagtgttgtgaagagggaagtagtgatggaagtatctagagcggatgggggagtccagattatataagacattgctattactggttaatgaactgggcattattctaagtgtgatgaaaaaccatcagagggttttgggcaggggaatcatctgattcatgtattacaaagtacaatctggctcatgtatggaacacaggctctgggaggggcatggaggaagcagggagatctgctagaaagttgtggcagtggccaggcgcgatggctcaagcctgtaatcccagcactttgggaggcctaggtgagtggatcacgaggtcaggagatcaagaccatcctggcttaacacggtgaaacccagcctctactaaaagtacagaaaaattagccgggcatggtggcaggtgcctgtagtcctagctacttgggaggctgaggcaggagaatggcgtgaacccgggaagcggagctggcaatgagctgagagcacgctactgcactccagcctgggcgacagagcgagactctgtttcaaaaaaaaaaaaaaaaaagttgtggcagtactccaggcaacacatgatggtaccttggactcttagaccgtggtggtggacatatgagaagtgattatttgcaggatgttcagttgaatgttgttgacttgggttgcctcggaagcagactcagagataacaagtcaggcacaagtagtttgtttgggaggcactcccagggagtttgggtgggagaatgtggaagtggcacaatcaagggaatgaagtcaatatagagcacatcaatgagcaggttaccactgtgggcaactggggcctaatccaatgggcacatctcatgccttagagttatcccaccatggggttggcacaaagttggggtagttactgatcaattcgcatccagtattggttgaggacaactcttggaaactccccagcatttcttccatgctctgtgggcagagtgtgcatattcttctgtcttgaagaagccctcaggcaaaaagtcacaggtgcttacaggaggaagccataaggtgggcatgcgtgggaacagtgagtgtagagtggatgtgtgcagggcaccatctgccatagatcctgactgtgaaggaaggagaggaaagaaggctgacccttagatcattagtttgaagaactgaggggggagagatgtgatttattgagatggagaagcctgggttagaaacaggattggggaggtaagaattaagtgttgtgttttgggtacataaagtgcttagtagagtgcctagcattgaatactgcacacttttttaaaaacatgttcaaaataacaaaaatggcagccacgttggagatgtccattagacatccaagctgatgttgaataggaagttggacatggacacccagagcttagggatagggaagagatagaagtcatcaatcagtttaagaggatggcaaccaccgataagacagacaagtcaacaaacatgagacaatttacaagagttatgagtcaagtggtatggaaacacagggaagggtgcagtcagttatttcacagacagggaggacgggcagttaagggagtgggaacagctatagaaaagctgcagaagcatgattatcagaccatgttttgattactctctctaccctaaatttagtagaataggctgaacatcctgctcatgccctttcattgcttctgagactgaatttgtaacaccttcagtctacacagctctctgtcagcagtgcaggaggagaacccaccattcattttaatacaccagccttgcctttgcccatctattccttactaggtctatcctaagcaaggaggaacctgaaccaggttgatcagaaattcagcccctcaataagccctgttttattggcaggttcttaacaggccagtgctcatgcatggttctacctttcttgcatctggtctctcaagtgttaagtcaacctgggtgagtcttttcctagagttggagttggaatgctttttctgtaatgggcaaactagaaagaagtttgggctttgttagttgtgtagtctctgttgcaacaactcatactcaactctactgttgtagagtggaaacagtcacatataaaaatcaaacaaatggtcatggctatgttcaaatacatctctatttacaaaaataggtgttggggccagacgcagtggctcacgcctgtaatcccagcactttgggatgctgacgtgagtggatcaagaggtcaggagttcaagaccagcctggtcaatatggtgaaaccccatctgtactaaagatacaaaaattagctgggcgtggtgacacatgcctgtactctcagctactcaggaagctgaggcagaagaattgcttgaacccaggaggtggaggttgcagtgagccgagatcacgccactgcactcctgcctgggtgacagtgagactttgtctcatagatagatagatagatagatagatagatagatagatagatagatagatggatgttgggctggatttagcctatggctatagcttgctgacctttattctagaagcatgactatgatcctcatctatgcagtggctgagtaggtggaattagtgctcattctgctacctagcaactgaagattcattagagggcacaggaaggagttcctttcctgggcttctcaggctgagccatgttctacaacttagcctttcttaggttttagattcgggtaataaagtgccttcctagctattaatgggtcataattttgttctttctgtgtccaacgcccttagacaaacatcctggaagagaagcaatacaggtgctaggttttgggcaccaatctctgacctaaatctgggtatggcaaaaatgttataaggataggtaagtgctcatttcacaaatgtggggcttatctctcacttttctcctcttgttctttctccttcttctccttttcgtatttctcttcttgctcctcattctaccaaaccttgcatccatattgccaccagtttaggccatctctaggtggaagatgcttctagctactgcaggtaactcttagaactcagattccagccctagcctcctcttctatcccagccaggtaactccatctcctccaggcaacttgccaggtctgttctctgtatgtgaagggaggttgctgctctcagtggtagcactggacttctggatgtcaaagctgatctattgagggtggattttgtacctgaaaccctctgtgataaaagccaattgttcaaccaaacatgtccccctgaaagtggggtgaagccaaaagcaggatagcatgactgttttcatactaattttttgaaaaaataattgcgttgagtacttgccatgtgccagggtttgggttaccattagcttaaggtctctttatgactgcacattagaatcacctgggcaggttttacaactcccaaagccaaggtccttctcaagaccaatgaagtcagactctctggggtgggacataggcattggtagtgtttaaaactccccagctgatgctactatgcagccataatttttgcaaatagtgactttaaaatattttcccatgagtctcctcattggttccttttgttttgggtttgtcccctccaatccattctccactgtaatcagaaagatctttctaaaatgtgaataggacccagtgattcctcttgccattgccttcaggataaatttcaaactctttagtgcaacatccttaatgacttcaccccaaatgcccctgcagcatcacttcttgctcttatatctatcctaccagttataaggtgtttaaaatttataagacttttcgcatgctgttccctttacctgaaattcccttccacctgagtccgtctgacaaactcctacatgtccttcaaaactcagcgtaagcatcttctttgtggaatcttctctgttcactctccctcaccccactgcatccccaggtaaagccagttacttctattattagatagacttctttgcatctaataatttaactctatttctcaacttggtcataggcttcttcaaggaaagggtagcatctttgtcacgactgtatctccagaacccgatgctggctctatacttcagatgtgcttgaaagacctatttaggatgaatgaatgagtggaataattagtgaatgaggtggcttctgtgctttcagagggcaaatatcctgggatcttagaggtgtcagtgaccttgaaaattgcctagttgtgttcccatccacaatggccttccaagcagctgataagtggatccatagcatctatcacttggataacctccatgacagatagctcaccacttctccaacttttggcctcacttttggacagactcaccagagttttttctttactcaacctcactgcactttgcctatgccatctcatggggccccacagaataaatgtgtgccctttctctgtcctgtgacatcctgcagagatttcatgaaagtctcttgtattcactcccagaatccttgaatggcagtttggggtcctctcaccatcaacaaacaccatgccttccaggagacaccccagcatgcacctatccctcaacaatcctaaaccgaacaaaacagttgtgataagtgggtggcagttcgtgggaaaccacacaggccctgtcatggtcctgggagcctctgtctcccttagtgggggctgaaggggaccgagtaggcctgggggctgtgatgatgttgataaaagcagaggagggatgcctaatagagcctctgggagggagtggtaatgaccccgtaattggcagactttgatcacacatccatttccctttttagggagctacaatctaataagggataatctcttgaagcaaaaaaaatatgagggggaaaagtatgaaagagagactcatttccatcttcaaagtgagcaagctaagggcattatttttccattagtggctagttacagtagattgaccagggaatggtggcagtcattaggcgctaatcacattcttttgaaaccaaaattgccatctcattatattcatccattatcaatctccgctttccttttctcattctcttctcctgagagtgctgggccctatttttacattcctctctgagtgtggaaatgtttcctactcttcaacagtgttgtttttccaaggcagtcattttttttttttttttttttttagttcaaaagatgtatttggggatgtccttatccctggagagctgcgccgtggtatttatagaatcctcaaaagtcagatttggaaggatcttttgagaaaattattgactcattttatagatcagcaaagtgaggtcctgagacaggaaatgacttgcccaagaatatacattgagtctgtccccactccctccctcactcacttccttccttccccagtgaccatctggatgccaggtgctgggatagacagggacccgggcaagggactagatagggtggtgtggggagaactctgaaaaggggagatctgagagggagaaaagcagcccctgaattctgggagctgacctggcactcacaggtaggccttggtgctctcctgctgaacgtggacaattgcacggaagaccaaccacaggcaaggccgctctgaggccacgatggaacaagacaaaagcaagttgtatctggatgcagacaaagatatgaacattgtccaagccaaaaaaatgaccaaacacccccatattctggttaatatgagcggcctgattctttgccaattacagctctagcctctatctgatcttcccttcttataggtaagatgtattaagatatccaatcataccacttcccagtgtgtccaacctaaaacaaagcctcacctccttagggcctctttcaaatcagcaaacacagcccacattctgagtccttcctaacatcctcttcctgaaatgtcccacaggaatgcacacttccaggtatgcattcacttcattgcaacaagtgataaacccaacttgttcacctccaggaggtgtgtccctgctgatctctggccaatacatttcagctaaaaactaaatgataagcagatgccagctttggcgagagctggggaaggaatgttccattcagagggaacagcaagtgcggaggccctgggatggaatgagctttttgtgttctagagcctctagaaagggaggctctccagagcagagagaataagaggaggatgacaaataatgtggatttggcttggggttggggcagggtgttcaatcaaggtctcgtggaccaaggacaagaacgtgagttttattataattcaatgggaaagttttggatttttttttttttttgagatgatggaatttccctcttgttgcccaggctggagtgcaatggcatgatctcagctcaccgcaacgtctgcctcctgggttcaagtgattctcccgcctcagcctcctgagtagctgggattacagtcctgtgccaccacacccggctaatttttgtatttttaatagagacggggtttctccatgttggtcaagctggtctcgaactcctgacctcaggtaatctgcctgccttggcctcccaaagtgctgggattacaggcgtgagccaccgcgcctgacccagaaactttttaagaggggtaggctgagctagtgccagcatcatgataaatggcagacagtgcttgtcactggaaccttctttatccttgatgatatgctttatagattttagaataaaattatcatctggtacccgccccagactaactctccctgcgagtgcaacccaccctcctatccacagagctgagcccatgggaggctcagaccacatgaccacaagtcacagacttcttgtgttctgctgtgctgactcagtccataggactatgaaacctacctcaatgtcccacttagtacgttcattttctgctagaactgagaatgatcgctgatgcctgtgtggctgattttttcttctacctggttctactgagccaaaccaacagaagcttgccatccttctttagacactcttctttgcacctaagcccttctgagttatgcctaaaatagtaagatgtcaaaacacaaagcttcctagagcagctcactcccaattcaaggctgagggcgtgtcagcccatttcatttacccatttacctcctatcctcagcagattctgtcatttgcaatgccccccttcactctcctttgcttgactgtatccctggagataattggatatgttatgccctagggtgcagcaaaaccaggccagggatcgctgatgaggcagttcctggctgatgctccagggcacagctgagggcttgccgcctccatgttcagtccagcctgccaggatttctccacacccctgtccaacactgtactctcctggtgcagggaacactctggagagtcttcagcaaggaggcaccattttacctgggtctttccttcatttgtcttgtcaagaaatacacttgcacactaactgtgtatgcgagtcagggaaaaggcagagctttgcaaaaggcagacagactaaaatgtttgaatatttttactgcaaataagttcaccacttcgagtgtcaataaacgtttctgaaaagagtcagtaatacatcctgaaggttatgggtggggaaggatttaactatacagaagtaacgcaaggtaactttttggttgatgaaattctcatgtgtcctgattgtgttggtgtttaaacgactctatttattaaaactcataaaactgtacactctcccaaaactaattttatactatgtaaattttaaaaaatggaaaataacacaccccacggaattttgtgatgattagtgactacccgatacaatacccatagcacctggcacaatgcctggtacacagtaggtgcccagaatcttccatcttccatatcctctttcccagggatataatattgagcctttttggtccacttgtagaaatcattctcttgccatcttcagtcaaaaacatcaaggattttttttttttttttaattttactttaagtaagttctgggatacatgtgcagaacgtgcaggtttgttacatagctatacatgtgccatggtggtttgctgcacctatcaacctatcatctaggtttcaagccccgcatacattaggtatttgctctaatgttctccctccctttgtccccacccccaccccctgacaggccctggggtgtcatattcccgtgtccatgtgtcctcattgttcaactcccacttatgagaacatgtggtgtttgcttttctgttcttgtgttagtttgctgagaatgatggtttccagcttcatccatgtccctgcaaaggacatgaactcattcttttctatggctgcatagtattccatggtatatatgtgccacattttctttatccagtctatcattgatgggcatttgggttggttccaagtctttgctattataaatagtgctgcagtaaacatatgtgtgcatatgtctttatagtagaattatttataatgctttgggtatatacccagtaatgggattgctgggtcaaatggtatttctcgttctagatccttgaggaatcgccacactgtctttcacaatggtagaaacatccagtttcttttttcttacaagggcaaagatgggaaatctctgaaacatctattctggtttgcctcagaccaaagggattcccaggatgtaggactttcagttttaaaactgggaccgttttgggaaaattgggataagctggtccctctaggtataggtaaaatagcatttagggaatgggaacgtttcataatctgttgggagcctaaggtctggtctctattgtggtccacgggttcagttaacacatttactgatgtcgatggtcagcttgtgggtgacaagggaatcacagctctgcaggttgtgcacaatcgaagagcattgcatctatgggagcaccatgcatacggcagaaattttagggtttccatatttattatgaacattttctggaaggtgacagccaaatatcttgagacaggtgcaccttttgttatttcactctaaggtgctgtaggagttagtggtggccttggcagaggccaagctttcaacaaattccatcttctgtgctgaaaagcacaagacttagggattataaatgtggacagagaaggcaggagaggatgactaatgacgtctattcagagtggcatcaggagagcaaatattattgcataccatgtcactaaatagacagtaatttatgagttctgctggtgaagctaagtagaaaatcagattgcagcaagatgggggtatttgtctgtgacaggaactttgatcaaggcagagaagttgagtgcatgtctgcatgtagactcacaaaacactctttaaaaggcccaattaaaagctacaagttctcctttaggtgacaaattccctgccttcaagaagtctatagcttaatgggaaatctcacgcgagggtacctctattcctcccagctgtgagtctacaatcttggggatccccataattcacttcaggctacagacttccagctgtctacacccgtctccatggtcatgcatgagcttccgggtggctgactccagaccagcaactctcctctaaacttgcagccagctatggtgaagaggcagactgccaggggccatgatcataaccttggtaactgttttcaagaaaactgtgcaacgggtgtaagattcctattaaatctccccaactagtttcatttctcctttcataggcaggcatctttgtttctcctaaaaaaaaattggctgcagcattttaatcatttcgttttttgcttccaagctttgcacatgtagttccctcttgtacacaaccttctcctctacccatcttcttctacttttctctaactcggagtcttatcttttctgaaacttctgatagcttttggcaacaagaagtggcaaaaagcaagtgtgtctccaaagcatttgaactagagttctgttacatcattacatggtgtggcaagaccacgagctttctttaaagcagcatctttattttctttatttatctttctatctccagtgcccagtgttaggtgcacaataaatactcagtcagtgtttctggccagattagtgttcataaaatagaagcatatactatcagcctttagaatttcatgctaagcctgtagtcaaacatttcacagatgaaaatgagacccagagagggaagagtcttgcccaagaccacccagagtctcaggagcagattgaggaccaggttttgactcttggtcaaaggatttttctatagtaccacctgaaaattgctcacttggttgggggagatcctgtattaaatacacaaaaaacccaccatgtgctctgttagaaacaatattgtaagtagaacaataaaaataggctaaaagggaaagactgagtctcttcccttttcccttaatggggaatctcacacgagggtacctctattcctcccagctgtgagcctacaattttggggatccccataactcacttcaggctacagacttccagctgcctacacgtgtctccatggtcatgcatgagcttctgggtggctgactctaggccagcaactcttctctacacttgcagccagctacagtgaagaggcagactgccaggggccatgatcataaccttggtaactcttccaagatcctagatccctccaagatccttggtaactcttccatgatcataaccatagtctcttccatgtgagctctttcctgctggaaaactctcaagtttgaaaccacagcggtcactgatggcttttggccactccctataatggcctattgtcttttttcaatctggaggtggggtggagtggagtgaaacgagcaggtggagcccaggtattcctgttttggtcattatgagttcccagagttgaagaaccccatggatttcccattcatgatttgggcgtgggccagtaattcctcatgcccctccctagaaccatgctcatctgcaaattgaggagctgaaccagaacctttctggggttgcctgtggtgggatattctgtcatcactctgttaccaactgaggagaacaaaccttgtgggagaagcagaggtgtcctcagacactgctcagggggctctgagcagagaagggagcacctggggtgacctgaaacttccatctctatagttataccccattcaaaagctgcctgcctgccatcaccccatcacccacagatgactaagaacaagatggcaacacaggccttccccacaaaagccatacatatggtgtgtccgtcctgagctggaaaatgaacaaatgtttgctcttcattaggctgcatcatattcctcacagctgttccttgttgctttaaatagtcttaatggagctgtaataaccagtaccttctggttgccctactgggctggttccattcattatggcgacagcctgtctggattgaactgggatgaatgtgcttcttccttctctcccatcacaaagtcacctcttccaattctcccttttcttccctaaacctgctgctcttctgactaccatggcagcagttacatgggacacagataactcggctctccagcccacatctcttatattttgctgtgatgcttagggttttgctgtgtaacaggggaaggtgggagaactggagctgggggggaagcaggctggggaggagggaggatgctgtggttcagaatcacatgctcttgactttaataggaagggtatatggttcagaatcacatgccctttcatcagcaggagtagacctgagggttggcagagcatgccaggggatgtgtgtgggcacatgctggggactccatgggttttcttagtggttctcagctttaaaagtatattcacatcaaccggagggcttagaaaacactgaagtatatatcccacccccagtgattctgaaatgtggctgtacactgaagtatacatcccacccccagtgaaactgatctgaaatgtggcctgagcattggtgttttttaaaacttccccaggtaactctaatgcgcaacccaaattgaaggcctctgactgaggctcagatctatctggcaggtgaagttaatttgtcttgggcctccttgagctcctaggagcccaaggcccttggccaattgtggtttttagaacttgagacataaccatggaagcggcagccccagatagtgaggtcccatgcgaccatcagtgggagggaggcccagctggctcggccaattggttcttatttagactcccagaatatcagtgacagaagggttatttggatcactttgacaaacccctttgctcccactgcataaatgtggaaatggaggcccagaggagagtgacctgcctaaggtcacctgaatacttaatgaatgttataggacttgattccaggcattttgactcttcaattcaagatagttcatacattatttcaaataattgaacttaaaatatatattgagagactcaagttttcatgccaacgagaacaagctgattttatggctctacatgcagaaaaagtgcgtaggcttgtctgggctctgggcccagtctcctggtttgggcagccccatattttccttgaattactgtcccagccgcctacctgcctctgttgtccctgctctgatctctacaagatctaaaatgcaaatctactttagaaagtcctgctctcttcgatggctccagtggcttcttgattacaatccaaagtcattagtgtaacaaacactcatcttttgcttcatcctggcccctgttgacagtttcagccccatctccctccatgcttcctcccaaaccgtttctggttcccctcactcaacctgctgtgcccacccctgtgccatagcttatgctagccgctctgcctggaacgcccttcccttctttaatttggttcttcctacttctcaagcttcggttgaggcttcatgtcttccagaaagccactggctatttacctttaggctgggttaatgcatcccacccccaaggattctcatagctctggatatacctctatggtggcattttttggctctcagaataggctctacattccctagcaggcaagggctctatttagttcccagagcctagtacagtgtctgtaccctggaaaatgctcccatatcttaaagttgaaattctgaaaggcctggtcctaggtccttgtctctgtctatactcacttgcttggtgacctcacccagtcttgtggctttaatcatctataggccaataactcccaaagctttctctccagcccaggcttctttatcaaattccaacttcatagatccaactaccttcttgccaccacatggagacactaatatgtctaatggacattgcaaactcaatttaacatgaaactactgattgttccagctctgctttacttgagcatccccatttccattagaggcagctccatcctaccagtggcacaaacaacagccttggagttacccttaattccttttgtaacatacaccatgtgttaggaaatgctgttggctccatcttttaaatatattcagaatccaaccacatctcaccacctcctctgccatgccctgagtcatcgttgtctgtcacctgggttactgcaatgtcctcttaacttgctttcacccttgccttcctaagttccattctcaacacagtagctagaaggaagtaaggtcagatcattagcacttgtcttctcaaagctctgaggtggctttccattttagtcagagtaaaagccaaagtccttataacggcttgtaatgcatagcatggtcaggtccctctttatttctccagtcgaatctcctattactcttatcccttgctcactcttcctctgccaccctggcctctttgcaactgcttgtacatgccagatatattactctctggatctggaactctcttcctccagatatcttccaccatgtctatattccaagtttcgtcatctaattaaggactatccttttatcctttttactattggaacctcctctacttcatgtccctggaacaaatctcccttccttgctctattctttctttttccatggtacttgtggcagactgtattattatccaaagattttctttttctttttttttttttggagatggagtctcactctgtcccacaggctggagtatactggcacgatctcagctcactgcaacctgtgcctcctgggttcaagtgattctcctgcctcagcctccagagtacctagggttacaggcacccaccatcacgcctggctaatttttgtatttgtagtagagaaggggtttcaccatgtcggccaggctggtcttgaactcctgacctcaggcaatccacccacctcagcctttcaaagtgctgggattttcttccccccccaatatttcttgctctgcatgctcctctagaatctggcaactgcccctcctcctcatcaagggatagagtcaaattcccctctcctagaaagtggggagtttttacctgcttacaaccaatagtacatggtaggaataatgcagtgtgatacccaagtttgggccacaacggtgatgcacttttcaccttgttatctggggagctcacctatggagttctgagccaccatggaaatcgtccacctatcccaaggctactacactgtgaagaagcccaggccactgaagaggccatgtgtaggtcttccagtggacaatcccagctgaaagcctgcatcagtcactagacatgtgagtgaagacatgttcagatgattccagcccccagccttggagacttcctagccaaggctctgaacactgtgtagaagaaacaggttgtccctgttgtaccctgcacagattccacagaatcaatgaatgcaagagattggttgtttcatgttgttaaaatttggagtggtttgtaacatagcaaacagtatttctcactgtctaacacactacattatataatttgcttatttttttaagcttatgtttatttcctatttccctttctagaatacaagcttcagaagggcaagaatctttgtttcattcactgttgtatcctaaatacctagaattgtccctgggaatagtaaatagtacatatttactgaacaaattttaagtgattattcaactgaattgaattttgtcttctgatgcagcttgctatggctgagatgtcccttagatgtcaacttgtcaaacccactcatgtgtatgaaaacactgaacagagcagagaagtgacaggcaacaaacagcacagagcaggttggtatgagagtagcactggaggctcaggagtcttttatctgcaataggacaatgattctcctagcagatctgtgactcctatgctcaggaggattaccgagatatcacaggagccttgatgatcaaagcaatccagctgtattctgggctggacattgcgggctagcacattgtgaaatgacttttatcaggcaatattttccaattaaccctcagttaatcagaaaataatgttaactagaagctaagctttacagcttgctgattaatataatttggactaattgaggccaaggctagcctagttagatttctggttgagattcaaatgatgaaataacatgtattgtttgttttctcattataaaagctgttcatttccatgctagaaagtttggaaaatacaaaagggtacaacgaagaaagtttgaaaagcaactcaccacacagggatgaatgctttaaaagaaatattaatctagaacgaaatgcatgaaagtagtcaaatacacttgtaattctgtcttcaaatttcagattgcaagttcttacatatgtgtttctcagcatttggctacttgtccctttttttttttttggtaagccacatatctcccttaatgatatttgaaatttttaatcaaattgttatgactaatgttgaatataccatttcctttctttcttttttttttttcacccaaacagctatttattatccacctcccatacttccagtttcttttgggagatatgccacctggaggctgttttcccaatcctatgttgccttcctcactttcttgctaattattaaaatataacccatcctctgaaggccatgctgtctatagaatcttgttttttttttcttggatatatggcttgaaaatattttctttttttaattattattatactttaagttttagggtaccaaataacataatcttcctgacatttgttcaacaagcaggtctgcatacacacacagaaagcatgctcacatgcaccctatgtcccagagactgggaccattcaaccccctaggaaatgagatccagggatgggtagtgatgagatcatcttcttcaactctaattcgaatatcctttcaagatttgtagatgagaatatgaaaagtgctattttacttagaccgtttttgaaattaagtgctagctctcccaagcttgtaattacttacatccattgacataaacatttttgttcttataaatatgtcaaacatgccccttgtcaccatgttttacactctcataaagttttaggaccagataggtcctgagagatcaccttatccaaattcttcattcgactaataaagaattttaaaactcagatagcaaaattctaaaatcaaacagcttactacattggaatccagctgtctgcacccccagtttagcacaatttcatgacctcatacgacttcagaaatattgctttgtaagctctttctcagaatatagtctgagggataaacttagtctgcaatattaagaattccaaatgtgtggagtctgagccaatgagttttctactgcacacagcaaaactgaatcaagcatagctggggcacacgctgcatgtgaagaaaaaaaaaagaacaaacaacaaaaaaaccacaaatacatataactcagaccatggtacacagaagatactcaaaagatattttaggaaagaaggagggaagggagagacaggaaaggaaaagtgaagaaagaaattcttgttttcaaagctggctgcagctggagtctaactgcaaccaggagagttgcagaattattcttggagagtgagctgctctttggttcagaaaaacgtcttaatgcattttccttttattttattttgctttttgtttgtaaaacgtgaggcctaatgggcaggatttgaaacaaaaagagtgagataaagaaagctaaattgttctgcaaaataaaagaggaacgtggtgccctttgtctggatgctgaggggtgggggtggaggaagttttgaagacagtaaagaagactttgaggagaaattagatagagacctgtcaggagaccagaaccttagaaggccttaccagcaatgtagatggttaaggaacttataagaagaacaacgttgtattgagctgctgcctgtcctttactgcagtccttctctattattccccaaacctcggtaacaaccactacctgcaaatcctttgtgttagggatgctttggggagatgggaaagggatgcccagtgcagggtgaagagatggtgcagaaagagggaactgtggtcactggagatgaagcattgccttcgggggatgggagcggggaccagaataccacagaagcttgagtatgagacaagaggtgaccaagggcaagcatgcatgctggaaatcattggcaggggagatgtgctggcttttctacagcatgtgggatgggagcttgagccattctggcatagtgaatggaggtgagactccaaagtgcagaaacgttggaggtaatgaaactttggataatgaaaggggaaggggagagaaacaagagtgaaaaaggatgtcttagaattatttagcatggtgcttctcaaatttaatgtgtatacaaatcacctagtttctggttaaaatgcaggttctgattcagtagggagggatggggcctgagatgttgcatttcctacacgctcccaggtgatactgaggctgctggccagggagccatactttttgtagcaaggctttagtgcccaaataagcctctgaaactatcaggaagtttccccacaggctggtctcttacctcgtattcctccttgaacccgtagccctggcctctcttcatctgcgtgatgtgctgcagcaagtcagccacccggatggcgggttggaactggtcccgggggtagctcatctccacagggtcacaggtgcggtagggatgagtctggatcgtgagggtgggctgggaaagctccccgcggctgccatctgcttcgaaaagaaggaggcagaacagatcatcacctatagaagctttgccctttgtcctccctgtctcccccagcttggcctgaggagggcagagggaaccaacttgggactcaactgatagggaaactgcaaaaggattggagatacactccttccctggcctggctgtgttggtagatctaagtatcaaacccacaagcaaaccaatgaccacaacacatttcaagggcacagactgataaagttccaggttgttcatcatccccgtctgtctcagtccttcgtttagactttgttgggcagaaccactaagaagctaggcaggctatttattgggagccccctcctgtttcggaagcagagaggctggaaatagtgcctgatgcctgtctgcaggggaggagagcctcaggtggcctcaggtactcgaagattggagtcacatgtataattctggtctatttgcctgcatggctgtgacctggcttctctactatttttttttcctttgagttttaccctgggaagaattggggctagtcttggactgccagaagctagcagggaccctgaccctcccagctgctctctctagttatgagctctgccacagtgaccaccttcttgctattgtatagtttccccatcacttaatactattaatccagtggcatcactgaacccactttgcagatagggaagcctgggcctcttccttcagtgctgctagctactttccccgggcctggatgctatgtctcatcgccttcataaaatctctccctgatgtaggatctatattctctcttgataaaaaccttttcatccaatgagttgctttaactgccttctgtcagtttggtcaccctgaaaactgatgcctggtcagattgggtttgaattcttctgttccccttggacgactagaaccaatttcttgcttaccacctccctgccaggcatacattcttgatctctcagggccagtttacctttcccagaaccatctaggcttggtcttcccaacctccttccaaagacatggacagtctatgccccagaccatcttgtttgtggcatgcaagagatgagaactgccagctgcagcagttaatgtgtctcccccagatgttttcagaccctgcaaaacacctatgcaggtacccactcggcctatgccatactcattccctgggaggtttagcatatattcccaattttctgcaacttgtcttttcaaaatccatgtgcccttcagcttatttgcctgtcatgttggaatactccatcagacatggatcctgtgtgtgaatgcacactctacttctcggcagcagcatcggcaagcctgttcctggcaaggaaagataatggaagggaacacctgaccttcctgctttctaggtgaccaacttgtcccagtttgactgacaattttccagttttaacattgaaagtacagctgttgggaaacctctcagtcatgggcacacaggaatggttggtcaccctaatgctttcacttatatctgtggttggagtaggggataaatttttcactttgcagccttctgcctgcctccacctaccaagggaggagaggctactaatctgactggtctgactttgagacactgatggggtcgtacctaattagtaggtggggtcatcgtaggcagagtgtggtctctaaaacttcctaattcagggtggtaggtaaacatctccaaaggagagactgtcctttggggaccagccaaataacccctggactgcttacagaaagatttctaagatttagatttatgcacaagaaagaagggcctaggcaagtcgttagcaaaaccttcctgactgcacagagaaatactgcttactttttctcccgggattttaggtaatagctagtacatgttcactggcattgcttaaatgtaccacttggcaaacatgggggtgttccctttctccatcaaccccttggtttcatgagttcgacttactgagaacccactctgtgccaaggactatggtaggcagtggcaatgcagacagaaatactgattccaccctcaaggcttgactgtctagcaaggaaatagacgagaagaatcaactgaagaaaaaggacagagcctgagagatgaaggcacatgtagttaagaacaaggaggttgataaggagtaaaagctgtgggtagaaatgtcaggggagggcaacactgtaacagatggtgcaaggcagatccagagactgtgaatgtgcaagacccttgaagccagtgtgaacctgctgaagggttttaggaggaatctccttctttaaagactcacactgtttcttgtaggtgtcccagctgtcatgaatagctctcatcgaaggcatccttccagcgaatatcactcctgtgatggtgtgattggaaatggagaggaagggagcacttgtgtttgattcatctagagatggtacaaagctatggcaagagccacagaggtatggatgctgcatacctaaagcttggagtcatgccatactctatgatttctatgaaaggatgagctgagtcaatgctaggaggcctgtgagtatttcccaccaaagctaccatcaaacatggggacagttgtcttcagagacccacagtctcccagaggaacttggggcatgggctgcatgggagaccagctgcctgggaaagacaggcttcctaggaatgggaacttggctttttatgtgtgtgagaaatgtcaaatgtttccaaaaccaaatagctgtcaatatggatattttccctaaacacattgctagacagactgtaaacttggtgtcagcaaaaccaacactggaatggaaaataaatgcattgaaatttaacaacttgtattgctgtaacatttgcaataatgtcaatgccagtgctaatgatgctatgaagactcagaaccaagggattttcaaggtttattaatccaacgggttagactcccctttccaaagtatcttacctcacctattcccttattaacctctgataatgcagaagtgatgtcttttatcacactccatttcaccagacgcactatacttaattttccatcgttaggtttaatgaaaacccaatttcacaactcacttctctcaggaacctacaagtaatgctacgtttttatcaggcccaattaaaagacgttatgatgttcctgttcaagagggagccttaaaactaatgtgcgattctgctgctaattcaacaagggcactggaattcacacgctgctcataaaatgtaactcacaccagctggcccagggacagaggatttttcattttttctcctcaccagccccttaattctcatgccttcttctgatttatgggtttggtatgtttatttatcgtgcaataatattttggatttctttcacactttttatatagctgttacctaaccctgtgaattcccctgcagtaactcttgttactgcccgcgaggagcttgtgggatgggcagaaggattttggtgctgtgtatgagattttgggttactgtctcactgatttcctctttgctgtcttcctgctctctcctcctcttccttgggatcctagattcatcaccgctgctgcccacccttatcccctgccccactgctaccagccatatagatctccctctacctttagtcacatatttccatcacttactgggaattgccactccaactggttaagaaatatttaatgagtacctatactgtacaatgcacgttagatattgtgttcatacagcagggaggtatgttcagggagaaataagcaggccacagcccttgaaggaggggagaagaaaatataaggtgtgcgtgaataagcctaagataggaagagacaggcccctaagagatggaagaaggatgtgccatggggtttggcaatctggaaacattctccaagcattaggcattcatgatccacctctgtgtctcttgccatagttgtgtaccatctatgtgacagctgtccaatagaactttccacaacaatggaagtgttctacatctatgctctgcaatttggtggccactaatcacatgtggctactgagcgtctgaaatgtggctgatgagacagaggagctgaattttaaattttgtttaattttaattaattcaaatagaaatatttacaggtggcttatgtctactatattgggcagtgcagatatacagaaagagatagggaaagaaagagagttctagagtcacacagtggggcaaagaggtctagaatagcactggccagtggaaatatattgcaagccatgtatgtaatttaagatggtcttgtggcaacattaaataaggcgaaaaagaacacatgaaagtaatttcaataatacattttacctaaccccatatgtctgaaataatatttcaacatataatcacaaaaattattaatgctatatttttacattctttattcacacaaaagctttgaaatccaacgtgtattttacacttacagcacatttcaattcagactggccatatttccaggattcaacagacactggtaaatggtaggctaatgtatgggacaatgcaggtgcacacagacttatccagagccagatcaagttctaaagagaggtaatttagagctggagtaaatgctaaataaaaagacactgatccagtgtaaaacagctctcacccagcactatccaaaagaaccttacacattgacaccaatgttctatatttgcactgttcaatatggtagtcactggccatctgtggctattgagcactttgaaatgtgcctactggtgctgaggaaatgaatgtttaatttaattttgatttatttcaatttaaatagccacaggtggccagtggctactgtattgaacaatgcagatctacacaattacatcttcaaaacttttcttcagataaactctcaactattttttttaactttgcctcattatgaatgatagtgcaacataaaatcatgaatgtgatgtgctaattttgttttagtgctcactaaaatgtttacataactatttgagaagaagtcggggccaggtgcggtggttcatgcctgtaatcccagcaatttgggaggcctaggtgggcggattgtctaggtcaggagtttcgagatcagtctagccaacatggtgaaaccccatctctactaaaagtacaaaaaaattagccaggtgtggtgctgtgcacctgtaatcccagctacttgggaggctgaggcaggggaattacttgaaccagggaggtggaagttgcagtgagccaagatggtgccattgcactccagccaggggtgacagagcaagactccatcttagaaaaaaaaaaaaggggggtctgttcatgttgcatgaggggaactcaatctgcaccctgagaaatgttgagtctgggtcccagaatcagatagaatggggtttggatcattccttggccaagtgacaaatctttctgcatctcagtttctttatctataatacagagaaaacacatgttgtaaggattcaaagagatagtgcatgctgagtgctcagtacagtgtctggtatccaggaagcagtaaaaaccagtatttgttctgatgaatttgtgcataatgtcatattggacatatgagaatccacacactagagatggcatctagggagtcatttagggcttctttcgcctttccttgtctcctctctgctttcctttatgacacaccccaaagccatctattttactccattcctgctgctattgccctcattcaggtcttcatgacaggactactccatcagtttcctgatggcccttccttctttcacagttccctttacagagctttgatcaagtcatttttcttagcaaaagtcttcagggagtcaagacaaaatttcttaactagctaatcaaattcctgtagttccttaccagtatcaatgtatttcttctatcactattcatcctagctccatgtgctctttagggcaggagagtatgaagagtgatgtgtaagtagctagcgactgctcattgagaggagagagtctggaagaggagagaagttttgaggtgaagaggaggctgggtcacctgcacagagtggggatgcaactggaaccaacactgtggggactgtggcaacagcaggtatcagagtcaaagcacagactcactctgaagataaaacattggattcaaatgtgatcttcacagatttctagctataggacctcaaataagttacagctgacccttgaataacatggaggttaggggaaccaaccctctgtggagttgaaaatccatgtataacttatgacgccctcaaaacttaactactaatagcctactgttgagcagaagccttattgataacataaacagctgattaacacacatgttgtatgttatatgtgttatatattgtattcctacagtaaagtaagctagagaaaagaaaatgttattgagaaaatcataaggaagagaaaatatatttactatttattaagtggaagtggatcatcatacagttcttcatcctcattgtctacacattgagtagactgaggaggaggaggaggaggaggaggaagaagaaaggttggtcttgctgtctcaggagtgacagagtcagaagaaaattcatatattaagtagagctgtgcagttcaaacccatgttgttcaagggtaaccatactttgagcctaaggtctttatttgtaattgctgatggtgatgacaatgatcatgattgatcatcatcatcttcttctgagaaggttgttgcaagggttaaatgtgattccactggaagaaatctcaaggtggaacctggctggcagtcagtgcctcccctcttctccctcacaaaatactagaaaaggctcaagataataaacttgtaacagctctgaaatctaagtctatccactaacctattgccagaatctgggaagaaaacttgtttattattgcagcagcacacatcccatgtgcaggaagatatatatttcaactgctaaaaatttctcgaaaatccctctctcaattgattcaacataatctctcaattgattcaaccacaggtagtttcccctccaacgctggaagtgattacatttccttgttgaagcataagatgaagcagttggcttgtgcttaggagtcatgttgtaagaatgctctgttctgtgtttctgaattctagacttgcactagcataggtgtatgagatttgtgacccctgaggaacagtagattcacatcctcttactcaatgtaacaacagatggatttaccttttcccatctttcttatgtctgaccaaacacatagtagggttgaacttgtagaactaatagtaatagaatgccactccactgtgccattttctatggagctgaaacaaacatgatacaattgactttgatagactttgttacttgggataaagcaaacccaatggcctgaagaacagaaaagaaatgcttccaattttctcattttaattcctgagctcagagaatcaaagactgtatcaaccatatagcagggttggggcatttccaagctctttctcctcctaaacctccatcactggggtctttgacatggtaaagacaaaagatggtatctttgtttccgagacgcagattcagtgttaggaagcaattgtgatgggaacagtcatgggaaaatgcttctaggattcatttactgtttctgataaagagatcaatcctcctgcttgtgggggagagtatgaattccttctttcacagcactcacaccagatggaaggatggtgttagacactctatgtagggatgggggctataaacatccattgctcctcttgcttaaaccactgccagaatttgggaggaatattgatgaattatagcagcatcacacatgccaggatggtatggaataaaaggattccaacaataactagttggacagtgaggcaacgatgaggatctacctcctctatttactggcaagcaacaggtctggagagacttctcttcctttaaagttaaataaacagaaacaagataatatgaggtcttagaagaaaatccaccatgttaacagtaaggaaagtgatagcctggataccgtgaaaagtacaattttcaaacacacacacacacacacacacacacacacacacacacacacacacacaacagtcagtattgactgttgacccaagagccatcccctgtcttgttattttctggctaagttcaccgtatgacttggtgggggcgggggcagggaatgaccctactcccaaaacaagggacaaattctgatgtccctacgccatcaaggtgttccgataccttttgcaagttaaataaaaatcttttatatgatatgggagggaagttccattagaaggcttctaggaaaggttctcttatctctaagaaggacaatccagtggcccgtctctgccaccagacagtaccatgtctgtgtgtgatgcctggaactgctgaaacaatcttgcatccatgaggggagctgggctgaggttgccctcatgccaagataagaggatgaagaggagagcttgaaagaatgtgggtcctcaatgacattcatgggcatctcattcaaccaactctaacacttgacttcctgttctagaagataatacattaacttgctgcttaagccatttttattcattttttttctgttactggtatcttaatctaaacaacagaaagtagaagtgcattttaggttccttgaagtttattgaaaacgaaatgcgagaaaagatagaagaataaaggaaattaaaggtgaaataataagactaagacaacagacttttcccaaaatagatcaagttaagaagtagctagaaaaaatatttactgggtgaggtaagaaacaattgtaaagaaaccaaaatgcaataccagaattaaaatgggcactggaatctgtaatgagaataagcaacaggcttgtggagaattaatttgaaaaacttggaaattaaaacgcaaggaaagcagaacaatacaatgtatatttcctttgtatatatcatctgctcatgtgtgttcatgtgtgaagggaacaaaaagacatttttagagaaaagaaaacaaacatataaaagacataattgctgttacagaagaacagaataaatggaacagaagcacattatgtgtcctttcttatcaggacacaatattaaaacaactcattggcaaaataaaaacttaaatcttcacgtgtaaagagttctccacctacaacttaaaaatagagcctatattctgatacaattgtttaaatattattgatgtagaaatactcagataaacatctaggctggaaaatggctatgtataaaaaatcagaaactacgttactcatacattttcttgcccaaatttaaattccagaaaacaatgaaacaaaatttttcaagtaaaaatgatgtggctaaaaaattatacagtaaatagtttttcatttgcgaagctacagaaaggcattccctgacacataaagaataagaagttatgttggctctgattcttttccagagggttgggtagctgataaagctagtcaaggatgtgagtccagaaatagagaaaaaaacatccacaagaatggaagaagtcttgttataaaaaaagttgatttggtaaacacagatatgagtgtaaaaatcacaataaatgtgaatcaaaacagaatgaactataagaggtaatgcttaaagagaaatcagatttaaaaatctaatataaaaattcttggctaaaatttccaattgtattaacaaaaaccaggaagtgggtgactgatacatcactaggaataaaagtatattatcttcttcacctttcataatggatattcaatgtgtactatttcaatcctgacactcttaattgaagaacacaattttaagcgaatgtgtatgtactgtacagggtactgtagaggtgtgcatgtgtgcgtgtgtgtgtttaaggcatcaactactagcataacaagaagaatgaacaggattcaaatagagataaaaaaacaaaacaaaagaaaaccctgacttctagtacaagtgcatctggcatccaaattttgttacttgtttgatagaagcacctgccaacatagaaatcaacattaaaaaaactgtgtaataccactgaaaactacactgtcctgacaagcaaatgagaaatcatcctgtagaggtattttcataatccaaggcacattaattcccacagaacaaaactgcctccactaaagacgaactcatagtaaaaaataaattataaagaatgacaagagccttgtaaggaatcttatccccataggagagagtcagaagtcatcatacacagaaaaatacacctctcaagaattgaaaataataaaacaatcaaagagactattaagtaaatacatttagattgattaaagagaaaaaagaaggaatatgaaccattgcaataatgcacacatgacagaaaaaggataggtgggtttgaaaaatatacattcaacttcttgagataaaaaaacatagtcattgaaaatagaaagaaagtaaatatgtatataagaacagacatggaacataacacaagttaaagatacagcagaggagctgaaaaaaaacagcaaaagctggctctttcctttgaaaacaccaacaaattagacaaacctctgccaaaaaatgattaaggaaaaaagacacaaataagccacttcacagttgttagagactgacagaacatttttagcccaggcttagactggagaatgattaatgaccagagaagccctgagacacatctcaagactctgatggacgtggtcagggtcagctggtaaacaccagcccatcacctgggtgctagctttttaaaaaagaagtcatattttgagatcattacagattcacatgcaatcgtaagaaataacataaacgggtcttaaatacccttcacccagttttccccaatgttaacacttgtgtaactatagtacaatattataaccagaaaattgacatatatgttactgatcttattcagatttcattagttttacatgcgcttgtgtgtatgtttaatttatgcaattttatcccatgtgtagacctgtgtgaccaccatcacagtcaagatgcagaaatggttacatcacaaggacctctcatgcaatggaacactagcgctgagtttcttctttctacactaagacctggttactagattctgggagactgcagcaataatgaaaagaattgtctctcagtgaaatgccaaactccgctagggatcgacaaactgggatcccatctttcctgatgctcctttaatccaggcttccacaggaccacaatatgtggctggtcatacatgctgtgcactgttcaattttagagggtgtcattcctttgacggccttgctcttgtgatctacaagggccatcaatcttgacttgttccagtgactagcggttattattttcattttgagtaaatcaagtggaaagtttcacccatctggtctagagaggaagcaataagcaaagcatcagtctatggacttagttccctaagagctgaggcagagttaggaaaggagacctctgttcagagattcttctatgtgtctggagtgaactgggccacaataaagggttttgtgcatgtcatgtgtgtggggagtgtgtgtatcctggcaagcatgtgagttttcccttacctcttctccaaccagatataaatggctttttatctgttttagaaaataaacatctaggtataattttgttcaaaaaagggtttcactattttttaaaaaactttcaaaataatttttttctttttgtcaaaattctatcaaaatcagtgaggaaagaggcagcaaaaatgctgataccagtgttccacagcataggttgtataaacaatacatttggaaaaaaaatgaaaggtcgttgagtttgccagagcaacagatgtttagtagtgatagggattctctgtggctggccttaaccacttagtgatcaaactaggaagtgagggaataaagctgaggggcgtgcatggaatcctggaagtattttgttgcaccacaaagaagaagggatataattatggactttttaagtcttttaactcactggaaatataagccctttttggtaacatgtaggttgattatttaattcttgcatattcaccatccatttatactttcagagacacttgttgttgaaaataatggccttaaaaaatgctgaactttgaccggtagaagaataacccataaatagacattgaaatatacgcctaaagaattttataaactgatgataaagtagagtacaaatattggttggcaaagaatggattcccagagagtgtattatttttcagaagagaatgaagtatattaaagtagatgaaactgtaaggtggcttagtgttagaaagattaatattattggaaagttacttcatgctttcagtaagaagttctgcatgtgactatggcttgttaagataaatagcatatgcaaaagaacttagaagaacatgtcttggtcagtaagttactcaaagcataaataataaagaaaggtaaatcacacagttttaatattcttgcaagcatgaagggagtgataagggtgtggcatttgagaggagtttatatggaaggaaagactgggattaaatgaggaaggatctgagttatagataaagggattgattgaggcagcaagcacaagaaatggaaagcgactctgcatgtcagttctgtgtttcacagagccactaccagcataaataaaacccggtattgatagatccatgtggactcacctgcccctattctcaaaccatcacttaaaggaaaacttgggcaggtgaacttatcctcaaagtggggccctgtgttgacagggactgccagcaactcggacagtcttctgccttgaaaattctagagtgtttgaagaatctgatatattgaggaaaacggcaagtccaataggaaagactgagaggctcacacaatactctctgaagacagggtagtggtctaacacgtacagactttggacatgaatagggctgagtgagaaccctgacaccatcacctactgcctgtgtgattttgggcaagttactcaatctctctgaaccagtttctgcaaagcctttatggctagtatctctgaaaactggagatagaaagagaaaatcaagcactgatttataattgttagaagctcaacacatcagaggttataattgttagaagttcaacacatcagaggttaatacaacagaagaagagatagtcatttctctccatggccaggatcctcaaatctgctgcccctctctttccctatccatagtggctgaaacaacatccttacaactccttgaatcccctcttccttctccatgttcttttctccaaaataaggcatgagaactttttcaaaggccaaagctgagcatgtcacctccctgctcaaactttttattggatgcccactgtcctttggctatgttccagatttaagatatttaatatggcttcaaggctatgattggtctagctctcaccaatctcatttgcctcatcttgtgtctctctgtcctttcccctctaggctgcagccacactgtctcctcactgaattctcgcccacctgagaatctgtacaggacgtgctattctcctggagtgtttataacttttcccccaaacttccaaggccacgtggactcctattcatccttcagcactcagctcaagtcaattcctcctctagaataaacaaacccatctgtggtatgaatgaatggtggttaccaattgggttgagtaggggcaggggatggctgggaatgggcatgagggatcttcctggcaagtctgtatattactagggggctgggttgcaaagtgtatgcaattgttgaactcataaaatggaaaacctaagatttctgtgtttttttgcaagtaaattttatctcaaaggaaaaaaccagactcttgagtcggcattaatgatgtgtacagttaaatattgggaggaaagggaagtgtagtgatgtctaaaatttcctttgatatgcataaaaattaagatggattgaaggatggatagatgggaagataggtaataaaataaatatagtaaaatgttaatagtagaatctaggggatgactggtcactaaaagtattttaacttttctgaatgaagatatcaaggaagacatctctgtctgcctccatccccatctgagggtcccatgttatatcctaacagtatcattttcatgaattacaatatatgtatattcctgaacatacatcgtcttcatgaattactatagttattgaataatagtgagattagtatcttatccttcaccggactgtaagctccatgaagacaggtatcatatctgtgttgtttactcgtgtatctccagaatctagtgcctactctggaaacactcatttgttaggtacaccttgctctctgaaatccaccctccaccttgttgataaatacaatgtttgtttatcttcaaggttcatctgtcatgtcttctaattcttttggtgaggatatcatgatctctatttcctgcctcagttccatttgccttggtgagtgtggggaggttgataagccacatttactcaaaatgcatatcttctcctgatgggcttctggtgattttaactacactcagatccgaagctcttctctcagagtgaaaatgttcagcttcactgtggctccaggggactggacatgatttggagtttctcattggctccagggttgtatgtgcactgaaaacaactggcccagaattttgtattatgtatatatcaccaaactccataacctgcacacttatgggaagatgtgtgatagaaggaaaagactaagtaatgcctcacactgaaaatacagactgctcctattttctatctctcattcataaaaattataataagactaaggaatgcaaaatagttgcagagtaatacttagctaaactagaaaaactcaattttgacaggtttttacaatcttcagcctgacaggtgactttgtcttttgttgatgtgcaagaaagagaaaatgaaataactaaacttgtctgaaagatgaaatttaaatgtgcaacagatgtttgaaagagtttgccattgttgtgggtggataaaagcttcctttctccatttcaaactatgccctggatatttaggctgagtttgtggatattatgaactacaaagacaacgggacattaagacaatggaaagaacacagtttgggagttacaagacctgagttttcatcctggtgttaccactaaattatcttgcacaattaccttcacctttgtggaccttaattttaaaaccaggcagctgaattagaccaatgcttctcaaggtgtaatgtacatatctagagatcttctataggcagattctaatacagtgggctgaagtgtggcctgagagcctgcatttgtaacaagctctcaggtgatgctgatgatgctggtccatggaccacaccttgagtagtgagggattaggtggtctctaagggagcttccagttaaaagatacaatgtgttctttaaaggtcctggaatttctcttaaaaaagcaaacattattctttctgctcttactgaatgaatgaagtagtacagcttagtattgttcaaaaccaaccaaaaaatgcaactaattaaatctgatggccttaaccctggaaagaacagatacctaacactctcataagaatgaataaagcagtgtgtccccatcaaggttcagcctggctgatcctcaggtgctgaattatagaggctgatcactgaaatgccaaactactttgttttatatagtagattccaaatgctagtaccgtacaagagtcattcaaagaacatactaaatatagattcctttgctccatattctagacataaggatttagtggctttagtttggggccagtcatgttttgggaactactgttataaccattttatgggggggcaggatagcacctagggaagaagaatggtaagtttgacccaattccttattgggaacatggtaaagatctttctgtctgtctgtctccctccttctcttctcccttccctcccctccccttcccttcctctctctcttttttctttctttcctttctctctctctttctctctccttccttctttccttccttcttttcttttctttctttcatggagtctagctctttcgcccaggctagagtgcagtggcatgatcttggctcagtgcaacctctgccacctgggttcaagcgactctcctgcctcagcctcccaagtagctgggataacaggcacctgccaccacacccggctaatttttgtatttttagtagagataagatttcactgtgttggccaggctgttctcgaactcctgaccttgtgatccacccacctcggcctcccaaagtgctgggattacaagcgagagccaccgtgcccagccagaagatctgtttttcaagcctgcttgccagcctctgaagaatcctagtgattctcatagtaataaaggtgtgcaagtcataagggagtcaatgttacagggaaacagtccctgaatagttgcccttatgggatgtcaaagctttgaggatccctggcagctgcaatgagaggtctggactgtaattcctatcttcttgtctattgaaatgcatcagaagaaccagggttaaatcctggctctactacttattagtcaaaggctttgggcaaattaattaacatctcacatgttaagccatgtattagttatccactgctacttgacaaactacccccaaccacagcagcttaaaataacaaacatatacgatctcagtttctgcagatagaaatctggttgcagcctagatgtgtatctctggctcaaggtcttttgtgaggttgcactcaagctgaccgctgtggtaatgatctcatctgaagactcagctgggagagaattcaagttaactgatttcataatcactgacatgatactgacagattcattttttcatgggctactgcagtatgggactcagttccttgctggctgttggctgggcatctccctcgatttcttgccaataggtcaacttacaatatagtagctagcttcccaaggaacagacaagtgggagtgagagagagcacccaagataaaagccacagtcttcttaaagacaaatcttgaaagggacatctcatcactttatcatatcctattcattggaagccagtcactagatcttggctgcaatgaggaagggcgttatataagaatgtggcataggaggcagggatcattggggccatcttaaagtttgccaaccacaaatcctaatatcattctgcaatgtttttgtgagaaccaaaagaggtaatgtcgatgaaagaacatttaaatatacacatatgagagtatattataataattcattccaaggagtccagtcaaaatcttccagctgactttgcttagctttgccaagtattccaaggcattcacttaataaaagttttttaattcatgaaagcttctaaagtaccctctttacacttttccaaagagttttccaagatctgatttttcaaggaaagtaaatggtttaattttccttatcacatgaattgccattgacaacaatctttaatcgttaaagagttaacaatgtactttcaattgctttacgcagataaaaaatccattccctaagacaatgaattagccacataattgacagccaattccagtaataaaacgctaattaagtgataatgctaagtaaaaaatataatgtgatgaatttgctaaacaatggcctaactaataaattttcatgctaaataaatgatttggaatggtgactaaaccctcaccacatttagggtcagttgaaaaagcaatgatgctttcagaaaacaatgacagaagtgactgtgccagctaacatccttaacagtattacactgggctctttgccaagcagggccaagggactaagtctgaatggggtaggtgtaccggaatctggggggctggagcaatcaccatgatgatagtatgggtgactagcctaaagaaaggcatggaatagccaagtatagccagctgtagtaatagcagaacccagcaatgggcaagaagatgcagaaatcaatgctagatcatcttgagctaaagaagatcagggtcagcaccaaggacagatcctggatgcggtggctccgggaagattcctgcagatagacgtgttttgtcataaacaaggaagtcaaagattacagagttttctccttaccccagaaggctaggctagtggtgagactcagctctcataggcacaagggtcttcactattttttggaagcaccatggtttcaacccatttaatttacaatggtaccttctgaaaggatctaaatttagaggagaagtccatatttcttatgggttccactggttttgactgacctttacagctggaacagggttctagcttccacatatcaggcacatgcttgccttgggagcctctaatagagacactctttcctgacatggctcacatctgttacctttttaaagtctttagtcagatgtcatcttctataaaactgcaatcctcctccacttatgactcctgatcccattcagcatgttctattgtttcagtgcaccctcacttgttattatgtcatatcatataatgtacttatcttttgctgtccattgcttatttcctgtctctctttccacttcctaccatcaatggaatgtaagctctagaaagacagggaatttttaatttctgtattcttcactgatgtatattaaaagtgcataatatgtcaggcacatagtaggtgctcaacaaaccttgttgaataaatgagtggcagcatgttcagaagcttgttacactctaacctctgaagagagtagtgcaatcttagaaatcagtggagtaaacaagagcctatatcctctgattttaagacaccactgtcccagtatgccatcctcttacttagtggcttcagaggtgtccgcatatttctcactattcgggagggagtacattatagtagtaggatcatatgcaagagaaagattaagtttaaatcctagctctactactaatagctatgtgaccttgagcaagttatttaatctccctgaacctcaatctccacatgtgtgaaagaagcctagtaccaacaataatcatcaactcataggttttaaggattaaatgatataacgtatgcacagcatctagcatagtccttggcacacagttagggctcaataaatattagtttcttgtactttcccatttaaatacaatatgatacatcccttaatacataagagtaaattgacttttcagattatgccagatattgggaaggctcacaagggcatgaaattggagaagagtaagctgtgactggggaagtgtaaaaggctagaagcctagagccctctggaggagagaggggagatcacaagggtaggggcagtaggggacacaaagtgggtctgaagagtgttccctctgttttccagggctacactgagtggtagagagtccaaggaagccagtatttggtgatggggcctttagaactgatgactaggacaaagatacaaggattaggactttctaagaaatggaggtgcaaagtgcaccatatatctctcccagactagtgcaatggtcccctcccttgtcctcctccctcaaccttcctctatgggattaaaatctaagagtaaccctagtcatcgctatgtctgcaggtcctcattgtcccagcaatgcataagatcagttgactgaatactgaatagtgaaagtgaaccattgtgatctatcctgacttaaaattagcataatgattcattcaacaaataccactcaatcgtattcataggccaagcaccatactagtctccagggatatagtagaagcccggacagaagttgtctatgcaatcatggtttaaaagtctggtgaagatgacagacattagccaaaaaattattaaatgaataaacatttgcatacaagaaatttctgacacatgctaagagggactagaatgtagtaaaattaaaaaaaaacaacaagtggccactgtttagatagacaatttagggaatccctcaaaagaagacatttaatcatagacctgaaggataaaaagtggctaaacagtgaaatatagagtggaagactgttctggaaagagcaaacagaattgtgaaagccatattttgggaaatgcttagtgttttcaaagaataggaaggaggtcaatatgactggagtatattgagcaagacagagagtagccagagatgagactaaagatgctgacagaagtcatgtcattctgagccttgtaggccacgaggttaatttttacttcatctggagggcaatgggaagccaataacggatttttggttgagcagtggcattgtgagtttgttttttaaaattgaagaacacgctaggcaaatggctatttcataaataaagcataacaaagatagtgagttattggtatacttctgctgatggatcaatatgaaaggagaatgatgggatagaataagaagggttacagagagggtgacagggaccagatttgcaagtgtgtgtatttgctagaacacagctggctgaagattcactggatgaccatttgggtctccactgcagaagagacagaagtgactgttagtttggaatgactcctatgttctgagcctctgtcatgtctgtacatcagtgggaatttcatctaacctagatcaaagatcctgaagataaaaggtttcaccttggaaaaactcaactggtcccatgagacattaactgaataagaacactcatttcaaagtcaaacatgtccaaaaatttccaggtatcacaccctcaaaatactgactaatcaatacaatatggagcaagcagggagatctagtcaatacactcggcttaaaaatggtttcaagaatggaatgccgtagaacaccttctctctaccattgcttcattacagagagttggccatacccgttgggttgtagtgactgttaatcctacaagcaggggtgtgtgtgtgtgtgtgtgtgtgtgtgtgtgtgtgtgtaatcagatttccatgtgcaccagcattttgtgctgtcactttccttgaagtctgatataggcagaaacaatacttacttaaagctttatccactcccactctccaaaacttttacctcactatcaccaagatgatctttctaaaaccgactcaatccttcctttctacttcttaaaatctatgttagctccttgcagaaacataatacatttcaaactccctagtattcgagaccccagttcctgcttacctcttcaggttcatcttttaccacttaatcctatggttctaatatttcaagtactacagagaagccaatccacttataattttaagtgcaacataaggaagggtcttcctgggaacctaacagcaaggaagaccaacaccatggacagagacgctaacaccgtcccctgcccttcaccctgtctttcaggatataggaagaagttaacattactgatgtcttttggactctggatgttagggaatacatttatactcacaaggaattgtacaagagagcaaaagctatagatttgtaaaatgtgcagagaccacaaaactacttgcttgtaatagcagaattatcacgctaatccaagtggaaaatggaggttttgaaaatattcctattattgactatattagccaagtagactttcccacctctatgcccctgtatatgtattcttttattttagaataatgtcatagcttgttaccaggatgaccacaattgattccttctcttcctatatgcatatgccatttttcctatagaagggttgagtctgctcctctactcccttaaatttaggctaatatgtgactgcttttaataatgatacacagcagaagtgaagctggctagttctgagcctagtttttaggaggactagcatttctcctggctttctcaaacacttgctctgggggaagacagctatcatgcaagaagtacaattaccatgagtctgtcctgttgctaggaagcctaaggtagatgtatagggagagagtgattccagcctaccctagatgttacagtcattttagcataggggttgaatatgcaaatgagggaggcatttgggccttccatccctgacagatgccacctaaggaagaactgaggtcccagacatgttgtcctacaagagctgtcacagtcatctccagccattcaagtcatcccagctgaggctccccattttcaagcagacacaagctatccctgttgtaacctatccaaactcctggcccaaagaattagaagccaaatacaatggttgttgttttacactgttaagttgtgatatggtgtgttacaccatgtcacttatttcttcttttctgcattgactaattctgaccacacagtgtttaagattcaacttctctatgatgttttctttgatcaccttgaagtaccttaaggattctatttcctgctggtatttctttcctttcctttcctttgctttccctccctcccttccttcttccctcccctccccactccttcctttcttccctccttcctccccccttcctcctcctcctcctccttcttcttcttcttcctcttcctcttcttcttcttcttcttattcttcttcttcttcttcttcttcttcttcttcctcttcttcttcttcttcttctcctccttcttctccttctctctctctctctcgatagagtttcactctgttgcccaggttggagtgcagtggcatgatctcggttcactgtaacctccacctcctgggttcaagtgattctcctgcctcagcctcctgagtaggtgggattacaggcatgcaccaccacacccggctaatttttttttttttgtatttttaccagagatggggtttcgccatgttagctagagtggtctcgaacttctgacctcaggtgatccacccaccttggcctcccaaaatgttgggattacaggcatgagtcactgcacccagctcattcctgctggtattaaactcatcctggctgcttctcacctagaagaatttgatatcctatcaactcatcgtggcttcctctcacctagaaaaccagcatggtccaaatatcttcctttttacctcacagtttttacttcggagtttcaataactagagaaacatcttggctgccaggacaagtggtgtggaaaagccaggtatccatgaccacatagattaaacccatgtaacaggtgcccatcatctcccagaacctcctcagaatactgttgtccccatggctacctgtagggtcatccatccaatcaagaatcacatctgttgttatatatgcttctttcctttactatttttcttggttcttccatcgggagggccatatagtagcctatctgaatctctgcctatatttgtatgtggtctgaagatcaccagctgatttctcttcctattcctatgattgaaggactaattgtatcagattcccagatccaaatggttgacttcttgaggatattttgagcagcagcttctggttttgtaggaaccataaaaagggctttgtaaaattcccttcagtgttggctacagtgggtgatggcaggagtgggagagaggctaagatccagatagcatctgactggcaaagcatcatcccttgatttctttatccacctttattcaattctgaacgctgaaaacaggacaatagtgtgtgatgtcagttgtactgagctttctaaatattccttttagttttctctgagtatataggatttatatacctaagtcttgtctgtttatccaactattcatctacccatctgtcaacaagagtttcaggtattcattctgtgccacatgctgtgccacatgttgaggatacagtaataagcagaaaataaatggtccttccctctcgagcttgccatctaacagaggggtcaggcactctgctgaggatacagtagtaaacaaaaacatggtcctcctttcttcagcttcccatctagtagaggggtcaagtcttaaacacatttgcaaaccgcagttgttgctgagaaaaaaggtggaatacaattctgtcatagcacctaacaaaagaaatccaatctggtgaagggagaagggggtcaggaaaggaagaaatgtaagaatggaggtctaaaggaatcaattaggagaaaagcatgggtatagccagtgatctagatgaggagttggaaaacatttctgtcaaagaccagagagtaaatattttaggctttgtgggctaggtggtctctgtggcaactactcaactctaccattgtagtacaaaagcaaccataggaaatgcatgaacaaataagcatggttgtgttctaataaagctttattctaataaagacagagtgcactggatttggcctatgggcctcccatcccacgctccttctaccacattccttctaccacacttccaccccacattccttctaccacaggacctttgaccatgccattgctctgtctagcaatagcacagtcaaaggtcctgtggtagaaggagtgtgacaaagtttaagtactgtgagaagattatggtgtcacggagctcacagagaaaggggaagtgagatgagagagcctggggaaggtcagaaggacaagacctgtatgtgaagtcaggatggggactttgatctttagcttataaacaatcagaagcaaaagaattgttttaacccagggatgagtggtacaacgtgtttagatttgccttgaaaaggtctccctggctcctatgaaaaaatagactacagaatgacacggatggatatgaggattatttaggagttgtggatcttattcaggtaagagatgatgatgacttggacaaggatggaggtagtggatatagaggaaaatagatggattctagatatatcgaagatgtagactcatcaaaacttggtgttgaactcgatgtgggaggtgagagagaggaacgtgtcaagattaatctatgttacatctctcctgaatgtatccttgctattaaggggaattgaagttttatttcattttcagccccatataattaggatatcaactcatatgattggtaaggtgaaaagtaaatcatctgaacagagatgaatcacaggttaatggatcacgacagctcccccaccctcactggacaacattctcttggcagcttctacacacacctctactgggcataccaagtcatataactattatctgtgttccctatttcatgggctttttgagagtagaaatgccatttcttatgctactaatggttattattttggttagtggaatcttgtgctcacttaacatctgtctattctacaggtgagtgtagatttgagatgtgtttgatgtctggtggggtgggcagttctttccacctagttaagagcatctcactaaaagtcaaccggtgctgagtaactaaacatcatggaacccttttcaaaattatgtaggaagcaacccagagaattatggaaatggtgatgcactgagcataggggctttgcccatccttggccctttgctatttccttctactacctcacatgcagcttttcaatctttgtgatagtccgccctatggctcttccattgactttcctagatccactcccaaccattaatacataaaccagacctcaggttcttgccgtaaacttctactttgaatgtagagatcctatcacaatccagctgagtagatattgatggggtcttctaatccatcagctccttcacacattctgagttccatcccaggatccaggtgatttccagaatgctctgcacttggaccacatttacacagccccatttatagcccactgttttgatgttataccctgagctttaactgatggcttttctataggtcctcctatatgtaagtcttggctcaaagttctggttcttccattaacttgctgagtgatcctaggcaatgagtttcacctctgtgggccgcagtttccctattcatggcaaagtctccaatcacattgtatacaaaatgcagtgaacatttatatccccaggccaggctcctctgttgagctccaggccccagagtccactgccaacctggcatctcttccatgactcaataacacctcaaatcgattggcctagatgtaaatgtccccctcttctgcttcaaatctggccccttcctgtgctatctcatttggcatcatcaccacctacctagagtgagtatgagcagaaaggaagagcttcagggctaaggccggggacacttcaatgattagaggttgggagcaagtacagaaccagtaaagaagaatgagaagaaatggctggggaggaaggcaaaacacaaggagagcaaaagtcaagcaaagaaaatgtttccagaaggaggggctgcgtgataggtccatcatgtgaaactaggttcaagccctgggcttggtttctcggtagctatgtgaccttgagcaagttacttaagttctctgagcctcagtttccataacatgcctcatagcattgttgagaatattaaatgaaatgaggcatagaaagtgctttgtccagcaattactcacaaaatgttagctagtagaattattatctatgttttcaactcatcaagtctgtagctttgagcagagggggggaaattggtctctaagctcagtttattctgctacctagcaactatatatttacatcgtcaacatcacttctttatccctgattactttaacaagcactttttaagtgctctgttataattcaagaccacctgtgaggtgtagagaacaattctattttcttctcaagatgtagtggcctaggataaattgtcaaaaagcaacttcagccttgtaactttactgaggtctctttgaaagtgtattgaggaatgcttgggccagctgacaatgacagtgaaggtctgtaactgataaaatgcactctgcttatctacaatagaaagctggatctatacaactcaaagagcatatgaagctgggttccaaaatcacacaaggacagctgacactgggatcactccaattcccaagcaggttacccttcctggaaagtgaatttaaatgggacacaaatgtgaagtcctttccaaggaggctccagctaccattccagcttcgtctctggccatacattcttgacacagagtatcttggacttcaaacccacttctctgagtccaccagacctcacacctcatatttccaagcttttgccccttccacctgggtcaatctgttctcttgcactattttcaaatcaaaatccatctccttacatcgtattttccaaatcacttagccagaattaatcacttgctgggtgtctgatcagtgtttctgggacactatacacaccttttctctatcatttatcacatttattgaaactaatccacttacaactctcctcttagaggacagtaatatcattggaggcagagaccatgtcttatttatctttacaatccctaaaatgcttggcatagagtcggcattcattgaatatttaaaggaacacctcagctactcccataaccaggagatgaaaagtataattcaatttgagaaggttctatttatgcagaaatcagattaggagtctacagaaaatattacatagaagacaaaccattgttgactgtacttcattcctttgaagggtaccgtgggacaaaactagaacggtcgtgtccctaattaaaggccacgggcccaattctagctggttctacttgtgactcattgagtgatcttgggaaaactctctgcaactcaaatgttcatttttaagatgagaagtttggatcaataacatctaaggtaatttttagttttagtttgattatgtataactattatatcttttttgagtctaatattcttctctaaaacttgtcttaatttaactccttagtgtttgtgatggaaaattggtcaactttctcaaggctgcctaaatttccattttgtaactgctaaggaataaacaattccattcaactttgggttgccaggaacttaataagtgtgtcctttaatctgtcagctaagtggatgattgcaaaatattcaataattcctgtaagatattcaataaaactggagggggcaagcttgtaacattcaattcttctcccagattcaatttaatcttggagcaacctgaaaatataattgttcctgcaaacaggatttttgcatctttgagttctttttcacaatgctctgttgagctctcgatttcagtgtgtgactcatcattgcttttccttgtaaatttccactccttccatcctgactcttagattgttcactgttcagacaaaaggagacaaaatcaaagatacggttgagattcccagattcggggaccctcataactattaatgggctttagcacccttcaggtccagtactcctatggcaataacctcttagttcatctacccagggaggtgagctagagccttcctctcccagagaggccataattctactatcatgaaagacagctttgcaaataaagaagaagggcttgagtctgacagtcctgggcattactttgagctagtgattctctgaatcacctggaaggcttgttaaaaactgattgcttggccctaaccctagagttttgggttcagtaggtctgaggtagggcctgagaatttgcttgtaacaagttcccaggagatgctgatgctgctgttctggagatcatgcttcaagaaccactgctttgagcagatgactcagtgtctgtggccttaagtttccttgtctatgaaatgggaataataacatctacagaaggcagcatggaggagtagtcttggactaagggcctcggggtgtcaggctgacctaggtttgagttccagctctgccatttaaagctacaaagccttaggcaaattccttactattttaaagcctgtttcctcacctttaaattatcaggtataatcataacacttacttaattttcccaccataccaatgagataagaatgcttatacaatataaaacactcagcacgtaaatgggcatataattaatgctctgtatataataactaggatcataaatattaacaatgtagtaattcctacatttcaaggccccagactaggaggattaagtgattggctgacacaaccagaaataaaaaaaaaaaaaatagccctgtaggcttggcaagcagggtcaaacctaacaagaaacagaacagacaaaatgtaaaatctttgatttgggccccaaaagtcatcttcatctgggctgactgaggcagccctagctggaagccatgatttctacattaggcagtcacgtgatgaatatttagaggttaattaaaacatgagtgatatattttaaacccaggtttaggatcagagtgagggtgatggtagctctctgaactcccagtgactcagcccaatgtagagggtcatggttgtcttggaaaccacacattccgtgggcatggaccaaatggagacagaagggtcaaaagagattttgagcagactgaaaaacagaaatttattccgaggagggctgatggctgatgcagtgactgtttagcctgagggaaggacctgggcacagaggtagctgcagtcaaatagctggggagggtgtgggtgctgcaggaagagaagcactgattccattaccctgtgtgacaccagagggcagacaaaggccagcacgtggttgctgactaatacatggttgtgtacaaaagcaggaatgaatgaagttacagaggacagattttggcttaattgaagagagaatacattatgagaaaagatggaaccaggtctgggcttggaactagatctgagtgtgaattccagctccatcattcattcattcatatattcaaacaagtactcaatgagtatctgatgggccagagagttgggcaactgtcattatgtactgatcaacaacaatgaggggtgggggatttaggatgcagtgtttaatacagctcttagcttggggtcatcaattatgccatttatgaaatcaagataatgattcctaactggttgcattgttttgaggatcagagacaatatgtgaacagcacctagcaaaatgactgacccagagagagtcccaagcaaatgtagcaatccttgacatcacacaccatcaagtcaagagtttttgccagagaagatcagggtcaggccagttttcccagagacccatttcccagccagctggccattttcctgaaagggttaaggaatctttacaaagagtttaccaccaccccagccagcctctattgttttaaaagccatgatccgtcttccctatttgaattgctttagttatataacatgttcctaaaataatctggctaaaattttgcctggtacttccttctgcctgcctcatctctactgaaccatcccaagggagtaccaagcctgaacattctctgaactgcccacaaagaaacccttttatgaggtctgtgtggtaaagaacaggaagaatatcaggtttcagggtccaccctcctctttggcagaaaatacctcttaaggtgactgtgtgctggctgcctggtatattttggtcatgttgggaggtacaaagtcagggaaagggtcctgtggctcttcgtgtaggcttccattgcacaaagtcctgtaacaaaggttctctttcttgaaccatttgtctccactgccaggctgcaagctctctgttaggcaggggccattctttgctcctctctctctataactacccagggattggtctagctttgggatgcgtaaggatgggactactggtctgcagtcccactttcctaagagggtcctagtaggatgattccggcagaacctgtctgtgcgtacatccacttggcagctgccttcctgaggcaggagtttcagggaatagaggaaccagtaagaagcactgttctcccagccagaaagtctatttcaccttgatttcctgtctctccttcactcgccttcatggtagagagaccgctaaaggtcaaaggaaagacaaagttgcttggttttgaaagtagaatatctgctctggggtccagggcccattatctatttgtcatatgacttcaagaagatcttttaatatctgagagcatcagtttcctcaactgcaaaatgaattcgataataatcatatggactatacagggttactgagagaatgactaagactccatatttgagcatgcttatcatagtacctggcaccttgtgggaatctgctaggctccatgccagtacctggccccaggcctctgttcagaaaacagctgtggcagcagcttctgcccacatggtagaaaagccagctgacctatcagtaaggaagtgaagttctccctttctcccggctgtcagtgaccttcctctgtgagactggtgaatgttgggctaccatccacagtagaggagaaggaacactgatttaggagtcagagagccttatttgcttctaattctatccctactctttcttcattgtgtgactttgggcttatttacttcagttctctgaagctcaattttctcattcacaaaataggaataatatctaatgatagggttccttgggagcttcagagtggaatttatataaagcataagttttagcacatagtaggtgcccaataaaagttatcttcttctttgggcattttctactagaaatcccagagccaaagtggaatttaaaattatcagagcgcatattttagattacattttaatgtaatatagttatatttcaatatatcctggtcctgaccttcacattttcctgatactgattatttttctcactattttttaaattgtaggttcttttattggatatatccccaaattctttgcagaatgagatggatagactctaactgaaatcaggagagatgtattctcattacgactctgcaatatatgtatgatttgggccatgaaagctctctgaacctcagtttcctcatctgtagaatgggaataattaaaaacctactagctaccttattcctacaggaataaggaactattgctgcagtggagcgttttgcagaaagacttcgtaaactatgaaaggcttacaagtagaaccatgtattatttgtgatataatacctcattttattcatctttgaaactacctctctccccagaccgtgccacatggcttacagcacaggggtaggcatgtactgagaaaaagtccattaaatcccagctccaaggtgacacttagcagagagctagatggcccagtgtctgtctgatgacccttagagaaggactgcctttaccttccagacatggaataattcaatagagggaaagcataaaaatcaggacggagttaactcatggtacccagtaggcaagttaatctgtcaaatgccattatgggaagagcagactaccaagtccccatatcacaggaattcaaaaggaatttattttgaagcatttttgtttggactgaaaatgaacaagaagatgacatgtgaacaaaagagataaagaagaagatttaagcaccagaagaaagacccagaaaatgatcccagtgagcaaaagatcgcagagaaaaataacaagtacacagggcagtaagatcaaaatcagattacttaataaaagctagcatttctctaaatggaaaacaatgcacgttgtttgtccttgaaatgtgacacgtactcctttttcaagaataccaaggcactccaaagcaatggcccatatctgacaaagccccatcaccctagagccctggaggtcattgttcctatacaatattagaaggtttgattgaatagatgtcacagaacttagcagtcacttgaaatagaaaaatcaaacaccgcatgttctcactcataggtggaaattgaatagtgagaacacatggacacaggaagggaaacatcacacaccggggcctgttgtggggtgggggatgggggagggatagcatttggagatacacctaatgttaaatgacgagttactgggtgcagcacaccaacatggtacatgtatacatatgtaactaacctgcacgttgtgcacatgtaccctaaaacttaaagcataataaaaaaaagaaaaaagaaaaccccagaaaataaacctatgcagggacaggtagaatttgaattaggctagggcctacctggtcaataatgaaataattgctcaaggcacgttcttctgtaatcttttgcaatgtaacaactattctgtgccctacctctcaatgctgcctcaacatttgtacataatctcagggcctcctaaagacaccgattcagaggccagacagtcacttccctaatgccacaaaaatagattcaattctacatacatcagggtgatttcagaagcaatttctcatctccagtgtaagcattacttacatttttccccctcaaatctcatcccagtggttccacagggcattttaaaggtacctgatgcattctagggcagtcaaaagatcctgagagtgtttttgtagctgtagcctgaggacgtcagatgcatagagagtcctaacgtattcagtgattcagactaatgcagaattttctaataattgagtataataagtcaatcattatttaaatattttagaaagcaatattgttatgatgaatgcatatatacagtcatatatgtatatttgtgtatatatgactgtgtaggtttatacctctctctgtatatttacgtgtctgtgtaaatataaaacacatatgcacacacatacatacacaccttaatcatttgaaaagtttgtccctggcctttaaaacatctaattagatttcactggatatttctcctcttcctttatggcaagttaaactatttcagtcttgggtgttttcatcttaagggtctaagttttggcccatagcgaacagtgacaatgttatcctttgaaacataagaaatcagtattacccaggtttgcatttgagatcagaaagattgagaaccaatatctaaaatttcagggtcacaatgattgtcaagaagttttggccataatcattttgcttttaagagtcctcccagggtacttttacaaatggaaaaaagtgcacaagaggctggactggacagaaaaggatgaattggtattacttgaccagtattttcaatcagatgaacttgcaaatgaacttctctgccccagagccgaaagcaggggatccagtgacaacttagcatagccagagactcagtgagctcctgatgagcctttctctttttttctattattattaattgacactaattatatacatatttatggggtatagtgtgatacatgtatataatgtataataatcagggtaattaatatattaatcacctctaaatttatcattcctttgtgttagaaacattcaaaatccactgctttagctatttgaaaatatacaataaactgttattaattatagtcaccctacagtacaatagaacattagaacttattcctcctagctacctgtaattttgcaacagaggttggtttacagatgcaaaattatagctaggatgttcctttcttttaaggaaaaatcaagcccattttcttgtcaaccctggtctatgtcaacaaccaatttccctgcttctaggaaatgtatgagtctcagtgatttatctggattgaaaatgggaaaaaaaggactggcttcatggttaggcaaaccgcaaatttgctctgatccctaagaaaaacagatgttaaatatttgctcataatcagtatgtgccattagactttgtctttaaaagccattatctaaccttaagaagaactcaaacttaccatcactggtaatgtgcaaagcggtatgatatgtccattaataggatgtaaagggaagtacgtcatatcagctatgtcatatttttgccaaaatgtgtaacctgaatgttatcatgatgaaaaaaattagacaaatctggattgtggaacactctgcaggacgacagccctagactttaaaaaaatgtcaaggctgggtgtggtggctcacgcctgtaatcccagcactttgggaggccgaggcgggcggattacgaggtcaggagatcgagaccatcctggcaaacacggtgaaaccccgtctcgactaaaaatacaaaaaattagccacgcgtggtggtgggcacctgtattcccagctacttgggaggctgaggcaggagaatggggtgaacccaggaggcggagcttgcagtgagcagagatcgcaccactgcactccctcctgggtgatagagtgagactccatcaaaaaaaaaaaaaaaaaaaaaaaaagtcagtatcctgaaagaaaaaataaagttgagagggctgttctagatcaaagaggataaagacagctgaaaaccaaatacaatgtgagcgctctgattggatcctggattaaaataacaaacaaataagcaatagagaacatttggaggacattgaggcaatttgactatgaactggtatattagatcactgaagtaaggttatactttattgtggttatgttgaagaggtatcctagttcttaggaaatacatgctgaattctctggaggtaaagtgtcatgatgtctgcaacttacttctaaatgattcagaaaattttgaaaaaaaaaacatggataaggggagaaagagagagagggtgagtacagccaagtgcaaaagtgcaaatgttgcaaaatggtagcagttggtgaatctaggtaaagggtatatgagtattcattttgctgtcttctcaacatttttgtaggtttaaactaatctctcttcccaaagacagtacatcagtatctaagcatagctattgcctctgtccaagtgctgtattctaaatctgggtgcctatgagaactctctgaatgacttacaaaatccatatccctcagttgggccccacctctcatcccccaggagattttgattcaggagataaggtgtggggtccagatatggatgtgttgaaaacctccccaggtaggttctgtgctacactggagcttaggaatcatgggcctgagttactctcagatctggatccattaaaaacaagctgtgtggctctgagatggctggccaaacacacttagcattgcatagcttacctataaaatgggaacaataatactaaggatcttacaggactatggtgaggatgagagacagtgtctacattatagaaggggataaattttttctttctttctttatcctctcatagatccccatcatcccaaactgatcatctcttgagtgattttttacaaaatggaggttcttccatttgtagcttacatggtatgtggaggacatctgtgttatgcacagattctttgagacttcttgcattacccaatttggggaagaggctgggaaatctagtctgttaactgtctgatagaatggctgtaagaacagaagcaagtctgtccacaaggaagccttagatgttggcagtcttggagttcttcttaggataagggttaaccctgatatcttaaccacccaaatcttgggatcctttattaacactgcacaaggactcaggtgcccttgaccaatgctacttggaacactggctgtggtggaactggcaaatgtttgagggatgaggcttccaatctaaatatgtaactcatcagccattgtattttagataagttgcttctctgagcctcagtttcctaaccactcagagtggagacagtcataatctgtgactcacctaccttatgtggtgtatatgaaacacagatttgaaaatcttaagccactcaattcagtgtggcatatttttctccttaaggacataaccatcctcctcctctttcttttttactgctattatttttaacctgtctctatttatgtccacaagcagttaggatgacttgctcccatttccatctgatttggggaagattttttaaatattccttttcatcttaggatgaactgccccaagtctttgtcagggagaaccttcatcccagtccatatcaggcaagcatccataccctatgcctggcagcacctgatcaatgtgtggggttcacagcagaagtactagggctgagctggaccacggatgtccccttcccctttgttggctctacttactgaatccgttgacgtcctgagaactagaagagaagccttcatcattgcggctggcgctgagcttggtggtgggtttgtcggcagaggccacaggccccatctccctctgggctccactctgggtctccttctgcttcttggccagcttcctttgggacatgtgcaaggggaaaaaaccacagtcagatggtgccagttgcattaaagcattgggtagattgttcttccccaatgctcatcctcaacccccaaatctggttcattctccagaaaaagaatcaaggcagaacaaaccatgaatggtttccatttactcagaaatatgagactcacgctgctgcctcacccccgacaatgcatgtgttctatgtttgagcctaaaatgggaaatcaatgagacttgtacaatgcttcccccactctcctttcagaggaaatcaacaagatttgtattcctttccctaagtctcctttcagagggaggaagtggctagactggcctttctgtttctgtggctctgaatgagattaaaaatggaggcttgtctttctcaggaactgagctcatcaaaaacctaccaaataatagtagagtgaagcaggggctggtggttggaaatggatgagtgtgcgggttagtttcacagctcaaaagaaggaaatttagagctgaattgatgcaaccttattcccatgggaataaaagaccctcagaaccagacggatattatcataatataactattatgataataatagtgtagagcagtgcttctcaaactttggtgtaaatttgaatcacctgaagagtcacaaaaaaatacacacacacacacacacacagaggctcaggatcattgaagtaggacaggacctagaattctacatggccatcaagttccccaagttattctgacaccagccactggaggttaaaaatatcagctttggtgtcagacagactcaggttcatagcttacctctgctgcctgccaactagctgcaagacccagggcaaatttcttactctaaatcctgaactattcttctgtatactgtggcagatgacaggaccaaccttatagggttgtgaggattaaatgagacaatgcataaaatacacagagcacagtgcctcgcacatagtggacactagacacctagcagttgctattcttgttttttctactattgccagtggatccaactatattctaatgttggaattccctccccaacagccccactgtgggatcccatctctccctgaattctttcaaatgatgtggactttgacctcactgaggaactaaaaagttaaaaagttcttttctatggatttaaaatctatgtcctttaaattttaactggataggtctcagatatatcattagagatacaaaaatatgactaactcctcttgcatataagagttattcaaatatttcgaaaaagcgaacatggtccctctttttccaacatatatgcatcgaaatatagctgttatagtcttatcacatgaaaggctataggttaaacatcagatatcttgagagtaaatttctccaagtctcttactccatccttcacaacagtaggcttcaaattcaattttggtcattcctgtcctgtctcaacacacaaaaagggctgtcccagagaggtcaaatccagtgcaatacagggaataattttccaaggttgagccccactgatcatgaaacagatagtttcaagaggtaacaatctccctgccagaggaagtataaaaggaaaggataaacctcaacttaggctgggaacagtggctcatgcctgtaatcccagcacgctgggaggctgagctgggcagatcacttgagcccaggaattgagaccagcttgggcaacatggtgaaaccccatctctacaaaaattagccaggtgtggtggtgcacacctgtgctactcagcaggctgaggtgggaagatcacttgagagcccaagaggtggaggctgcagtgagccgagatcacgcctctgcactccagtctgggtgacagagtgagaccccatcaaacaaacaaacaaacaaaaaacagaaaagaaaagaaagacccaaacctcagcttagaagtgttttagaggagttcacataggacaaattccagtttgatagcatcctccttgaaacatgaatctcatgctctaggtgtagacttcacagaagaatgacagagggcatactcaaatgaggacaatttgaggaaggtttatttataaaaggtctgctgataaaggtgacaaatgtatagagacccataatatactagtgcctcagtaggagagctgtttattacctatgggaccagaggaacaaatagaggaagcagtaaccagagccccaaagaagagagctgtgaaaaggaggtaccctgaacagaagcagcggctttctcttgaaaggcccagccagtcatagacaacctgacagggagagaaccagaggcaaaaaaaaaaaaaaaaaaaaaaaatgccctgactacaccttatgcccttcctctggtcgcctgtggcagttctcactagctgaacccaacaagtcagaagtggcaagtgatctttttgacagacttcatacagaatgcactctggaagcagagagcacagtagagaaaggtggaaaggggaactggatccaggaatcccaaccaagaagagaaaagttgcgtgtgtgtgtgtgtgtgtgtgtgtgtgtatgtatgtgtggacagtgtcttattctgttgcctacactggagtgcagtggtgcgatttcagctcactgcagcctctgcctcccaggctcaagtaattctcatgcctcagcctccagagtagctgggactacaggtgtctgccaccgcatccagctaagtttttgtaatttagtagagacagcgttttaccatattgcccagggtggtcttgaactcctgagctcaggcaatccgcctgcattggcctcccaaagtgctaggattacaggtgggagccaccgtgcccagccgagaaagtttctttatacgtctcgttttggccataatttggagaaacatgtagcctaaaatggaattctttattcactaatttttttaagttggctcggggaaagaaaggcactcaggaagaggaatgcatcttttcattataatgctttggccacaggcacactgttctaccagtaaaatgattccaggcagatatacaacaagaaatgaagcattggattggtcagacaattagacaggggcgggggaatgccaacgaaagaaaaatgagcaattctgcttctgatgacattttgaaattttattcttcatttattatcaaaaaggagtgtgtttaaaaatgtatatgtgaccttcttaatcataaatttgaaaagaaatatagcagattctttgcttctatctgagctctgctcacattgccccagcaggaaataaaaggaaatctgataagagagttaacttaaaactataaatgagtatgtttcggaggctttgatatttccttaggggcagaactctcaaccaatctcattccattcagggtaaagtaatatggaaagggttgtcttaggcacagatcattggttttcaaaggaatcataataataatgaaagccttgctgcttttatgaaaaatggtactttatagaaatgtttgggtagctctgaacacctgtattaaaaaaagaaaaactaagcatccccaaaacacatatttaaaaattggaaagctaactgaattgtaaaaatatcagatatattacatccttagtatttaaagctgatggctgactctgtattttcatggtgataataatgttatataatcattttaatgtatggatagatgttatggcaattggcaaagacagctacaaggtggaaatggagggggtatttgtggaaggaaataaaacacaaaaccacagtttggggatctatatctattctttcagaattctgaatttaagtgttaaaaagacctctcagtaacacagaaaaattgacattcatctccatagccaaataatttaatttactacctcattatttttctctctcaacgaaagagaaacccaaatctgtgaatagggcaaacaagacccttaaactaaggactgggcttcaactcagtcttattctctgcacataaccttatcctcccctttcagaaaacatcaactacctcctcccaccacactatttctcaatactccatattccttgatgtgtccctcttcttctccactggtcacctcctctttgtcctccaaggctcaatgtaagtgtcacatctcctctgaggcttctccctgctcttctacatagaattataattttctcctcttgcttgactcatccattgaacatgtacatgtataagtctctgctaaatactagaagatcatgtcttcttgaccttaatccacatggaacatgaagactaatggcaaagacgggcattaaacagataaatacagagacaaaaatcacaaagacgatgaacaccaagaagaaatacctgttgctatgtaagagctagaacctggtttgaaccctggcagcagatcagggagggttttggtgccatgttagctacgtacttgttgagtcaaattgcagtgattcaactctttcacctactacgacaagaacttcttgggaaagggcttttgactctttgcacctactccaatttcttgctgagtgtctggcacatggctcaataaacttgttgcacgaatttatacttaaaagtctgcaatttggagtctagaaaagatagtcctcttactctgaacacaaattacaaccactttaaaagtagatacgtgcaaagaaagagaaggaaacgcctgcataaaattagctggtgacctggaatattcgtaactagaaatattttgggcggtaacttagcatttccttcttggaatgtttgcagaattaacaaaatattcatgggagtcagagatttcccccgcagagcccacaaaatagctgcagctatagcatgttgaagaagaaaaaaaaaatctcatgcaatagtcatatgactcatgggatgatcatataattcatggaattctcagagccttcaaaactcaagtacttatgactttctgaactgaggatttttttctgtagttgctttgagatttttgccaactgggtcacacaatttcgccagcagggggtaccaaaagctgataaaaagagagtatgcataagtctgtttattcctttgcaggaacatttccaaagctgaagactgttttaagacacagcaatccaaagtttactgcttctgacaggtgaggacgaggtgacgcggccatagctcttggcattttccttctaacggatcactttgagctctctctgaccttcgcttgttagctgagggaggggtaggtggcaggggatgggcccaggatggaccatgagtcctgtgatttgttctgagtgccactctttacaagggatactggcaggtagaatggctcacgggagaggaatgaagggctgttaaaagtgtggaaatcatgctacgagaggaggagtgcgtgaaacatccagggacatttctcacggagagggaatacaaagtaacgttctcttcatgcatctgatggttgggtctctatggtcccaggggcagaatgaggaccaggttggcttgatacaacgaaggaatttctttttttttttttattatacttttagttttagggtacatgtgcacaacgtgcaggtttgttacatatgtatacatgtgccatgttggtctgtggtggggtggggggaggggggagggatagcattaggagatatacctaatgttaaatgacgagttaatgggtgcagcacaccaacatggcacaacgaaggaatttctagcaaagtagaactgcttaggtctcttttggaagcacctaacgcctgaattcccctccccaatttttctggtttagcaaccttctcttcaccttttaaggcccaactcaaatgtcccctactcttagaagtctttgcctccttcccaaagttagaagttccctcctctttgctcattaatttgttggacaaatagttaatgagcaagtacgttgaatctgtggctgttagaaggaaggagatgatgatatgaaaaacaagacaggaatcctgccctgtttggcttttgcaagtactcagctccctgctattggagaagttcaagtagagactgggaaaccacttagaaaagaggtggtggaggatcccaggatttggactctgcaaaacccttgactctcttctgggctaggaacaggaccatccagccaactggtgggggcaggagtctacagggttccacctagagtttttccctgaatgtgggagccatgcccactctcctggggagacactgatcaggcactcttcctcttccccatagggctcctcctctgggccatcctccattgcaatctccagataaactttcctggaaaccatgaagattgaaatcctggagtcagagatctcagccataggaagtggaccaaaaaaaaaattcacaagtgaggccctgcttctactaaaagctggcactgtcctctttgaatccaggatgctctgctggcatgactagatctcagcttaaagttacacatcgcaactgtaagggaactatagcatcttctcatttcatagacaagacactgaggcctggacagagtagtcccttagctaagatgcacagcatgtaggatgcaagccctgctttctgcctgccagttcaggaatgtggacacctgctccacattcctccatgcttcttctagggatttgcccttccagattagaagggcaaattcagtctgtggtacacatgattccagtgtcttacaaatgcagcaaaactttattcatctatgcccccactgactcagaattactgtaattgaggcaaaggctgagctacatcacataagaatcaatagtgtagcagggggaggagccaagatggccgaataggaacagctctggtctacagctcccagcgtgagcgacgcagaagacggtgatttctgcatttccatctgaggtaccgggttcatctcactagggagtgccagacagtgggcgcaggtcagtgggtgcgcgcaccatgcgcgagccgaagcagggcgaggcattgcctcacttgggaagcgcaaggggtcagggagttccctttccgagtcaaagaaaggggtgacggacggcacctggaaaatcgggtcactcccacccgaatactgcgcatttccgacgggcttaaaaaacggcgaaccacgagattatatcccacacctggcttggagggtcctacgcccacggagtctcgctgattgctagcacagcagtctgagatcaaactgcaaggtggcagcgaggctgggggaggggcacccgccattgcccaggcttgcttagataaacaaagcagcccggaagctcgaactgggtgaactgggcggagcccaccacagcacaaggaggcctgcctgcctctgtaggctccacctctgggggcagggcacagacaaacaaaaagacagcagtaacctctgcagacttaaatgtccctgtctgacagctttgaagagagcagtggttctgccagcacgcagctggagatctgagaacctgcagactgcctcctcaagtgggtccctgacccctgacccccgagcagcctaactgggaggcaccccccagcaggggcacactgacacctcacaaggcagggtattccaacagacctgcagctgagggtcctatctgttagaaggaaaactaacaaacagaaaggacatccacaccgaaaacccatctgtacatcaccatcatcaaagaccaaaagtagataaaaccacaaagatggggaaaaaacagaacagaaaaactggaaattctaaaacgcagagcgcctctcctcctccaaaggaacacagttcgtcaccagcaacggaacaaagctggatggagaatgactttgacgagctgagagaagaaggcttcagacgatcaaattactctgagctacaggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatggggagaatggaaccaagttggaaaacactctgcagggtattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactcagcttcataagtgaaggagaaataaaatactttacagacaagcaaatgctgagagattttgtcaccaccaggcctgccctaaaagagctcctgaaggaagcgctaaacatggaaaggagcaaccggtaccagctgctgcaaaatcatgccaaaatgtaaagaccatcgagactaggaagaaactgcatcaactaacgagcaaaatcaccagctaacgtcataatgacagaatcaaattcacacataacaatattaactttaaatgtaaatggactaaatgctccaattaaaagacacagactggcaagttggataaagagtcaagactcatcagtgtgctgtattcaggaaacccatctcacgtgcagagacacacataggctcaaaataaaaggatggaggaagatctaccaagcaaatggaaaacaaaaaaaaggcaggggttgcaatcctagtctctgataaaaccgactttaaaccaacaaagatcaaaagagacaaagaaggccattacataatggtaaagggatcaattcaacaagaagagctaactatcctaaatatatatgcacccaatacaggagcaccaagattcataaagcaagtcctgagtgacctacaaagagacttagactcccacacattaataatgggagactttaacaccccactgtcaacattagacagatcaatgagacagaaattcaacaaggatacccaggaattgaactcagctctgcaccgagtggacctaatagacatctacagaactctccaccccaaatcaacagaatatacatttttttcagcaccacaccacacctattccaaaattgaccacatacttggaagtaaaggtctccttagcaaatgtaaaagaacacagaaattataacaaactatctctcagaccacagtgcaatcaaactagaactcaggattaagaatctcactcaaaaccgctcaacgacatggaaactgaacaacctgctcctgaatgactactgggtacataacgaaatgaaggcacaaagaaagatgttctttgaaaccaatgagaacaaagacacaacataccagaatctctgggacacatttaaagcagtgtgtagaagtaaatttatagcacttaatgcccacaagagaaagcaggaaagatccaaaattaataccctaacatcacaattaaaagaactagaaaagcaagagcaaacacattcaaaagctagcagaaggcaagaaataactaagatcagagcagaactgaaggaaatagagacacaaaaaacccttcaaaaaattaatgaatccaggagctggttttttgaaaggatctacaaaattgatagactgctagcaagactaataaagaaaaaaagagagaagaatctaatagacacaataaaaaatgataaaggggatatcaccaccaatcccacagaaatgcaaactaccatcagagaatactacaaacacctctacgcaaatgaactagaaaatctagaagaaatggataaattccttgacacatacactctcccaagactaaaccaggaagaagttgaatctctgaatagaccaataacaggatctgaaattgtggcaataatcaatagcttaccaaccaaaaagagtccaggaccagatagattcacagctgaattctaccagaggtacaaggaggaactggtaccattccttctgaaactattccaatcaatagaaaaagagggaatcctccataactcattttatgaggccagcatcattctgataccaaagcctggcagagacacaacaaaaaaagagaattttagaccaatatccttgatgaacattgatgcaaaaatcctcaataaaatactggcaaaacgaatccagcagcacatcaaaaagcttatccaccatgatcaagtgggcttcctccctgggatgcaaggctggttcaatatacgcaaatcaataaatgtaatccagcatataaacagagccaaagacaaaaaccacatgattatttcaatagatgcagaaaaagcctttgacaaaattcaacaacccttcatgctaaaaactctcaataaattgggtattaatgggacgtatttcaaaataataagagctatctatgacaaacccacagccaatatcatactgaatgggcaaaaactggaagcattctctttgaaaactggcacaagacagggatgccctctctcaccactcctattcaacacagtgttggaagttctggccagggcaatgaggcaggagaaggaaataaagggtattcaattaggaaaagaggaagtcaaattgtccctgtttgcagatgacatgattgtatatctagaaaaccccatcgtctcagcccaaaatctccttaagctgataagcaacttcagcaaagtctcaggatacaaaatcaatgtacaaaaatcataagcattcttatacaccaacagacaaacagagagccaaatcatgagtgaactcccattcacaattgcctcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagttaccaatgactttcttcatagaattggaaaaaactactttaaaattcatatggaaccaaagaagagcccacatcgccaagtcaatcctaacccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactgtctgatctttgacaaacctgagaaaaacaagcaatggggaaaggattccctctctaataaatggtgctgggtaaactggctagccatatgtagaaagctgaaactggatcccttccttacaccttatacaaaaatcagttcaagatggattaaagacttaaacgttagacctaaaaccataaaaaccctagaaggaaacctaggcattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacgggcaacctacaaaatgggagaaaattttcgcaacctactcatctgacaaagggctaatatccagaatctacaatgaactcaaacaaatttacaagaaaaaaacaaacaaccccgtcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggccatcattaaaaagtcaggaaacaacaggtgctggagaggatgtggagaaataggaacacttttacactgttggtgggactgtaaactagttcaaccattgtggaagtcagtgtggcgattcctcagggatctagaactggaaataccatttgacccagccatcccattactgggtatatacccaaaggactataaatcatgctgctataaagacacatgcacacatatgtttattgcggcgttattcacaatagcaaagacttggaaccaacccaaatgtccaacaatgatagactggattaagaaaatgtggcccatatacaccatggaatactatgcagccataaaaaatgatgagttcatgtcctttgtagggacatggatgaaactggaaaacatcattctcagtaaactatcacaagaaaaaaaaaccaaacaccgcatattctcactcatagatgggaattgaacaatgagatcacatggacacaggaaggggaatatcacactctgggaactgttgtggggtggggggaggggggagggatagcattgggagatatacctaatgctagatgacgagttagtgggtgcagtgcaccagcatggcacatgtatacatatgtaacatgtaactaacctgcacaatgtgcacatgtaccctaaaacttaaagtataaaaaaaaaaaaaagacaaaaaaaaaaaaagagttcaatgtgttgggaagtcacaaagtataagtaccatgctagtgctaggaaaataaagatgacccaattagtcttttttctcaaaaaaaaaaaaaaaaaaaaagaatcaatagtgtaaatagggatatggatgtgtgcagcatttaaaggagaatgcactgttttccctcgtatcaggaggcaggactgcatagcagttaatatactggctttggtgccagacagcctggcatcaaaatctggctccatgtcagactagctgtgcaagctcttgcaagttactgagccctctgcatgccagtttcctcctgcctgtaaaacacggattagagtagtacttcccccgtcagactgttgggaggattgaatggtatgttgctggtaaaccactttgcccagggtatgcacacagtaagcactcaataaatgctctctggtatgatcatattttaaatacaaaaaaatccatgttagtttaaataacctcattatttattaaatatgaatactttgaagtggatgccctggataatgacttttctttaaaaacctccattgatgcagtctagagccatgcttttcagctttggctgagcacatcatttggggagctttaaaaattaccagtgagattctaatttaattggtctggggtgcagcctgggcatctgggcattcagaagctttccaggtgattatagtgtgccactaagcttgagcaccaccgatgcggaacagctgttctccaagtgtggtttccctggaccagcagcatccgcttcacctggggatgtattagcaacgcaagttcaccggccctgccctgacctactgaatcagaaactctaggtgatcaataagccctccaagcaattctactgcatgccaaagtttgagaaccaccgaagtaggtgggcccactcttcagcaggtctgaattagtaaagtttcattcttgaaaatggaacactagaaggtaagagacccgggtgccgggtccagatctccagatatctcattgagttgccgtgaacactccctttcccctctctgtgtattgatttcactatagtgggggagttggcatctaagaatcatggcaacaactgatgcttttaaaatgattgttatggattgaactgtgttccactcacccactctctggccgcaaaagatatgttgaagtcctaatccatagtacctgtcaatgttaccttatttggaaatagggtctttgcagacgtaacgaagttaaaatgaggtcactagggtggctctgattcccagatgactgatgtccttacaaggagagggaaatttggacagaagtgcactggaagaatgccacatgacaacaaaggtggcgatgggagtgatgagccataagccaaggagcacggaggactggtgggcaccaccagctgccaggaagaggcatggcaccattctatttagagtctcagagggagcctgacccctccaacaccttgattttggatttatagcttctaaaattatgagaggacaaattttggttaagtcatctagtttgtgagacattggtacagtagcctgaggaaactaataaaatgaccataattcctaaattgatgttatttgtttaataaacattatagagtacttattgaataccagccactattcaaggcctttataaacagggtattaagttccttaattctgctacaacaccgtgaggccaggagtattattagttccattttacagataaaagaattgaggcagagagagttgaagtaacccatggaaagccacccaggctttcagaggcagagctaggattcaaaccctccagtcaggcttctaaatgttctctaagattccctgttatgtcacgcttaggcaaaaagccatcacatatctccccttgtcctaaagctttctcagctgtctccctttctccccaggcaaacacacactcacacatatgcacatacatgcatagacagctgcggccagaaaactcactcacaaccactcatgtcctgcaggcaatgagcatcctgtctgctcactgcctctgttgggtaccaattctggggcatagctggtgggtcctttccctcctgccccatcaccctcatctagggcttgtgaatcccccagcatggcaaagttacagaagcaacagcagcagcaacagcagcagcaacagacgtcatgacaatttgaaaggccaaaggacttggtcttctacttccattgctttgctatcttgctgtccatatctgtgcctctatctgtctatctctgcttctttattctgcctgtgactacctctctggcctggatgggctctcctaccaatcacactctttccacttaggcaatagtcagaccctgttggaccattctctgcacccagcagtgaaatcagagcagcagaaagcccgaaacacaggtgaggccctcctccctctgggtacatggccatactggcccctgggccctaaagcagagcctaggaatagcactgactttggagccacactgcctagactgaaatcctggctccatgatttattagatgtatagtcttgggcaattgctaaacctccctataactcagttttctcttctgtcaaatagggataattataatgaattctcttagcaatgctttgaggtagatactaacttataattatgaaagtacttaactgggatctgtcacctaccaaataagctctacataagcatttgttacataataggtgataagaaagaaaaaagtgcttcaaagcagagtgtgaccagaattcatggttcagacaatgggagcttccctgaatgaatgctgtctgagctctgaacccctgggttggggagatggcccctctgttcttggtgttgcagaaataccatgggctctggccctggactgacttggctcctaacagtggtgtaatcatgatcaggtctccatttctgtgactctgtgagactcaatttcctcgtctatagaatagaatttaatataccctaatttgcagagttactgtgatgatgagaaatgataaatgatgacagttccctagcatggtctttggcatataaagatatgcaacaaatgctagttcttttttatcctccttccttgccccagcaatccgcatgactttttccttgctttcatttttaattttatgtttgatctgcttcccaagatgagcactctagggaaccaaggtgactaatctttcctccctgtagtttcatcttgctctatccatatcctgctcatacgacccgaaaccaaaccagccagtggggcagatgctcttcccctattcatgcgttgaccttcagtttcacatcattaaaagttgtagaatcttggattctctggctggaaaggccctcccagtcattttcccaccctagctaggagactccttgcagcatccccagccagtgggtatccagcccccgactgctgaattccagcaacccaaactcatcacctctgtgggcagctctttaacagactgcagctccctatatagggccattccttgctgagctgaggctgagctgaactctgtctcctgaaggcctcaccctttagatgctcctcctcggtctgtctgctatatcccaacaaagcctgtatgtggatagatgatgaccatgaattcttcaagctttatcccaagcaaccgcttccaagcagcgtctcctggttgctgaggctttatggctatttccctacagctgagtgaacctccttctccgttccacactcacatgcccacatctcttctcagatctcaaaccaggactccagggtgatctccctctcaccagctcacaactgcctcctctcaccctgaccccatcttagaccttcagttgccaactagaaacatcatctccttcttgctgaatggctaacttacagggctattgccctgctagactataaccacaaggacaacaacctttttggccttgttcactaccaattccccagggccttacatagattttggaacaagcgggtatcctgtaaagacctgttgaattaacatattaagagatgatcacaagtccttcaaatcccattcaaatcatcacttctttcaggaagccttttctgatctcttcgtgatagggtaggccttgcttctgttttgtatcccagtcatttgcctatcttctctcatcacttttcattataatcaaggtacaaaatatacatatttgcgtattgtatttgtatttcctttagcacatagtttagcacttcccacaatgttgtaaaagctttaaacatgtttatggaatgaatgaataaattgagtgacactttccattcctttattgttgcatcgtcccatatttgagcttccccgtgtctacgacttgacccttttcatcaatttctgcaccaaatttctgtatttaagcagggtcctacttactattctacaagttggctttcttctgcaggtagtgcatggcaatgattctcagacttgagtgtgcatcagaatcaccttgttaagcaggcattgttggtctccatcaccagtttctgatttggtaaatcaggggtgagtgcaaaaacttttcatttccgagttcctaggagacgctaggttctatattttgagaactactggtctatggaatgccatcttctgccccagaggggatcacataccatttatcttccaacttttcttcatcagtcacctcaaacattacatccaggccaggcgcagtggctcatgcctgtaatcccagcattttaggaggctgaggcaggtggatcacctgaggacaggagttcgagaccagcctggccaacatggcgaaatcccgtctctactaaaatacaaaaattagcccggtgtggtgacacacgcctgaagtcccagctactggggaggctgaggcaggagaatcacttgaacctgagaggcggggaggttggagtgagccgagatcacaccaatgcactccagcctgggggatagagtgagactctcaaacatacacacacacacacacacacacacacacacacacacacacacacacacagaacattacgtccatcccccactccaccccaaaactgtagatgggcataagaccatctatcctttaatccacaattcccatttttctagaattttatcctaaggaaataataagaaggaaaatatacatgtatcatgtaggtaccactggaaacacagcttcctctatgccaggatttctcaacctcagcactgttggtattttgggccagataattatttgctacgtatgtgttggggagttacctagtgcactgcgggatgcttagtagcatcctccttggtttccaccctctagatgccagtagttccccctactcccaggcatgtcaataaaaatgtctctagacattgcaaaatggttttctttttgggtaggcagaattgcccctactactggcatagttaggtaaatgtaacagtttaacatttagcagatactaccatgtgcttagtattttaaacatagctccgattttcacaacactaacaaggtagtgattatttcttttgttttataggtgaggaattcagggcccagaaaggttaatcctaaactcgtaaaacaggtaaagggaacaggtgggatttgagcctagctcttcagcctgctgagagcatgctctcctcctcacccaacttggctgcctttctttaatagcaaatgatcggttaaagcctcgtaaatgtctaacaatagggaactggttcagtaaattatagtgcatcccctggatggaatattatgcagccattaaaatgatggagggccattaaaaatgaaaaccatgtaacgacatggaaaaatgctaactggattacattaagttaaaaaaactagaaaataaaaatgtgtctacattgtgattacaacgatgaagaagtatatctatgtgcggatggctcatgtgttggattgaggatattaaggataattttcctttcttctttgatatccattattgttatcagagtgtcttcatgatcctaatttctaagtagtagcagagtaatgataagattcaagatgttaggtttgccctaggcccttcttccacctgaattagaatgaagacttctctaaactctgactatagcaaggggttgatttacccttactttccctcctattagcactgttgcatgtatgtttgtgaccccaggcccctctccttgcactgaccagcttctcccaagcacagaaagctggaagcatagaagaaaacaactctgaaggcattggtgtgaatcactctgggagccagggctattaggaacatacagtcttagagtagcagatggcatctgtctgtcacagggtactgagcggtgcactgtctcatgcattatgcatcaagagtggcctagcaccctggcccggctgtgtgggacaagtcttgcaaaagaaacatctgatgaactgatcgggatgtcaaaatgtcattaaggataaattaatggatgtgttactttggctgtaagaggcagtgccagcaagacaacagacagccggtgggctgttctccagcccaagacagacggcgtttgcaatggagattcatggtctttatgcaacgtgaggtgctttgcagggagaagaataaacagaaatgctccagcacttaagcgccataaaatcacaagcatgagattaattaattagtgtacactaggaaggcggctggtctgtctgcgctcctggggaaagctagaatggatggcactgggttagagatgacgggtccctgcaccagcctcctaaagaaaagcaattgaatttaatgtgcaatcataaactgccgctgatggaaagataagtctggtcggtgtttgttttttcagggatactatttctgcctactgcttcaaacactttgtgtctgtgggtcaagtatctgagaggactggggagacctggaaactagttctgcttataacgccatgtgggctatgaagggtgttataatctcaacacatagagcaactctcagggaagcctgactccccctgcgcctttctagatagggggttgtccattcttctgtgataggaggctcaccacttccctttcaacctgacccagtgttagataagcattgttagagagttcttccttagacttccctagcctcttcctccttataacttaacaacaacaaagacaagaaggagaatagctaatgcttactgagtgcttgctgggtgccaggcactgggctctggtcaagttacaatgttatcatgtattatctccattttgcagtgtaggaaaaagaagaccagagggtgtgaaagacatgctgaagatcgcacagctagtatatggtagggccaagatccaaacccggggctgcctgaggccagggcttgacagcttaactatcacatggttctaagtcctgtaactaccattaattggatggagcctggcttttagagcaatacagaatatgacaaggcaagacagatgagaactcacatgtagcacatattgggcactgctaagcacctggcctgggtcagcctaacacatcgttcatgcagtagccttttttgagtaacgaaattatttccccatctgagatatctattttcttatctttttaaaaaagttatatatatatatatttttcaacatataaaaatcggtttcacttctgtgtatttataatgaacaattagaatctgaattttcataaatagtacaatttacagtagcacccaaaaaagaaacattcagatataaatccaccaaaatacacatgggacctacatgacaaaaactataaaatggtgatgaaagaaatcaaagaagatcgaatcaaacaaagagacatacatgttcctaagctggaagactcagtattgttaagaggtcatttctcaccaaattgatctacagattcaatgcaaacccagtcgaaactcagcaggatattaacaagcttgcggatatcaacaagctaaaatgccattgtacatttatttccaaaaaagaacagggaggcaggtcgtgatgggtcatgcctgtaatcccagcactttgggaagctgaggcaggactgtttgaagccaggagttcaagaccagcctgggcaacatagtgacaccctctctacaaaaaaataaaataataaaaataaaacacattaataaaaagaatggggaaaaagcctctaaaccgcacatgtccagaaaatataacatgaaacattgttatgtataaatatcataatcacttaggtacattgtttaaataaagttttttatgtatgtctgctataactaaattggaataaaattctctccaaggtacaaccctttttataggatactataaacaaaaacgttaagagacaaaaatttactcaatgaagtttaagcaggactcaagaggccaatttaaaaaacaatgaacgtgaccccaaccgtatcctctctttaatcttggtcctatttctccaatgtagatgataaatttcataccaattgtgaaacaacgaatgatcttgctcctgttttagggacagtgagtatatttaaagaaatgatacagttggtagagtttttttgttttctgttttttgatttttgagatggagtctcactctgtctcccaggctatgagtacagtggtgcgatcttggctcactgcaacctccgcttcccgggttcaagaagcaattctcctacctcagcctcccgagtagctgaaattacaggcatgcaccatcacacccagctcatttttgtatttttagtagagatggggtttcgccatgttggccagggtggtcttgaactcctgacttcaggtgatccatccgccttggcctcccaaagtgctgggattacaggcatgagctactgcatctggctagttggtagaattttttatttggttggtatattagtccattctcatactgctataagtatactacctgagactgggtaatttataaacaaaagaggtttaattgactcacagttctgcatggctggagaggcttcaggaaacttacaatcatgacagaaagcaaaggggaagcaaggcatatcttacatggtggcaggagagagacagcatgcaagggaaactgccactttttttttttttgagacagagtcttgctctgttacccaagctgtagtgcagcggcatgatctccactcactgcaactcccaggttcaagcgattttcatgcctcagcctcccaagtagctggaaccacaggtgcatgccaccatgcctgactaatttttgtatttttagtagtgatggggtttcatcatgttggtcaggctttctcaaattcctgacctcaagtgatccacccaccctggcctcccaaagtgctgggattacagatgtgagccaccacacctggccaaaactgcgacttttagaaccaccagatctcacaataactccctcactatcatgagaatagcatggagggaaaccacccccaagatccagtcagctcccacccattccctccctcgacacatggggattacaatttgagatgagatttgggtggggacacagagccaaaccacatcagttggttttcatcttttctattgtaatttagagcaaagggtaagggctagctttggaccctttcattgcatctttcccctgcactcagacctgtaaagtgcttctctctggggcaggggctgtaatacttaccagcctctttcagaatccctgccacagccaccctcaattcatgatgagaacacagcactagtaattagcacatctttgttccacgggtttcttccttcatatgacctgtgcccctgctcagtgtggtgagacttcatttccttacatttaaaatatttcctcattggagtgactcaaagatttcatgagatacctgtggtgtcatgcaatatatagattggatttgtccactctgcctggtttataactcccatattccttgttacagtcttttgctataatgttgggtgtgttagggcccaggggaaggcctcaggtgatacaccctctctccttccttcctttcacttgccccaaggcaggactctcatcttcccctgtctttctgattgtgggtcttaagaccttcctctgagagggtcccacctcatacccagggggaggaatgctgattttatgaagctcccctaagaacctatgagggctgcgtttggagagagagcttccagatagctgaacgcgtggaggttcctggatggtggtgccccggggaggttatggaagctccatacctcttcccccaaaccccaccctatgtgtctcttcatcagtattatttgtaatatgctttataatagaccattaaacatgtttccccgagttctgtgagctgctctagcagctctagcaaattagttgaacccaaagaaggggttgtgggaaccccaacttgaagcctgttggacagaaatttcagaggcccaggcttgtgactggtgtcttggggaatggggaacagtcatggggactgagcccctaacctgtgggatctgacactatctccaggtaggaactgaattgtaggacacccagctggtgtccgctgcttgatgtgtggggaaaacatcccatacatttggtcacagaaattctcttccatgttgatgactgtggtagtgtgagagtagagaaaaaatgcagtgtgagagagtttttcttgacacaacacttacgtgaaagtacttggtaaactgcaaaacagcagtagacagagtaatataaaacataaaatatactaataataactacaaggtactgagcacctactacgcgccagatataaaaaccagatgtcgtatatgcattcaattatcttatgctgtcctggtaaatccccacagcaacagcccacatttggtgttattgtccccaatttacagatgagagaacagaggctcagagaatttaagttagtaagcggcaaagtccaggattcaaaccccaacccagtccatgctcttttcgctacaatgctgcttccaggtgttgcttattgttttcctcaccattcagagctaaggcaaaagcactgtttaacgcccttaaggaatgaaagatgagattacagaagtacaatttttgagcaaattgccccttgcctacatggctggaaaacacatcacagtaaaacagtcaatgtgtatacttcaaatcagccacagatctggaaaaaccttagatcccacaatttcatggtagctctgctatataaagcaaagataagaaaaaataataatatgaaatcccgtaccaaccagatatgagcttagatttttcaccaaaaattctcatctggtagattcccaaatcaaaattggtatggggaaggaagaatgaaatgaagtatgaagacttagcttttctccacttctgaaaaagtccattgttgctaagctgttttcccaaacagaataagccttctttagtctcgaggctcaatttggtctacaacattaataaaacgatatttacaatctttacaaaaatcaagtctttcattaaaaacagggttttgaccacactaatctttccattcttccacttaaaaaacatgggtggttgtaatatacccaccaattcccaccctcttagaatgttctgcactgtggttcaaagcccttagaataaaaaactgctccagaaagcaactcagccaatgttcttttattctgttaagaaagagatttcatcagcagaagcattgagtcccttgaggcttcagggatagaggcttctgaacacacatttctgaggagataatcatggtggaggtgactttactcctcataatgcctccaaaaccatcatgagtagtgattgttgcaagaaactaaatactatttcaaacgtatgtgctcagggcatttttgccctttattaaatgacctctgtacatttatgaacagtctaaggattgtctacctcaatacctaaaaaaggaaatgatgccaccaaatagcatcttgacttctacagattttactttccaaactcaagttccatcatcatactcaaactcatgtttatctgatgattgtatgggaccaaattctcaactaaggttctgggccaaatggccaggctaatgcttcacgatgctctttcaaatgcctttatttgatagccctggattctcaagcccttccagatgggtggttctcaactacggtttcagattagaataacctggggaactttaaaatgtctaggcactacccctgaccagttaagtcagttctccaacctctctttatagactgtggcttggggtcttctccctagctgagtgccctcccgcaaatacaccaactcctctaagctctgttcccagaaaggcaacatttctaatggcattgttcagaatatggtggcctctctcgaattctgacaaccttgcctttttaaaggaaggtgttgccagccacatctcaataaacaagcctgtcccccagcccttatatttggaaatggccatggtagtgcactctcccgaccccattcaaccccagctctttctctgcccaccggtctacagagtcttcttgtataaaaatgacattgtcttcctttgtagttctagccaaaatcattagttatctcttttctttcttgttgatatcaccacgggtggatgccaggaggagggttgtcttacccaattgcttggaggggaaaaatctgtgaagtttaaggaacaccatctaaaatcctcctacttcattctattttcaaattcttcttctacttaacctatatctgctagttacaattgatctctcctctctcctctctctctctctccctccctccaatatatcaaaccactgctttgttctagcctagctctataatttcataaatgacaataattcccctggcaagtacactgtattaatttcttaagataatcccatgaattgaacactaccattcccattttacagatgagaaaactgaacctcagagggtttaggattcacagctactaagtagtataaataggattcaaactttctccctacccctttctttccctctctatagcattcctttcttccacttctttgcctttttaagtttttttcctagcatgctatcaaattaagttatgaaaaaaagtgtgtttctgtgtgtgtgtgtttcaatgttatgaggccgaggagaaaagtgaatgaatgtgtcattttttatttatttattttagacaaaatctcactctttgtcgcccaggctggagcgcagctgcacgatcttggctcactacaaaccccgcctcccggcttcaagcgattcctctgcctcggcctcctgagtatctgggactggaggtgtgcaccaccccaccaggctaatttttatatttttagtagagatggggtctcgccatgttggtcaggctggtcttgaatttctgacctcaagtgatcagcctgccctggcctgccaaagtgctgggattagaggtgtgagccaccgcaccaggccaaatgtgtcatttctttaaggaaacatctggcatctactttataccaaaaactttactgggcccgttaacccatggtatctttcctcaaaatagaatcagtgacttccttgcctttgttatgtcttcactgctcctcttttcatgcacttgtaacattattttgtaacgttttattaacacgttcaagttccttttaagctgcaagctccttgagagggtatttcttactaaagactcaacaattttctctccttagcacaagggaattgctcagcaaatgcttatgaatgaaataatatgtcatttaaacatcagagctattgtaaaatgtaagtggtatgactcccattttacagatgagaaactgaagttgagatggaattaagtgagttatctaaaactgtggagccaggaagctcagggctttttcctgcttggcacagtcatctatctaataatgacttccgaaatacctccaagcttaactagacaactaggtaataagtgggaaagcactttggaagagataaatccctaaaaacaaacaaaatgcaatcattagcatcatcatcaacattgaggggcttaactaaagcatttccttccattaaaagcactattttgaaacacttagaaaggcattttccagtttgtgcatctcaggatcccatctttgctacagctctagctgtaagagtccttcccatttgggggatgcttgctgaaggtagtgctttcggaagtaaacccaatcctgccttggagacatattgctaagtgggcactgtggctgggcacttctgaccctggttctctcctctggctggatcagcaaaagggtattgctacggtcttctctgtgatacatcttcagctcccccaagcaggagctatgtgtgaagatctctgtggctctcaggtccagcacaagcacaggtgaacagcaaatgcctatgaatgaatgatcgcccaaggaaaaacattttagagtttatgtattatcagtgggcaacaaagtaataaccccaatcagttggtatgcagagtgttcataagcaatgaagagtgcatttcagtggtgggaaacccacttgtctccagaaaagccaatgggagagtcccaagctgggttctctgaaaatcaatcagactctgagagagattgacaagcaggagatgtattggggaagcttcacctgtagataaaagggaagaggagagaaggggaagaggaggaagggaagaggaaagaaggagggaaggaaagggaagggaaaaagaaagggagtgggcagaggaaaggttgaatggtgatgcagttggagcagtggctaaagccaaccccaggggaggccctgaagctggggttgcttttacaccctgtgtcaaccagtgagtagatgactttgagtgaggcggctccaaagggcaagttctgaaggggggctgttagtgtcacaaacaagtgggtttccctcccctgaaatgcactcttcattgcctatgaacactttgcctaccgattggggtcattagtttgttgctcactgataatacaaaaactctaaaaagcttttccttgggtgatcattctttcataggcatctgtcagcatcaattgtagcgaatggggaaagtccctcattgtttttttttttttttttttttttttgagacggagttcactcttgttgcccaagctggagtgcaatggtatgatctcagttcattgcaatctccgcctcctgtattcaagcgattctcctgcctcagcctcccaagtagctgggattacaggcacgtgccaccatgcctggctaattttttgtatttttagtagaaacggggtttcaccatgttaaccaggctggtctcaaactcctgacctcaggtaatccacctgcctgggcctcccaaagtgctgggattacaggcatgagccaccacgcccagccccctcattcttgaaggtggatctgagcagcacatcacagagtcctccacaggaattttctttctaaccacactgcagtagggtactcctttctgttagcagagaatctccatactctcattaaccttgtttataaagttcaagtatgtttatgaggtagaagcattaagagtcacagacagtcttttctaagcctcaagacatcactaatacctggttggtattattaggttggtttaaaagtaattgcggtttttgccattaaaggtacattttacctttttaaaatagtaatgaacacaattacttttgcaccaacataataaaacttaaacttaggtataaatttataactgaaatataaacaccttttgccacctttggaggtaaaatttgtatttttcctgattaaagtgacagagcctctgacttacagatttgctctgtttggcatgcgtgactgatgcgtttagacgccagttcaatagagtaaacaataaagcatccgttcagttgcaatccctatccaaatctatcagtacacatggtctagcccagtgcatttatatctattaatatctcattgtaatagcagtcattaattttacacatttataattgtgtcatgcaagtaccaatgcaacatttctaaacctaaaacccatataagactacaaaataggtgatctgaaagctctatcatcaccgtaggccaaaataagtgaacatggatattaactaacttctagagaatagaataatataactcaatgagagacaaaacaaaattggaagggtatcaactccacacatataaccactcatgtatctttgttcattcatctaatcaacacaatcttatgatgcctgatttgtcctgagcactgatctagtcactgggaaatgaatgatgagtaatacatagttctccctacatggagactgacatgcaaagatgccaagggcaggataacctgggaagggatcatgaattagtaagtcaatgggtgaaggaatgaaagataaatgcaacgacaaagatatgagcccagcgctatggatatggtccatggaaattggagggggcctccaaagtagagaacaatgacactccctttataaagatactggagttttctgggcacacaagggggataggaagaattccaggaagaattcactgcagggataaacattatgaaagggacaattaaatcagagtgatgtgaggatgccatgagagttgttctcaaagtcagcaggaaaaataagaatctgagatacttgttaaaaagcagatccccaggccatgcttttaaggagactgagcagatctggggggtgaggctcaggaatcagacttcccaccaaggttctcctcttggctgaagagccacactgctagtaaccactttagtcttgactgcatggtaatgtcttacattttcacctattaacatgtttgctgttgataatttgatatttactagtaattgatatttagcaactttaaatggttttcttctattcctattttttcttcatttttattcaaagtggctgataaattacattaaataacttttgagtatctcttgatggaatcattttaaaatgcctgtttaaatatattgaagcaatgatatctgcttcacagcagctgatgatgtgaaaaggcatttgcctttgaagaaaggagcagtctcttattttggtgaggccctactatgtgctaggcattttacattatgtccattgaatctttgtgagacttcttctgtaagatttgtattttttgtctctgttttacataccaggcaactgagattcagaaaaagttgagtggcttgttcaggtcacacagatgcaaaaatagaagcaaaaatggccttaaacccacagaagcaaggaagttacaaggtctagagttatctaaaaaatgatgtcatttttttttcttttcaagaacagagtaccaccctgttgactttagctgtatgtccgtatgtcttttaaattcatcttgttccttcactcattacacaggcacttactggggttcactgcatgtgttaggagttccatggagaataccctaatgagcaagcaacatccttaagacaaatttgctcctgcccataacataaagcaactgcagttcagagaaaggcgccattcccacaggtggagagaatcatgagagacttcttgtagaaggcagtgtttgatctggactttgaagaatgatatcggatttgaatatattgagatggaggagatcagaaggctatagaaaagcccaggagtcccatggagtatctgtggacagaaaccagcccaggtcacggttttctgcctcggagacatctgcacaaggcatttgtccaaggctaagtgaagtagttacgtgctctctctcagccagaacaattggtaaacaccttcgcgctttctcaagaactactacagtaaaatacctctgttcaaaacaattactgtgcctatcacacaccttgaggtaaattaacctgtggacacatgccaactcttaatatcctttaaaaaggcaaacactgaacaactgaagttgttggggtctgctttactacagaaaggcaaaaagggatcccagagaggcatttttgtcagctcagaatgtgaggaatagtagctgctatttataaaatacctactgtgtgccagccactctacatacacactctctcgttgcccttcaccaaaacactgggaagtcaccgctattatcatgattttccagatgaagaaactgaggctcagagtgtttctatgagtgttccaggtggaaacaatctcacaggagaggcaaacctagaattgtgaaataggcctgacaccaaaacccacatgattcacatttgtgtgtgcgtgtgcgtgtatactggagagacaataatgggccttatctttaactatcctgtgtccctgggtccccagatccctctgttccatagctccatttttattgggctgttatttatcctggtcattaacacccctttcataacctcttgctctaaccctttggctacctctgatgcagcagctcagtgccctcagctctgactcctctcaacatgttgcctgtgcacagcactgcttggaagaccagccacatcatgtggccaatccccaggacagcagagacaggactgccccagcggcctccttaccagcctggaatagctaccacttcttatgcctagaagggcactgatggccatgcacagaaacgaggccctacaggcagacagacttgcatttggtacctggctcttcttcaacctggctgctgtgctccaagcacgtggtccaggcagaagtgcccccatctcccaaagaacagggcttagtaagaagaatgggtagggcttgtgggccatgtggtcctgagttcaaacttaaccctgctgcattctggctgtgagcaatagacaagtcttcagacttcagtcttaacatctaaataaaatcaacaaaataacatatactttgcagggcttgttataagcattgggtaagtatatatagtagggaccaactggtaatgcctttcaacttctgcccttttgtagtctggtatagggtgcgccttattcacttttgtgcctgcaacatcaggcacgggataaagtacatggcaggagctcaataagacaggatgaatcttgactgtcacactcttcctacgctcaaaactctagggcaagaattggcaaactgtgacctgtgggccaaatctggctcactgcttggtttttaaaaattaagttctactggaacacagccacactcattcaaacacatagctatgacttcatgctacaacatcagagttgagtagatgcaacacagaacacaagggtttgtaaagccaaaattatttactgtctggctccttatggaaaatatttgtggaccactgttctcatgtagggatactttcaaagatggagagcacttgatggcctctttattttgggggaaatatagaattcctctgctcctcccccatccatactttatctcctctttccctagtttatttcttcttcttagctcttaccactacatactatttatttttgttatatatgttgtttactttctacctcttctactaaaaaagctccacgtgtgcaggaatttttacttgtgctaactcctatatacccagaaccttgtccaatgcctagcatgcagaggacattccacaaatattggtggaatgaataaacactgatttcattgaagagactggtgagccaaagtgtgttgaagagagaacacacttcaatgaaatcagtgtttattcattaaaaggaccaggtggcccctgatacctatgaggagggtattacttttcctattttatagataagacaactgagactccagttaagtcagtgattctctaacatgcatatgaatcacctgcgaccttgttacaatgcagattctgattcaggggtctgggctggggcccttgatgctacctctctgacaagctcccaggtgatgctgatgctactggtccagggtccacacactgaagagtgaggcttcaaggctccccctcggggcatatactagcacatggggggccatcatttcctttctgtttcctcttcctcatctccatggctctctctcaatcctatcatctccaaggcctctccctcctcccccactcccagactgttccctgtccccaaacacctcgcctccagtccttcacttccatagcccccaactccagtatcttcagccccttccttctgcccaggctcctccactataactaaatctttgcccaggactttctgatctttcaggtagccagtatcatgtttcttctctgttttacaaaaaaaaaaaaaaaaaaaaaaaggtgaaaggtgatcctactcatggtccccaggcaggctggctacctcttcaaccttcatccctacaacctgtacaagttacttctgatggccaaatgtccaggctgtgcccaaacccaccccctccatcctctgcagcatctgctatggccaaccaactcctcctgctgcaaaagccttctcttgggccttacgcttttctcctacctgtctgtctgctttgccagttcctctcctcttctgattctttaatcatggtcagttcctgggcctcagcccctagcccttagccctctgttcttgtcccctttctccaggcctgctttcatccacctggcactctcatctgcaacctctcagaggaaggttccaaacatccacgtcctacctagactccacttctgcatttctaagttcccatgggatgcttttgcttgggagctccaccagcattctcactgcaatatatccagagtcatatgcatatgactcacatgaccatttctcaccccaagacgtctccatttccaggataatcaattctccctcccatctacttctgggtagctttgggggaatgacttagcttctcagagcaatttctttcccattaaatagggataatggtacctaccagactaggctattcggaggacttagtgggctaatgtatgtacagactacttggcatgtggtggtggtttcctattctcccctcctgtataaatgattaaatataccttacctgttcgatccctttaagtctagcaactggttcatctatcacaagtgcttggtggtagttgggatgggaagatggtgcttaagaggaaatgtaaccacctaaggtttctgtatagaaggcaggctatttgcagtggcatacaatatatgaccgtcatgggggccttggggttggtgaatataaaatgaatataattatggaaaccctgtgtcctatccagatgcttctgcatcccactgctggtatgagcttcctgctctgggacctgtggcacagaacttcatgtctgcaccaattgaaaggcctgtgtttatcattgcaccttcaactgcaagtatgtgcagatccatcctctgtcctttcacactgcttatcttggattccaccccagcacccagcacacagcactgtataaagtgggcattcaaagaccctgataggcaaactggctgatagagggatgggggttagatgccagaggtggtgatgggtccctgtatgcccacatctgctgtgaaacatgcataccctaagaggccctggaagaagagaggggctcccagggactactattcctgccatgaaccctgtggtttctgaaaggggaaataaagaaaactaatatttcatgagtgtcaactttgtgccaggcactttacaaaatcatctcatctcctcttcacagcaactctgtgagtcaggcaccattaccctcattttataattaagagaaaagagaatcaaaaagtttagaaaatttgcccaaggctctataaccagtgcacgatagaggcgggacatgagcccagagctgcgtcactcctgaagctcattctctttccaccatagcaatgacacaccatattgtttcgtacctccgtgtctttgcagatgcagtttcctctaatcagaattttaattttttcagtaatgggtaaagccatctctgaatacactgatacctatcccctgccacacaaaaaattcatcactcaactaagtgttcctgtactacagtatgtagaggcatctctcagctaacgtttctaataggtgacgttatgctagtctctcagataggcttgcatactgtgaggctgaacctctgggttctagccatttcttcatccacaccatatgaaacataatgtgcatgttcaaagcatgtttgtgggatgaatgaataagtgatctggtacttccagtattggtgatgggggcccatttgttcccatataacatgagggtggtagtacccgtcctaaagacctgtggaccccacactgagcagaggggatggggaggccttttgctggctccatctttatctatgaagccttcagcaggtaatgctattaggcacagcctctctcataaagctgagtttgccagaggtgagggaagacatggagcgctaagcaatacattttaccggaagccaggcattctctgttttaatcccactcttttgctagctggatgttcaatgaattcacatccttcaatctctttctaaggtccctacaacctctcaatttccaaaaatagaaagtgcatattaggaatgtggactagttcaggggctttctaactttttatcaccaaggatctactgtacagagttgttctcctttactatcatgttttgagcatctctgttgttgttgttatttattattattattattattattattttgagatggagttttgctcttgttgcccaggctggagcgcaatggtacgattttggctcactacaacctccgccctgggttcaagcaattctcctgcctcagcctcctaagtagcttggactacagacgcctgccatcacgcccagctcatttttgtatttttagtagagatggggtttcaccatgttggccaggctggtcttgaactcctgacctcaggtgatctgccctctcggcctccaaagtgctgggattataggcgtgagccaccgcacctggccctctgttttattaataagaaaaataatcacttttttttagcaagtgcaaaaaaatggataagcaagcacccatctataactcccaacaaaatgcactgataatatgagataaataatgctaaacaccaaacacataatcccaacccaaagcaaagacactggatgtttctttcacctgtgaggccggttctagataaagtaatgaatccctgcagactttctgaaatagcataaacagccaatgaatacctttctaaactttgagcccccagggctacccattctccaagtaaaaacacatggatttagaagttgctaagactgtgattctgtctcatgtgtgcaagtcctacagcaggatttggtcccctgcttgatggaattcagggattcctaactagaaaattacactcacaaaggagaaacagcccttcacatctctaaaaataagaggaaaaaaatccaagatggtggaaacataacgaacttgaacaatgacagtgcactttcaaatgtaacacatttatgcaaaataaaaactttaaggctacagacaacttagacagaagtgaaaatgagaaactaacagacacttggttggtgcaggaaatgcatgctacaggttcccttacagggcacgaagcaaagttaacaccagctcgatacttacaagtaataggagtaggaataagcatttcttctatatattgatgggcagtcagatgaaggaaatgtccaaaatgggggaaaaagaaaagacaaacaaacaagaattagatttttaatgaaatcttgattcttagaaatgcacatattatttcagcatccctaagctcaaggagatgcaagttcctctactaatcatcttcactgagaatcagatatttccagtggtagaagaaacaagagagacctcttctataatagggaaacccatggtctcacatagagtaagccatgtttcatgttggctgttgtagttggttcaaagttcttccttatggtcaaccaaaactagattccttgtaattatgatttttttttttttttttggtcggcggggtgcaggtgagggtattggatcagctctctgtggcttcctgggactagtctaccactcttccctatgataatgtcctgtgatctaagcaacaccaaacttcttctgtctcctctatttcagataaagtcacatcagagtctatttagtaaggtcatacccaaagcaaggaaatcatatagccagtacccaagatggctccccagtgatctgcacttcctagtattcaggcccttgtggactgccctcccacagagtcaggactgaccctgtgtgaatagaatgtggtaggaattatgttctgggactttccaagctggggaaaaaaaagaagcctctcagctctgtccataactctctcttagaaccctcagtctccatagaagaagcccagtttccctgaggctaccatgctggagagatcacaggagagcctctgagactacataaaaagaaagaaatgtcccaccagcccccagccattttactttcagccaaccaagttatctcagctgagaccattgacattgcggaacagaaataagtcattcccttcaagctctgcccaaagtgaagacacatgagaaaaataaataactgttgctctttaagccattagattttgggggtagtttgttacatggcagtagatgaccggcgcaaagtccaaccttatcttggaagagcactgtactgagagagaggagttccaaccttcagtctgaacagactctaccttgaataaactctctgttccttcatttctgcatctgtcccttaggtccattaaactagatcagtaattttccaactgtgttcacagaagtctgggggttctatagcagccactgtgtaatgaagaaggagggtactgagcaagtgaggctgctgccccccaccatccaccaaagcacctattttatatattgaagttttatctattttatactttgaagtttcatttaagatatcatatggctgagaattccattctccaaaagaaagcttcaaaaatcactggcttcaatctctttccaatgttcctactggctcctggcttctaagcaatcacaaaactcaaataaaagcatgatattccctttgttataacttttcttatgttgtaagaaaataaataggagtgttcttatttcacatcagattcagctatactgacaataaatgatacatttatagattgagaaaaatggctagataattcaggtctccaaatatccatctgagtagacaagaatggtttccttttttcttgaactatttgattacttgcaaccattatcccatttgcttggtacaggaaaatacagtcgttataactgcagagtgggggatacgtcttcacagccccaaattttcccatctcaagtaggaaatatccaaaactcccaagatggggctatctctagtctttctttcatcatctcatctcctcttcacagcaactctgtgagtcaggcaccattaccctcgttttataattaagagaaaagagaatcaaaaagtttagaaaatttgcccgaggctctataaccagtgcatgatagaggcgggacatgagcccagagctgcatcactcctaaagcaaagcccaaccctacacacccagaaggaaagtgagtctaaaagttaagaagccacagaagaaggaaagccccatacctccttagggggctgagctagggaaaatgagccacagtgcagcaagatctggccacatagaaaactgttcaatatcctggactgaaagaacagtgaccctagatgatgagaaggtgaaggactggggactgcaatgagtgggaattggaagctcctacagaaagtcatcaaatccccttcaccagccatacacgttagcactgtaaggagataatttctttacctcactgctggcaggtccagtgcctggaaggtgattcccctgggacacaaaactcagggtccatttgatgaagacttataggacacctgtgttctctgtattgtcaagaacactgagctgagaatcaagaggccagcattataatctcagatctttcaattgctcattgtgacatcttgggcaagtaagttcttcttcttccctttggacctctatttcctgatccatgcaccaaggtggatggcatagatgaccgacagctcaaacagctttcaggagtggaaatacaataagccttagcatctcagcaccatcacttaactaactgcatgaccttgaacaagtcactaaacagccctgagtcccagtttctctatctcaagcttggggacaataattatgtattcccaagaatcaccataggcattagcattatattaatctaaattatactcacattagatatgatatgtaatatataaagtattctatgtaaattccattaatctaaattgatattagattatattaatctaaacatctggaatgtattagggctcagtaaagggtggcttatgtctgcacctcatccacagagataaggtttactgcttcttattctggtcaccaggaacaaagtgttcacctctttaggaataataaaatatgaacaaatacttattcagcacttactgtgtgccaggtattgttctcagctttagcacacattaactcatgtattcctcacagttgctctaaaagataggaattagtgccattcccactattctgatggagacactgaggcaaacaagaagtaacttcagatcacacagctagtaactggatttgatagcaacatggctataaagcttgtagctcattttctttctttttttttttttttttttttttttgagacagagtctcactctgtcgcccaggctggagtgcagtggcgcgtgatctcggctcactgcaagctccacctcccgggtccacgccattctcctgcctcagcctcctgagtagctgggactacaggtgcccaccaccacgcctggctaattttttgtatttttagtagagacggggtttcactgtgttagccaggatggtctcgatctcctgacctcgtgatccatctgcctcagcctcccaaagtgctgggattacaggcatgaaccgccgtgcccagcccatagctcatgttcttgacctcaagcctgtgctgctttcaaggacagaagaaaatggatatatcttgagaaatctggggagtcaggcactgggatgtcaaaacgttatctctttcaatcctccccacaaccctgaggagcagatataattactctcacggttagctgaggaatctaagattataagtccatgcctcactaggtcaaaggctttgtgtatctttggaccagttgcaaggcctccatcctgagctggatgctctcactgtcagcagccacctcctcctcagctacactgagcattctggaccttctagtttttctgctgtcaaccttcaggattcacctcagcctgagccaagaaaacatgcttccttcttcaccttcaaaccacagaccaccttttccaagttgcttttctgagttatcctgggtgtcaccaaaagccttctcgtgctatctctgacccagcagcaaggcaactccaggataatggtaactgacaaacttctattaattgaatctcttttcccaattaaactgcaaagtcttctaggtcaagtatcacaggtctttattctgtgaccaaaacagtttacatgtgtgtttttctctaagccttgaagaagatttactgaaggtctaaatttacaaggatacagtgatattgcaagtaacagattgcctgaaaccaaaaatcctgagcaggaagacagctgtgcttagaaaaaacaaaacaaaacaaaacaataaccccaaacttaataaatcacatactgcagaaccttttttcagctagctcacaagattgacttcaggcacagttttcttttgttccatacaatttaaacaggacaaagttgtctatctaacgacccatttaaccacctacccatccatctagatcacaaacccacctgttcagccatctatccatccatccatccatgaacctatccatgcattcatgcatgcatgcatgcatgcatccatccatcccatccatccatccacccacccatcatccatttatccatctttccatcattaattcagcagaaacttctcaaaggcctactatatccttatctctgtcaagtacagatagaaagacatatgagatcctaatctagtccatatgtctgatgagagagccagactagcaaattataaagcagatgataatagctgtcacttaaatactgggagatcaatcatgtgtcaggtactgttttaagtatattgcatgaactattttatttaatcttcacaataaccttatgaggcattattatccctgtttacagatgagtaaagtgaggctcagagaggttaaggaactttctcacatttatatagttgttaagtggcatggcagggatttgaatccagggagtctgatttaaagagcctgtattaatagctattacattgtattatcttctgtcatgataaattgtatgataaggcaacacatggagctgtcagtccatacctggggataggagtgaggagggaaagcaggcaagatggcccaaaatctgggatgcctgagtggtaaagtaaaagagaagtcagatggaggagaggggaagggaatttttaggtagatggaactgtgtttgtggtttgggcaggtgggttaacaaagtgggaatggcaagatgttggaagggctagttcccaaagagtttaagcagcttggtctcagtcccataggtcacagggaaaacccaggaagtcatgtggccaaatatttcttgtaggtgaattatttttagcaggagggtgaggagaaagtcaaaggcagagtgaatgtggttacaccatcactgactggccaacacaagaaataccaggggcttcctttgcagtggccatgggatggggaagaaaggtcagcagtgtgcaaggtgtttaagacacaaaatcaaaaggtgattaaatgtgaatgtattgaagaagacttccaagttctcagcttaagtggctgtccacgtgagtgcaagcagaaggagcaggattcaattttcaggtgtagaggaaggagcagtttagaacaggatgaacagaagatgacacattttgtttgggcgtttgggcttttttcccacctcgataaatcactcaaaattatgccacagaatttggcatctcagcaggtcctgttttatatttaatccagattagatgatgtttcagagtgtggactccattatcagattgtccaagtttgagacccaactctgccatttattaggtatgtgattccaggtaatttccttaaactctatttccatttcagttttctgatctgtagtacccttaataaagtgcactgctcttttagcttggcctgagttagcttttctgattgtctacccagaaacaaaacaaaacaaaacaaaattttgtggcaatgtgctctctgaaggctcagaccatggcatgtcttccacatactgcctccagccttgccttgccaccctcctaccacaggacttggtgcacgaaccattaatgcttaatgttgacatttaggtctgttctctgagtgaagctctcttgtataatccatagagagttgatctgttctaattccactgggctctcccattcaacatgtttttaggaaattctcagtatttgcaaggcacactggagatgaagatgaatcagaatagacagctgatggtctagtgaggaaatgggatgcaaatacaaaggaaaagtataaggcagaaaataacatgggtcctcccagaggggatctagatggtgaagagattctgtccagatcaaaggtcaggaagggtttataggagaaagtgcctactgaattagtccttaaacatgggtaatagctggtcacatggagctgagaaacacaggcattgaagaagaagaaagttcgtaagcaaaacttatggagcagaggtgagactttaggagacttgtcagaaaaactaagaaaaaaatagaaaaactaaaaagctaagaagaactaagaaacttgtttccatatgggcagggagacagtatcacttgacaaagttccccaggtgacttagacatgtacttcttccctcacttccacctcatgaaccatggctatggagaagaagccattgaagggtttcagatgacaggtttgagagtacgagctttattttttaacacaatgctgactacagtatggaggataggttagaggggtggggcacagttaggaaggtcagtgaggaaactcatgcaatagggctatagaggtctgacccagggaaaagacaatggaggaagaggaggcagaggcagaggcagaaaggaagggagggagggagggagggagggggagaaagagagagagacagagagacagagacagagagacagagagagagagaatgagaccaagagaatgtagagaatcctgggtgttggaatcccatctgtttgttgatgggataggaggtagtgcctgtgaatgagatgggaaacaggttggggagtaggtaatgattttgactttgactacgaaatacctgagggattttcaaggtagatgtccaggggcagatgatatggataatggagctctaacaagagaagactgatcttcaggccagcaaaactacaaccaccgggtagtgtgataaatacacaaatgaagactagcatgtatggcacagtggctgcagaggaacatcactggatcttcctggggcaggaggctggtggaaaggctttgctgagatggtaacatttgggagtcctactaggaagaacaagaggctgagagtcagagtgtgataggaactttgtaggttaagagaaatctcaggacatttcattcagggaaacagcatgctcaaaagaagaaaatagcgaaattgggaaaaacaagccccagagaggaaagtggtaccgaatctgagtcacatgtttcttagtccaggatttgcttatttcctgtcagtctccatggactgacagagtagaaggtagcagcatgagctctagagacactgagactgggtttccacatcaactctgcccaaaacgttcaccaactcacgtgatcttttcgaacttcagtttcttcttttcaaacaagcaacagacctaacctactatgattattaggaatattaaaatcagagtatagctgcagtttaaatgaaaaatgatgcaaattatgtcagtgtgtgagcattgattgcaaccctgccattagcatattagtaacgggtttggagctggcctggtacagttgatggtcatgtggagatgaatgtttctgtagatattgtgcattgtaattccttaagcaggttcagggaacaaagcctatttcaataattagctcatttgatctttagaatagccccataaaactggctacctttcatagaagggaaagcaaaggctaagatttgttaagttgcttctgcaaggttgacagcaaataaacaggactaaaaatttggggccagtttttctgattctctgtcccattagactgagagctactggagggcaggtacaagtcacagagaattgatgtataaccagagatgcatataaaatatcagaatagacattcatatttatactcaagacactccaaatacactcttggaacagaagtttccatttggacagacaaggaaagtttggcaaaaggttaaggctggactaggacgagctgggcaggggagcaggggaggagacagggtctggctagaaccatggatggtaccaactttgaatatacctccctaaaatttcctagttctcatttgaaaattaaaatgtgatggacgggttagtgtaggatccaggcaagtccaggggtgcggatcttgtgaaaagtcctgcataacttggctttggtgtttccctatgcataagtgcatggccatgctttgagctttaagggaccatgttcagactccaggaagtgtgtcccaagggataaaatcgagctatatgaaacttgtgtgcgcatacatataatttcacgctccacaaacaaacattgaattgtagaccttctcatatgtgagtggctaatgaacactttcaactattgagacatgctggttaaggcaataatacttgatcttttcatcttaatttgcattaaaggcacacagtgccccatggtattaagttaagaaaacatagagttggtcatgcaacctcttgattgctggttttggaggagtggggaggatgtctaacagttctaaggggaggaggcaagggacgaagatgatcaggactgcagtgctgagtcagtgatgaaggtctttctcttatgtcaggacttaacatggtactcatgaaaaggaggtacattttactacataatgacatggggtacccattacagaacattcagaactctagatgtgatcgacagatccagaggaaaaagatggagccactatctagtgacagcagaaggatggatattgtgtagttggtgtggctaaaaccacactggtagttaactctgtcagtgaggggctccaggatcccttcttataatgctcatatcatcctgtttatgtccatgcaatcctaattccatatggttccacattcaatacagcccagttcaaacagccaaaggtaatgcaaaaagaattctaaactttaacttgcttctctttcaaactataagagaatcccatttaaatcacccaccaacatctcatatccctttctccttttcgtttctcaagatctccctccccccgttacaaaacaaaaccaggcaacaacaacaaaacacctctcaagttttgttgatattctctcttttccctcctctattttgtattcaggtgtctaaatataaattaatttagcttttttcattaaacccttcccttcatccatggatctcaagcccattctctgtctgtcttctagttctgtgtcataaaaggaaacccctaacaggaagagaaagactctctttggacagtggcaaggaagctctaaagtcagtgatcacaaaccttcagagggagaagctggggacatcttatgtttctggaaacatctgtggttatagctttaggggggctttgagtcagctgaatctattaggagcagaaaaaaaaccccggaaagtaaccatgtccatgaccagggaaggcagggagaagacccaggcaagcttaagccagtggaggggttgtagcagtgttggcctctgtgaacttctgagtccaagcactgtaggtgatgataggacactgaggagatgttaacactagtatcctgagctatggtgatgagcctgctacttggaagtttctttgacttgaatacatcttcctttgaggtagatgtagacagtattctggccaacagtaagttggtagcagactcaattgatcagtgtagtatatattgatatatatatgcagctggggggtagctggggacagaagaggtacacagaatttcgctttcctttggggcatctctagacacaggaagacattgtaggttagtggaaagagtgcaggcctatgttcaatttctctcttcctccccattttctcctcttctcctcctaccctcccctcccatctgtaaactgttccaatcaactaggccaacaaaatgtcttattttcttcaaaagatgccatatatgtaaacactgattagcaccccacaacatgcaatgcccaggttttgcctcctggggagaaatggtgatcatgtgatgcctgttgattgggtctgatggacagttttgatagacatgagagttgatgaagatactcagaggaggttaaaactaccacaaaggacttattttatagttgctcctaccctggaaacataaagccttttcctccctcccaaaaagtcacactcacacatttcagaaatagctgtgagaaggaagtgaaatttcttcacaatctcacagatgatggtgacgtgggttaagccaggctttagaaagagcaaaattggaagagcatatctgatttacaaatcagtggcaaagaataataaaatttcaggtctatcaaagaggtattcagttccattaatttgggtggacaatcccaaactcacctctgcctctaatatatctgtaactctaagaaacatttcacctctgcctctaatacatctgtaactctaagaaacatttcagtgatcttacatgtacaatgtgcttactgctcccagagaaatcaaaagtcatatactaccctatgtaatagcagcagactagtcactgggacatataatgtggccatgtgttatcagtgatgatggtgatatgacaatgtagtgttgaccttaaccctttgagggctattcacccccaatattaacataataccttctgttacccctagtttctccaaccagaaaatcagtagatggaggagaaccttagctcttaagccattgtgctgggagcttgaggcaagacatgatcctattagacagaaaaatgtcaagaagaaatgtcctcacagtttaatgccctggccagaggctagtatggttgatccaaagcagaaccaggagaaagagagagagggacatcctggggcttgcatagccaagagagggttgactgcatgtgtagtggggaccctagtatttctaaatcactgattgctggaaatggggatattgcttttaaaaaattcttcattttatattcatgtggttcctaaggtaggagctggaattagttgttaggggtattctgttcctttgttctggtaggaaacacatttgatgagcatttttcatcctatagatggaagcaagttcccagcccttgttcttggggttgccctgaactctgtgcataagcaaacccagagcttcaggctgaggtgttggtttggttaataatgtagaaggctcttttgcctgggagcagggcacaatacaccacctagtattataatgtggataaatgttttgtttgctatgatagactgaggagtgggaaggtagagactaaggttggggccctggcattgaaactgagaagacgtggaggtgggaagtagatgtgttaacatggtggcaggcaggggctaaggagaggggcgagtaagactctctgtttagaggaataaccagtgcaccctgtggacagggatagctgatattcaccctttgtattttcttccctctgtaatttccttgtgttatcctcaagccttgtgaatgcctcttaaacagaggatgctggtgtagtacatcttggaaataagggaggaatctgtgtgcatgctttcgtgagaaatgcaactggagaaaacacacagtatgagcaaactagtagctggccaaaggagtccagggagacatgcttttgagaggtgacaaacaacagcaacccagctgggaaggttctgtgggacaggacatagtacagagcctgtaataggacttgtaattgggaactctcacaccactgtagactctatctctcatggagagggcagcctgggatgctattatttgaccagtggaaatcaggggcaaacggaggtgagaatggtaaaacattactttcctgcaactgcgtttctggactgatccatgttcctggggctcccgagctatcttgatgacatgattgataacaacacagcagttaactcctataagactcaattcatgatacgtggaatcccatggcacatcgcggtggcccagtcatagggatcactggcccataagaaaatggccacctcaggaccacctgccaaacaggcagcatgcacccttcaaacagcaacacaatgaaccacagccggcccatgtatttccggacctcaatggttataacagaagatccctgctggacaatgatcaacagagcaaaaacctggccacacagcagtgttgaggtcacctcgggtcagcagagtcttgcaggcagcagcagagactcacctccttttgatggtgagcatcacgcccaggagaatgatgatgaacatgaggaggccagcgatcacgccagccatcttcacggtgttgtccacctgcttctctggctccacagtgttagaattctgggtggaggcacctaggaagggaaagggaaggatagcaatgttgaaagcacccaaacatgcgactagacaatcatcataatgacaacagcttcctttagttgagtgctaactatgtgccaggcactgtgctaagggcatcacatacattgtcccatttaataacttctgaggaccaattccttgtgaggttgggattatcattagattcttttgagatgaagaaactgacatgcagagaaattaagtgagttgccttaggttctcacttgggcaactgtgttgaagcattcttttccttaaggcaaatcaagttaagatttttttttctctcatattgctttgtctctaggatcaaaccatggaacactgggaattatacctaaccctacattattctttcaggtaaatggtggaaataacagctttattttggggcaacacaatttaaataactagatttttaaagataaaaagaggtttttgttttgttctttatagggaacaaatggtagggcaaaaagtttgtatattcaagggaacttgagtacaccttgggttcaaaaaaacacttaaatctgatcaattccatttttagcatttaatactaatgcaacatgctctaccaggtgttaacttgctgacacaatcctcagtagaggaggcaggtcactggccacttactatacatccttagccctatcctgggtaacttcatggatctggcctggtcagtcctcacaaacattcccaaaggtagacgagatactgattttcccattttatagatgagaaaaccaagggaagttgctaaaagtcacatggctgataaaggtcagggccagaattccacaggtttcctgattccaattttagacctcagtggtcagaaaccctgaatcccttcaagtcatctagttcctcaatcccttctccctaaaacaaccattctgcttatgccataacaaagtaagcaggcaaagaatgccaagaaccagtatcttcatgctacgtactagggatcagaggcaacatcttatttcagacattctagagagtagtccaggggttatcagcacccgaagtgaatttcctcctgcttctatttatattcctattggcgccagcctttaagtgggaagcagcttaaagtccaaaccatcctcttcctaactcattccttcttttcttccacatctacatcagctcactcttcatcagccaatacgctttctctgagcctgtgcccctgggagagtttctccctcttctctaaattctattaacactttataacactttgcacatgcctcacaatatcttttactacaatgcaccaatattattagttatttgttttcacatctgtctcctccagtggtctgcaaactcctcaggggcaagattacgcctcgtttatcttagttttcccatgttagcacagattctgactggtaatagggctccctaaatgtttgtggttgtttagtgtttagctaaaaggatgacgtctctgcccacacacatttgttctcatggaagcaaattgagttttctcctttttaaagtcatttattcatagaactcagcagagtcttgagttgaaggaatgctactacccaaaagctatggtcctgattcccaaaatgcactgatgtttaagccctccagcacattgatgcaccccctttttttttgcttaagagcattaagtgtttcctctctcagagcactttccccaagctgttgtaacttagacatgttgggtttacttggccaagtctctctagtgagaatggtaagtcaccctattcatctctctaatgccagtgtctagcacaggcctccctcctcatcattgctgcttaacagataaattataacataatatgagggtgagtgaaccacagttgtggactttatttatccattcaatcattcattattttgccattgagtggccatgtgctgtgtgctaaactatgctgtctgtagagtcagagattctgttcctagaaggacttctggatgaggaattttattcattcctttcacaagctaatggcaaaaccaactcatcaaattccagggctgactgagtagactcttctcatctacagcccagagaattcctgaaagagttggccaccatctcttcagcagggctggtctgacatttagggatggggggacgagggctggttctgaggagctcccatgcagcccccatttcccaggctggagacatgatttctgagatgtggctaatccacaatgtagcaagcataaaggaaggggagaatctcagatccaaatttcctcaatattgatagagtctttttatttagatttggaggaagggttgtctctggggcattcactcactggcacagcccaattttacttagtgtgcctgctaccaggtcctgttctagagactaggagtgcaatggcaaagagcccctagagaggatcctattactctaggaacaatgctattagcttggtctaatgagactcatacttcattccttcagtaagtgatcataaataccctctatgtgccaggcatttggtgatacagtggtgagcaaaacaggaacagttcctgctctcaaagagtctacaattagtggtggttgggggtaggggaatataattaataaatcaagaatcagtaatagcaaacttgaaccctgttaaggtttgaacagagaagcacatggcacttgtaaatagatacttgcataattaaaaaaaatgcattgcttcttggagcaattcacccctaataggggtgagttccaaaggaagacaggctgtaaccaggcaaagggaccatgaaagcagcatatgggagcagcaggagaaatagccttgcctaatggggcaagcaccctgttgtacttaaaaaacaaaaaaaagaaaagaaatgtagtataaccagggcaagaaagcaaggagggaaagatgaaaaagaagctgaagagggcatcatgaatgagtccacacaggatattactggccacaatgagggctgttgttctttaaccaaaggaagacagggcaccatttaagtgttattcaaggagcaatgatatggtcagatttgtatttccaatagatcattccagctttagtgtggaaccaaagtggattggtgaaatgagttttgagactactgcgggcattcagatgggagttgatagttgcttaggctcaggtgatgacagtgaagataggcagatgtgataaaagagacaattacttgaaatagttatagataaaatctgttgatggattggatatggggaataaaggagaaagaactgtcaaggatgaccacaaatctttgcacgatagggtggatggtggtaatgtttacgggttccagacacaatggaaaaagaatagctttagggggaaaatatatctagggcaactggagcttgagatatactccagcaaagtatgtagtcaaaaatgcgatctggagctctaaattaaaggtcagagttggaggcaaaaatgtgtgagtcatatgtacacagatggtatttgaagcgtgggggcctgttggtgaaatcaccctgggaaagaataaagagtggaaggagaaacagacctagaatagagacttgagggtctgcagtatttagtgagtagagggagataagcctgaatggggaacaggagtgaccagacaggtaggaagtaaacctgggagagtgtagtatcctagagccaagagaagagaatgtttcaaaaaggagggcatgatcaactatgccaaaggctgttcccagggtagaatcaagtccacacacaaaggaaagtgaagatcttggatgagtattagaaaaattttcccaaaagaattccaagacattcctaaatagaagcagcttcagcaacgaccataaacctacaaaagaacatacttgagggccacagaagaacattcaggggattcggagaggctgtctgaaagtccagagcctagaggtttagacgaattcaatgagttcagccaacaggcagcagagctgaaatcacagactttacacaggaggtttttagaaaaatccatgcttggttggtctaactagacatcagatacaggaacgtgaacattccctgggacagggaaaatccagctttgcctttggcactctttaggggaacttgccctagactctggatatttgtgcctctgttcatagtggaagtgtgttgacagggttcaaaggtgatacagggatagaggaaatggactaaaggcaagacagcatccacgtgtgactcccatatctgagggatggacagaggatgggagggtcccgcttttgtggcagagtcaggtgtggccacagggattacatcttaaatgctcagtggagcagaatgtgacctgtgatgggagtcataaaaaagcacatcagggttggctactgatggggccattggcaatgtggtgcgctttccacagatgccagcagtaggtccatatagaaggctatctgtctgactcagtggccccaaaatcgaaagggacttttcagagggctatcccactggaagcccttcagtgggataacacctgcgttacttttaccccaagcatatcctttccatgagagtcaggcttagtatcagccttagtccctaaaaggctgtctccgactctgggtgactttgttttattaagcagggcctggggatttgggaactgggagaaggaggagggatttgggtgcatcttcctcatctttaccctccagaggacccaatctgagaataggccaagcaaatcagaattggcatctaggcaggcaccagatgataaatttctccaattggggaagctttgaggctctacttgagtctcctgtgtgatgtgataaccaaaaataatcttgtgaactcagcttgtactgacaggagactccctctccaacatcatgctgcaagcctcacaagcctgacctgacggcacagccaactgtgtcctctgagctctgagcactcccaaaggctgaaccagttctcaaagcagctgctgctgcatcctgctgtctattctttccccaaatgccatgatggctaaggatccagtctcctcctagctccagcccagagtcttaatctggcttttatatgtgctacctgtctactcttacatatggaaacctggtgcacaaggcatggcccttggtttattaagctctacttccctccctcaatattagctccatacatagggtctagttgccatgttttctctctctgctgcctcctcccatgctacccagcaaccctcccagctgattttccccaaggattactgagacctaacaagggcagtgctgccctgctctactctgcactggtcagaatgctctggtgagtcctgtccagctgtgaacccaacctctcaacagggacctccagagtgaagacaggccatgagccttgctactcaaaaagtggtccatcgaccagaatattggcgaaacttgggagtctataaaaaatgcagtatcttgagccctaccccagacctactaactcagcagctgcattgtaacaaggtctctacatgattgaggtacacattgattgagatgcacaatgttccagagattattgactttgaaggtacatcactctgaatcaggatttttcatcttagggaagggaagattcagatgagacctattttttgcctttagatagataaagggccattgtggaaggtggagtagatttggtccctttaatttcaaagctcagagctgtatcactgggtagaagtgacagggggtagattaggaatcaacacaggaaacgtttgaatgtggaagagctaatcagctaaggctaaagcccagaccctttcaatgcggcatcatgttagagagaggatgaggtcattatggttccaaagtcctgcatcagagtcagcccttcattttacctgcttactctgtctctgttctcatctccttggcttcctggatgcacaactaagccctgaggacctcatgtctacaggatgctgacctttttctctgacgtcatcttttacctcaacttggttccccttaattccagtaatactcatactcttggtgagagaaattatccctattatctttagagccatgagactcccatgcagtccattcccaccccctcaccctgaccctccccatgttacccacaaaggcaggggaatgtgtcatcaacaaggacaagagctggctggaacatcctgtgctccccacaaagcagaagggacgacaagacttcttatgccccttttgatgtcgagatgctatggttttatgagtctagtcaaaagcattgggtttcacattggaaatatgcaagcttgcgtctagatgccatcactaatgggttgtgtgaccttgatcaaacctgttaaccgcaatgtgatttgatattctcatttatgaaataattagaaaatgccaagttcacactgggattttctaagaatcaaatgtaataatggagggaaaaatgcttgataaactcttgaggaactgttcacatatggggcacagtgatgatgtgaccttagcactggatccagggtagcactagggttttttgtgtctatgaactgtaggtcatagaggctgaggcaatgcctccttgtaacctgctacctaagttcatccgatcctcaggataaaggcagagcccctagagtgattcacttaactttcctcatataggcaaggcccatatcaggcttgcatctggatgacttaatggcagcaataacataatttggcaacaagggactggcaattaatgattaatgattcattctgaagtgctctcactggtgacaggcccaattctagagctttacttcagagaattttccttgtaaagatatggagcaaaaataggagtcacagataaagaacatttaattgcaattgataaaaccaagtaaatcccaatggatgcataacccatgctggtgatcattgctgacgataaagaaagcaacccggctctcagggacactattcctaaaaactgcactctttaaaacatacagttgtttctcagctatccaagggcatattatccccagtgtggcttatcagaggcaaatcttactttgctggcagtttaccccagtctactgaatggcttcttttgttgaagagtttctctggctttgtatgtatctggcacccagtagggaaaacctttgaaaccctgactctaagctggtacttctacgtcagggaaggttttaagcattacaggcatctctgattatgggggttttgccaagaggagataatagggaaaagatgaagatgctgggcaactttctggctcttctcaagtcaggtaagcaccataaaccttcttgattttgctggaaacaaattctcagaatagcagattatttttaagatggaattaaagtccaagacagaaaagaagttggcaggagagcatctggatacttcattagattcaagcctctagactttacaaattgcatcccaaggcattgagaatatttgtaattgtgatcatgaactactttggcagtctttgaggactgaaattgtagcaaacaggaggggtgcgagaagcctggggagaaacaaatgctgttgctgactttttttaaaaatgaaaaaaaaaatgtatttcagatactttacgctagtgtgatgttgatacaggaaaaaaaaatagactagatgattaaatcaggttccccccacccccacccttaccacttaaaaaaggaagaaataatcaccagaaaccagcacagcctcacatcagacagcattcaaccagggaaaaggaaaccactcctaacttttaaaacagagcaaatttactagaaaattagtacacagggattaggagacaatgctggggaaactcagagggtggtagtatcaggaagccactacccagcccagactggagaaacaaaaagagatggtggagttctcaaagcccagaagtaaggatcacccaacagaagtggaactctggtagacccatctggagacctgaagccatggagtcaccgccaaagaaggggcctgagcccaagagaaagaaggctcctcccttcctccagctttaccatctcttattaaagtctcccattagccaaatccagaagccagtaggcatgcgggtcccatgcaggggtcacctacatgcccaggagcatagggcaacagtaaaggatggttgtgacaccaaatgggccaaggacaagcatgggcttcttataaacaagtgatgctagcctcacctctctttgccactttcgaggggtgtgtgggcttgtaagtcagggagaatgtccagaactgcagcttgattttagccaagtcaaggccaacatggagaaactgtggctgactttcaggacagccgggtgtgaaactgagttcttccagaagatggaaacagaagggtcaagatatctgaccacatgcaaagtgctaacaatgaacaataaagaggtaacacatctagggcttttactacaatccaggctgccgttttaaacccttcacatatattctctcttttaatcttcactgccctatcactatggtttggatctgtgtctgcacccaaacctcatgtcaaaatgtaacctccagtgttggaggtggggcctggtaggaggtggttggatccctcatgaacggtttagcaccatcccctttggtactgtcctcatgacagtgagtgagttctcgtgagatctggtcatttaaaagtgtgtagcacctccccccacccccccccccccgcccactactctctcttgatcctgatcctgccatgtaagatgcctgctgcccctttgccttctgtcatgattggaagcttcctgaggcctccccagaagcagaagctgctatgcgtcctctacagcctacagaaccatgagccaatgaagcctcttttctttataaattacccagtcctgggtatttatagcaatgtgggaatgaactaatacacctatgaagcaggttccatcattatacctatttctgagatgtgggaacagcctctgagagactaagtaatggtagcaagcaggagagctgggacataggccctggcagtctagcacagagattattctctttaacctatcgtactactctgtcacctctctaataaatagggggagagaccgttcagcagagaaatgtgtttgtcttttctcaaatatctggaagaaagaagcagacacgtatttagatctagaatcttccattgaccagccagattaaaatatctttgtattgatgcctgtctctgccgggtttgccacccactctatcatgcagttctatttcatgcatctttcttgaagattatctcctctcatgccctcgcacccacgtatcctattctaatatctaagggattgatgaacatgtcatgtgaaccttgttacatgagccaaattatacagactttgctcaaatgatatttaaacttgacctttttaacttaagttccctcatccttttcacttttcttgtatatcaaccaccacctccaagcctttcatatgttgcagttagttttattataatcgctgggctttctatataatacctttattgatatttagcaaacaaaccatcccatataattccatagggagacaagtcttgttcaaatttaggtgatttttttctgctttgtctccaatattctttctttgatcttgctgtgactaatttttttaaattgctgactacctccccatgcctcaaagcaatgcctccttcaccagatctggttgataatagagcacttgagaaggattatttcatcattcttctaagtgacatcacctaggatgtttctcaagtaataaataaattgcctcaattcatcatatgacagtaattgcttttagtcacgatttaactcagagtcaatgttaagtagctggaaaataccacagagatgcagggttttcaaagatagctctacccttgctgtggaaaaccacttaataagtactgttaaatgcaaagaagatacacatttctaataccccagactcctcaatactacccagtcagtcctaagaagttagaattgacttcatcacagcctatacaactaaaactgctaaatattgctgacagaagttgccctcgttttcggcctcgaatggaggttagcaccctgtgagacaggaatagctttaattgattgtttgaaagcactcaggccactcaaataaattgttcctcaagtgctgattttgcttggtctcctgaatctatgcttccagatagaccttgttttacactgtaaatgctctgtgtaggtcaaattctagttcagtcatgttacacacaccaggaaagacggctaaatgagactctgatagagaacgtcttctggatgtaagaaaactcctttattctattaagaaagtgtcttttttttatccatggaaatagaggaaaacagacttatttatgagcagtcatgcccaactgatgccagacacagtcattattgacacaccccttctatggcatatccttttaaaggtttcaccgttggtgagctggaaatccatttatacctcccaatgacctcaactactttctgttgtgccaaggaggcctaacctatgagggctgccaagacccagctggggtagagagaggattcagtctgtggtaagactaagaccttaagctatgactagagtcaggtataaggttgtctaagaaaccaagtatagggcatactttgtagactgggttaggtttcagaccgcagtcaaggttaatgaccaggatgtggctgaggtaggggtcaaagctaaagcagagatcaggagtcaacttacggctcgggtttagaagtgttatggcagtcagtctgcatccatggtggggtcaaacttgcccacaagtgtggcttagactttattcagaaataaaatgtagcccatggccatgaaaataactggacaaagcccagtgacctccacatggactatatccattaccttggtctcattagcatcagttcaacccttggcttcataggaatagtcctggacattgcctaacctgagtggtgctaggattataatgatgacagtggctatagcaaggtgctgagcatggaaggtaattagacaacactactgtcttggaactcactacttagggggagaggaaagtgcaaactaaaaatcagagttgagtgatgggcaccaacacagaagtgtgcacaggaaagggcatgcccagctctgcttaaacaaaactagactacaaacttgatttccacgtcatccatggtgtgggacacatcagggcattcctgtgaccactcagtggccttctcttttccctccccaccttgactccctgtgggccagactgtcctgctgatgcggatgaagaggctgagtcatctcagtgctgacagtactggctccttgcttatagaatctgtgctttgagcctggagctcaggaggctcaaagccgcttagctgctgcaggcaggagcacccacggcctgcactggggattaagggtttagtctgaagaacagatgtaagaagaagaacataaactctttaggatgccctgcagcaaagtgatagtccctttagagttcttcaggcagccagtatgagagagctgtggtcacactgaactgactgtaattcttcctgtgaagctcagagcagtcccagggcagcaatgggccaaggagaggcttctcaggagcagccagtatagagccaagtacaaaagccaatcagggacagtctgcaggtcatgtaattccgggacactgagaacaggttaccacagcctggcttgtgaagcaaagcccaggccagggcatgaccagcaagcagatgctgagactattcaaagggagaagcagaaaccaaaccaagaaaggaaggtttagagccacagagtggagacctgtctgggccaaatgtagaatacagtcaacaaggggacctcactggggagatggggtgagccaaagggattctctggatggcagctcttggccaaggttttcttgaggtctgcccactttaaaggcacagcccttaaagctcaaccactgcccactggccagtgctcaggatcactgcatttctaagtacattcattttccagggctgttattacaaataaccacaacccaagaggtttaaggacagaaatttattccctcacaattctggaatccagcagtcccaaatcaaggtgacagcatggccatggtccttctgagactgtggcagaactcttctttgcttcttcctagcttctgctagtggttggcaatgcttggcattccttggcttatagatgcatcactccaatcactgcccctgttgtcaatgactttctccctatgagtctgtctttacatgatgtttttctcttcttgtaaggacaccgggcatattggattagtgtccacccttctgactttatctaaactaattacatttgcaaagatactgtttttaaataaggttccactcacaggtactggggttattacttcaacatatccttttggggaacacaattcaacttctaagaccaggtgaagctgagtcatgacccacacagcctggggatgggctacaagcaggagcgggagctcagcatttcactaaatgaaatgcaaactctaaaagggttcacagccaaatggacaggcagcatgtgggaagaggaatgggggctcctgcttggttgtggactgagcagaacacaaggcttctggaaggataatatgtctcagcttcctttgtctgaactgcatagcagggtgcaccagaggccgaggctcccctaggctcatactcagaaacataattcaattctttccaaccaactctggccaaattgatcccctaaggggtgactgtattacctgacttagaggggcaagaaaggggaggagaagcaaagatctgcccatctggggcagctttgtccagattatgcatctgcaacatgccgcttgcagctagcatcagagtgcctggaaaggagagaaggggcacgggaggaagcaggcaatctataggaaggattagtggaagcataagcaggatcagacagaggagccagtaaacacgcagcacagaatttcagattagtgcaactaacccgtgcaacggtaataaaatgagcagcagcaagcacggaattgattgttgagattccagccaaatccaccatgaacatgttttctttcttctagcctttgcccctttgcttttgaaagcagaaacactgaatcactgtgttctgtattaaaagctgatctgttcccctccccaaaggatggatggaaaagcagctctgctcttagtgggaggtgaggagggtagaagaagtggccagtgtggttgtagcagatgccacttgccacactggcacagagtcctaagacagggtcttccctatgactgcccacgattcctgcccccagcccaacctcttttgggccaacaccatgagatcccaggcgagacactgggctcagcaagaccagctccagcagatttgggggagctccaaacaagggctctgaagactcagtctctaggaagcttggcaggtgagtctgcatggagttcaaatactggattgaaaactagtgactcacaattagcccaacaaaatggtagatggtgagtagagtgaggtgcttgaaccatcacaggctggaggcagaagtggggatgggggtgagtataccatgcctggcacatgctccatcaatgtcagtcatctgcttatttattaaatcattcatgcatggggtcaaatgaatgagcactacaatgtgtgctaggcacagggaaagagttgatagaaaccaaacagctccaacaaaacatgcttataccttgtacatatgccatgttcaatagaaaactttgcttagggcgggggagggggttgcagttctttgtgccaagtggcccacccagttgactatctctgcatgcaatctggagataatgggggccagtaaaggttttgcagagatcaaactgtctgaacttgatcctagaggatgagtaaggcaaaccatagagggagaacatctcagcagagagaggagagtgtgagaaggcaagtaccactcacatgatcagtttgaacgggttacaggatgctgaggaggaaataaaattggagagataaaaaagggataggcactaggtggtaaatggcctttgattcaggctagttatcccaaagcacaaggggagccctgggagcattttaatcaggattagactctctctcttttttcttttcttttcttttttttgagactgggtcttgctttgtcacccagactggagtgcagtggcatgaacatggctcactttagcctcaacctcctgggctcaagcgatcttcccacctcagttagggccacaggcatgcgctgccatgcctggctttttttttttttttttttttttttttgagacggagtcttgctctgtcacccagggtgcagtgcagtggcatgatctcggctcgctgcaacctccacctcccggcttcaagtgattctcctgcctcagcctcctgagtacatggaattacaggtgcgtgccaccacacctggctaatttttgtatttttagtagagacggggtttcaccatgttggtcaggctggtctagaactcctgacctcatgatccgcccaccttggcctcccaaagggctgggattatagacatgagccactgcgccgggcctttttttttttttttaactttactttcgtagagacatggtctcactatattgcctaggctgatctcgaactcctgggctcaaacaattcactgactcagcctcccaaagtgctgggattatgggtgtggagccaccatacctggcctgaatcatactcttatttttagatgatcactctggcttcagtggggaataaatattggaaggggattgatgtaaagacatggggaccccaatttggaatctgtgacactaaccttatgagtcccagacatgagttgtagcagtgagcaagaaggagacagagattcaggagagatttcagaggccgtatctatcagatttagtgataaattggatactgaagatgaggaaaaagagaaggcaaggatgatgcttggcttctgaatctgagtttaatggcagtttgaatggaagactggagactgatttctccttgctttaaggagaatatcccaggagagaaaaaggtgcagtgagagcctcagtcatatatgctccctgattagacatttgttttgaagaagcacaaacattaacaatcatctcccacagaacaccctacagggatgtgacaaccctcttctgcattaagtcttttgattcagtggggagacgggcaacagaaaatggcagctcaaatgatgtaccaatagccttgtgtctgtcaagctttgagcatctgttctaagactgttgttaaggacagtatcctaatgcacttgatccaaggctcgtctcctcccccattctgtagtgtcagccttacagccatatgagtagttgcccagaacagctgaggagggtcctctgcaatgatcagcctggctcctggatgtcacctgccctcgtggcctccagctgtagctcttcccctagtcttctggcacagccatgacctttgtgcactccagaaccaaccaaagcactggtcaaggggaactagaggatgcccaggtcaaaggctcagggatgtccacatcctttcacctatctcagctctcagtcttgctcttgccttgggtcactgcaggagctggggttgctgtgctgctgtgcccagccatccaccttatatcctaaagctttgatgagccctgattcatgacttctatttggcactttaggtgccccaggcctgaggccctgatgggctcttacctatttcctccaccactcacgtttctcagaaaccacagttctggcccagtcaccagtcacagtctggcccagattcagtctgcctgaatcttaccaatggtcagcttgcctgctgctcactctctggacctcaatttcctcatctgtaagatgggttaagatcattataatgatggcacaagtctaagataatgaagttttttatctcatgattcttctcaataactggtcatttttagtatttccattttgcagatgagaaaatggggaaactttggggctcaaagcctctcagatagtaaattatgtggcttctgagactgtcctgaaccatcctgccatggtatttcccaatgctggctcagaatgggtgttctctaatgtctatgggcacagagcatggagagtatgattacagactgtcttgagagacctgggtttgaattctagtttcatcatttcagagttgagtgatttttaatcatctgaccctcagtttcctcatctgtaaactgtgactactaacagtactctatttggcagagttgctgggaagtttaaatgagttaatgatgtgaaactcagcacattccatagcatgtaggaagtatgtaacatacttgctgttatatttttcttttcatcgtcttattggacattcccaatgctttgtcccccagagctgccccctctctcctgacaggctgtgcccctgcctctgctgcctgtcttcgcctctctccatgaagcattttcccctcatggtggctgttcaggttggagcttcacccggttctcctgcctctggttcctgttctcacaccatctgtcaaccccttccactgggcacatgctcccttggagggtcactgaagcctcagggtgtccaagctcacagggcccagggcatgaccctagggagactgctgccttgcttcatcatcttctcttggcccacatagctttctcccaaaggctcaaactccttctgcctgggtctgagtaaagctgcccctgggaaagttgctttaaggacagttgctaagaactcccagagagtgtatgatgacctgaatcctgtcactgtgccaaggccgtgatttaaagaatttccagcgaaataataagagagagttttaacatgaggtacacaggaaataaaggaataataagggaagctgtatccaatatcttctcaaacctggagctgggttgagagtgcatccatttcttctgttgaccctcaccatgattaggcctggctgtacagggactcaactgtactatttcacaaatgaagaaggtgaggctcagaaaggcgaaaggctgagtaattggctcaaggtccccagttttaaggaatggagtttgggctccagatgagggcttgtcccacagctcttttttctgtagaaaattgacaatgggcatggggcatggccaagacaatgaagtcagatctgccactggggatgacctttagcacagctactctggcctccagactggacactgtcagtctcctcttgggctcagaagtccaggccacccccttgaggcctggctgaactgcaggagggatgtgaaaagaggccttctttctgcactggtgggcctggggaagactgagttctcttaatgttaattaactggtcacttctctactgcagcctccagtcagctcactgcagaaaagtgcccaatcctggccagaagaggattttaccttatttttctcaatataaacattcctgacctctacccactaggtgactatagcccctcgcacccagctgtgacaaccaaatacatctccagattttgccaaacgtcccctagtcctagagagcaacaaggaataaaaggaactgaatatttactgagcctcttctctacacatacatttctattcaccaactagggacaaagatgaccctagatgtgttacctcttgatctgcactgcccacaatggtagtcaccaagtcacgtacttagagcacttgaaaggtggctggtgtaactgaggaactgaatttaaaaatttattttattgaagtgttctatgtgtaaaatacacaccaaagacttagtacaaaaaaagaatgtaaaatatctttcatctgttgttttctttaattttgctgcatataataataataatattttggatataccagatgattgtgaacctaagataggtgggcttaagattctttgactttacaatgctgctgagaaagtaatacctgttcagcagagactacactttaagtaccagtgcaaacattctgcttttcactttcagtacagtattccataaattacatgagatactcaacactttaatataaaataggctttgtgttaaatgattttgcccaacttcaggctaatgtaagtgttttgagcatggcacatttaaagtaggctaggttaagctatgatgttccgtaggttaattgtattaagtgcattttcaacttacaacattttcaacttatggtacatttattgggacataaccccatcataagttgagaaggatccgtattgagttagatacattatattattaaaattagcttcacctgtttctttttacttttctcacgtgactctaagaaatttaaaattacatacaatattcaaattctatttctattaaacagtatggctctggaggtttataacagaggatgatttttgtctccatggcacatttgggaatgtctggagatgtacttggttgttacaattggggttgacgtgctgctggcatccagtggggagaggcagggttgttgctaagcatcctacagtgcacaggacagccccctgccaccggcccccaacaaagaactatctggccccagacatccatggtgctggggttgagcaatcttgccatagagaatgaattccttgaaggattagccaataaattaggaagacctgaagaactaattggacctagatgggcaaagaagttaaagcttttattgcacttagttctcatgattacctatgactgtggctattcatatttcaatttctccaaataaaaataatgaagtctggaaaagaaaaataaattatccaggatcaccagcccagaaggtggcattgctgagagctgaactcagcctccactcactccgaatgccagcctgtccctgctacataatgtggtcctgcagctctctgagttggtgctgatatgaaaagaggctcctgtgcttaaagtctaatatccccatcactcagacccaggcagttattatttacatcagccattattgctaccaggggacgaacattaacaaaaacaccctttgaaagggatggcactcacaggcacctcacccatcaaatgaggttgagaaacgtgtggaaataaatggatcacaatgaaataaacctgtcagaggaggaacattcagacgccttagaagacaagaggtaagaacaaaagcacctgatatgggactggctctgtttaaagaaaatattatctgactgctcgactggaatagagcctagagaacaatggcccagcagaaacggaacagctcgcacacactctggagaagtattgtttctctgtaaattggtggtgtgcacagtgacgagagtcacttttctcccactgtccatctgcaactcccacctccctttgggaagggcctctgataaggtagggctggggactgatttcagtaaagacctactatgtgctgcaactgcacacaacattcctagcattttctaatggaatttttaatatgactgcatgaagcacatatgataattagttttgcacgtgaaataaggctatgcaacttgcttaaggtaatctaacagggagtggctgagatgaaattcctgtggtgttggcagtgacacactggagtacaggtgtccatggcagtacaaaggcagagataaaacttgcccatagtggatgctgtttaggctcagccccaatctcctttactgggcgggtgtgactactctccagctgctgtgggtgctggcgcaaatggctcacaaatacctcccttcctagagaagtaccatcaggcataagggaaccacttccccaggaggtcatgcattcccatggcagcccacagccagtggctgaccaacaccatggtacaaatattggcccccttgcctcaaggtgggcccaactctttagtacatttcctactccagacctcccctttacccagggctcaggtagatgcagatctccacatccccccttagctttgttctctgccatatctcatcttcctccctttcttctgagaacactctgcaatgaataatttgcacaagaatctccatctcagtctcagtgtccagggaactcaacctaagacattcaccagcagtgatgtctctgagtttgggaaacagggtggcaggagtgaactgtgaaggtactggatgcccagactcatgtcatcacagcctgctgcacctccttctccaccatgataaactgaccgttcagggattagtagaccggaggccattgtctgggcaaggactttgagagaggtgacagttaaaggtttgaaatctccaagaaacttcccattgactaaaaagggaccctgtaataaagaggtctctaggtcagcagattatcttttgagccccacgatggacatcaacctctgacatgagtgggctctgtgtcctttgaagaatggcatacatttatgtgaaatgaactccacctatggtacacttgaggaaaggggctggtattcacttcaaacaaatacagactctggactgggcgtacccatggcagctccttcgatgtctattatcttgtttagtctcagaggcctctgcatgtgtacggtctacaacgtaaatggtgccccataaggggtaggtgggattattcctatttaacaggtaggaaaagtcaggctgatcatggtatgggtaaattgtcaggacaaatggtagacctgatcatagtgagagcttctcatttcctaagcacagaattgttatgtcaacttttttcccaaacttagatcacagctcagctgtcgcttcccctgtgaagcactcctttggctgcacatgggtttgtttattttgaataccatgtacctttcctttgtaacaccacttgaagtggcaaatttatttgtgtagtttttggaccagtggctgtttcttctcctggaaaggcactggaacatatcttcttttgctcatcattgtacatctccatgcctagaacagtgcctggcacccagtaggtacttagtaagcattagtagaaggaatgaataggtgagtggatagatgagtgtatgcatagagggatggagggatgggtggatgaatgaatgtgtgggttgatgggtgaatgggtgggggggtgggtgggtgggtggggtggaaagactgctgattcctctctggtgcacctggcctggaggacccactgagtgtgggcaactctcccctcccacccgcccagggctctggtgatcacctgtggtgaggaggcagagtggagtccccggggtcacctgggcgctgcccattggtgctgaccacaaggaagccagtccccaggcagcatgcagaagagaaggagagaaagaaacacacatgaaaacgtgcagcacggtgaacaaaactgcaattcttgtggctctgaagagctcacactaaatagcaaaagaacatcatgatttaacaaaacagggcctgaaatagatttaaaaaaaatgaaacaagagtaagaggcaccacttatcaagcacccacgacatgccaggtacttttctgggtgcctcacatataatgtttctaagatttagaataacccagaaaggtcagtatgactataaataaatctgtcatttttccaccgaaactacttctctgttagacttccctttctgcataaatggtgccaccatccatgtagcttctcagtctagacacatgggagccctccttttttctgatgtccctcttataatcaatcaccatgctttattaattctaccccagaaaagctcttgaagctgcttccttctctttaatttcattctcactttgttcaagccaaccttgtgtttcacatggattatttaagcagcctgtcgtctggtctctctgcctccagtcttgttccccttcagtcttactctccatccttcagttgaaatacaacagtgctgcctcgttgtccccaaggtaaacttcaaaccacctcactcagctcacaggccctccatgatgaatctcctgcccacccctctggtcttgtctctcttcactaccactgcccaccctgtcccaagcatgacaacagctttccattatcaacagccccccaccttcttgtatgtaagccttccttaggtgagtcactttgcatgggatatactccctcctgctccttcacctggctgataactgttcatccgtcaggtgtcagtttataacctgttacctctagggagtctttagtacgtcagtgaatctgggacagatgccccttcttgtcttcccataacaccctcatcttcccttcttattgcaatatatcactgtattagaaatggatgccttctcttaaatctgtagtctccttgaaagcagacacggtgtcccatttactagtgtactcatgtggccttgcattgtgcctgacacatagtaggtactcagtgaatatttgttgaataaatgaagaatgaatgaagaaatgttgaatcatagaatttgtaaaacttgttcaaggtcacaaactggtaaaggttgtattcaaaccctggtttgtctggctttaatgttcctgtcctttcaaatccacccctcacctctctaaagaaaaacatacaaaaggttgaaaggtgttttaggcttgtccagggactgcagctttctccagtgatccatcaacaaaactgcaggaagttcttatgcaaaattgagaagatagagtattccagaccaactgataaacaaaaaatacataatttcaaaaataatacagatggcaaacttgatcaacagccatgaaatactataaaatttaaccaccagtaaatagtaatcataatacttctcccttaaaaatatgaaaagttttgctgttttaaaagcacaatctaagtcaggggtcagcaaactatgacttgtaggccaaatctggccccccactccctgttttctgtgcagccatgagctataaatgctttttacatttttctaatggtggggaaaaaaatgaaagaggagtaatattttgtgacacatggaaattatataaaatgcaaatttcagtgtccataaacaaagttttattggaacacagctgcactcattcttatacatattcttatatgtatggttgctttggagctacaatgacaaactttagtatttgtgacagagaccataaggcctgcaaagctgaaaatatttactatctgtccttttacagaggagtttgctaactcctgttctaagtggctattttttagggttttttttttaaccccaatgctctcagataggcaagacaaagactgtcgccctcacatgtcagtaaaagaaatgcaaagcttcagagaagagatgacttacatgttcccacttggcccccttcagcagcctcttaactgctctcccattctgtagccttctccctgccttagtcttccttctctgattcattttctaaactataactagggtgtccttccccaaaaaggcagtctgcttaagtacctccaggggctccactatctaaggacaatgcttttatatgtgcgcgcatgcgtgcacacacacgtgcgcgcacacacacacacacacacacacacatacagtggggctacacagagtcctgggtggcccctgatcactcctaacctcatctggtcacactggcctactagccatcattcctttgccttgtcccatttaaattcagtggcatgctctcttgccttcagtgatttgcatacctactcccttggcttgaaggctttcttgacttactttgcaaccttgttcgacatgataattgttactcttctttcaaaccttatctcagtgatcacacattctgaaatagcataccctaagttgatttatgtctcccttcttgcccaccagtgacatcctgattttgccttgacgacagcccttattggacttatatttattcattgcctctcccatgaactactatttgctgagtgtttcttacaagccaggtattatattaagtactttcgatacattttctcatgaaattcttacattagccctgtgcagtaagtggtagtacttatttatttatttttgagatggagtttcactcttgttgcccaggctggagtgcaatggcatgatctcggctcactgcaacctccacctcctgggttcaagcgattctcctgcctcaacctcctgagtaactgggattacaggcatgcaccaccatgccaagctaattttgtatttttagtggagatggggtttcttcttgttggccaggctattctcgaactcctgtcctcaggtgatccacccgcctcagcctcccaaagtgctggaattataggcgtgagccaccgcacccagccataagtggtgttattgtcattggtttatagatggggaaacagagacacagaatagtttagtaccttttcctacctagaatcaaagaccatccaaatctaaagatgatgtttttaaccactagggaatgtgggattacatatcaatactaagttgtactcaataaatgcttactgaaaagtaaatgaatacatgaaagtctgattcagtatttttcactcactagctgtgtcatttggaaaattacatacatttctaaattttaatttctccacttataaagtggaggtaataattatctcatgaagtcatcttgaggatcaaatggaaaagagttaaagccttagttgggttggtgggcctagaggaggtacctccccactccatcctctaggtctgcaacccatgctgtgcttagcagtaatgctcagctatctggggtaggaacagagggacagctggataaatgcaggaatggggagagatttttctagttggtgggcagaatatagtgggatggatcatggatctcagcaaaacacaaaaggaggcagaaacagaaaaaggtcctgtttacatatatggttctagagatgtctcatgtttaccagtgtctgttccatctatccttgggcataggaaagagttccagtcaacttgcagttgggctgttgtcatgtgactagctctcatcaaggccatgtaagtggaagtggcatgagtcatttccgagtgacatatttaagatccaagttgccacttccatgctttctcttcccctgctcaggggttctctgagaccacatatattctagatggcacagcaacaaatatgcctttgtggtattaagctactgggagttgggtattagcttgttatgttagcaaagcctagcctagcctaactaatccagttgctgaggtagaggtctcttgctttctcctgcatcacctggtcccctgaccacatcacgttttgaggattcattacccttctctctttactgtttccaggccctgtacagtgtgtgtgtgtgtgtgtgtgtgtgtgtgtgtgtgtgtgtgtgtgtgtgtgtgtgttagcctgcaaagaaggagctcagaatgctgaatgtctcagacttcccttctgactcttgtcccttctaaagcaatcagtgttgagtgcagagagatgctgctgggctacagatggccctggagcagacaaccctgaagactaactaattttttggtttattagcttcaatatgttgtggaagtgaagaaagttgaggatttcttgagccacctcaccttctgctccaggacttagcttgaatactcctggagacaggccaaagaccatcacatgctaaatattctattatcaattattactagaaaagaggcatgggaagaggttaacaaataggtaggagacagagcatcctgtcagtggtcaatgaatctcatctgtctatagtattaacacaatggaatcagatctgatttccaattctgaggaaacttgagctccttatttaaccccttgagcccatttggcccatcattaagtaataacgatgaccactatttatttagtgtgtgctaagtgtcaggctttacttctgtcatcacactgaaaccttgtgtcagcacacaaagccctgtgactggcacacaataggtggttaatttttgcaaatcccttttaatccctcctcaaacatcacattgagatcccatcaatggggtttaaaatatccaatagagctttattctctttatttataacccttgtctctagcctaccccaaatgtgttccttcccggactcccaattttaaaaggccccccttttcctttagaagatgcaactgctttgcaataacagacttgcgatcaagtcgactcaggtgtctctcagatcttgagtagataattcttatttctagttgagaaagatggattggaactcccaaggtacatgcttgaatggcaagagttaatcctcacttgtttttctgaactctatcaaaccagcttttgtcttcctgagtggggtatggaagtggggtatggaaggggtgtgtgtggcgggggaagtttgagcacaactagagaggctagagagatgtgccagctgttgtagcaagaaaaatattaaagaaagagttgggatatttaaaggtcatatttaggctatcttatgtgtacttatgatatagttctcttcctccaacttcttgcaaaacctttaggaaaatctgtatttttccattgacattttaggacctagaagacagtcagtgagagcaaagggggccacaagtcaaggagaatttgttacactcatgtaactctgaggatcccagtcctggaaaatgtatctcatgggactcagctaaggaagaatagcattgtcctgcccaaaccctccagccacacagtctgagctttcacctccaaaagtttgacaagatttataaagactgaacaacaatcaagagctttccaatagactatctcactagagtctttcctctcacaagtgattccccattatggcccctaccctggttgctctagctagatttggacatgctatgctcctgggtccctcctgaaattgctggtctggtgatgaagaaaggacagtgtcatagtcaaggctagaaaagggatgaccacaatcctatacatgtccataaaagaatactattgctctgcaggatctcatctagagacaacaacctatcaatgggaaggtcaagtactgaaaagtgaggccaacatcactcctgtcccctctgggtttcttcactttggatctaacctgtatccatttgacaaacggctgatttgtagaactgtacaagcagtgactagagtctgggctgtggctttttccttagagaactgagagagaggatctgtgcttagtaggtctgggtctccaagtcccacattaaagactcagaaaggaagagagaaagaaggaaatatatatatatatatatatatatatatatatatatatatatatatatatatatatatatataatgttcttgaatacttggtagaaagggctaccgatctcaggcttcaaagtgaagggacagattcgtagattttaactgacttgtccaaggtctaacagctaaattttgggggacaggatttgaatccaggtgtttctaatttccaattattccatgcaacctctcaaggaagcttcctatataaaacagaatcttccacataggcttgtatcaatgggagtaggcattgcctattgatagcagaggattatcacaccacctgtggctgtgattctgtggataaacaaggcatggacacatcactcctcctctgggccccagtcttagcatctgttaaatgagagcatctcactgaaaaatggctatttagtgtccctgctggtccctgcaggagtgagaatccattatgggaaaaggagaggaaaatgccagatgaaatgctttatctcaggcttagctcttatgaaaagaaggcatatttacaaaagccagcgcccaaacctcttgctgtcactattggaacaatggcgttagtccatcgctgccaccaagcagaacaaaactactggtgacactggcccctcatcctatgcttcattattctggagttcagctttcagcacccactccaagggggttgttttaatgggatcgttagagagtgtttactagattaaaactgtggctgtcttctgcaaagcaactctgcaaatggctttatgggtttctgggtttattttgtctcaatgactcggctcagtttgcaaatcaaatcaaagctgatttttctaactgccactcgggcgcacccagcgggagtctgcagagccagctgtgttcccttgacggctggcgctggagacaagatgggagtgctgctgcctgctggcagccagagtggttccacccaatggaaagaagcaagcatgcaccttcctgaccctaaccaaggctggaggagcaggtcagaggaagcaaatttcattttctgaaaggagaaatggtagacagaatctatttgacttcaaggactgatgggcagaaaaataatagggagccagtttggactcataatgtagaagccctctcaaacggaagtgtccaaagtgtgaagcaagtccatggtgggtagagagatctctatcacagcaggaacagaaacagaggctggctggccttcttgttagtggggactgcagatcccatagtggacactttacctctgtcacttttactcctaccatttaagagaacaatcctgacatgtaacttgcatttgaaaaaaatgaagccatggaagaataatgacctgttagtcatccactcatccatccatccatccatccatccatccatccatccatccatccatttgttcatccaatgcatttcattgagtaccagtatatgctgagatctgggaataataaaacagtgctcaaaataagcacagtctttgcacttacgtcacttagagtctagcagggagatagacattaaacatgtaagtagactatatatatatatatatatatatatatatatatatatatatatatatatatatatatatatttgcaagttgtgatgagtgctatgaaggaaaagtacagggtttagtgagagtggaaaattagggatatacattaaaacagaggtcaggatggtcttctgaggacataaggtttaagaggccatcttaaagatacttctctgttaagatatttatctattaaggagacatatatagtagccaaagcatttcagagagagggcaagatgagcgaaggccccaagcttgggaggagtttgatgtgcctgaaaaactgaaagaagaccagtgtgccagagtgtaataagagaataaaaggatagaagcttagaggaggctggagggaggaagggatcagatcacgcaggcaagactggtggggcaaggcctgtgggtaaggaaaagtagcaaaatgaacagatgagtacaagaaaggagtcacggaagaattagaaagacaggacatcagtgggtaagagaacttggatggaactgggcatcagtttctcaaagggggactgaacaatatagttctagaattgaacaactaggtcagaaacaattttcccttggcctgctctgtctcagccagaggacatgaattgagatacctgggtacctcctttagcagctgcaacctggggcatcttctaccagatgggataatgtacctctcatgggaagggtcattttctctctacttgagcattagcacctctgaagtctaagtccctaccccaagcttccacatgctccattttctaaaggatcaccttaagcacctgtggctgacatcttcaacctgctacctatgttgagcccatccctcatcttccaaaggtatggttctaaatgattcccctgctcacttgccctttctaacatttcctattttaatgataagaacaaaacctgatttttaaattgctcttttttgctctgtggctttctattgtcttcctttcagagtctgaataatagttttaaatccaaaccatcacttaatgcctgtttacccactggctgcagttttctctctatggctctgatcagattgattcccaggtctagagtgtgtcaagcaaagtgctcaaaatgtcttttagcttttatattcaaggaaattcccttgctttttgctaccctaatcaaacatccttattggattaggtggtagtatcctcataaaaaggggaattttgaacacagtcaagcagacaaggagaatgtcatgtgatggtaaggcagtgatcagggtggcgcttccaaaagccaagaaatgccaaagatttgccagcaaaccaccagaagctaagagacacacgtagaaaagattcttcctcacaacactcagaaggaacaaggtctgcagacaccttgatttcagactttggacctccagaactgtgagacaataaatttgtgttatttaagccaaccaatttgtaggactttgttacagcagccacaggaaactaatagaggtccattactttgcaaccgtccaagctgggtggtactaaattagatccagagttactagtagcaacattacacaaaggaaagggttggagacacatgctggagccaggtgtgtgtctaatattcttgtgtaaggggtactaggcttggggtcaagttagaatgatcctgaatgagtgcttagggctgttacaactggcaaccatctggttctgtgggattcatgtagctggtcatagacagtggctggactctccagggtcagggaccagacagcggcaagttgcttcatcaccagagtactggccttgagtctgacatatggacttcagggtctggatgccctccatcagacccatgaagcagctgccgtgatgacagagagagggaagagccttgggagagactggtgacccatctctgggacttcatatgcttccaaagtccgtgggattctcagtatcttcctgtgttaaaaagaatactgttttcaggaaggctgcctagaggaaatttgatccgggtggtcaggaagggatgggataaacagaatattgattcccagctttaggttcttgatacaaactcctcacgggcagtggacggatttataatagatagggtttgcctttaatcaaccctaggtactctaagcatagtaccaggcaccaagtagacactcatcaaacacaggtctgcttccctttgtcctatgctccccaagcatccttcttatctgatgtggtgagaggggataactgaactgtgtccgactgacattctgcactatctagttctctaccccattcccaagtgctactggagcctcatttctttgggtttaagtgttggatctcaccaaattggaaaaccagaatgcggatgctctgatttcccaataccctgacctctcagaagcctgcctgggcttggacagctgggcattcacactcattcatgcattcctatcctttcacacacgcttactttacctgcatacacactccattcacttaaggaaagatggtaacctaaagctcaagcaagaggggaagcccttatgctaaggagaggtagagaactcttctgtctggttctttaaatgtcactgcaattctcttgcacatcagcaaagcaactctagagaagcccagcagggtgggcttctatgtctctgaggactgcagtcctgaagttttcaggagagtatagttttagagattcttccactgtccccatatgttcctattgcttgtcaggtctcatgtttccaattctcagttcagaaattatgacccagccagctaccctctaatagagcttacatcccagagggtgtccttagaatcccacctaccccatggagtgcaaatccattgcatccatctctcctggtctagaaatcgaaagccaccgaggagccatagagcataccatagtgaaggagctttctctgtgagtttccttccctctccagctgcttatttaagcaggctgcagacacctagctctcccgattgctgtctagagccctagtgctacccaattgatggtgttcttccttctacattatctgttttcttcagtggaaaagtctgccaatatctgtgatttgtgtcacttttgtttgcaggccatcaattctccttgcctcacagagagtattttatctctttccatccaggagcctgagttcctgagagggaacaagttagggacatgtcaccctctgtgactcatgtgaaatcatggtgacttcttatcacagggagccctagtgcttccgttttcttcttcctcctgcatcttctcttttgtgcctacatattgggctgattttcttcaaagttataaaagtcatgtgtgatgggtcttggtgcacatttcgtcaagtagctgtagatttttttctctctttttctccccactctgcccgtgtgtgtgtttatgttcctctgtgtggttttgtcgttgtgcatgtgtctatatatttacacacatacacatacatacttgggtcatcgcttttctctgtactttaaatctacggttatatgcctacttacgtttaccacttttatctccttggaagcagtctatgaaactatggatgctgccagtaaattcagggaacagagtagaattgcccagttctgttgtgtgtgtatggggagggtttgctgttaaaaatatcaactctgtaacaaaaagatacatctgatttctaactattcaaccctgtaataggttaaacgatagcaaaccattcattgattttgttttttaaaaagagtaataaacagaaacatgtaccaactgaaagagccaggcaattcaattataattaggaaaacaaaagtgatgagcctgaacaatgctgccttagttttggggataagtgttgaaaatgccaaccacgtaataatgcagcgtttgtcttctcattactaaaggccccagtactaatcacctcatttttgaaagctgtgtaccaacagaacgaagtacagaactcagtagatgggtctaatagacatgcttaaaaaatacccacataaacatagacccaaatataagaaaaacatatatcaaaagaatatttgagtaaatttatatccatcactccactgatcaaagtaccagtccatccttttacaccattcatccacccatccatccattcagtaaatatgttttaaacttttactctattttacgcactgtgctactaatatacaccctagaatgtatgttctagatgcaaatgactccggtgaaaataacaattctttcttgttttgagttactgttgcctaatctttctctgtgtggctagaaagaaatacttaaatggctgaagaacaggtgaagacagacaagcagatgccaacataccttttgtagccagacgaacacagttgattttggtctcctgtgaacaacaaaaatgagatgccaattaattagctgtgagttatataaaattgttatataaagacaaaaatacatatatatttgcatatatattcatgcatatgtatttttaattataattttaaatttgccctttccatttttttccccatcggatgaccttttaattccattttttaatttttttctcaggctaggtacatatgttattcagttcacttcctgactcctaccatctcataaacctcattcccagacagaaccactttataaacatatcagataattcccagcactcatcatctttaacaataacacgtagtgggtacttggggtatgcaatgtgctttgttcagttgcatgagtgagcagatggaaggagggcatccttgggaaactttgttactagcaataatgcatctacatgcatagacgggaagagatacttggcaatagtccagtctatatgaaacatgtcaaactcaaactgcaaagttcatgttcaaaagttacttttcccctgagctcttgtgtgggcctcgcaaccttcataaataatgtgtgtggcaatagaatctttgctaggtgaactatctagttgttgttagctgttgccaaagtaaaaaggattcataaatgtgtgatgttgctgggcacacagtggagttaatgaagagtgtgcttaggaagagaattctctgcccgctttactgggattcatctcccaggaggtcctggaaccagctgaaaattccagttgactaaattatacccccaacaacagtctgaattcagtgtagcaaggaaagtaaaatgcaaagaatgcaagtatgtgagttgctgaaccaaaaatctgtcaatcatccaattcttgtcttgctgcagctcattcacaaagaaccattgcatcttgaagggattggtggcaatcaggataggaaaggttaggaggccataataaaacccctgaacttcagtggctaaaaacagcaaaggtttattttccattcaaactacctgtccaatgtaggtgtgtggctgggtctaaggggtgagattgggggtgattgggagacactctgaccattgtaaccactcagagatcatagctggtatgtccattttaacccaaggggagagagtgctaaagggtaaagcagtatcaatcaaatgctttgaatcagaagcgacactttcacttctatgcgtgctttattggctagaaccagacacatggccatgcctaattttagtgagatggggaaatggaatcctcccatgtatccagaagtagagaagacatgacaatgtctacggcagattctattccatctaggtacacctctgaatgctggaaatgatcacttctattacgtccaagtatgactccccataattaatctcatagttatcgccaatagtcttgattcttttcctcaaaatgcacagaaagtctgcttttgcttgtgtaaaaaagaggtctggataatgaaagatggttctcgggctcataaacattcttctttatcaattcctcatattataagagttcaagtcttttgagctatcctagctgctcattctaggacaaactccactttatcctattaatgtggggtgactagaacacaaaacagcagtctatacatgctcttattgatacatgattatattgatatatgattatctagactatcactattatccttacttatattgggcttctattaacatagctaacatcctggtgtttatccgtctcccccaaccaaaaataaaagtattggttagaagcctgcttctacatgtacaagtgtggctatatttttgaaacccaagtacagagtcatatttaccactacaatttccatcttcttcaactgatccaagtactacaggccatcatcacagtctccacaagctgaaaatttttagaaatcatttttttctttaatttcatccagatcattaatataagtaacaatctggataatgccaatggtagaaccttatgacatgtactagattccttcttccacgttgatattcatctgttaatcagaatcagaactaattgctaatatcctaaactgcttatgaattgagcttgagaataggttcaaattccttttagacactgatactctgtctattgcatttctccaatcagtgcaaagactgtcttaaagaaagaaggttgggttgacatgacttgttcttcggaacaagtgttttcttcttcataaaaactataagtgtctctctttaaaacaaacaattatttcattttataaagtagataatttggaaatgttaaaaaaatgacaagtcatggttcaagtatatgaatcattcatataaaatcttcacacaaaatttgaagcatgttacatttcaataacaaagttttttcagagaacatacccaaaagatgaaaaaaaaaaaaaggaaaatggctgagaaaaaaagtaacagtaaaggacattgctctaaatgtgatgtacaaaaagcttaagttacaagttaaatcttgcatatgacaattaaagtgagcaaactcatttctgttttcatgtttggacaaaggttttcagcttctgttggcttccattccaatagcaccataccctgtgttttggtttaaagagcttgagacggttaaataaagcatgaaacccagaacactgaagaagacatgcaaatgattgtacagtgtcacaatgactatcattgagaaattgtgtagactgggagaggtgccaggagactatagatggttagaatgatcttccacttcatggtaatgcaacaacaacaaaaaaagattttgaaagtaatatattagaaaacttgccagttctgtgcatgatttttgaatagagcagagggcaaaggtttgatgaggctaatactgctgagagtaatttctaaatatgtatcttcactttaaagaaattcagtcttatctgtccagacatctaagaatcttttctcagggaataactttaaatataaatgaagctttatattcaatgatgttggttccagtgttctttataaaagtgaaaatcatgagcgatatatctgtctaaccacacaggcatggcaaagaaagctgtggtctctcttattcaacacagcactgcaagtcctagccagagcaactgggcaagagaaaaatttaagggcatccaaattggaaaaaaaaaagtcaaactgtctctgtctgcacatgacatgatcttatgtatacgaaaaaccaaaaactttaccaaaaaaacactcctagaactgctaagcaaattcagtaaagttgcagaatacaaaatcaacatacaaaaatcagtaatgtttctatacatgaataaactacctaaaaaatacaaaaatcagtactgtttctatacatgaacaataaactacctaaaaaagaaatcaataaggcaatctcatttataataactaccaaaagtaataaaatacctagaaatcaatttaaccaaggaggtaaaagacctctacaagaaaaaccaaaaatactgttgaaagaaattgaagggaaacaaatagaaagatatctcatggtcatggattggaagaattaatattggtaaaataatcagactctccaaagcaatctatagattgaatgtaatctctatcaaaataccaatggcattcattatagaaatagaaagaagtcctaaaatttgtatgaaaactcaaaagaccgcaaatagccaaaacagtcctgagcaaaaagaacaaagctagaggtttcacactaacagactttaaaatatactacaaagctgtaataacaaaaacagcatggtactggcataaaaacagacacataaaccaatgaaataatatttttaaaaacgccaaaattaatgcacatatctacagtcaactgatttttgataaagtcaccaagaacactcactggggaaaggacagtgtcttcaataagtggtgctaagaaaatggatcatccatattcagaagaacgaaactagaccgccacctctcaccctatacaaaaatcaactcaaaatggataagagacataaatgtaaaacttgaaactataaaactactagaagaaaacataagggaaatggtctgaaaccaaacatatgacactgatctaggaaaatattttatgaataagaccttaaacatataggcaaagaaagcaaaaataaacaagtgggattatataaaactaaaaaattatgtacagaaaagtaaacaataaacagagtacaaaggcaacctacaaaatggaaggaaagtatctgcaaactattcatccctcagggaattaatattcacaacatactaggaactcaaacaattcaacagcaaataaaaatccaactaaaaaaatgggcaaatgatcttaacaggcatttctcaaaaggagatatacaaatggccaacaaatatataaaaaatgctcaatatcactaatcatcagggacatgccaattaaaactacaatgaggtatcatctcacccttgttaagatggctattacaaaaaaaataacaaatgctgctgaggatgtgcagaaaagggaactcttatacattgttgatgggaatgtaaactagttcagccactatggagaacagtacagaggttcctcaaaaaaactataaatagaactattatatgatccagcaatcttactactgggcatttatccaaaggaagataaatcaatatattgaggagacatctgcatcatgcttattgcaacactattcacaatagccatgacaggcaatcaaactaggtgtccaaaaccagatgaataaagaaaatgtggtatatatacaacaaggagtactattcagccataaaaagaataaaatccagtcatttgtggcaacataaatggaactagaggacattacattaaggaaaataagcagtaaacagaaagttaaatacttcatgttctcactcatatgcagaaactaaaataagttgatctcatagaggtaaaaagcaggaagcagatactagaggttaggaagtggagagagagaaagggaaagatttgttgaaggatacaagattatacctagatagaaggaataagttctagtgttctgtagccctgtaggatgactatagttaagcaaaatatatagtttcaaatagctagacagaggatactgaatgttcccaacacaaagaaatggtaaatattcaaaatgatgaatatgctaattaccttgatctgatcactattcattatatgtctcaaaacatcactatgtatcccataaatatttacaattagtatacgttaaaaacataaaaagaaaaaattccaaaaggaaaactggggtctatctacatagtagaatattatggagctgttaacaaaaatgattgtgagggccatgtaataacatgggatgatacacataagagaatattaaataaataaagcaaagtacatttttttgttacaacatgcaaatttaagcatttaaaaaatacatcctgaaggaaacagactaaatcttaataattcttgcacaattaatttgaagtgcaatatacatgcagatgagtatactaaacttaaatacagtttgacaaatttttcaccaagtaaacacacacctatgaccagcacccagatcaaaacactcaacattgccagcacctcagaagtttccctcatgcttcttctggtcacttcttctctgcaaatgtgaacattaatttgctttctgtgggaatattctcttaaaatgtggtcacaataaagggaattctgcagagtttttttgttttgttttgttttgttttgttttaagattcagagggttggtgtgcaggtttgttacatgaatatattatggaatgctgaggttagggcttctattgaacccatcacccaaagagtgaacaaatgaacatagtacccaatatgtagtttttcagcccttgcctctctccctctttccccacttgtggagtccccaatgtctattgtttccatctttatgtccatgtgtacccaatgtttagctctcacttacaagacagaacatgtggcatttgattttctctttctgcactaattttcttaggataatggcttccaggtacatccatgttgctgcagaggacatggttttattcttttttatggctgcatagtattccatggagtatatgaaccatgttttctttatccaacccaccactaacgggcacctaggttgattccatgtctttgctattgtgaatagttctgtgatagacatacaagtgcatgtctccttttgttagaatggttacttttcttttgggtatgtacccagtaatgggatttctgggtcaaatggtggttatgtttttagttctttaagaagtctccaaactgctttccacagggacagaagtaaagccacacacctacaaccaactgatcttcaacaaagatgaaaaaaataaacaatggagaaaggacacccgattcaaaaaacgatgctgggaaaaccaggtaaccatatgcagaagaatgaaactggatcactacctctcaccatataaaaattaattcaaaatggattaaagacttaaatgtaagacctcaaactataaaaatcctagaagaaaacctacgaaatactctcctgggcattggcctaagcaaataatttatgactgagacctcaaaagcaaatgcaacacaaacgaaaattgactattggaacctaattaactgaagagcttctgcacagcaaaagaaaaacaaaaacaaaactatcaacagagtaaacctacagaataggagaaaatatttgtaaactatgcatctgacagtggactagtatccagaatctgtaagaaactttaacaaatcagcaagaaaaaaaaacaaatagccccattaaaaagtgggcaaaggacacaaacagacatttctcaaaagaagacgtataagtggccaacaaacatgaaaaaatgctcagcattgttaatcatcggagaaatgcaaatcaaaacaagatactgtctcataccagtcagaatggctattattaaaaagtcaaaaaaataacagatgttggcaaggttgcagagaaaggggaatactctgttgatgatattgtaaattagtgcagtggtttattctatcttctcttgtacattgtgtcatttgtgagaagtttttaactttccttaatcttcccttccacagtttcgtgcaggaaaatgagccatttcctaaaatcaccccttcagcaccacacgttttaaagtctgttttctatgatctagagtgtatatacgattatgcttaagtcttcctgactgacaaacgtgatgccaaaacgtttgttttctcctaagttcctaacaactttaattccataaccaatttgtctctgttggtcagaattaggtacagaataacaaagccctaagtcactctcttgaccttctgagtgactagattgtcagcaagcaaatcaggtatattctggatactctgatatttatcagaggagaggtgtggccagtgtgcctatgtccaaagtgcccagtcttttcaacaaaaagaaatgagcactttctttgttctcggattatataagtctctggggaatggaaaaaaaagctgtattttctatttgatctctactataccctaattccaggtttgtaatatattctgggacagtacaatataatttcatttccttatcattttaatctcacccatgctccacttcccactccagattaaaatctgcatgcaggtataaatcaccctggggtagaacaccgtgtccttactgttgtgctctgttgagaaatgcttctactcaaggctcggccagtgcagcaatattgggtaactctctgtccctttctgtggctcaatttccccatcaatcaaatgatggagaatggggtagaaaaggccactttggtagaataggcaggccactctaccaaggttgcttccagtcctcaatgctgcgtctggttttagctactggcagtactcctttactttcagtactcagtcttcttgatactacttcctaatacctcatttcatgcaaataattttatttatttatttatttatttattttggtaggctgttacctaccttattactcaaaatgcctcatatctgtatctacttatagcctccattttaacactaggtcaagtctgactcatctaaccatccatccatccatccttcaattatttactgaaattttaggatgcctcttcaattgaggagttcacagtggaactgtttaggtcatcaaatgtctcatagctgctgtttatcatccagaaagacttgggttaggctgctaacctgatcaagaagccctaggtacctggctaatacatacaattcttactttactgctctattagactcctcatttaataggatgtagatttaaccctgatcccatagttttcaaatagttttcacattatcccaacttgtgtctttattttgtctaagactgagcttcccagttgatatgatggaatttagacctgacctcagcgtctttccatagtttccccagtaactttgactcaggccttaattctcctctaagactgtgctgagatcctgaaagtctacctaatttttgttcatgtactcatttggtcaactgctcaacagatatttattgaatgattactatgtgccacacattgggctaggtactggagctacaaatacgaccaaagtagacatggtccctgtcctcatagagcatgcagacctggggagagacaaacattagacaaccattctcacaaacaagtatctaattaaaagttgcaataaacactgggagatatgcaataaacacacataggtatgtatttacttggtgaaaaatttgtcaatctatatttaagtttagtacagtaaactaaatgaggttgtgtttaaaagtttagtacactaaagtaagtgagaagtgccaggtgctgtgcatgtgtaagggagatggcatggggtgtgggtgggaagggagatggtctgctgcttttagaaagaccatttaaccttagaagttagacacaggaagcatcaggaaggtcatcccagactcagacacagacatgcaaaggcctgaaagtgggaaaatgcatggtgctgttgaagacatacaaaattctggcatggctatcatcataatgaattacctgaggcatgatgtaaaacgaagctagcgacataagaccaggagaccttttgggactatagagttttggtctatattttaagaacaacaggaagtcattaaagagctatttaggcaggaagaattgaaatttcaggtttaaaatttttaaaggtagaggctgttacatagagaatagacttacggtgcaagagaaacaagttggtgagaagaaggtggtggtatagtcgaatgatgagatggtggtgccttagaccagaagagtggctgcagtgatcctacctcaacctttccctacctttggaaagcatatttttgctctgtttgactctagagctccctcccaccatcccaccccacctcacgcatacggatcagcctgggcttatggtattgacagcgttgggtccttagtctagccttcccacaaactgactctccttgactttcttccattgcactgacccttaagctattgtttagccccaatgggactcactcacttaacatgtttgttacctgaaagaagcactaagaatttttttttttttttaaaagatgtcctcttttcttttttctttttgaaacagagttttgctctttttgcccaggctggagtgcaatggctcaatcttggctcattgcaacctctgcctcttgggttccagtgattctcttgtctcatacctacttagcatagtttatgtcttttaatccttataacaagactgtgaggtggatacgacaatgtccatttttttctcacaagattaaataacatttttcaaggttacacgtataataagccaggctaaaatacaaagtaaacttcaagcaagtggccttcttttctgaggtgtctgtaaggcaaatacccctttgtcattgaggtcagatgctatgctttcttgggttgcaggcaggcacacaaagacaatggggcacagctttctttggaaaacaggctaagtggtttgtgatattacaaaattctgtttgacttgacgcaggaccttgaacaatcagataagatctggaatccttgagtaactcagaaccattaggactacgtaatgtggtagcctcctcctcaaaggataatgcatgaggaatgcctttaaaggggtaacagaagcagtggggcacttgagtgctagctcactagaaagcacgtatgctggattctgcagaccctcagtaaccaacagtgagtggcaaggtgcagcctcaggttgcaggataggtggctattggttacagacacttctaactggacaaatgttcactatcaactttatgagatcttcctggaaggcattaggctccacttgaggcaatagccaaggccatgagccatactctaagaaaggaagcccccaagtagcatgcaagccattcggaaaatttaaaatcaaacccaacctctgaaaatcttcttgtaagttttatctctacttgctgactccattgcctcaactctccaagtctctggaactcccttcagtgagactacactaagtccactaagacttttatatggtcagcactcatagtcactgctacaactccatcttccttaatctctcatcaacattagctgcaactgaccattccctccttgacctgtttaattatcttggctttaagtcattctaccttccagacttttctcctacttcactacctgttctttatccctttctttgcctatgtatttatcctttacttgacttcaacacactggagtgacctggagcttggttttatatcctctttcatcatttgtatcctaacttttttaggagattataataaattgcaaggatttgaatattatgttctcatgactcccaaagtactttttctagcattgatattcctgagatccaggctcatctatccatctgtctacctgaaatactcacaatcaaatatacaatcatctaaaagaattgttttctcttttattttcactccaagccttactcaccactaattttccatgtttaaataaatgtcaccatcatctacttagttgattaagcaaacaacctaggagtcattattgatttttctagatatgtgacttcccacagtcaatcaaccattaattcatgttggatctgggtagttgaagaaattggtaactatttaacaccaaattttcccacatatgattcaaaaacaacacaggaaaagaagaaaaaaataaaattgtacaaaatccacaatttcagcataattaatgtatagagaagtcttaaaatgtcataggcctgtttggtacaaaaagaagaaccagatataaatgaaatatctctaaagctttcaacacaatcacccttgtcatcctatgtggagaacaagagctatgtaaaaacaatttggaagagaaaagaggtaagctagcagagagtacatggctgatctaaaatacgttccagaaagacaaagaccacactacacatgaaagtgctaaaacaattcctggtagatcaaaactaagagtacaggaaaaggacttgaaagaacatgtgactcaaggtggtagtgttcaacaggtgaaataggttcaatgggtgaaaatgagataaaaagaagggagaagtactcttggaagattggagattgaaggaaaaaaggaagcaaagtgggaatttttagaatcacaaaagctagaataaaaacaaaaagtcagaacctacacccattccctatgacatacacacaaaatcatcgactgaaaaaaatacctgtactttactatccagtcagaacaaactgtttctgaactgagaatcgtataagccactttaaatctaaaaaattttttaaaatttgaaagagcctaataaagctactagatgaagaaaacagaaaatgtcaaaacaccacaaatgatgaaaatctacccctaacaagaaaacagtctagaagtaatattacaaactgaattaaatatcctcaaacaactttgacttacagaagcacaagtgaaaaaccaaaatatacaaaagatcaggaaaaaataaaaagaaagttgatttaactcaggagagaaatttttaaaagatcacctcagaaatgaagattaaattaccagatgtcaaaaacagcaatttaataaggggcactaaagaaagacagaaacccaacaaagacaacagaaatgagatatagaaaaaattaacaaggattggtgaaaaagtggtttaaaagtaaggcaaagaaaatccaacatatatatagtgaaatttctgagcagagagacaaaataggtaggtaaatattttatgacaataacccaagaaaaattattggaagtaaaagaagtcccaagcctctatactgaaagagtgcacagtaccctggggaaaatgcacctgaaaagatcaactccaagacacagcctagtaaactattaaacttagaataaatactctcaaagccaaagagattgaataatgtacacatgcaagagaattagactatcatgatacttctcaaaaacagcatgcaaagcaagaaaacaatgtggcagcattttccaaaagctcagagaaagtattaatattaaccaaggacttcatagctagccatgtgtttttcatatagcaaagctatggaaaagtagctttcaacattcaaaaagccagggcatgctgtacttgtctttcttgaaggatctacagaagataagttcatccaaaaaatacgactgaggaaacttcagcaaaaggactgatgggtaaaagtttaatatgtttaactgtaaatctaagactgaaataaggtaggggttggatgaaagtaggatatataaatgttatgttttctgtcattgcagaaataatacaactaaaaattgagagagagagagagagaaagaggaagaaatagggaaagagaagagtagtattaggtcatttattgttgtacaggcagtgctatggtctggctttgtgtctccacccaaatctcatcttgaattgtaatccccatgtgttgggggagggaccttgtgggaggtgattggatcataggggtggttcccacatgctattcttgtcatagtgagttttcatgagatcagatggttttataaggggctctagttcctttgcttcgcacgtctctcttctgccaccttgtgaaggacatgtttgcttctccttccgccatgactgtaagtttcctgaggcctccccagccatgtggaactgtgagtcaaacaaatatcttttctttataaattacccagtctcaggtaatatctttatagcagtgtgagaacgaactaatataggcaatatgtgaaagttaatggataccagaaaaatctgacaaaccagatagcaaaagattaaacaagaaaagatgggattaagagtgctaaataggccaggtgccctggcttacgcctgtaatcccagcactttgggaggctgaggcaagcaaatcatgaggtcaggagttcgagaccagcccgaccaacacagtgaaaccccgtctttactaaaaatacaaatataagctgggtgtggtggcacgtgcctgtaatcccagctactcaggaagctaaggcaggagaattgcttgaacctgggaggcacggtttgcagtgagctgagatcacaccactgcactccagcctgggtaacacagcgagactctgtctcaaaaaaaaaaaaaaagtgttaaataatataaaagaacaaaggtaactactagaacagaaatacaagacttcctaaataccaaatgaaattttaaaataaaagagtaaagaaagcacaccagaaagtattataaaattaatatagtaaattatgacataaaaatatatggcagagttgagatatctcagtcatatcaccaaatgttaatgatttaactcaagtactgaaatgtagaagatattcatttggattacaagacaagacccaactaccttctatgtataaaagtcacatctaaaacattgttattgtaaacagtgctacaacaaacatagtcaataataatttatttgtacattttaaaataacagagtgtaactggattgtttgtaactcaaaggataaatgcttgaggggatggataccccattctcaatgatgtacttatttcatatcacatgcctgtatcaaaatgtctcatttaccccataaacaaagaaatatataaatatatcctactatgtaccctcaaaaatacaaatttaaaaaatttcaaaaaaaggtgaacaaaataattttcttcagaaaagtaaaaaggaaggaatgaaataagctataaacagtaaatgaaaaaataataaagatatagtagtgatcctgatataaaacaagaattcaactaaaaaagtattacacatggcaaaggatactttttattgctaaaatccacagctaacaaagaatataataggtataaacatctatgcccccaaaaacataatgtatttacaaagtcaatagtagtcatatataaaaccaatactcagaggacataagggtagcaaaaccccattacaatggcaacaaagatgaaatacttgctaatagcaagaacacacaaaacctgtataaagaaaactttacagcacccatgaaagataatgtagactcgaacaaatagaaagacatcccttatctcaggtaagataattcaacatcttaaagatgtcatttcactctaattaatgtataaatttaatgcaatcccagaattactaatagactttttatgaatctggacaagtggacactaaaatttatagggaacatgcaagaagagctagaaactcactgaaaaaggaaatctcgatggggaactttccctcgcagacattaaagtttagatcccataattataacagtgtggggctgctgcgtaaatagccacatagactggtgggatagaatacgacatccagaaaaacacccaagaacatatgaaaatttaaaatatgagaaaagcagcatctcaaattatcgggacaaaaatggacttttaaatacatgttgctaagacaactagacagacatttgggaaaacagataaaaattagatccataatttacatcacacacaaaaacaaagaccaaacatcagaaaactaaatataaaaatactaaaatacataagacttagaagcaaacatgggtaaattcctttatagcctgagtgtaagaaaaaactttttaactgtgattcaaagtttaaatgtaataaaagaaaaaaaatgattcatctgacaacattttatttgctgtggcaaaaatataagcaaagtcaacagataaatcacaaactggaaaaaactgcaacatatatcacagataaagtactgatatctctgatatataaataactttaaaaattgatagaaaaagtaaaaaacaaactgaaaattgagcaaaagacataaacaggtaattcaaaaattacataaaaatggctattaagtataggagaatatagcaatttcacttataagaaaaaggaaattaaagctatattgagatataatttcttacatgtaagtgtgacaaaaatgaaagttagaccacacaaactgtttacaaggcagtgaggaaacagtcatacattgctgggacaaatgcaagttggttttacccttaaggaaggaaatttagtgacatctagcaaaactgtgtattagtccaccctttaatcctacaattcctcttctaggaattcactctgaagacgcaccttcaacaatacaaaaatatatgtgcacaagttccttgatgcagcaacatttgcaactgaaagatattgaaaacaatatagccacacatgagagtggccaaataaacagctataatcacataatagagtactgtgccgggcgcggtggctcacgcctgtaatcccagcactttgggaggctgaggcgggctgatcatgaggtcaggagatagagaccatcctggccaacatggttaaaccctgtctctactaaaaatacaaaaattagctgggcatggtggtgggtgcctttaatcccagccacttgagaggctgagccaggagaatggctggaacccaggagggggaggttgcagttgagccaagatcatgccactgcactctagcctggtgacacagcaagactctgtctcaaaaaaacaaaacaaaacaaaacaaagagtactgtgcagctgtaaaaaaaaaataaggaagacatttatgaaataatataaagtgatacccaagtatctatagtatgttagcttttctataagaaggggaaatataacatacattgacttcaaaattttcacaaaaaaaaaccgccaagaaattaatgacattggtttccaacaggggatggtagaggtgatgtaaaagaagtgatatgtgcttttctgtatgcacttgtttgtacagctaggcttttagaaccacgttataatgtttttagaaccacgttataatgttttacatattaagaaatcaacagggatgggcaaaatgaaactaaaattaaaaacaaagagtcataaacaaacctaacttaatttccaataaatacataaccatattctagtgaaagaaaaaaaataaaccaaataattttcaacacaacggtttgcatatatttagactgaagagagaacagaaaatatatattgaaccctagttagtaggtttgttttgctaagattaatatttctggaaatacttcttgagtattctatgttgaacaataagtaaatatatgaataataatgaagttaagcttctcactgtcagagaagggaattacagaaatgggaagagtgaaggctggaataaactccttgatgttggactagaatggaggtatcatgaacttttgcctttttttttttttttttttttttgagacacagtttcactctcgttgcccaggctggagtgcagtggcgctatctcatctcactgcagcctccgccttctggtttcaagcgattctcctgcctcagcctcccgagtagctgggactacaggcatgcaccaccacgcccagctaattttttgtatttttagtagagatggggtttcaccatgttggccaaaatggtctcgatctcttgacctcatgatccatttgcctcagtctcccaaagtgctgggattacaggcgtgagccaccgcacccggccacttttgccttttatgatagatagctaaaggctgggtgtggcggctcatgcctgtaatcccaacactttgggaggctgaggcaggtggatcacctgaggtcaggtgtttgagaccagcctggccaacatggtgaaaccccgtctctactaaaaataaaaaaattagctgggcatgatggccggtgcctgtaatcccagctactcaggaggctgaggcaggagaatcacttgaacctgggaggcagaggttgtagtgagccaagatcacgccattgtactccggcctgggcaaaagagcaaaactccgtctcaaaaaaaaaaaaaaaaaaaaaaatagacagaaagatagatggatagacaggtagagggatacatagacaaagagcctagaatcagtggtactcactaacaatgattcccactcgttcccaggtctgagtttctataataagtaccattccccatttaaaggaaccagagctggggcaaaggaagcacaagattctgtcagaaagaaaataagttttcaagaactgctggagacatttcagaatgacaaaagaaccatcttgaaggggctcacactagctaattctgggacaatttgagcataaaagtaaatgatgatagtactgaagtataaccaactgaataaaagaagaatctataaatttttatcaatataaataaattaatacattgaaaataggggagaaaggagaactcatcctcggaatagatgtccactaataaatgtggaacaaatgatggaattagaaaattgtcatttggcaaacatctttttatttgtattattattattattattattatttattattattatactttaagttttagggtacatggatgaaattggaaatcatcattctcagtaaaatatcgcaagaacaaaaaaccaaacaccgcatattctcacttataggtgggaattgaacaatgagaacacatggacacaggaaggggaacatcacactctggggtctgttgttgggtggggggaagggggagggatagcattgggagatatacctaatggcaaacatctttgtaatagttgatttcaacaaaaaatatcagcaaatgctaaaagatgaaagtttgaagaagattttacatagtctagaaatatgtgtgtacaaaacacttatatattacaaagaaatagtagctttatagtggagaaaaccttaatggacaacagtttaagtaatcaaagttaatgtcaccagtaatggaacaaactgatatcatgtgccacctagtatgacacattgagaaggaagcaacatcacttttgtggtattcctgacaaaaatgcataacttgaatctaatcttgagaaaacctcagacaaacccaacttgagggacattctaaaaaataactggtctgtaatttttaagagtcaagggcataaaagtcaaggcaagacagatatgagaactctaaagggacctgacaactaaaggcaacatgtgaccctggaccaggtttttttttgttattgtttaaatttactaaaaagtatatgactgagacaattggcaaaactgaggctagtagtattatgtggacattaatttcctggtaattgtattgtagttatgttggaaattgcgcattaaagcatttaggagtaaaggggtgatttatagacagatagatagacaaacagacaaataggggaagaagagaaagaacaggagagggagagagagaaaatgggatggtaaatctattgtggtaaactgttagcaattagggaatctgtatagagagcttattaacattctttacactattcttgaaacatctctgtgcatttgaaactaccttgaaaaaaaggagttagacatattggtggaagagaaagtaagttggaacaaaaacaaatttgacgatgggttgatgatcattgttgaagctgagtgacgggcacatacagatcagtctgttatcatcttgacttttgtatgtgtgaaacgtttcttagctaacaacgtgtgttttaaaggtgagaacaatacatatggagtatgtcatcaataaaaaattgagacattcaaattttgtttttcccaacatgagtgacattgggtacattccttattttttttgacttacagtgttctcatctgtagaatgggagcaataccctctgtacaactctctagggtaaacaaaattttgtgagcacaagtgccttaaggatgcaaatatatatgcatgactttatgattctaataaattgatattgagattataggcaagacaatttttttttcttttccctgttttcaacagaataaatgccaagtattttagcatggcatacaaagcccagcattatttgatatctgcctctctctgggcttcattccatatcccggaaccaacaccgggattgtcttcccaaatgtatcagggaatccccaattttggggcttctgctcaggtgcttcctttgcaaaacatacactttcctctgccccactgtctacctggaaaatatccacttaccttctaatagccaagtcaaatgtcacttcttctacaagattttcctaggcacctcctcatcccctctacctccaggtttatagctgaacacaccaggtattctgccactgggattgctgataatttattgcccacatttgtcttcatggctgtcttctccactggattgtgggttcgctgagggcaggaactgtaacttatttatctgtattcccaactgactcacaacaagcccataataaataattggtgggtttttggggttttatcatcatcattcatatctccttacagaggagctcatgaccaatgaaggcacaattctgcagagtaaacaaatgcaaatggggtgtgggagactgggtttaagccatggctctgatcttgagcaaataacttccccatactggacttcagtttccttttatctgctgaaagaagagaactggacaatcaataagctcccttccaatactgcattttatacttcccattcctcaacaataggactttgaggctgtgtacaaactatcccctaattgagaagttggaaatgtagtttctctgcacctcatgaagagggacttagactttctattaggagctggcaaccccctggtttaaaccaacccaaaccagagcagtccttcatgcttccctgcgcagctcttatctgaccttaatgattcctgctctgtaagagatccattgagctgtaattactaattgatgtttgtaaagtctttgaaattctcaggtgacagatgtaatcaaaggccaatttattatgataattgttattagtacagctcctcactatttgttgatgttaatggcagggccagcaggtgtttcaagattgactgagggacttaggctggccatgtttggcgggaggaaaagaaaaatatgagtgcataagggatttgggaccctcctggttctagtgcacccatattcctctatgaagctatcttgtgggactagggctcggcatgaaacggagcagtaaatgcataggacttttaactgcatttttcacatgcacagattcaaccccagctcgttctcttgtttctggagtatgcttcagcaaatcatagcctctcacagccttggcttgcttgtgtgttaaatgagaatacatatagtgccaatttacacttgctgtgattcgagaatctgtttgagacaagcaatcgtggatgtgggaagaagcgttaggagactgttgaggttgtccaggcagaagatgttactatccagaactacgatggtggcactggagatgagaaaagtgcatggattagagagagcttcagagtgtagaacaaagagaacttggtgatggctgaatatagaaggtgatgtatagcaggaaacccagactttgctgataggaaagatgcaggaataactttgaaggagatgaatgaatcattgcctactattttcatcagtgtcttgtacatatggttcatgtcaatctcttcaactgtgtagcccaataaattgcatttatgggtttgcaaacttgaggaccatgatgtaaaagatgacacttgatgaaaattcagcctctaggaggaaagggactgcagaagaattgtcccacttctccacttgcctctccgtaagtacgacattcccaaacttcctttgacatctcaatccctctctttctttcaggcagccagtgtgtcagctgccgtctctggaaaccctggacttcactaatttttttcctcctcctgaattccctgatcccacgtcatgttcatactctattcaaatttgatccatgggtttaaaaactctgcccctgtggattctgcttgttctttcctgagtgtacctctatgctctatcccacctgtgatatgtaatagcaatatctgacattaattggatgtttattgcatgccaagccccgtgataagtgttttattcatcttattatttaatatttagaaacattcttataaagttgatactatgggtgttaatgttttccaaaagaagaagagactcagagagcctaagtcacttgcctaaggtcatgtagctggtcagtgacaatctatgcaacaggaaagaccccatgctagacatattaatcaaaaatgctgaggtgaaacaaacttggaaattcactaatcttatttaatagcattaatgccattttatagtgcaagaaatagaatccgtgagtgcaaatgtctccattaactttttatattttaacctcagatttcataggattgatataagagggactaattgagtgtttgagcaaaaatgttctgatgacattgaccagcatcaactcagggcttcttatacaaggatatatgtgataaatcaccctcttagtgtctttcatgaaaaatatgtatgcttccttcaagtaagagaagctatgcaaacctgccacctgctctttttttccttggcttcgaggaagctcaggagatacagatagtgtaccctgcgctaaccacctatactaggcctctggtgcaatgattactctttattccactataagattcttagactaatttaaactttttattctagggcctggtgcagtggctcctgcttgtaatcccagcactttgggaggctgaggcaggaggattgcttgaggtcagcagttcgagaccagcttggtcaacatggtgaaaacccatctctgctaaaaatacaaaaattagccaggcatgttgatgcatgcctgtagtcccagctacttgggaggctgaggcaggagaatcactcgaacctgggaggcaggttgtagtgagctgagatcatgccactgcaatctagcctgggcaacagagtgtgactctgtctcaaaaaataaaataaaagtaaaaaaaaaaaattttaattgaacatgtatacatacatactcatatatacacatacatctatatatatgcatgctaaaatatttatgtgtatatgcacatatgctgaattcttgttctgtatataaatttcataaaatttacagttaaaaatttagattcacatacccaagtgtttccaccaaagatacttcaaagttttccaataactgaattgagtatcagttttaacatgtgtgtgcacgtgtgtgtgtgcgtgtatgtgtgtgtgtgtgttttagcaagtatacctttacctgaaaggtcctttgcaaagagttatcacgcctaccatttacttgttacaaaggtcctagtgagcttgaaggacacatctcatccctgtttgacagaggggaaactgaggtttggcaggcaagtattctgtctatggagctaagaaacggaaaagccagttctaaaacccatggataccatttccaaattcagaagtttctctactttttcaccatctgagggcaatcagtccaagcttcacgaggttccttacattgtaggggcctgatggaggcagagatgctgctatatagaaactgaggctgctatttccatgaactttgttgggactggagtctggagcatttatccctgaaggcccaggctgacaagattatcagctgtcaacatttgggtaaccttcatctccctttccaaatgaatttaaagtatatttgcatgggaaggaaaatgttcctgctccctcaggtctcataccatgataataaaatctgtagaaactgtaagtggatgaaaaaataaattagcaacctgggagagctcatcttggtatctgtacaaggtgacacttggggaatttctatcttacctaaggagagaagtctgggccccaacagagctccagcaggggtttagagttttaaggctcaaacaatggaatggaggcctggaagcagggatgcccaagtgagtgggtaagccccaggagatggagtccactgaggactgggaaagagttctaggcagataaatggggcatggaacctaggctctggtgacagacaagagctgtgagtggatgtttacccgattgagattttcctaaggagtaatggaaaggttgtgatgataatcctggaatcaaagtgtctagttcagtcttcctctccacttcaacagggctctgcagagctaataaaatccaggaatcgattccttacatagactatagtgacaagtcagcaaacggttacgtgggggcctctgggtcacagctctctgttgccttggctcagctaccgatgggtggtacaggtctaaggtctgctgagttatagaagcattggaagaccgttgcttttcagggtggaacaggagcacattgagtttcaggcatttctttaccattcctccatggaggtaaaggggaaaagctgttactaaaatccctccttcagtgtgaagtaactgagaccccatgggattccaggagcctctaggtgttcgtccatctactgaaaaaatgtagtcactttgtgagaccaatcaaggaagcagcataggtgaaagcaccttgcttaatatctgagacacagcagatgctcaagcaattgaaattcctcaggatttgtggtatgaactgcccaggtgcttcaggagcaagtctgggtattataagaatatgaaggggaggcttagtcatcatggaaaattgtggtagtcattggggaagttctcaaatattccagttctcctaggcatatagaaggcactgccttattctttctgaaattaagtgtggccatgtggttagccttggccagtggaatgtgaaaatgctatgcaccactttgtatggaaacttgtagaacgaatgctctatttgccacatttttctttctcagacttggtggtggtgtcaagatggacattctgttggcctgagtctctgcctgcaacaagcagagaccctctgctgacccatttcaaatatatagcagaagtgatccagtgagattttgttgttgttactacagaataatttagcttatcttaaccaatataggagttttcaaataaacttcctgatggggtatccaagacccaaactgccatgtgatctcctgatgatcttaactcgaaccctctagagcttatatctacagcttctcattccatgtctatctgaggttttcataaggacatgcgaacagtcactgaactaacacgagaaataagaaatggggtagaaagggcaatatcataaccaaaagataagatcaattgtgccaaaagactcaacaggaacagatatcaggcttgaaactgtcagagacctttgaaccagagcaactccatcttgaataggggctgggtaaaataaggctgagacctactgggctgtattctcaggaggttaggcattctaagtcacaggaagaaacaggaggttggcatgagatacaggtcatgaagatgttgttgatgaaacaggttgcagtaaagaagccggccaaatcccaccaaaagcaagatggtgacaaaagtgacggctggtcattctcctgctcattatatgcgaattataatgcatcagcatgctaaaagccacttctaccggcaccatgacagtttataagtgctatgacaacatcaagaagttagcctatatgttctgaaagtgggaggaaccctcagttccgggaattgcccacccctttcccagaaaactcatgaataatccacccctttttttttagcatatcattaagaaataaccacaaaaatggccaaccagcagctcatactgctgctctgtctatggagcagccattattttattccttaactttcctaataaacttgcgtggacttgcctagaattctttcttccacaagaaccaagaatcctctcttggggtctggatccggacccctttccagtgacaaaaccatgtatgagaagttaaactaagaggaatacagcctggggtgagtcatgggtgagtcaaggcggtcatcagctgggacacagacacaagtcctaaagtcctccaaagttaggaaggtgtgtgcttctatgtggagtttactggacaaatcggtatatgccaggtaaggatgctccaaccctcttccccctcagaagaggagcctctggaaagcagccaaaagaaaaaagaacaaatagtccaactgtaatgcgataagatactttaatatacattgtctaatttactctctcccgatttttttgaggcagatcattaatcatattttccatcttgagatgttaagtaaactgttcaagttcacatagctgagagcagccaaaattcaaagccaagtctgtctgatgctcaactctcagttctttccactctatcatgccacagaaaacccatccatgtgcaaccatttctttaacagtggttggacacaagtgaatataatttctcccaattcattcagagacacagaattttccctaacctagctctacctagataatccccactattataacgtgattatactgcaagcatcatgaccaattcaacacagcatctggtttccaagtgctctcaagaggcaattgagttcaagaactggaggaggaagtaggagagagagaacaatcaccctgctacttcccacttctcttatttagcttagcatttggcagaggcatcatccaggttaaatgtacccctacatgatggaaaggatatgacaagaaaagacttttatcctctgcataaatagaacatgcataacagcattgcccaacaaaaggtggcttctgatggatatttgcatgagtttgccacacttgttttgcatccaaccgttaattatggtcctttcaacttcacaattacggctaatggtggtgaggatgcagagaacagtagattcagcagacctcattctgggaagagtgtgaaacaaacaatgcgaaactgcacccacccgctgtttagaactgagacagctaccctgggtaccatttggaggatttggaggaaatcaaggctgcccaggagcctggagcttgggaaatgagacatctggggaaaaaaatcttactactatgatggagaaaaaaggtcctttaggactcttttatctatggtgaaaatggctcaaacaacatctctcattctacgctgaatggaaattcagactgtactgacacctacttggtgcttttcattattcaatatctttttcttatttaatcctcaaacagactgtgtgaagtatatattactatttcaatttataagtgaggaaacagattcatagacaacaagaaacagttcatagtctcattctttcattaatccatcaaatgattattaggtgtctattatgtgttaaatagtacactcagcatggaggatatagcagctaaaaaaacaaaaaacccaaacacaccaaccacaattcatcactcttggagctctcagcatgctgtgggaggcatgcagtacccaacaacatgtgcaaataaaatacatatatatctagtgtaatatagaaagatagtgggttaacatatgagtgagtgctggtgggtggttcttaggtaatatggttggactcttctctggagatgtgagattgaaactcaggcctgaaaaatgagaaggtactagctctgcaaacagtgaagaaaagacagatgtaggtaaaatgcaccctgaattaagaccccaaagtgaaaaacatgttggaatgtttgagaaataatgtcttaggaaaggttcaagacacgaggcttagttaaaatctagcaggcatgtctgaaccatatctgaagaacagtgataggttctgggcaactctttttgaggagaacatgatggggaaaatgagcctatcagagaaaagggtaagtaggatgaaggatacccagaaattatgccatgtgaaaaataaaagaagtaatagcatgttaattatcaatgagaaataacttgagtggccagaggagggtagttggtactgtcttattttctctgaaaggctaacaaaggaaagaacgttttgatttgttcaaaccaatacaagtggctacaaggggagagtcaaggagacagaatttagctctatatgggaaaaaagctttaacaattttacctgctccacaaaggaatcaactccctttcactccagcaatttgcattgatcaagctgaagcaatacaatgtgttgctaagaatgctttattggagattttttttttggcttctcgtctagactagatgacacttcaaagtccttcctactctatgatgctatagttctataatattgctatatccaaaacaaatggttacaacatggtctaattcataagagacaggtgttgtgaattaggcaccaaagacagtgtgccaggacaaatgggactacatttttatctgtaagaaggcatcaatggataaatgtgagattactaattggaacaaaattcccaacacaagtgcctgtgaacaactcttgtgtcatgaaaatgcctgcaagaaccctgagcaacatatcttatagtgcatgccacacttgaactctgcatggtgttcacatggctggattaaaatacttcatattcacagatcaacaaagagtctataaaatgtctttatcctcatgctgataatagtaaacatttaatgactgacttccacattcctaatgtgaaacctaaggattcattattcgatacattatttcacttatttatttttgttctctcccccactagaatgaaaacacgatgagatcagggatctttgcttgactcactgctgcattctcagcactcagaaaaatgccttttttgacatattgcatgtgcttgacagatgtttccttaattaatccatcatatctaattattttagtagtttactgaaagtcacacagctactagggttttgtacctaggcagtctgatagtaaaggttgaattcatagccactctgttaacctgacaaaccatccttaacatccatagaacaaagatgtccagacctcagaattctcctacccttccttgactaaaacttgcaggtagagtagggagcaatgaaatttgctgatagtaaattattccacctggctcacaaccatcctgcaacaaatgcccatttctgctttcctttcacttgaggttaatataactctatctcatcctttgtctttaatcttttagtgacagaaatatgggtaattctgatttttctttgacctaagctgttttctttctctttcacaatggagcaaaacaacacttttttacccccccgtcaccccatatcaaatctagtgctttcatcttctggctttttttatagttttgattttcatgtttacttatagttttctttattttcttcatttttcttcgttgactgttgtttctcagctttttaagtatagattggagagctgactttgtttaaaagaactatactttttagtattctcagtatcagaaataaaacagtaattatgtattccctcttgtctaacatgagaaaatgagcagatttttatttacattcatccatcttccaactttgtcttagtttttgttgataaaatagtgaattatagatccagattagaactgttaagtttttacattatgcatctttgccttaagtagttacattttacattaaccttccattttgtaacacacttagagccattattgagcattaatgctatgtttaattagttttatgctcactgtaggtcttcgtattccacatttctcaattcttgatttctttattttgattaattgctcagtcaattgctctgtgaatgatttattagaagcagggaacgtgggagcccctggataccgagaatggctttctgatgtatttgcacacgaacaacaacttggctgataaagaatttgtggattataacactttctcctcaaaaatcctccaggcttaacatcattgtctgctgccctttatgatatggaaaaatttgagagggaccaggcagagatttgttagactgagaatggctgttctgcttcaatgaccctttcacccaactcttctcagtaaaatttaatactaaagacagtcatttgaaacagtgtgtagtttttcctttgccagaaaagtacagccttctgagtgcccagctcccattgcttttcccctgtctgttcctgtgaggtcaagtgcacccgcaagacatgtggcataagcactcatccaattccattcctgcctgtgtttcgttactgggaatcttagttacaaagcaagagtacatatgcatggtgtggaatagaaggcacaggtaattaaatggccttgttcatttctgaagcagtgtcaaaactgcttctgagatgaggcagtttcagagtgagatccttttttttttttttttttttttcctctatggcaaatccctgagtcttgaagagggaggtctctgatatgatgtttggggagcaaactgtcggaggcatttgaacctgagcaactccatcttaaataggacctgggtaaaatgaggctgagacctactgagatgcattcccagatggttaaggcattctaactcacaggatgagataggaagtcggtacaagatacaggccacaaagaccttgctataaaaacagcttacagtaaagaagctggctaaaatccaccaaaactaagatggccatgagagtgacctctggtagacctcactgctacactcccaccatcatcaggacagtttacaaatgccatggcaatgtcaggaagttaccctatatggtctaaaaaggggaggcatgaataatccacccttgtttagcatatcaaggaatagccataaaaatggacaaacagcagccctcagggatgctctgtctatgaagtagccattcttttgttcatttaccttcttaataaacttgctttcacttcactatacggacttaccctgaattctttctcacacgagatccaagaaccctctcttggagtctggatcaggacccctttcctgtaacaaaacctctgtggttggctcagggccaaccactcttatggtgaggacattccttctgatgtgcatttgttggtttcccgggttctatagccatgctctatttctaggttttctgagtatcttagtgggaagaataaagtaaagctacttctttcccatctcatcatggaaacccaaccacaacttttgatatgtgccaagagcagggaaagccacaccttcttagagggttgtgctgaactgataaactggccagtgtgggatgccgagaaccgagaacaagatgagtcccagatgcttctgccaatttttatgtcttcctgctcaatacatcagagtgcttcatgcagcgggaagaccagatggacaggtggaaggcagtctggcagcttctctttgtagtcttatgctctctgtgaggagtgttgcttgaaccagtaataaatgcagaactgaaataccacagtggaatttaaatgggtatgtggacattctaaatgttaattagttcctcaatccgggtttctcaccaagcactgactgccattgacagattaaactctcaatcttggccacccagagcctgcccaggctgttccccacacacttcaccaaatcttgcttctgtctcaggcttcccttctccagcaagcttctcagttctccatgttatacactgcataacaaggcacatgacagactcccttacatttctataagctcttggagggtacatactacataaacttaatatgaactgtagggcttagcatttgttggtgtttgttaaaagaaatatgaccactttggggctgggcacggtggctcacgcctgtaatcccagcactttgggaggctgaggtgggcagatcacgaggtcaggagaccgagaccatcctggctaacacggtaaaaccccgtctctaccaaaaatacaaaaaaattagctgggtgtggtggtgggcacctgtagtcccagctactcgggaggctgaggcaggagaagagcgtgaacctgggaggtggagcttgcagtgagccaagatcgcaccactgcactccagcctgggcaacagagtgagactgtgtcaaaaaaaaaaaaaaaagaaagaaaagaaaagaaaagaaaagaaatatgaaaatatgaccaccttgatggaaaatacaaacttgtgtaataaaacaggctaaagatatttagcttgcagaaaagacaatcttatgggcacatttatatagagaagaaaagggtgttagaaaagatcttatgtaactgaaagactataaaccaagaaggtggttgcattggttttgtaggatgctaagagtgtgaatcaagaacaatggatagaaacttcaataggaaatatttcagtaagtacattaaaaagcctccttagagacacagcccactccctactccagaaaacagtaaagctacctcagagataaatgagttctctgtcattggaggtattcaagaataagcactaatgccagttaattggtgttgtagtatggatagaaccattgttttgtgtgtgtttgagattgttgaatgacctttgatatgctttccagccctgtgattttctaatattatgactggtgccaatccttgaccaaagaaatatttgacacaaaaatggttaccttgcgtgaacccgggaagcggagcttgcagtgagccgagattgcgccactgcagtccgcagtccggcctgggcgacagagcgaggctccgtctcaaaaaaaaaaaaaaaaaaaaaaaaaaaaatggttaccttgtttttgtttttggagaaacactattttctaatgtgaccaatggcaatgaaaaagggcgtattaatcactaatcaactaaaccatgattagtgcattcctagatagcaaattgatagatattattattatatatgaagaacttaaggatcagagaggtcatgtaatttcctcaagtaaagcaccatctctttactttaatacaggagtgtgcaaaggttttatgtaaaaagccatataataaatatcttaggctttgtggagcatatagtctctgttacaactgttcaactttactgttaagcatcaaaacagccatagacagtatgtaaatgaacaggcatagctgtactattatttttttaatttaaaggcatgaggtaggatttgccccacgggccttagtttttcatcctctgctctagagccctgctgacttatcatttgagaatgaaaaaatgcaaacaaggcaaggaatggcctccatgtggccatacttactccattggctttgctgagtgcctggaagtagatgctgtagcttttcaggggagagagaggagggttccagtagccattgtatgtcttattgtcacccactgtaaatggctgggtgacaggcaggttggcaggcttcaactcagcagcaaagtagtgtagagaatcgaggctggaggcattccgatagctcacgggcaccgaaaagcactcaataatgtcagctgccctccgtgacttctgaagtcgctcctccttgacaaccagctgataaacactggacaggaaagaggagacacagatggttgagcaactttctggaagaatgagcttgttagctctaatggtgtcaacccaacttctcctatgtggaagcattggttcggtctacaacaaaactccagtcctgagcatcagattttcaaacctaccacgttgtagaactttacctccacttagctgtctcagagccagctcacactagacacatctaaaactcaacttagccccaacccctacaaacctgtctgctcctccttctacatttcctttcttagtaaatggtagcagcatctgacaagtggccagaatctgaatctagggctcatcctcagttcttaactccttcgttctcactcctcatcctaatcaacagccttacagaagtctgttgatttggcttctgcaggtttgcatctgccccacctctcttttctccttccactgataatgccttggttggacactttcccacttacccagattcaactagtctctttgcctctaaggcacttgatttattaatcactcatcctaatcatatggcttcctaatcatatagctcttcaaacactttcataggccttccattgtccaaattatacaatctgaactcctaatcttggcatttgaagtcctctgtgcctgccttctgtcttccatttagaaggtcttctcatggtgttcccatcttccagctactccagaccccatgctattgcacagacatcttttggatctcacctcatgcattactgacttatgcttcctctacctgcaatgccctgcatcctggccacctctggtttcctccaaaggctgagcatgtctttcacttcctctatgaagcctgtccagatatgtccagtctggatgaattacctccctctttagttcccctagagctcatctaatctccatctgctttgttttccaatatcatgagatgggactactctttcactggctagattgtgaccttttacaaagtaggcattgttgcttacttatctctgcctcattctccacccccaccccatactgcccagcaggatgcctgtcacccaacaagtgatcaatgaatgcttgttcaaatgaattaaattggattgaattaaaattgaaagcaaacatgaaaccaaatctgcctggatgcagaaaccctaatcggataaacagcgattgccttgagttcctgtctagtgatctcatattgttcccttcaagttagaaggatgtaagaagatgctagtgtgtgaatagagatgactgatcctttattgaatatcaactgatacccaatgttagactctctttgtaaaagttcttttaaggtttgtaagttggagaacatttttcaatctctttgaatgccccacagtttatagttctctggaataaatgctcttcttttagaagagctttattgcacagatctctgggactcatgatctaaaacagaagatcgattgcccaaagagtacccactggagacttctgtgaattaatgaggtggttgcagtaggggaccccaaaccaatcatttaaacagggcatagtgaaccagcatgtggtttatcaaaaatgaaacgtgttgcaggctaccatccttcaatcagactatccatctaaagacacttgattaaggagtacaacttgggagatgacagagacacaggactatttcattaaggaaaaaaggctatggagaactgccctaagaaaatgtgacacactcaatatggcaagttttcccctgaattttcttgagcataggaattttcaggcatgcgaaaaggaagcgctgggcatatgagtatatgccacacttagatgagtgcaggtaaacagcagctcaatgaccatgcctgttgtacatacacatctgagtaagaacctgacagttcagagtgcatgtgagtgacatgcgagtggatgtggacaatctctcaagaaatgcacactacatctgagggtgtaccatttccaagtgaggatctgtattacctgggcatctaactccaaatgagtaaatataacattcagatgaacgtggctaacctgagtgtttagacttctaaataagtgtgtgtaacatctgagaaggtgttaacaatccaaagtttgtgtgtgggtgtgcaccatctatgcatgttcataatgcctgttgaagtcaataaacgtttaaattaaattatgatttcaataatcacttcctcctcaactctggggtccttctcaactgtacaattcctatgtttatcaggacagctaagctcaaagcagtcactgaaaaatagcacaaggacctaatacccaaacctagaggttgcagggcagaagtggaggggtgtttgtaacagagttttcaggacctgcactgctttataaataacaatatattcaggtaaatctttgaatctggcttgaatgctaatagtagctcgaccagttgagggtccattacttgtgggactctgatctgtgagggaaagggcaaacacaaaagagcttcatgaagcagacaacctcttgggctctcctgctgaagctaacaacagacctaagaacactgcattggatttgggagcatgcaaccaaagcagtcctcatatcctcttcagcagattagaaggaaccaatagcctcatccccaggaccaggagttggaaagagctgggagtccctgctttcttctgagggccagcctatccctaatcaccgcttgaattgatcacatctacataacaaggcctttgtcttgctttctcagacagacttcccattctaccttaaatccttctgtcatctttcccctctaaattgagacccccgaagccttgggagcttccctgggactgaatccccctccaagaatcagttcctactgtctctggccctcccgtgatgggatggatcaagaggaaccacatggctgtcctcatttactgtccacaactagcataagattccatagttgtggccaagcaagaagatgggttctcactgggctctgaacattcaaatgctgccaaggactattagacacagccataatatctctgtgagggtcagcctgtatatccccatcagctctttctccccaccaatctgattactgaagatccacttgtcaattcaaccaagctcaaaagccagattacacatgaggaggctgaggccgagaggtcaagtgattcatgagggtcaaactgcagcaaaagtagaaacccagacttttcattcatagctcagtatccttcctttttttttttttttctattttcttctcttcctacaaaccaataaaacgtataaaggggcttccaagcatttttttttaacttggcatcctaaactgcttagctctatcccaaccaactccatatgaaattacaaagaatagcaaagggtatttttttttggtttaaactgtgcagtcaacatatggttcacatacgattgtgattattgtgccaaaatatacccagcaactccttcaggcccatgcattcacagcctgtccattcaaaagcaaacctgcaatgcagccagaaaaatttaaatcattttgttagataaatctgtttgccagtggattcagcctctctcaaagaccacagaactctgattgaagaggtggagagaagaaacagcactcacaagttgtataactttcctttcctgacactttttaggaaagggtgggggaaagaaacaagaaattgggtattatttgtatttcttgcaatagcttcattctcattctcttgagaatacatttatctaagagcatgttcttttcagcttgctggtaatgataaaatcatatccaaatgtgaatgacctcccttttggggtcatatctccagctcaaaaacagtggttgcaataatctattcagaatcatttttaaagagaaaggatttttttagtaggaaaaatcccaataacatgagagaagaataacctaagacactcaccacacagcacatagcatttactcatacattttctcctcttgtgacaccctctctgtttcttccaatgagaagatgggcatttatgacctgttttttcattacttatgccaaggatctcttattgcaaggatctaagagttatactgtgcccccaactaatttcattcactctaaggtgacttctgtaaggtcaaggagagtttgtactcttactttcagtatctcctgctgtccatccaaggcaaaaaccctcagaacctctccataggctttggaaaagcctgctgcttgaccatcttcctccctctggaccctaagctaatggtttaaatggtggcttgagattctcggaccagattccactgagggggaccagggacctatcagagcctccttccatcagtaacagttcctgtggccctctttctatatctagaaaagtttctagctaggaggtgtatcctttcagaaagttgaagtcaggtgacagatggagtgtatgctttagctcacaggtacagattgcccaacttcagaaagatgcatattttagtccacgttctcccagaaggaggcatgtctgagttcaggttcttccagaaacagaccctgagccaaagtttcactgcaaatgatgtattgaggaagtagtcccagaagaaactagtaaaggagtgagagaaaatgggaggaagtggagcaagggtgtgatatcaggcaaagtcccagtcttagcctgatctcatagggagctctggagcataaattatacccccagcatttgtctcatctcaaaccaaaggcttttgaacctccagtgctggtcagttattggctatgtctgcaccagagagacataaactctaaggcactcctaactttgtgtgagggtcagacaaggcggctctggcatcttaatggcaacatcccacagcaggtcacacctggaagccatttacatcaaagcacatggaagctgggagacggacacacagcagaaaaggggaggtgacagtgtctgggaggccagcaagagtggctctgacagggcagctttggacaatgaccatatgagacttgtgaaaggatcagagacctattttatcaaggtaattttcaaactttgtttccagcactcctcatctgagagatacggtaatctctcaccaatcatagtggcttctccatcactgattcttcaagtgagggcagtgaacagtcatctcagaatctcaatggagggttgctcaagatcaatagttctcaacttgtggctgcatattataattacccagagggctttcagaatgcttattccttggctctactacagatcagctgaatcagaatctctaggggtaggaccctagcatcagtactttttagaaaagctctctagatagttaaatgtgcagctacaaaatcataaacctaggtgattctgatgtttatacgcttgcccttatgtttattctgatatttatacctgtatagccaacaggggcattcccctccagtattctcactcccttggaagacacactgatttgagtcattccaatttcaccaaagcattaatacataattaccagtattctgagtcgttgtacaccacatctcctgatttatttcttccacagcttttatcataattgaaacatgtcttatttaattatttgtttactggctttactgcttgcccccaaataggctgccaacttcatgaggtctgagatcttgtcatctaattcattgcttctaataccatactagacacataatggtttttcaataggtatttcttaaaaaaaagaatttaaggtcgagcgcggtggctcacgcctgtaatcccagcactttgggaggccaaggcgggtggatcatgaggtcaggagatcgagaccacggtgaaaccccgtctctactaaaaatacaaaaaaaattagccaggcgcagtggtgggcgcctgtagtcccagcttcttaggaggcggaggcaggagaatgccgtgaacccggaaggcagagctgcagttagccgagatcacgccactgcactccagcctgggtaacagagcaagactctgtctcaaataaatggaagaacatttcaacaaatgttaagactccgatacaaacaaatggaagaacattccatgctcatgggtaggaagaatcaatatcgtgaaaatggccatactgcccaaggtaatttatagattcaatgccatccccatcaagttaccaatgactttcttcacagaattggaaaaaactactttaaagttcatatggaaccaaaaaagagcccgcatcaccaagtcaatcctaagccaaaagaacaaagctggaggcatcaccctacctgacttcaaactatactacaaggctacagtaaccaaaacagcatggtactggtaccaaaacagagatatagatcaatggaacagaacagagccctcagaaataacgccgcatatctacaactgtctgatctttgacaaacctgagaaaaacaagcaatggggaaaggattccctctctaataaatggtgctgggtaaactggctagccatatgtagaaagctgaaactggatcccttccttacaccttatacaaaaatcagttcaagatggattaaagacttaaatgttagacctaaaaccataaaaaacctagaagaaaacctaggcattaccattcaggacataggcatgggcaaggacttcatgtctaaaacaccaaagcaatggcaacaaaagccaaaattggcaaatgggatctaattaaactaaagagcttctgcacagcaaaagaaactaccatcacagtgaacaggcaacctacaaaatgggagaaaatttttgcagcctactcatctgacaaagggctaatatccagaatctacaatgaactcaaacaaatttacaagaaaaaaactaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttaaaatggcagtcattaaaaagtcaggaaacaacaggtgctggagaggatgtggagaaataggaacacttttacactgttggtgggactgtaatccagttcaaccattgtagaagtcactgtggcgattcctcagggatctagaactagaaataccatttgacccagccatcccattactgggtatatacccaaaggattataaatcatgctgctataaagacacatgcacacatatgtttattgcggcactattcacaatagcaaagactcggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactatcgcaaggacaaaaaaccaaacaccgcatgttctcacccataggtgggaattgaaccaatgagaatacatggacacaggaaggggaacatcacactctggggactgttgtggggtagggggagaggggagggatagcattaggagatacacctaatgctaaatgacgagttaatgggtacagcacaccagcatggcacatgtatacatatgtaactaacctgcacattgtgtacatgtaccctaaaacttaaagtgtaataataataaaataaaataaaaataaaaaaaagaaaatataaattacagcaacaatgagaaactatcacacacacccattataacggccatcagacaaaagacagacaaccagtgtttgaaagaatgtggaaaaactggaaccatcatacattgctgttggaaaggtaaaatggtacagtcactctgggacacagtctggtagttccttaaaaaggtaaacataaaagtaccattcatctagttattccatttctacctatctatccaaaagaaataagacatttccacacaaaaacttgaattaaactgttcatagaagcattatttataatcgccaaaacataaaaaccatccaaatgtttatcaaccaattggtgaatgggtaaacaatatgtggtatatctatgcaatagaatattattcagtaacaaaagaaataaactactgctacaatctgcagcatgaagctccaaaacattatgctaaatgagagaaataagacgtagaagactacatattgtatgattctattcgtatttattaagttatggagaaaaggcaaggccatagagacagaaatcagattagcaattgcctgggactggaagtggaaataggaatcaattgtacatgggcataggggattttatggtgtgatgaaaatattctaaaatgggactgtggtgatagttgcacgatcctatacatttactaaagaattgtacacttaacataggtaaatttatggtatgtaaattatacctcaataaagctgttaagagaaacagactgaataatcttcaatgtcctttcacacttcaaaagtctatgctttggcatttaagtatgcacaaattttaatacaaaatgctatgataaaccattggttttataggataagatgggctaagaaacaagtgtgagctttgtaatgcccaacagaatctagctttgcaattacattccctgcttaaaggtcactcagaactatggagctgaaatttacaatgatatgtcttagttagccaacctttcttccaagactctgggaattcctgtttttactcactatttgcctagtcaaaatagctcgcagaggagacaagaaaatgggaggaggtgtacattcggcagattagtgtcagaattagtgcacgtgcatctttgctttgcctctgactagttcggcgacctattgtcctatctgtctgtcttttatacatttattcatcagacatttattgggtgatgatagctcaataaagtaaacatagcaggttcaaatttgaatgcaacctggccactgggtactgggtgcttagagctcagagtggagaaataatgaactgttcactataatccaatgaagtgagggcagcaagaactctgccagggaaggattctgggaaggaaggaacctacagggcagtgcaaagactgaaattacatgtctaggaagtgcattctagaaagtgctctatgaaagttggctggagccttcacaattgctgcatgcattattattacaatattactgaattagacaccaaagagtggctttgtttcttatttgggcccttctcctatgattgaattgcatttgatacatttaatgaaagtgaattttgtgtagaaatttagaggaagaaaatatgttgggtaaaggaatcatgaaaatccagttgaagcatccaaataagttttccctcaatcatggctcttctctctttcaaaataccatagattcagtccataagcaattcccatggcttcagtttcaatatactgtatattgagaatctgactgcttctcagcatcttcatagttacagctctgaactaagcttccatcatctcttaactggattattgtaatagcctcccaactggtctccctgctttcacttttgcccccaaaatttattctcaaaacagtggctagaatgactccttaaaaacatgactcagctcaagactcccctctgctcaaagcccccttatggctctgaccttacttagagtaaaatgcaacatctttacaatgtctacaagactcactcttaagaactctctgatcttactcttctaattcttctccagttacactggcctctttgctgttccctgaacaccccacacacgctcccatttcaaggcccttgctctcgctatccccttccttgaatggtcttcccttggagataggcaacctaaggaaggcttactttttcacctctgccagggaagtctgtcctgaccactttatttaaaatagcaaccgaaatccacaatatagccaattacactttccctcttaatttttacctaccacacctaacagattaggtccttttaagagagaactgtaagcactgcaaatgtcaaccttcctttgggaaaaagcggctggatcaatatggggccagttaggcaatatttgggtagataaccttgatatggggacctttgctaaagcaaggtggaggttttagtactggcttcacactcgctgctctgtctgccatgctgagaaagtcactttacctctagaacttgcctctaaaatggaataattgtgaccaatgcaataagacacaaaacagaagagatacacattttagaaaggaaagcaattcatcgtcatttgcagataacatgactagacctaatatattgaagcaaatcaactgaaagactgttaaaattaataaaagaattcagtaaagtagttttgtagaagatggaaataaatacactgtacaccatggaaaacaagctagaagatgtaatgaaaaagccttttagaatagagtcctttaaaaatagctaaggaaaacacaaataagaaacgtataggactgacattggaaggaaaataaaactctactgaatgatttaaaagactatctccagcccctagcacacggcttggtagagtgggtgttaaataattgtgctgaactgaagatgaataaatggacagaaaggctgaaatcctggaggaaagcatcatatattgtaaaaatgtcaattcttgccaaattgatgtattgttttctttgagaaaaagcaaattgtataaaatatgagccagttaggtgatatttgtgagccctaaagatgtggatggccataatttgacaattccagtaagatttgttttgttcaaatgggaaatatggttaagaacttaaaaaaaaaaaaacaacaaaggaatgaggctgaaaaaccactactggatattaagttatattatgaagttacaatgattaaaccatgggtactagagtatgagttaaataaaaatggactaggtaggggtgtgtgtgtgtgtgtgtgtgtgtgtgtgtgtatgacagagagagagaaacatataattttatgtataaaattacacgcaacataaattaatgaaaaagaaaattttatcacttagtgtttcagaaattccataattatgagatgaaatcatcaaatttaagacctcgctacatatgaaaaaccacattatattccaatagttcagaattaatttatttactgaaaaattttagtatgcccttgccaaccaaatacaatgtgtgatccttgattggatcctggattgaattttaaaaagctttaaaggacaattaattgggagaattggggaaatttgaatgtgacctatatattagataccagcattatgtcactttgaaatttcctgagcgtgatgattgttttgtggctatgtaacagactgacctttccataggagatacaaactaaaggttttgaagcgtcatggtcactacaagtaaccctcaaatggttgaataaccatttgagagacaagagaaagagagagaaactaaatatggcaaaatgcttatgactggcaaatctatgggaaggatatgtggatggttattgtctcattcttgcaatatcctgtaggtttgaaatcaaagaaaaagataatcttgagtggaaaagaattgtttaagcttaataatagaacaatttacaaaagacaaaagaaaaatgacagatttgtctatatgtaaatctgaaatgtctgaaaacagaataaaaaataaaacaaccaattagaaaagctattcccagaaaatatgacagagaaggaagcaatattttaatattttaaaaatcatatcaggtacagcggataaaaatgacaaaggacacacataaaaatcaataaattatctgaataaaggtatagtctatattctgtatatataatgggatagaaccagaaattgctaaatcaaaattctgcacaaatgaaaacctccaactggggaaaataggaacttaccttatatgatgccttataagtaattctcatatcaaatagaaaatcaaagccacaatttcctgctctttagaaactattactgtgagaacaataatgtttaatgcttatgggacaggaccaaacctgttttcagcatctgaaaagcctttgttactaaacaaaaaagaatgacaataaattaattaagcattccataaagagaaaattagaataaacaacactagagccagatggcttttccaatgagttctttcaatcttccaggaatggataattcccatgtcatagaaacaattacatcagacagaaaaagaggaaaagcatctcaaattgttacaaactattcctctaacatactattaaattggtgctccataagtggatcatttactgcaggtacacaagacagatttagtaatagaaaatctaggaaaatatcacataaataaatccaagtagaaaaaagaaaagtacgatcatataagtagataccaaaaaggcacttgataaaatcactcattttaaaagagtcataaagataaactatagaatataaatagttttccttttcagatttcaaaatacctatttcaaatctacaactaacattatacgtaagagaaatttgctggaggtctagtgtttgaggttggaatttagacaaaaagttcagctattaatattatttggcaacgttgcccggaaagctctacccaaagcaacaaaacataaaaccaaaacaagagctattgcaactgtaataggaggacataaaattatcattattcatagatggtgtgattattagctggtaaaccaagataataaaacttaattaaagaaactcacaagaggtttcagtgaatgagatgaagaaaacacacacaccacacacacactctctcacacagtttccctaaataccagcaaaaaccagttagcaaacacaataggggacagatagcagaagacaccacaagcttaatgttagtaaaacaattttaacaaggtagctatggatggagtctacatgagagtcaatgcctacgtcctgagaaatagtcaagactcagatgaatagataggcttgccctctttcagtgtggaaaagctcacgttaatacatatagtcattttagattaagcaatagtcttaatataatttagaccaattccattggggattgtttagagaatatgataaagggatttaaaaattcatagggaaacataagtgggtaaaaatagccaagaacattttgaacaacaagaaataggaagactagatattaaaatgttttgtaaagctatattaaaatgggtgatacagacacagtgaccaacagagaggcagatctaatggaacagtataaaccaagaatatagtggcacacacacacacacacacacacacacacatacacacacacacacacacacaggcaacatcaccgttcagtaagactggaaggagtattcaataaacggtgtggaggaaatctgtcaactacttggagaaacaaaagaataaatactccccaaacatcattaaaatggtaatagctatcatgatatgtggcaaaagaaggatgcaacattatcagggaggatcaaccttacataaagcctattttttttaatttggtgactaaaaatagggaaaatttcccaaatgtcagtattttaaaaattttcctatcatttctatataagcatgcattattttgtggtgactctaacttaaacatcatttaaaataaaatgataacattgtatgaattaccttagtattgtgataaggatcaaagataggaatatgaaaatactttgaaaatatttttttaatttaatatgttacaaaatagctgtagtatcatatttttaattgatggatggatttatccacatgaacgacatggcataatctatgcctaatactctctacccagctgggcattgttgactattcaatgtttacgaaatagatcccatccctacttgactccagaagtgctattttctaagtacatgttgaaaagtataatttcaatcagtcaagaatccagtaatgtataaaagatatttgactcagcttaaaataactggctgggagcggtggctcatgcctgtaatcccagcactttgggaggctgaggtgggcggatcacctgagatcgggagttcaacactagcctcgccaacatcgtgaaactccatctccattaaaaatacaaaaaaattagctgggcgtggtaggggcacatgtctgcagtcccagctgcttgggaggctgaggcaggataatcaattgaacatgggaggcagaggttacagtgagccaggatcacgccactgcactccagcctgggtgacagaatgagactccatctcaaaaaaataaaataaataaaaaataattaaaatatccactagccaacagctctattagcttatgttaataactcaattaaacaataactttaagcaagtctatgtagtctatgtaggccaggcacagtgtctcatgcctgtgatcccactgctttggaaggatcaagtttgatgctgcagtgagctatgatcacgccactgctctccagcctgggcaacatagtgagaccccatctctacaaataataaacttgttttttgttattgttatacttaacaaatagagcattcaaagcaaacagtgctaaccaacagaagcaagaacaagcagaatgctgcaggggccctgctcctgtgtagtcacagaccagtagcatcttcatcacctaaaaagaaatgtgttggaaatgcagagtcccaggccccacctcagctctattaaattagaatgtgtactttaagaggtcccaacttatttcatttgcacattaaattttgaaaagcagtaatgtgaaacagaacacattaggggactggaaagcttgctggtttttgttttgttttgttttctaatatacattctgaatcattttctgtaccctagtggagagccaggctgttttctttaccccgggcctctcaaacctcagacatcctgggaagcaaccccctttatactcctgtcaagttctcagttgaaatgtcgttttctaaagttaccttacatggtgagaggagcaaataaaaaaaatcaagttaaacaagactagcttccatggggattcagctcctaacttggcgattagaacccacagcaatgcttttacagaggaagatgttattgtttttaaaagagtaatcagtagggcgcctggatgtctccccttgcaacaaagacatttgcttaaggaaaggaaagtatcaggtgaaatctctctgaacagtttttttttttttaaatataataccatctgaaatcaattatcttcaaaaagcccttctaagctctaaaaatgtaaatggaataattactaattaagcattaaattaatcgtaatagcaggcatacttatttgccagatagggcaaacaaatgcaagagaaaaattataacaccagttgaaatattcttcttatgggaagacgtaacctactgttgaggattgcagaagtgcaatgaggtgaaaatcgtgtatgcacagagaattggaggttctcatccatccaacaacagaattgcctgtgaattctggattcccatgatagacctctgagtgtgaggcttgggaatgcaaattttgaacaggttcaccgtgatattcttatatataccaaattccagagatgtcctttgggagttcttcagacccattcaatgattctgtaacactgacataattgtaatagtaatactaagacttcatttgcctttttccactttgttaatattgaccctggaaaggtaggcaatactgctggtgcctcaggagaactcaaggcagtggtacccaactgtacttgtcattatattcttcaccacctcatacttgctataaaagcaaaaatgccagtttcacttaagaaggtcctcgatgaagcagtaaaaagcattaattttattaaatctcaacccttgagtccatgtctttttcacattcatgtgatacaatgggcagtatacacaaattatgtctcctgcttgttcaggtactatgatttcttcaagaaaaaaacattttttttcttgtttttgagatggagtctcactctgtcacccaggctggagcgcagtggcgtaatctcggctcactgcaagctctgcctcctgggttcacgccattctcctgcctcagcctcccgagtagctgagactacaggtgcccaccaccacgcctggctaatttttttgtatttttagtagagacagggttttaccgtgttagccaggatggcctcaatttcctgacctggtgattctcccacctgggcttcccaaagtgctgggattacaggtgtgagccactgcgcccggccagaaaagaatatttctgtgattgcttgaactgaatgctaaactagccacatttttcatgaggtacctttttgttaattcttgaaagaatgactaacgaactgtggtcattcagatttgtatatgtggaaaacattttttttttttgagaataaacgaagtctctctgtcactgtaaagaaaactgacagtatttgttgtcaaagacataaggcagctttcaagtgaaaactagaatttggaaaacttgtatctgccactgtgaactgtaaagatcttcaataattaaaaattttaatgatgaaattggtggtgacagtagcaaatgtaatattttgatatggtacaacaagatatataaacatttggaatttttaaaataaatccatgaatatttttcaaatgaccaatgcataacgttgcaaaatcatgtaaggcaaagaatgcactcaagtgcaagacagatataaattttaacgtaaaagagtataaaaagtttactgatatttcattgcaactaaactttaggaaaccaccactctgagttttggtgtcatatgagaggagaatacccacaatgatcttaaatggctattaaaatattcctccttttttttcccaattatgtatctatgtgatactggattttctttatttcaaccaaaacaattcatgaggacagattaaacacagaaacagatatgataatccaattatcttctactaagctaggcattaaaaaagatttgcaaaatgtgaaactgtatctcttcaccctaactttattatttggggaaataaaaatatattatttatattaatatgtataggcttagtttttttgagatggagtctcgctctgttaccaggctggaatgcagtggtgtgatctcggctcactgtaacctctgactccctggttcaagcaattctcctgcctcagcctcccgagtagctgggactacaggcacaggtgccaccatgcccatctaatttttgtatttttagtggagacggggtttcaccatgttggccagaatggtctcaatctcctgacctcgtgatccacccacctcgccctcccaaagtgctgggattagaggcgtgaaccactgcgcccagccaggcttagtattgtttttaaatgaatttaaatatttgttaacatgtggctttaattccttttcttgagatggagtctcgctttgtcacccaggctacagtgcaggggtgcaatctcggctcagagcaatctctgcctcctgcgttcaagctagattcttctgcctcagcctgctgagtagctggaactacaggcatgcaccaccacacctggctaatgtttgtatttttagtacagatgggttttcaccatgttggccaggctggtcttgatctcctgacctcaagtgacccgcccaccttggcttcacaaagtgctgggattacaggcataagccaccatgcccggcttgaatttggctttaatttctaatacagtaaacattgatagacaaaacccacataaacaaaagttctttgatgccttcattaatttttaagagtgtaaaggggtcttcaaatttaaaagatcaagaacctgtgaatcatacatttttttaaaaaaaagtctattaagacccccatggttcagagtttctcaatcttggcactactgacattttgggctggataagtcttcgttgtagggggctggctgtgctgtgcattgtgggatgttcagcaggatccctgacccccactcactaactagatgccagtatcacctccgacttgtaataaacaaaaatatgtcctgacattgccagatatctcttaagggacaaattaacgctggttgagaaccactgccataggtaattaggaaaaggatgtaaaaagaaaattcacaaaaaagaaatgttaatagcataaaaatacctagaaaaatattctgccttgccagtaagccaagacatgcaaatcaaaatgacaatatgttcccatttaaatgcattaaattagtaaaagtaagcataaattataacaagccatttcagtgaagctgtggttgaactggtaggattctacaattccagtagcatttttaattgattcatcaaattggggaaaataatctggcaatggttttcaagacataaatgtttttatgacctggaagtaaaaagagcataggctcaggaatcagcattaaacttgaattttagctctgaatctcactggttatgtgatcttccttaatttatttaaatgatagcatttataagaactgaatacgataataatgcctccatcatttgttatttgagaactgcaatagacaataatgtaagtgaacttctagttaaaagcggaagaattaatgtactccatttacctcttctatctcctcactgttattgcagtgaaatgtgaaaaagcatagaaatccacaaggaaaaagaggacaggagaggggacatcagtggatgagcagttttaagaaaattctggaaacctaaaaatggtcagaggagaggtaccacatgtgatgagataaagaaagtcaaattgcaaagacatgtgagtaagaatggattttatttgccccacagatttcaagagagattctgatgttggagtagtcaagtgtggacagtgtggaagtaaaatgtggggctgaaaaggggtgtttatcaaaagtctgtacacaaaaccatcaaacctttgaacatggagagctatgtgtctgccctctaccccttaggcaggagataggaagaggatttcatttcagaatttgaatgcctccgcctccaaaagcacagcacctccagtcaactttctcaacaccttacttttaaatattggctatggaggttcactggttaggtaagcaatgcttccaacatgaaagagagcagtgaattaaaaaaaatgactctagaagaaacagagataatacaggagtcagaaaagcttcccccttctccaaaatcaaaatcatatcctgagatgtttgagaaatgattacttctataaataagaagtgaatgttataagaaaaaaaattcaaagaacagtaagtagctcaaaatgaaaaattatgactgccaaaattataaacaaatttgagaatttttttgagggagttgttctgttttgttttaggaaatagaagaaattggcagaaaagaaaaggggaaaaagagtatttaaaggcaaacctaaaatgatggagttctgtgggaggaaaaatgtatgaatagtttaataaataaactgcctgaagaaatgagaataattgtacattctataacgaattaaacaaaaaagcccacaagaagagtaattagaagtagtataacatagtagtacactccagactgtggggctagaccattatgttcaaatttcatatcggctgctactagctgcatgatcttgagcaagttagttaacctttcagtacttcagtttccccatctgtaaaatagggataacactagtttctacctggtagggttttgacgataatcaactgagttaatatacataaagaacttaaaatcttagcaagctttaaattaattatgtaataatataatacttacatattatattatactgtaaaagaagtaatataccatttggctctgaagtgacctgtttttatggaattgtaaagttggccattgtgtagttatttaacaaaaaactgtggcttaactacattggaaagaaggaagggaggtattggatgatttaagacagacaagttaccatctatcatagcaggaaataaatagataatgtctgcaatcgataactttaaaatagcacattatgtagtgacattgccaattcccagaagaaagagcaaagaattaaaatgcatttgcctctgaggcacaggactgggggagggggggttgtaaatggtggtgttgggaatggttgggctatttgattttccaactatgtgtatttgttactttgagattttttaattaaagaatgaaaaaggttaatgtatatgaattggctgtcagtgcctggcatattagagaaggcactcagtacactgtagttcaatttttttcatttcagtaattgcattcctggggatttttgctatttaaaggtacaataccaaaagaaaaacatgaataaatttgtgattgcttggttatttataacaaaaaaaactggaaatgacccaaattttcaaccatatggaaatagctaagaattacgcaaaaagctgacaaaatttcataaaccaagaacatgagtttattgtttcagatggctgtggattagctaaaactgactgcacacacacatacaaagtccctgatgtgtttagactaggaaatagaaacctgagagaaactggatgtctaaagagaggaggagatgtagtatatctctactctagacaactttctgtggcctccagagtccttaatagggggcctcgcagctacttcagtcactgggcaaggggagttttttcccaaaactgaagagtttctttttgagctgtggcatggtctttcatacttagagtttgcatcactcttcaggaagaatgcatactcacaattgatgccactaatagcaatgcttacagatatttagaagcccccccttccctggctctacagttagactcaccattagcaaagtcaagcctcacctggaagtcattccaagctgtagttcgacctccaacttacaatgtgtcagaaaacccatttcttagcagagctattgatgaaaattatatgacaacaatgaaaaaatgtaacataatgcatctgagtctgcatcagaacctacaagagctacaggtcctaagatactatgagctgagcaagccatcttctcaggatctcagttttctctactgagaacaggggattattttttctacttcagggctgtattgtgagtgtacagtcaatgaaaggatgcttggtatcctcaggttctcatctcaggttctgatctagaggaggagctcaacaaagctcagttagatgtgactttgagtgtgtatgacccactccttaggactgggcttctcagactgtacacacatgagcatctcctggaggacatgttaaaacacagattgctgggctttactcctagagtttctgatttagttggctggggacagagcctaaacacttgcatttctaaaaaagtcccaggtaatacatcagtattcgatctgggaccaaactttgagaattactgtcttacaggcacaaaataccagcttggaaaatggttgagactttggagaggaaaagcaaaggcaggacggaaaagcttaataagggttccttatctgccttggtcctgatgcctactaaatagagtagaaccttggtgtgatgtctgtaccagctccacctccttcctaagctcccttctaaggctctcccagcctccagacctgaacagagcctcccgtgtcagcttcctgaactgaaagatgactaccttttccatctgcctggagcctatgggctgaggcagaggccacctttttaggttccaagaaattatgcattcgttatggaggaaattaacacctcaaagcaaactataattaggaattcttcaattcagtttatgctttttcaattaggcactctataattttaatcatgggagcattaacatgtttctgtaatttatatacctgcagtataattaagcctgggaaacacattgctctaaacctgaatggaagtgattgtttcccttcacacttgcagtattacatgtccctgatagagagatggtgccagttgcagaggagccatttgtgagttggagaggccaatgagagaactcctggctttggaaatatgatggctgttgtagaccatgtgatgcctttgaacatctgcatcccaaagcttcaactcctattgtgactttcaaaacattcccaccattggaaactgctttggacaactattcttggaaactaatttcaattaagcaggaacagggtgtcctggcaggggagacgttatctgagagccgtgggaagcagatggctttgaattgaagaaattgaacaataggctgaaacttagcctggattgggaccaaattcctttttttgaaaaaaaacattgattcctcttcctactttttctaactctgtttctctctcataatttcagctttgccttttagccacaaagcagggcctgaatcctatgtgcaaggtagttctcttgggattctgagaagttctgcaaattcaaggaattcagaggcacactgaaagtttttgtgcttattcagactgaacctctgaactgtctgaaggttaaaaaccttcattttttctctcttcttcctgctctccccacaatagcaaattcagatttgctgactacaataaaaggaaaaagaacataatcaaaactggcccggggggacaatgcatacagattccaacccagctgagtgacgcgtgcatattgctgcagcattttggcactcaatatattttgtctgatctaagaaaatatggaactttttatagagtgaaagttggaagtggatttgtttctcccaggctgctctagccttccacaaaagaacacagatttgttcagattctgatattctgatattcagcctcatcaaacatccatcttctacctagtccccaacatccgcatagaagtgaccgtattcagatatgctgtcagcatgcaacaacacaacatgaattattttgacaccagttattgtcatcatcataggaaaacagaggtgtgtttttagcccccacgtggacagggatagagaaataagctggcagagattctagttcagcttttaggagctaaaactggttatcctcatgctgaaacacacactgagagagacatgagagatccaaaagctgtaaactcaacaggggcaacttcacagaacaaggcaaaactattgcttccctatatcacaagaatgagcaaatattggtgccatagaagagatgacttggttccctgtacaggttcctttctccatacctgaggccacccataggccacaccagtagtactcaagcgtggtccaagaccagtaggtcacctgggaaattgttcaaaatgcagattctcaggcattatcctatagtccttggggacaggcaggactctgcaggcttattagaaccccagctgattatgatgttcattaaagtttggaaaccttgggattataccacttcccacattctatatccagtggaagtgatgtggggaaattttagaagtctagctcggtagatcagaatctccacagtaagtaagcccagccataggtcccacgctgttttcaggacctatacctctgtctaagtcttcattacattgctcatctcttatgataggatccctggcctttacctctctccccaaacgcctgccaaataacctctctgaaaccaaacatgggccttgacctcttcttaccaaccttcttagggtctagagcaatgtagtaaaatagaattttctgtcatgatggaaatgccgtccagtatgtcagccactagctacttgtggccattgggtacttgagatgtggctaatgcaaccaatgaactgaagctttaattttacttaattttaactagcttaaatttaaatagccacatgtagctattaatgatagttactgtattggacagtgtaagtctaaagtctagccctcgattcttgcagttgttactgggggtgctacatcttgctctgggcatgaatacttatatgtttataaaattcttcgtaagcctatacctaagtggaaatgcactaaatagcaaaccctaagcagctgtagccaggtaagaaaagggtgaattgtattctgagagagtaaccacacatttttttggcccattggtggagactctaactttaagatgttattttcctaccaaaaagccagggctttcagaatcacttctctcactgttgccaagtggaggcaactccctgagcagccctcaacagctggagcaggcatcgtgcagaatgctttttggataagagcaaacctccttggattctaacatggcacagagccatgctctaactcagaagaacatcaatagatcaggctatagaaatgcacttgatggaagcagacttgaaagtctgacctttgggcagttgcggacagagaccgagagccatcggttatcagctgtgcaagatctgagacaaagcagcgatgcaaactctcatggggcccagaacagtgggagaagtaaaagtcagcagaaaaaaaagttagagaaaaagtaaggaccaggagaaggcatcttgcaaggtcaccgagttctttcaaggagtttcaccagttccccagggttggagggtttgtattataagaactacatctacttggactgcccctccatccttagtctggcctcgtgttccttgcaacatttggctccaatgaccttcaccttgaatctattactgtctgttcaccatcactgccaatgtggtcacaccgagagccatcatatcctatagaagagttttattactgacaccttatatttgatcatcttattctccaaatagcacttcctgtctttctacactctccctgctttgtaccctctgcacaaattcttcaacagcatccaggttgcctggccctcaatatatctattttctgaacagcaaccttcacattctttttaaagcaagcctacaccagatggtccattttccagcacttttgttgacattatccatcatcttcatttctctgtagtcctggatcaacttgtgtgtctttcttcttttctactacaagagcttcttgaagctcctggagaagattaaacgattaaaaaaaaattaaacgattcttcctttgaatttcttgttttaaaagaaaagaaaagtcaaaatgaaatatacagccctggttttccttctacctctttggccagtccttctccatctcctgtgtgtttccttgataaagtttcgtagctctctgttctgtttctcatctcttctaatctacactctcccaggatgaggtcatccactcccctccatacttgaaataccacctggatgctaatgactcccaaatctaaaacccctgctcagatgcctctccagcactccagacttttggaatttaaatagtccctatggtaggaggtgagcatgacaaccactcttctttccctcatgccagtaacagtccctgtctccatctctccagatggcagacagtccaaaatagaacactctttcgatcttcatgttccatcgactgctccatttaaaatattcttccccaaacacctgtttttcctccttggttggagcctaagtaatataatccagaatcctaacaccagagccaattcttggtaagctgagttgttggtggaggaaggagccttataaaaggggacctgaaatgcagtcagggtaaaagctgaagtgaatgcaaacccacctacattatttgggtgtcacctttcttcccttttgttttcctgaacaatcatctaattgcagctctgtgctatatcaccagactgacctttgtctcctagggtgatgtctttggtggtacacacataacccttcaatatgtatcccaatggttggcatatgtagactgtgggacaacctcatggagaagggcactacagtaacattcatcccttattctttatttctggttacctcttcatatatctggcttctcctatttcccaatctggtgtgatgaagtcccagcgtgattttaggcatggctaaaagtggtgttaacaaagctacgtcttctcccaggttatgtctgggtatctcttatccatgtccccctaacccccaatacaccaaagtgggacccatagcattcctcatcatcaggtcccagcaaaggtggcccagagaactggggaactaagtgaataaatgaggtttggagaaagagtgtctaaatgtaattacagtttctcatctttcccaatgtggacaaggcctcacaaactcctcaggctgccctgtgtcaataaatcctctaaatgttcgtttctctttcctaattggacaccatcatatgctggtatctgagaatcagacggtaatgattccaattttgctcactgcggcttcatggaccagcaaaacccctctgtgattgtttcatgtgctcccactctgggcttcacagttattaaaggaatcctgaaggaaatctggcaatcgtttgcttttcttcccaataaagtttcttctttctttaaaagtaggctgtatctccaattggtactgtagctaatcactgtgcagttcagaatctatggtcttaactaactgcacctgtcaaatgcaaaaggatcacagattctcatcaggaggtgaagagaacttgcaatgacctttagaagtatatatcttgttacactgtcttctagggttccatctttcatacccctggtcctccaggctagagttcccacaccctgtgcaccatgcctcaagcaacctaagaaagcaggtctcatgtcctaactgaccttgtaaaaggtcccttagaagtcccccacactctcctagaccacacgccaggttgcagctgtccttgctcagctgagttcctaactcccccattcagttcccagaccacctttgccaccattcgcctttcctggatgaaatgtcctcatagactcttccctccctcggcatctattggctcagagaatggcaccactttccatcccacgaaccaagccagaaaactgggagtcatgctggacaatgtcttttccttcacaccccaacaccctgccccttggagaagtcatcacaagccatgtccattttacctcttacaagttgtatctcatcgtcataagtactctagtggtgggtcaccttcatttcttatctgaacaatgtaactgtctcccaagggtgttgctcttaaccccgactgtgctggccctttggcaatgagatactacaagcttgtctgcttgaatttatatttcggaaaggtgctcatatctgaccaagttcacagactcataggcactttctttttctgattgtctttcctatttttaaggtaatgttgttttgaagatcacccctggagatgagtgtaggtttcctgatgtgccctacactggccagcacttcgcatgtagtagatctcacatgagtgctggaggatacacagcagataggcattggcttgcagcagggctcagagaaaattcttgcccatggctgcccatggcttagagccactctttgcctcaacagcttggccaaacacaaggactatgtttctgttttgttttgagacggagtctcgctctgtcacccaggctggagtgcagtggtgtgatctcagctcactgcaacctctgcctactgggttcaagtgattctagtgcctcagcctctcaactagctggaattacaggtacctgccaccacacccaacgcatttttgtatttttcatagagatgggtttacaccatgttggccaggctggttttgaattcctgtcctcaggtgatctgcctgccttagcctcccaaagtgctgggattacagacatgaggcatcaggcccagcccccaaagagcatgttgaacaattaccagttgcaatttacacagtttagcttattcgaccttcaaaacaatctgtgatgtaggtattcccatttatcgacaagcaacttacggttcagagaaaataagtacctgcttccagtatacccagtgggacaattggataagactggtctgattttaggagccactcctgtttcagtgtatccaactgggaagtcagctatggcaggaagagcataatggtcttaggtctgagtgaggagctccgtatgggacccatctctgccctcagggaggccacagtctagcagaggctgacaacgcaaggcactgacagagggatgaccatgacagagtggcaactcagaaggagctggtgcattctgctgcaagagtggagatggtcctggatgtggccagtgtgaaccggatgttggagaggtggagaatggcatgcttggtggagagaacagcatggactaggggcctgtttgctcagagaaggacaaacagttgggcactcaccttcccaatgttccacactcccttctgaacaaagtctaaatccagagtgaagaccttcttcacctggaccctgcctgctcctttgcttctctcctcatctctctgtccccacgcactgagctacttgtggctccccaaacacaccctgtaccttctctgtgtgcgcttttgcataggctgctctttcttctaggttacactcttcccttcttcactaactcctcctcattccctaggtctcaatttaagcaacactgcctccaggaagccctcccagcttctgagctcaccattctaccaagggctgcctctctactgaactctcatggaaacttctgaacaagctggccaaacacaggctcattggcaccttttctttttctgattgtctttcctgtagacctttaccatccaaaatggcagtcagtagccacatatggctcctgaaatttaaattaattaaaataaaaattttaaacatcagtttcctagttgtactagccatatatctggtgctcaatggccatatgtgttcagtggcagtcataccacacagcacacatataggacatttctgtaactgcagaaaattctattgaacagcactcttttcagaataagaggtagctgaaggcatatatacacacacacacacacacacacacacatatatatataaaactagttactatagatatacatatatatataaaactagttactatagatatacatatatatataaaactagttactatagatatacacatatatataaaactagttactatagatatacatatatatataaaactagttactatacacacacacacatatatatacatacatatatatgtgtgtgtgtgtgtgtgtgtgtgtgtgtgtgtgtgtatatatatgtatgatgccagacactatcccatgtaaagggaattcagtagtaccaagccttcagatttcttggagctcacagcctatagaggggtatgtagaaacaacagaaaacaaaacaaaaaatatatatatatgaacagctgtataacacaattaaaggctcaggaaagaactatgaaggaactatataggtcactgttgagtaaaacctggtaaaggggcagacggaaatgaaaggaaaccggaaacaaggctaaggacagattctgatgagccttgaattccatgctaagaagcctgtacttaatgcaatggaaaaccaatgacccatttaagaattttaagcaggaaagttaacttgatccaatttgtgcttccaaaggatcactccagcagttcagtggggggtggattgaaggatgagaagctgcagcaagcactccagcaagcatatcctggcgggtgcaggtccacaggatgaggctggaaagtgccaatgtgggagaagaagagagagcttggcccaggttctgaagtccagaggaccagtctccatgactaattagatgggaaggggaggaatgagggggaaagaacatttccaaggaagtcttcagggatcaggggacggtctgttatagaacctggggctctgcccccagcctcacttcagggactgcattataggtgactaattcatggctaagttactttcttatgaaggttagtacggatcagtcacacatcagtgtgacaggtggggcgtgggggaagaaggctcggcatgttcaagccagaactgaatattagattctagtcactatttgattgatcttttaagcaattctgggattctgtcacttaaaaaccaataaatctttgaaggcctgaggaaagcaatacaaaagcaataaatctccattgtggagtgttagaaaaataggccaagctgctgaggtggtttggctggagggatgagggtgcgggagccccacacagcaacagtcctccctgtcacatctcgcccccctgcacactcagttctaccagatagagtcagatccacagggcttcagaggagcagtaagtggcaaagcaggggctagagtttggctcagccagggttggagcatcactggcagaaagaagagcctgcctgagtggggtctgaaggccaaagtttctgtgtgagtctgtttgagaacacacagctccactcaaagagggacccactgaagctcacaagtgatagaccgggctcacacaaggcagagttggaggacccctgagaattcctcttgcccacccctcatgccctggttggtggaggtttactccgtagcacccccacaaaagggccacccggtcatcacgtgacataccaggcagaggaactcagaacttcccaggggagccatgaactcagagccaggatactaggtctatgcactgtctttaactgtaacaagccccacaagcttgggccaatcagttaacatcttagacttcagtttcctgctccaaaatggagatggtatttcccaaccagctgactcaccaggtaggtgaggatcagataatacaatggaagtaaaggaacaattcagaaaactaattcagaaaactattaactgtaaaatttattcgaagcatccttaacccagtgcatctagtgagttctttgagtcctgggatcatagagtgtccatattgttttctccatccttcacctccccaactcacacaactgcacactgctctgctttcctgggtggtgctcatctgtccagccagtctaccgcttctctcaatcactacagtcaatgtacctagtggtttcatatcatcttacagtggaactgcagaagcagctcaatacccctgggttgcaagaaacataagccgagcacaccagatgcaccaggcatgacaccattggtgggacctaggtgcttggactaaggaatggggatagtttaataagtgaacaccacatggcatgatccatgattcaatagcatcacctcatgacatgatccagtcagatcaagtctcccacatcacgacattgcaaatgtccaatcagatcactccattaccttctgcctataaaacctgtccccgcctccaaaagcctgactcctgtctccttgttcagcagccttgcaataaacttttctctctacaaaaacacagtacttcagagtttggctttctattgtgcatgggcaaacagaccaagttctgttcagtgacactttttttgctaatttcatgattttgtttgtttgtgtgtttgcttaatgtcccacctccctgcctcactcacaaacaatttactggagcctcaagaggacagaggtgtggctatcttgttccttactgtatccctattgcttagctcacttccctaaacatactaagtgttcaataaatatttgttgcatgacctagtggtcaactacctctcatataacatcctactgcccagagttcaaggtgaatgaaggtcaagataactgaaatccattgtgatatttccacttctgtccttccagttgtcctgaaattcgtgctgggtggcattggttagtcacttccccttctagtcaaatgctcaagaaacagtctggaaataattccagaaactgagtctacacccaccctcaatgctctagagccttgagaggaaaagcagccagacatttccagacaccaaccatttcccctttgagcagtgacatttcttttatttatttatttatttatttatttatttatttttggataaaaatgtcaccaaaatatatcatgcacacctttctcctaggaggtggtatagtatagtaaaatgagtgttggctttaggtcatttgaactaagtttaaattttgcctgtaccgtttgctggctttatagcctgagtcaactgacttagcttctgtttgtctcaatttctatatttgcaaaatgaggagactattatacaatgttgcgagaatacaggtagtgttatatatagagacaagctggtagcaagtgcttgttccttaaatgaaagctagcaggctcctgtaagttgcagacccatcttttcagggtaaaccaggaccaagtaataaacacgaatggctatgagggatgacagcatgtaggcctgcttgatttttgagtccctgtgtctgttttgtagagttgcgctattcctttgcaccctgacaactgtcatttctcattgctactgggaaactttcatccccttatccctcctcataatttgttgagtcttacgatatataagcttgttaagtagacatgcaaaaccaagagtatagagattcagagggaaagtgtaaagacttctctgacttagggggagcattgtccaaagacttcagactacataggaacttctaaattggtggtggttggttctgtctatttcaatgcctatcatttctagatgaagctggatacaggatagacaatggctagctagaccatctcaaaagcccccttctgggctggtgtcctagcctccagtgacacaaggagtgaggctgcatgcatctctctagtagctgcccatgtccttcaaacaggcctgagcctctcaaacacactcccattctcatcccagcactcccaccttgatgtttatgttaaagcaacaaccgccctggttgctccctgttatagcatgctgtctctctcctccatgcctgtgctcacactggacactcttacaacgttggtgaaatcttaagcatcatttaagatacagctcagtgtccccactgggaattctctcctctgagctcttatgcgtatctccacaacgacacactgtactgtaattatgtttctgtctccccaactagagtttgactttctttaggatgtgacttatccatggctagttcactgctgtgtttccaagcacttaagcattgcccgagacagggtggattcttaaaaaaaaatgtttgttgaatgaatgaatgaatggtttttaggccttgggccccgcctcattcctggtacataacatactgagtttatgcttgatgaattgaactgagcaatttgaaagttgttccactcaatgctctgcttcattttaagggactgtagtcctccttcctggagttctgggcaaaaccggcagtcaatattgctgcccttgtgcaaagtgtatcttgtttaaaagagatgcccacgctcctgatatcatgaactagcagtggtcagtttaactatggagatgcgtcagtgtattcctgatctccaaccacgtttggtaaaatcagcagttttaccttgacagcaagtgcccctatgggactccagcaccctacagccttaaactggaccagtccccaggtcttgtcagatttgtgatatctgagcaggttgttttcagtattcagcaaacctgtctatctggctgttactggcagtgacacaaagaaaagtgacctttccaggagactgtgttccaggccaccgaccccactaactaaatttaccataaacatgttccaggaagtttccttctagaccatctcaggtcctgattaggatgtttcttgttttttttttttttttttttttttttttttttgagacagggtctcactttgttgcccaggctggagtgcagtggcatgatcacagttcactacactcttggtcttccaggcccaagcaatctttccatatcatcctctcgagtagccggtactacaggcgtgtgctaccacatccagctaatttaaaaaatttttttctttgtatagacggggtctccctatgtcacccaggtttgccttgaactcaggggctccctttgaactgggcttggggctgctgacctccttcctccgaggaagctttgttcctggccagtcttgcccatgggcattgccagtcacatgattcaactggaggcccatgtggcacagagaagaaaaactgcagactccaagtgaagaaccatcctcacctgacaggagctccccgggactgagcgggtttcagcatcactgtgatggtcgtgtctgtctcattcaatggggtgtctgtgtcgtactcaggcatggatggagctggacaggaaacagagagtgcaggtgagttcagcacagattcccaactggctccccaccgccccttgctgccatccttaaagacacagcatggatagagggaggacgtttaggaaaggggttggataagaagccttccaggccttcagtaaaggaggccccgatgcccaacctgcccatagtaggtttcttcaaggtgcagtagtgtggggaagggtagcaatgatctgtcgagtaacctgcatgaaccaaaacgttccacacctaataaacagatatgtgcagggaatataagtactaacaaagaagtgaaagcagagtcaaccttgccaaacacatttaaaatgcaaattacatcaattatgaactacttcccctctaccttttttttttttccttcatgagacctcccttccctcatactcagctgataggaatgcgactatatctattcctttgggaaggtaatttagccatttgtagtaacagctattaaaacccacatcctttttaattcagtttttccaaattctgaatttattcctaaagctataatccaaaccaatgaattaaactttattttgtaacatgtttattgaagcgttattttgtaaaaacacggaagcaccaaatatatccaaccacaggggaatgtataattaaattacgtccatccacttgacagaacattataacgaaagcaatgtagcaacataggaaacacttatgggataaagataagagaaaacattaagctacaaaaaaaacatgtttttctggaaaaccatgtgcaaaatatgtatgtatgcagaccagaattgcatacatatttaggataatgaaagctgtaaaaaaggttctgaaataattctgcattgttgctgtctagtggcagagggggccctacgggtgatggcagtctgtaattttggactactgtggccctataatagtaattcattcattcattcattcattcattcattcatcaggtatttcatgagaacctgcgctaatgtcttgttctggcaaaaagaatgttcctgaaaatgaatttaataaccaacttgtgtgcaatatacattatctacacacacgtgtactatttaatgcaagcctgtgggaaaattatttagtggcttgccacctaattaatctaatttttacactttaggaagttcatcacttagattttcttcataggagacaacaatggtaactcactagggactggatcgtcctaattccacccatatcacagggtgacaattcaagaaaaatttccacttcaaggaaaatcaggaagtgggggtgaaacaaccttttttcctttttcctttctagcagagatacctgaaattttggtggcaatccgagtggtgacagggggcccaaagccctttgctgtgctggccttgatggtgaaggaataggtggtccctgggtacagacccacaaagaggtggtgggtttcattccggagcttgaacactttccccctctggctcgagaggtcagcacttgggtccagcgagccgacagccttgtagttgatctgtaggacaagccagcaaacaaacaaacaaataaatgcctcactcaggaagctggatggagctcctttagaggaaccttagggaggcgggggaaggggcaggcatgtgaacttggccagcagattctgctaagctgcctgttgctgtccactttccagatgatcccagcctccaaataccccattgctcacccactggagcaatgcatgttctcattgatttgtaggagttaaaacttaaaataattgaacttacagagatagagagtagaaggatggttatcagaggctgggaagggcagtaccgggtggggggatggttaatgggtagaaaaaattgaaataatgaataagatcttacatttgctagcacaacaggcggtctatggtcaaaaataatttaactgtacattttaaaataactaaaagggtataattggattgtttctaacagagaagataattgcttgaggggatggacaccccatctatcgagatatgattattacgcattgcatgcttatgtcaaaatacctcgtgtaacccataaatatatatacacctactatgtacccacaaaaaatttttaaaaaaagaaacagagggcgacccacagatgtcattttgaattttctgacagtctcatgaaaagaagtaaaaaaaaaagaaactaattttaacaacacatcttgttgaacccagtgtatccaaactattatcatttcaatctgtagacaacataaaaattgaatggaattgtttacattctactattcgtatgaagtcttacaaatatgtcttttaccccttcagcgcttcttcatttggactagccactgcttttcataagtgcagtagccccgtgaggccagtggtcaccatgctggacactgcagtcatagaacagtgtccaggtagagcgtcccgatgagaattatttataagtcttgttaaaaatgcagatcccaggccccatattccagacagatagcgattgctgactggtgctttctcgtgcattatcttttttgtcttcctcaaatccttgggggcatcaggatagctactctcattttaataatggagaaactgaggtgccaatggaagcaacttgcatgcaatcaccatttttcaaattgtatatggagatagtttgtctatggtatatgaagaccatgccccatgtgacatatcatgtgagttcagcaataaccaaactggtctacacctgtggaatgatttgtgtctactgttccctgatcacacacttgagtgtcacagcaaggtactagaagagttttgaagcactcactctcaacttctgcacttgcccaagggtgaaaataacaattggtagcccagcactggtcccacggatcacactttgagtgtcacatcttgaaattacacagttgtgaagtggcaaacacaagattttttgtttgtcttacctggtttgttccattaaaaatatttaattaggctaggtgtggtggctcacacctgaaatcccagcaatttaggaggccaaggtgagaggattgctagaaccaggagtttgagaccagtctgggcaacacagtaggactctgtatctatgtatctacaaagtattaaaaaattagctgggttggtggtacacatctgtagtcccagctattcaggggctgaggtgggaagatggcttgagcccaggagttcaaggctatagtgagccatgattgtaccactgcactttagcctgggtgagagagagagaccctgtctctaaaaaattaaaaaaaaaattaattatggtataatatacatacagaaaagcataactcttgatgaatttttgaaaactggatacagtcatataatcaaaaaccaaaccattaccaggcccaaaacgttttcctcacactcccttgcaatcctacttgcctacccccatcagggatcacctctgtgtgacttttaacagcatagacgagttttgccagtttttgcactgtgtatcagtgaaatcctatgaaacgcgcttttttgtttctggtttctttctctcaacattatcattatgtccatgggattcatccatgttgtcatgggtagtagcaaataaggcattcccaggtacattcaacaatctcttgcagacaccgtactaggcaggtctgactccaaagcctgtactctatattctataccacattgcctggcctgttaacagtgcatcagttgaaaaatgaattcactcatccacttatttgctccttcacagtgtttcctgtgtactcctgtgttctaggccctgcactgtgtgctgctggagaggtgcccaactgaattcaagtcaggcctcatcctcaagtgacttccattcttgagagaggtaagccagctatatacacagctgacatcacttatcttccatcaagaatggccaaacccaggcagaaaaggaagcacaccaacttcccttcaaaaataagcaatttgctgttactggcaatggcaccaagtgttttggagagaaaagtgatttctctgtcctatattaaacagtagtggtgccgcatccttgaggagagaggtcagacggtgcccagagcagagtgtgcgcaggagggaggaaaaatgcagggagctgagggctttgggctttttttcaagcagcacctgagtgtgcatgtgcaccatgcaggtggctgctagcttcaggctgctctggtgggcctgtctacagcattccctctggtcacccctacccaccccactccttctcagaggcaagtgctacaggcatctatctgcctctctgtttgaggactttctccatgggtgcttgctgggaatgggggttaattaacaccccagccctgatgggagttgatgcatacattctccaggctccccttccttatacccctgcaagctccccctccttggtattcctgcagcatcccaatttccctgagaggctcagctccacttgcctctagaggcagctggtttgaaaacacagtgatgattggctactttcctttctcttccccactccatatctctttactggtgtttcttaaacttcttggcaaactgctcatattcaaatccccatctcagggtctgcatctgagaatgaccaaactaaggaaaaatgctcgtggaggtatctcaggagagagtgcaactgacatccgaaggacaatcctgagtcagaagaggaaagagtattctagcttctaggcagagggaaccgcgtaggcaaagatctgggatgggaaaaggtttggacagagcaaagcccagagccactgcagagcagtgagcaaatgggggcaaatggagttttcagcatgcaggtggattctggtttccactgtggcagaaaaggggagatgtacagacagttcagcctgtagccaccaaccccagtgcaccagtggagaggacgtgtgcttgcattctttgaaaattctgtccccgtccccctgcttggactggtggcaactacattgatatacagacactgggaggtaaaactcatgccttatttactagccaattcctttcctgcgctccaaattcaatccaaaagcaactcaatttccaccgagctgtcaatataatataccgcgctcttctgctctcctaacctttcctggtattacaggatcctcacttacttgtaatgaaacactatgaataaatcaatgtatgttaatatagcatgtcttcaattttttatgaagggcttcaccaaatctaattcccactgctttgtcagaaacagtctttgaaaaatttaacttgcaagtttcacgaagttagtgagggatcgggctggggagggaaagaagaaaggtgagaaaaatgggatgggagggagctgtggctgtaaacgtataatataatatgaaccttcatttataagcggggaaaacggaagatttgtagaatagcaaacataaaataaagggttagtagggggaagggtacacagctgcacatcaaccctgggctcctggcatgggttctggctgcaaaaagtactcaaggatgtcccccttctcttttagttgctgacagtaggatccacagccagaaaccaaagcaggtgcttcataacaaaaatcccaggctgagcacagtggctcgcacctgtaatcccagcactctgggaggctgaggcaggtggatcacctgaggtcgggagttcgagaccagcctgaccaacacagagaaaccccgtctctattaaaattacaaaaaattatccaggtgtggtggtgcatgcctgtaaccccagctactcgggaggctgaggcaggagaatcacttgaacctgggaggtggaggtagcagtgagcagagatggcgctactgcactccaacctggtcaacaagagtgaaactccctctcaacaacaacaacaatgacaaaatccaatcatgtcgtaagagcaatgctttcccagagctctcaggatgaagaatgtgtctctgtcatgtggtcttaatcagctcagtgcgtgagctggcctcgctcgtcctccccccagcaccccaagccttacttcagtactaaaaagagccatggtcttttctgccacaggaacttgcaccagctcttctgtcagcctgggccccgtcttccttcccatgcctccttgttgcctcattcatgactcctcacccttagcggacctcacttacagggactctttttatgggtatcttctctgactcccaggttcttattttacgtttccagagtcacctgtctctcttttgagccactaactttccatgtaaccatgtaattatttcatcaataagtcccttttctaccagcccaggagctgaaaaaatatgacttgcaagtcaaattcaatctaccatctgtttttgtaagtaaagttttattggaaaacagctacaccattgatttaaatatggacttatggctactctcacactacgaaagcagagagaagtagcaacagataccctacagcccacgctgcctaaaatatttattttctggcctttcatagaaaaagtttgcagacctctgtactagactttaagctccaaggaggcaaagatcgtatctggtgtttgttcaacatttcatccttttgcatgtctaaatgaataattaaattagctgtgtagcttgagggattgcttaacctctctgagcctcgagttcttcaagggaaaaattataattctaattttagtttccattttatgttgcagagtgacccccatttctttactcctggaagacaagccattgttttggaaggaaggctccagaatgtccatgagtggctttggcttctgtatcaaggcgcagtggctcatgtctgaaatcccagcactttgggaggctaaggcaggaggattatttgagcctaggagtttaagagcagcctgggcaaaacagcgagaccccatctctacaccaatttgttttaaaaaactagctgggcatggtgatgcacgcctgtagtcctagttacttgggaggctgaggcaggaggatcacttgagccctggaggtcgaggctgcagtgagccacaatcgcggcacagcattctagcctgggaaacagagtgagaccatgtctcaaagcaagcaagcaaacaaacaaacaaaacaaaaaagtttgaaggtcatagaaaagcaaagaaagaccaagaaatggtcacaggttgaggaacaaggagacatgacaacgaaatgctatgtgagagcctagaagaaaaaagaagacctctgtggaaaacctggagaaatctggaaaaaaaaaaaagtctggcatttaatcaataataatgcactgaagtgaattcttaattttaataaatataccatggctatgcaagatgttaacattagggaaagttgtatgaggggtataaaactctctctttttttttttttacagtttctctgtaaacttatttcaaaatcaattgtttaaaagacaacaaatggcatgctgagatttggctgctgtgagcatctttgtggctgcagaacagaacctaaacagatatccattgagctcttgactaggtgcttggccatgtactaagctctagagaatcctcaggaacctacaatttggtgagggagataggtatggcccacaggaataagcgggcaaggcacattaagagctctgttctgaaggaagggaagatggctcttatgagcatgtaacagagaaaacagattgagtctctggggccagatgccttcctcatagagtgtgaagctgttaaccagatgaggagcatgggagaagggtgggaggcatgacaggagatggtggagaatgaaagaagaaaaggctcttgggcaggacaactgcttgcctaagggatgcttttgtgcaaagtagaaaaggtgcctgtctcaactcagtctcagccccctgtacttcagtgagctgatgctgcctttgtgagaagaagaagatacgcttttcttggtgcccagtcatattcttcctggcagacacagcacagagtttaatggatttcatttccttggtagtgtgtctttgtgcagtgcacaaactaagcaacagtaggtggcatttctgctgagctcagattatggaagcctttaatgaactactcaagtgtatatattttatttcgagggtaatatagagccattaaaggagagggtaggccatcaagagagacacaggatcataccacagtgctactaaacgtgtggtttgcagataaacagcatcagcaccacctgggagcttgttagagctgcagattcatgagtctatcccagacctcctgatcagaatgtccggggctgaggcccagcactctgttgtttcataagctctccaggtgattctcatgcacactgagtttggagaaacactttctcaggcaaggggatggaggattgaaatgaccagaggaacaacaccggggtccctttggagggtctggctctcatgcagatgacaaatacaaagaaggccttgtttcaaccagaagcagaggagatggagaggtgacaacagtgactctgagagattctgagtcctggctggagaagaatgaggtccctagaaatgtaagaatgagacggagccaacacatggccccagacctgagcctcctaaggctgaaaaccactggggaagacctgcaagtatccttactggcctcgtgcttccaatgctgttaacattcatgaaggcaaagagtgtgggtctcagccagcgggagggaagaccactggctgacagtcttgcagagccagggctgaaactctgacccatcacttaccaagctttaagcgactgaagctctattttgtaccctcaccagccgaagggccctggagacaacagaacagagcagcaacgcctctgaacagcatctgccaggcttccctgctttccaaagccaagcttcagggtcagaggctcagcctgcaggcttggttggctgtgccggggcctgcccgggctgcacaccttccccagcactgccagcacagggacccatgcccgtggttcctggccgtatcagccctgctgcggccctgcaggggcttcctctagcctggtgcggactttcttggttaccatggatcaaagggctgttgtaggagtggggaagttaactcgtttgcccaacatggcttttgctgatttccaatcaatgccctgctctctgacttcagctgttttcctattggctgtgggatcaaacatagggagaaaacaaactcgaaatccagctggcccagggtccttagtattcaccatccatcaaccaaaatggagggttagttagtgggtgataataacaggaacaaacattatgtgcctaccatgcatatggctctcttccctgtgtcaccatcctgctccttagctaccagacacactttaggtgagtgtattcctgtcaacaggtgctccctccaccaacacctctggcccctccaatccttagcaccgggctgcttcccagactcattgccttccctcccctgcctcacatgagagggatattctgagattcactcttcccagctgccctaaatttcaaagaatgcagtcagagtcccatagcagggccaccatcaactcagacggctctaagctctttcttcctgaactaccataatgcagcctaataatatgaagcctcaacctcctttcagcttttagtctcatgctggggtgtcctgggtgctatgattttgttattttcacagaaaccttcttgtttaatgagtctgtctagcaatattcccaatggcttttagtctgtattgcaatacttcttgggtttctgaacatgagctgcttgccttccaacttcacactcagctgatttctgttctgctaagtttaacctggttaagttgctaagttgcatgaccaattcctctccagttggctttgggcatggagatgcaagaagttaaataatcccatgatcctgctcattggaaccctgcagccatactaacagcctttctggcagacaccgcctggaacaaatccttcattaagggcaaagcctagattctatttattgattgtaataattgccaagcacccagcttggcatagagaaggagtcaataaggtttaccaaatacatgaggattaagaatgaaaatgtaacaaatcctcaatgtggtacaactgggatttaaaatgaggtcattctgatcctgaagtccagtattctccgccccaccctgccaccttggccttggctcctctgtgcacatcctgtgtgaacagtttctagggagaggggctgattgaggggaggctgcaactgtcagaacacgaggctttgtagagggtctgtctgagcccaccccactcaggagggacttgccaagcaagcccagaagctgggtccatgcctgtccggcacagagttggtgctcagtaactatgtatttaataattaaggaggcccaaggtggtgaaggtcttgtatctgggcctgaatttctaaacctgtgtaagtagaaagtccttttggtgctttttagaaaatagcccatatcctttgacactgctttcattaaaaggtggtgtttatatcccctgactccccttaagtcttaggggacttgggactgctctcaccgatacaatgtaggggatgtgatattttgtgacttctaagattaggtcatgaaggcaatgtagtttctgacttgtccacagagactcttatgtctacagtgtctaagctgctgtataagaagtctaactcccctggggccgccatgtgtgagcaaacgcagggtgcatgacagtccctgtgtagatgctctagattgacagccccagctgagtccagtcatctgggcaacagacagctaagtgaggaggctgccgtgtgagtccagttctcggctctctggtcacccctggtcatttgagtcttctcagctgggaccctagacattgtggagctgaagcaaatcatccctgccctcttgcattcctgacccacagaatatgtaagcataataaagttgttgttttattccactaaattttggagtgatttgttaccagcagtagtaactagaacaccatttgttcattagacaagagtttcttaaagagcatcggcaatattttattctctttcatatccccaaaaggaaacagtaaatgcttaacaaatacatgctacattcttagccaaatgatgaatgtcaacaataccagtaatgagaaatatggacattcaggctgggcatcatagccagactccatctccacaaaaaattttttttaaaaaatagccaggcatggtggtgcatgcctgtagtcccagctactcgggaggctgaggctgggaggattgcgtgagccagggaggtcgaggctgcggttaggcaagactggtccactgcactccagcttcggtgacagagtgagaccctgtctctaaaaaacaaaagtaaaaaataaaaataaaaataaatatgtacatcatatgcctcttgatacgatgctctgagaaagggttatgtgtggtattttttgccaaaaatgcataatctcgatctaatcgtgagaaaacatcagaaagaaaaaaaaaactaacttaaaggacagtctacaaaataactgaccagtattcttcagaagtgtcaaggtcataaaatattaaaaaaataataaagactgaaaggctgaggagatgtcccagactggaggagactaaggaaaaaatgacaagtaagtgaaacacggataggatcctggactggaaaacgacattagtgggaagataagtgaaattcaaataaggcctgtagattatagtgttcattataatgtagcttaaagtatctatcaatgttaatttcctggtttcagtcactatcctgtggttatacaagatgctaacataaggggaagccaggtgatgggtatatagaaactccatactaatcttgcaacttttctgtaagtctaaaattattttaaaattaaatattgagccaggcgcggtggctcacgcctgtaatcctagcactttgggaggccaagggggacggatcatctggggtcaggagttcgagaccagcctggtcaacatggtgaaaccccgtctccaataaaaatacaaaagttagctaagcatggtggcgggcgcgggtaatcctagctacttgaggctgaggcaggagaatcacttgaatgcaggaggcagagactgcagtgagctgagatcacaccactgcactccagcctgggcgacagagcaagactccatttcagaaaaaaaaaaaaaaaaaaaaagaactaaatattttttttaaaaaaaagaacaaaaaatgtgcactaagtctcattgattggcaaatctgtaatcatggacccacaagttagaagccaaaggcacacccctccacccctcacattcttgcagcaatttattacaattatatatatatatatatatatatatatatattttttttttttttttttttttttttgagatggagttttcgctgttgtcgctcaggctggagtgcagtggtgtgatcttggctcaccgcaacctccgcctcccgggtacaagcaattctcctgcctcagcctcccgagtaagtgggattacaggcatgcacctccacccctggctaattttgtatttttagtagagacggggtttctccatgttggtcaggctggtttcaaactcctgacctcaggtgatcagcccgcctcggcctcccaaagtgctaggattacagccatgagtcaccgtgcccggcctattacaataatattaacaacacgagaggacatttaataccactcactagttgccaggtgccttgccaagcactttccacacattactcgtttaatcatcccacaagtttatgaggctactaccgttactattcccactttgcggatgagaaaactgagacttaaggggagcaacttcccagtgtcttcacagataggaagaggcagaggcaggcttggaaccccggcagtatgaatctagaatccacctgcttaaccttggagctcttttgtcatcatgaagagtggccagtcttacttccagggcctgggagaccaaaaacttttgctggaaatctcttaaaggatcagctagagtgcaaagacatgttaggagtatttggacaggcagagagagcttttgagtgcatcgttgggggcacagaggccaaaattaaggtgaaatggggtggaaataaatctggagaattaggggcgatcaggggacttgatgctagaatgcatttccaagcaccccagaggggttttctgaccacctgggaacttcctgcatcattgtcagaggccaagtcagggatcaggttgagaggcccttctaaggagaaatccatcgatcacgtaatcacacattctgggccagtgcggggctgaaggctgaagtttcactctattgcacttttctttcattcagcatttttctcatgaaattaaaatagaattgattttctcccccactaaattaggcattaggaaaggaacgaaagggagggcatgttggagactacaccatcaattcaatccagcagagtagcatttgtaagaaattgtattcgcccctacttactatgagaaggttttgtaaagcctatttttttttgttatatctccttcttactagaagagatgaacatttttttttctcccttcttggttaaaacgatcatttatactaaccttttctccaaccctctggcctcaggttagaagcttcctttttctaactttgcctctgtggtatttccccagaagcagacacacagcaggtgacactgctgtttatggaactgtcatttctgatgaaatgggtcatctggggactctacgttctcctattctgcagtgaccccaggctcatagctgggtccagagtggaacctcacagctggaaggaactactccatttacagagtgctgaaaggagatgggagcaggaggaaactgaggctcagagaggttaggaagcacacctaaggccccacagtaactggttctactcgaaggaggcagcgatgggataacaaaggagtcagaaaccttgggtacaaatcctgatgcttcctcttagcagatggtcatttatagctgcactgcccattagaaataggatgtgagccacatttgtgattttatattttctaggagccacatggggaaaaaaggcaaagagaagcaggtgggaattaatttcagtaatatactttctttaacccaaggtatccacaatgctattattccaacatgtattcaacacaaaattattgaggatattttacattctcttttcccactaagtgttcgaaacctgttgtgtattttatattctgaacatttctattccggctagccacattttgagtgtttaatagccacttgtagctagtagctagaccagggtttctcaatcatttttttctttactatcacctcctaagaaatgtatttagactttctgtgttgtacccctatgaattttaactctacagatgtggtgtatagttgtatatggacgctatgcatacctgcatggctgtatgtgggctttatgcgtattatgcatatgtgtatgaaaagggatttttccccaccctacccccaccactaccaccaagaaccaattttcatctcttggggtcgatggcacccctattaagcatgcatgatctagagcaggggtgtccggtcttttggattccccgggccacattggaagaagaagaattgtcttgggcaacacatgaaatacactcacactgacgatagctgatgagacaaaaaaaaaattaaaatcatgaaaaaatctcataatgttttaagaaagtttataaatttttgttgggctgtattcaaagccattttgggtcgcatgtagcctgtgggctcagggttggacaagcttcgtctagagcaagcagtaacggccctgagcctcaggtccttatctgtaaaataaggatgagtgtgtggactaaatgaggcagttcttgtgggaaagcatccagtggtgctgagtgtggcaccaatgctaatattggagttgcattgctgtttccaacacattcccttccacactgagtgccaggagtcaggtccccctcctcacctgcagccagttgccaggaagacgtgctctctgcccatgacttccctcctgctccaggggacttcccaaagccctcacagggtaaccaggggctctgtccttcagcctggccacaactcagcccagggcagcagggccttgtggaccaccttcttcaatgccttctctctcttagtggacacctaattaatgctgaaggtccagaggccacccttgagggtagcccaggtcccctgacacccaaaccaagcctctcttccctcccctgagtgcccattggcagatgggtggtgcccaggcttgttatctgtgcagagacacatgctccattttccaactcctcccagacccctgccccagtctaccccagacttgggaggttgctaactgtgtgctaagtggttttctccctcagcttctgagagattctggcacttgcttcgcttcccatctcgtggcttcccactggccagtagggtccatttctgcacctgtggctcccaagaagctctaccttgtcattgaccactctgccctctctgtccagttcttcttctgtcccgttcttcttctgtcccatctgagtgagacatgcccctacaagcaatgccaggggccatcaaggaatcatctggaacactttggagacaaggaactcagtccctcttactcacctgtgattctgccagtgggcagtgctgtaagaacatgagcactggagtcatagaagactgccttttctctctgcccctcttgtgattctagtggctacacggcacatgtgaggaagctgattgcgaaggctataaacttggtgtcctaagctggggattgcagagtaaaacccacgaagtgagcagcctgattgcccagccttctgcagtcacgcctcattaggcacccattggagggaaaagtcaaactaaaaaccagaaaagaaagtggctttgagacgttgcctttttttcccttaaaatgtacttcttggattgtgtttctttatagatgtaatccttctcccgcattttatttgggaaggggttcataataggaaggagttgttttgaattatatcagtaaatattcatggagaataaaaggaaatactttgggattataaaagacagtgtgaacctgattaacaatgtgaacttgatcttgggtgtgctgggctggttttaggctgtgatgcttagcacctgggtgaccttcaataatattcgattccatcatcaagaagaaaggtttttcatgaagttgaaatgtgtccatgtgtataagagagcttgaaaattcctagcacttgggagactgtcgagtaggtcagtcagacctgaatctacaacatcagagagggtgtttgatggtatttttggggaaaccacagactcattcatgtggagtcaataactatctcttgggcagtatcagtagctgttattttaggcacctgagatatgcccaggaacaaaccagtgaagacactgccttcctagagtttaccttctagttactaggaaggtgagaggaggggagaaaaatataatgaatgtaataaatatgccatttatttggtatgttagtagatgataagttctctagaaaacaaaagaaaaggaaggagacagcagagcagggtggggaggataggtgtgcatgagcaggtgatgcaggggtgagactgatcagcctcactgagaaagtgagatttcagcaaggacgtcatggaggtgagggaattagctaagtggatacccaagagaagagctttccaggagaggagagtgggagatggggtgaaaggggtgtgtgtgggtcacacagatctctgtgagtctttgaaagatttaggcatctagcctgggtggcatgggggctgctacaaattgtgagagccaggctgagacagacttcatggtgagaactggttgcaggactgaactcttcatcctgaaaggtaacagctccaactcagaccatagatgcaggatgcagggacccctgatctcctgaggctcttctacccaggctctgggtgctgcggacctgagaggacaagttggtgcaggagtcccacctccatgcttcctgggcccaggggatgctgcacagcccagtttctagacctttccttctggttcagctgcctgactcaacaacctcccaggaggcttccttcaggggctccttctgggtgagtgtggggaagaacaaggacatagattatgccctgggcaggaaaaatgaacacaaattcagggtattgaggaggcatctgagaagatgaccactgcgtacccagcatggccatcccaagctaaatctcaggagtgtggaccttgacttgaagacatcaaaggttattgtaagcagtgctctccgaaaatgggagttccctgagctttagcagatgtaccctccagctttagcatcccagggaccccgagatcttgaaacccattgcccttcaagtatggctgggagcgtagcaggctttcagagacaaggtaacccgctggggcaatatttaaagtcacacaaactctttacaaggtttacacctagaactctaggctcttattaagattcagagttcacaaatcccccaaatgtgaggaaagcaactcagagactctctccttggcatgttgaaggtgtgtaactaaaaggtgctgggtgtttcatgtaggaggtggaaagaatcattgcattgatttggatgaagcctccttcattgaaaaatatcaaaatttgcatgaaagacttttgctaaagtaatagcaattgaaatattctttgaagtgctctgaatataaatatagaaacgctcccatggagacctgctcatactggcttcttgccttatcgctgtctcactgggttcactgttagcctcagagggggttatacagtgtctcaaccatactgccttgggctgcctagcctgtgtgtgaggggtggaggagtcctgagtctggttcttttttttcttccctttcctttccttccttcctttcctttaccttttccccttccttcctcccttctttctccccttccctccttccttcctcccttctttctctccttccctccttccttccttccctccttccttccatccatccgtccgtccatcaatccatccatccatccatcctccctttctcactgtgttgcccagactggatctgaactcctgggctcaagcaatcctcccacctcagtctccagagtaattgggactacagtcatgtgtgccaccacgtctggcttggctctttcatttaatgacaaacattctaggggcccagattttgcctccaaagaataaataactcatgaaccgtgagagcactccaacaaatgagactgtaagagaaggaacgcactacctgtctccaaatctgggtgcatctggagaattttaataccctctctaccctgaacctatgcttcgcaggctacttctcccagctcctgaaccaccattgctgttatagagtcaatggtgctgtgggaacatattcaattgctaagagggctgaatatattaagccacaaaataaaaatgaaaggtgccagagctcaaaggcccagagatagtgggggccagagttagtcccattgcaggctgaagaacacatcctttgaagtgggtgacaggggagaaaatcaacacccaaacaaagagaaaagccagcgtgcagaaaggaggatggggcagacacacttaaggaagcaagaagcagagacaatggggaagagaaaaggaagagaagcctgggtatcgggtttccaattgtatgtccatgatgccaaatcatttttcatcccctgctcaagattttctgtaaggcaatttgagctattttgagggatgttgtgtttttagaaagtatatttccctgatgagaacatctcacctaagtgaacacctcatctggatcttcaatcttttccttgctctttcctcagcaaaatgccaagagatgctggctcccctagctcagtagctgccttcatgtcccctcctctctctgtgtccaggtccatgcttacccatcccaaatcctgtaacccgtgtgttatgagccatggattcatccaaagtgcagactccaaaccacactaactcatatgggtatctggtgctccccaaggcagcacagcttgtccaagaagtggaactgaatgtcaatgccttcatttcactgccatgtaactccctgggggaaacagcccaggaagcagctgtgtgggctgataagggcttctctgccttgtcggaatcctcaggcaccagctccagataacggccagcgacaggagtcagtacctgtgccaggtgtcaagccttccccttgagctacacaaactctcaggtataccatgctgccctgcctggacatgtccctggcagaggggtgggccttttcatcagaggacgggctacgtttttccttgctacactcaagaacggtaggagcccttactcacttcttgtcaaaagcaggaggcaactgtcttcagtgattaacaatgtaagccacttactagctttgagactttgggcaaggtgcttagcatcttggtaccctgattttctcttctgttaaatggagacaatgatgtccctttcttataggtcagaatggggaataactgagataatacttgtaaagcccctataacagtgcctggacataataagcactggataaacacaatctatccttactgttaagacattaaagttcttcaatagttttccattggtcttaggataaaagcaaccatctatactgtggcctgaagatcacacatggtcttgccctggttgctgttactcccacatcatctcactgattttgcactcaaaccacatttgcctcctccctaccccaggtactggccctacatctttcaccagaggttctggccatgctgttccctcactacagcatgattttccaccctctcttggtttggttaacacctcttccttcagttctgagctctattgttatttacttgggcaaaccttccctgctcaagtccaatgtgccacaatggcttttaaaggacaagaaccatgattttgcacaacttgcaggagcattgttcacactataacaatggggatggtgacctctggagtggtacagaacagcagccccatagggcagtggtttcagccagaggtaaaacctgaccatggggccaggatctgtaccactggtcggtgaaggaataaggacatccaaaaggcaccatcctgtgccaacattttctttgtgactcagagtcaaagcactgattatttggtcttatgtctcacattgcttcttctaccatcttcccactatcatcttaacatctgctgccaaagcaccacttacagagaacacactaagaaaaagcaactgacactctacttcaagccctctcctgcagctacttctgaagcaaatattactcatgcaatttcacatttatctgtttatctgattaatattttccactcagacaagactctaagcaacacacacaaaagggccatgttggctctggtgattgtagtatccttagcacctaaaacaaagagtagatcctcaatagatatttgttgcatgaataaataagctccagtttcagtgcccagggctgttctccagccccaaattgccaagcccagtgcctgaaattctaccactatatcatatatttgagcccagtccctggttcaagggaagaaatgttaagaacctcaactacactggctggtaatttcagaatcagtcctttcatcaagggggcattatcagttgtgtccaggtgagctgctaaattgtagtctttctacccctgtccagttgaactagggagtaagactggggtcaccttagagggatcatatggcaggtggttggggctgagtctccatgtaggttggtccagaatgtagtcaggacatcagcagttttagcaagacttctctactcctaggatgtttatgcagctagtcttcaggctattttgggtactggggggagagtggagtcaccctgtatcaagagactccaaacattccttacttccctaatatccaagatgtaataaaagcatgaagagtccaaccttcaaagatgagaagatccatcagcccttggctatgtttccaagtgaagggagacaattaaagacagaggagcaagacagttggtcagaaaataggggttctggactggagagtgactgttaaacagaagacagggttttcttaactcttttttttttttttttttttttgagatggagttttgctctgtcaccaaggctggagggcagtggcacaatcttggctcattgcaacctctgcctcctgggttcaagcgattctcctgtctcggcctcctaagtagctgggactataggcatgcaccaccatgcctagctaaatttgtatattttcagtagagatgcagtttcaccatgttggccaggctggtcttgaacttctggcctcaagtggtccacccacctcagcctcccaaagtgctgggattacaggcgtgagccactatgccaagccagggttttcccgattctgataaagggtttttaattcaatttagaggatatttgctaaagtttgaaagtccccccaaattcatacgttgaaacctaactctgaaaaagataatattaaaaggtgggacctttgggagggcagaactgtcaggaaaaggattagcgcccttataaaagagaccccagagagacacctttcctttttcaccatgtgaggatgcagcatgaagtttgccatctacgagaaagagaacccaccccagacacctaacttgctggcaatttaatcttggacctcccagcctccagaactgcaagaaaaaatttctgttctttataagttatcctgtgtgtggtattttgttacagccacctgaatggactaaaacaatgtctaactaaaatataacaaaacacagaggcttctgccacatcctaggcaggaagaaatgacagggatctcagtgaaatagggcctatggaggacacgcacattttgctgagtacctactgtgtgcctagcatttcactaggctctgcagtatacattgcgttatttactttgcagagtaacaccaggagtgaagtaccacccttccaactttactgctgaggagacaggctcagagagggtgagtgacttagtcaaggtcatggaactaatggtatgctgccaggctgggctctggcttctgttcaaagagtgacagccttgtaagtgtcaccaaaggaagcattttgaggacagagttgcagaactatcagttcataaatattcatttttaatccttattttcaggcagaagcttgtgctttctaaatatttagattttttatttgtaaactgacaggatcctatcattgacaagaactctcagagggaacagaatccactcctttttgattgtcacatccccaaatgacctgtctcccgcatggatgcatctaacagcctttgatgctagcagtggccagcagcagcaacctcagactataaatgaacctgttgataccaatatgaattcgcagttgtaataatagagattatggacatacatatagaggcgtctcattcgcaatgacttgaccctgaccacaattctgtgtagcatgcagaacggtgtgacaccatgtgcagggaggagaggaaagctgtggatataccaaaaccagagaatgaaaggtcagatttcacatgcacactgtttgagtccaagtccagctctccttgccctgtaccaccctacagttcatgaatcccagaatgggtcaccagtaagacctgcatcaggaaccacaggtcaaagatgccaatgaagcacctcacagcatgagtcatgcaggaaccaggcggagaacctgagctgaggccagagggtgctggggtggggtctgtcaccctgtttgggaactgggggctccagggaggtgggagcagagagggcaagtgacagtctaggaggcagaacaggtgcaagtcagcacctctaacccctaacatctaaataaaaaagcaatgacctcagtgtgtttcagcgtctgccagctgcagggaaatgtggcagtttccctgagcagagagcatcactgccatagcccatctgtctcactctcaacaccagctctttcttctcaagaacttttcagaggcagggtctgctgccctctgaggttcaaggaaaaggtcaggtgtggtctgtggacaaggggaaacctcattaaatcaagtgtcaaacgtaaaataaataaagccacacatttattagaagtaaatagctgtggctagttgtttgatctctggtctggactttttaaacacgcaagtaaatgaagaaaatgtaccttaataaacccagtgatagagtttaaaaatcatacggtaataatgttaaaacttacaatcaaataatattaaagggaaacaacaaaatgaaaaatacataaacatatatggcagagaacgtcaatattttcaaatatgaaaaagctcttacaaatcaataaaaaagaagaacatgcaaatagaaaaacaatgataaatgacatgaacaggaaattcaccaagatacatattaccaatggggggaaaagagattccacctcaccagaaatcaaatacttgcaagtttatattagatatctaggtttgcttttctaaacagtaaagataatttaaaatgataatacagagtgttgctggagtgagagtttcatgcattgctgatggggttttatatatcttttggggttaatctcatggctggaagcttcttacaagaagttagtaacaactagaatctgacacagagagcagaatcacagcaaaacaaaaccaataaccaaaaacaaaattatagaccagcatatcaactttaaaagaataatatactattacaaataagaatctattccagaaattccaccaggattattgtaattaacattcgaccaaagtaattacctttagccatagcttgaagttaatcccaaagactccaaaatgtatttgacaaaattcaatatcaatttctaaagaaaaagtaatgtatttgtaattggggtgtgtgtgtcggggggacagggaaagtctttcttaatggaaggggacagtcatgtctgtgttatatccaacaatcctttactgactgcccatcaggtggcaaggatacaaggaagagtgagacacagtctctgccctcagagaggttacattctactaggaaagacaaggggtgccacggtgtaaatttgaaccctactgaattcatgttcaaacttaattcccattgtggtggctctaggaggtgaggcctctggggaagtgattaaaccaggatggttttgccatcgtaaaaggctacagggaactagcttaggcccttttttgcccttcagccttctgccatatgaggacatggcattcaaagtgtcctcttggaagaagggactaggccctcaccagacaccaaacctgcccccctggatccgggcttcccagcctcctagaagtttgagaaatatatttctgttctttattaattacccagtccatggtattctgttataacagaacaaaggaactaagagaggtggtaaccaagtaaaccgataaataaatgagatatagatagatggatggatagataggcagattttctttatttaaacataaaaggaagtgaatgatagatgctatgaagaaaagcagggtgaaggcttatagaatgattgacagtcaatttcatttttagtagtgaaagtcaggacagtcccattaaagcaaaaaacaaagaagggggtgcctgctcagaacattagtgttcaacattgctatcagaatacaagcaatcagaattaaacaaacaaacaaccaccataaccaataaagcagcatgggaggatataaagatagcaaaattctttgggaaaaaaatgtggaagctctacaaattaaaatagttccagaatccaaaggctgaattttgccaacagcaaatgatcacagtggatggggaaaattgcatccccaattacgtgagaaaactgtgatgaacgggactaaaaagatacgagcttgccggatgaaagatggaaacgctccaccctgcaggggagaaatagcaatcctatgttcccacagcagaaaggagagacattctacagttgattcagtacaaaactgtctcagaaatgtcatcgggaaagaatcttctcacactggctgaccctcaccacactctcaagagtctcatattaaggaatactctccctgagagaacttctccaaagcatgttccctctccaggccacagctggttgcactctatgacagtgatcaatggctccattgcggagacatgtcttctgttccattcctgtgaccagacagtccagttgcctttctggaaaagaaatgccacagggctcctgaccacagcataacaggctctctggggagaagttcacagccagaccctaaccctcaccccaagaacctcaccctttccatggccccttctgaaagggaagattcaggaggtacaatggtgaaaagctcagacttgggtgttgggcggatatcagcagtgttcatgacatgaaatgggagtaagaagctcctaagcagattgaggcaaagaattccagacagaaggagcagctcaaggaaagatccccagccacaaaagcctggggagtacgaaaaaatggtgacaaattctgggtgatcgagtctatagtgggggagatgagcaagagtagtgaattggggtcagattgcaaagggtcttgaaaggcgcgataaggaagtcaagcttcacaaaactgtgggatgccagctgtggaattaaaccagagactgacgttatcatatttccccttttaaagaaagcacacacgggtgatagtttggatcgtgtaaagagaagctacatagaaagagagggagcaaggctgtcagatgcgtgtcttttggttcatattgcaattacctccgtcctttgataacttggataaatgccattttcaccactctgtttccttctcagcaaagcgatgcatttcacctgtgcttgaagaacctttgcagaaacattcaggggcaatagaagtcaggcactgggtggagttgcccacagaagagagaaaagcaagggagatctgcctgtgagcccaagtggacccctgagctcagggtacatgctaactccagaaatcctcaagtctaatgctcctccaacaagtggtttattcctagaaggtaaagatgcccaaaacgtggtggtccctctgggcaaacaccggtcattgcccctgattgcactcccccaacacaaatgtatgcatgcataaaccagtgttttgcaagctttaacttacgaccaaactgaactctgattcagtagattgggctggggcctgagattctgcatttcaaacacattcccaggagattctgatgctgttgttaattggtggatcctacatggtgtaacgaggttctaaacaccaatagactttcagctgcaagctctttgtctcaatttcaaagtaccactgacctcaacctaaaacctcaacctaacaaacgacctcaacctaaaatcctgtgcttccggttgtgagccttgtgactgtggaggagacatttcctagcgctgagcctcagttcgccacctctgtaaattgcctgtggaagacatggctttggaggacagaaaagaaaagtgaaggaagagaaagatgaagccagagtgaagtggtagcattagtgctgtgattcacaaaaataacactataggaagaacctggatgatagtattctgaatacagcaggagcaccaatagagtagcagtagtaaaaatagcatcattataactaatagtgcagaaatagtactaggggtcctacccagaggaggactgattatttcagaggcagaggttggggcagaatagaaggcttaacagatgtggtacatctcactggttgagaattcagattctggagccaaaccgacatttgatgaaatgaagtgtgtattgaaaacagcacagcaacccccacagagtaggggaaagaatgtaagatccccaaggagagggaccgtgatggtcttgctcagcattgcattcctggtgcctaggacagcgggaggcaccagataaacatctcttaaatatattaggagtctttgattctttttctgttctcagatacctactgactgtatgattctgagatcacacctctcttcttggcttcaattctttcatctcgaaaagtcaggatttgggctgtgtggcaccaaagatgctttccagttcctgtgttttctctcctgatgccctattttactcttcctttgcaacctgatagtatcttttttggttaattgttcactcattttctgtctccccactagaccgagttctccaatgtgggaatctaagttgccatcttgcacaaccctgtaatcccaaaacttggcacaaaacctgaggcatatctcagtgagtatctgtcgaatgaacaaaggaatgaacaagctctattttcttaagatcactggaggcagcattgtgccacggttaagatacgggctctaggttcagactgcctatatttgaatattgattcctccagttaccagttttatgacctgcaaattatttaacttcctgaggctcagtttcctcatctgtagagcgcagatactaatggtatccccttcacaggattttgaaatgattaaataattcatgcaaagctgttaaaatagttctgacatgtagtaagcattcaatacttatcagcctcatttagagaaaaaagaaattccttgtgaattccatgtgtaatttgacaggtgtgacactgactcaacttgctccagcaagtctccaaggcaaccattccccacttggtgcttctaccgtgcccccacagctccatttttgcacttggaatgctgcatttcgttttgaacatgtaagcctttgcttctgccttcaggtgctcaactctggcgtgcccagcctccccagtcttatgcctaccactccctccctcagtcttgctccacaaagtgcctctgtgccttggcatatgctgtcacctctgtctgtgatgaacttccaattttctacaactggccaacacctggtcattactcaagtcccgggtcaagcccctttattgcaggaagatttccctgaatctctaggctggtgaaatgcatgacaaagttctattcatttccctgcagcaatagagaaatcccaactgtttaatcataacagaagaggaaaacaaagaaaaatgagtgggagtgccttggtataactatgacaccctaatcatcatctcatggggagaccctagaacaaccagactcaaatttgaggcatccagtgcatgcttcccagagcctctcactcttacttttcctagaggcacctgagcctgtggagggcagcaggagctcggtctccagctccaccccttctccacattcctacaaaggagttatatgccaggtacctcctttctcggccttggccctggccgggtgattgggaaaatgaaacagactggccgaggcttgatgcccctaaattgtaatttcaaggtaatttgaacttccttcttcttgggcatgaatggaaaagctaaagtctccttgaatcagtgtgcagaactcaacaaagaattaaagtgcccccatgctttcctccaaagcttgtgtgagatcagcaggataatcaattttacaattctgtgaagctgattggaaagtgattacaaaggcagtcagagcattttctcatgggctttcaaaaggcctgttgcagagggacgtgaaggatatgaagtctggccatccatagcaagcccacaaaaatcaaggactccttcactcccaaagctttaatctctggctcccatgagttcgatagtcaatcctgcccaaggcctatagagtaaacgtgtgaggctggtagtccactaagaacctaagccctatttcagtagatagctttggggtcagaatgctactgcaggctgatttttaaaaaccttgaacttcagtgttgccctctgctgcatcctgcctcagtttccttatcccactctctctagctccctgtggagactggatccctgatctaaatcacgctgccaccttctccatgtgctggagcactgtctcctaaaatggccagctttctggcaccgagatgcattaggcactgactggtaggctatgcagagatcaggtttagcccacactcactgtcctgcctcagatgtggaacaacctgggccttccctccatgcactcctcacttcccttagccccaggcctgcctggcctggttggtttcagatagttccccttctcataagcctttgggtctgagaactggaacagagaatgtgtctccctcccagacattgggccccaatcggaatggggaagatggtcacacagcaagaaacagagaagccccaggaaagggctgccaaaggggaaagaaaatgagcctgcttggtcctacggctcttagcgtagctttgcattgcacttatcatgctgtcttgagcgtgtttttgttctcccattggactctgagctccccgacagtagggtgtgtttctaattcattttgatatcatagattattaccttaattggctcatggaggtatgttagtgtgttagtccgtttttgcattgctataaagaaatacctaaaactgggtaattgataaagaaagaggtttacttgttcacagttctgcaggctgtacaggaagcatgatgttgccatctgctcggcttctggggaggcctcaggaaacttacaatcatggtggatggcaaaggaggagcaggcacatttcacatggtgggagtgggagtaagggagggaggtgctacacacttttaaacaaccagatctcacgagaactcactatcgggacaacagcaccaaggggatgtggtgttaaacgatgagaaactgcccccatgatccaatcaccttccaccaggccctacctccctacctccagcattggggattacatttcaacaggagatttgggtggggacacagattcaaaccttattgggggccttttagattcattgtagggtgatacttttgagccctttgaagttaggtatggccagatgacttgtattggacaacaaaacgtgagcagaagtgacctgtttttatccaggtaagtgctttaagagccaaagcccaatttgccgctttctattttccctctgacatgatgactagcaacgttcagcttggtggcagctccgtcagcccgggtccctgtgtgactgctccctgttgacccatgatggacgtgtcatacaggtgagaagtaaacatttgatgttttaacatatagtgtgggtgaaagataagcttttgatgtttgatgtttaacttttgagatttgggaatttgttattgaggtgtaatctagcctaacctgacagatacagtgctcaatatatgttttagggtgagtgaaaggaagggaaggaggagtggaagaaaaggagggagggaaaatgggggaagaagggaagggagaagaaaagagaaggagggagaaatatgtaaatgacccgattagtcttcacctctctttgggtctgtttccaacttagacatctgggaaataatgttcatctttactgtgttcccttctaccttcaacacagaaaacctgatacgattcagacacaaactccatgcctttttttgtataaaagaaaattctattttctcaaatctaatgtgtaacatagcgatatttatagagaaaggtggcagagaaatgaggcaggaaacaaagcaattgtgacttttttgggtaatatatccaagccataaagatttcattagattccataatacattgctaatgaaaaataagaccctttcctattttacctactttctgaacattagaatcaacttggctttccaagctttgcaccccatttacattaattagaaagttccatattaaggaaagcttttaatgggctgttattgcaaatgattttactggtgagctgcattgttctgtttaatagcacatacaatggcatctatagaggagactttgataaaattgaagttttgatggactctgggcctgagctagcctttgctgagaggatggagttcggggatattttcctactgagggaaatggctcttctctttccctggactagagccagttctaaagcatccacatgtttctgatcccaggagaaatccacactgccttctgcctgggtacaccattggcagactgcttccagatccctgtacatcacttggcaatatctctcataggtgttcatggacaagacagagccgtcctggaactgagacataagggatgaatttcataaacacagactgcctgggccaggtggagagtgtcatggagatgggtgctaggtccgtgcaggaaaacagggggagaagggggacaaagcagaataaataatggctgcacataatagcaattgacacagagagtaaggtggggaacagggagaatcggggtatggtggggggtgtaagaggaaccagagcatgctgtcatggcatggagaaccctataggacggtaaccacttttccatttgtctttgtccctatccatgccctgcataaatggtgccacccataggtggtcactattgctcctgaaggttttccttggtcttggcttccagctgcctactactgataggatctccaactatcactatagcatgagaataaagtattcagaaggcagtgcagtatggaatttaggtgtctgagctctgcaattacatctgggtttacatcctacctctcctgctaaataataagtgtaatattctgggccaagttagttaatctctctaaacctcagtttcctcaatttaaaaatgaatctgcctgaagacttcctggtatctaaagtgcactcaatacatgtgagcaattataagtttcattaaataaatttgagtggtttaaaacactgagacttcgggcagagcacaggacttctgaaattatagttacactggtggagttatggaatacaggtcctcagatctcagtgacccgtgaatggtgaattcagcagacatttttgagggtagacattctggcttccctggtgcctggactggatgctgtgatccatggcttatgtgactgtgagtaccatgggctcatgggtttttattcttgccatgctggcagaaggacactgctaagcagggatagacaaaaaaaaaaaacaactatttgaatggaccaacctggctgataaccttgaagcagtctcaccaagagggcttctagtataaatgggaggacaggagaatggccaactagttgaattcagagagtagagagagaagactagtctcaggccactgattctgcagtgtttgataagtggtaagaacccattagagttggttaccattacagctataataggaaaatacaggaataatgcaagcatattatattttgtcccctaagaatgggggaaaataccactatatcatgtgtagggccaaggcttaccctgctgtcagagcccatttagcatcttgaatttagttctagatgtgacatcttgagtttagctacagacccacacctcatctccatcagggagataaagtggtgagtgacgcagactttatgccccacaaagaataattgaaaggattctccagaagagaaaaagttattgctaggtgatgttggttgcattctagtaatcaaacagcagctgattttacgacggattatatgtattctttctaagtaggatatgtgggtagatggggtagggacgtagagacgacaatatggatggaagatttatcaatataagtttgacacagggcacatggtccaaatcaggtgaataccttgcaatgttgtgagttcctgtcactgtggggcttcacgttaaatgtggactcatccatcaaatgcatatggaccatgcactagtacagggtcagtgatactagctgggaacacaaagattaatacaatgtggctcttgctttatagtaattcactcttctgtgaagaacacagacccattaacaaattcttaaataaccactgtgtcacacataccagtgtagaaatgtgtacaaggttgtgtcaaagcaaagaagtgacggcagtggggaaggaggcaaatgtgaggtcagaaggtggctgatccttgaggatgaatcggtaggattctgatgggtggacaagggtgcgagggtgtttccatctaaggaaacaacatccaaaatggcttgaagaatagaccccattttctttatcgattcattcaccagtgggcatttaggtggcttcgatgtcttggctattgtaaatcatgttgcaatgaatatgggaatgcagatatctctttgagattctaacttcaattcttttgggtatatatccagaagtgagattgctgggtcacatggtaattctatttttaatcttttgagagaactccatactattttttcatagctccattttacatctccaccaacagtgtgcaagttttccacatccttaccaacacttatctttttgtttttaaaataatagctatcctagccagtgtgtgatatctcactgtggttttgatttgcacttccatgatgattagtgatgtttagaatcttttcatgtacttgttgtccatttgaatgtctttggagaaatgttgattcaagttctttgccccctttccaatcaggttatttgttttcttggtattgacttatatgagttccttatataatttggatgttacatttatcaggtatatggtatgcaaatattttcttccattctgtaggctgtctcttcattatgctgcttgttgcctttgctgtgcaaaaccttgtagtttgatgtgattccaatggcctatttttacttttgttgtttatgcttttaatgttatatccaaaaatcatcgcccagaccaatgtcatggagctttccccctatttcttctaggtgtcttacagcagtagatgtgagagatatttaattaatattagtacattaaatctttaatccatattactcagcctcaaaataaaaaaggaagtcttgccgtatgtgacaacatagatgaacctggagggcattatgctaagtgaaataagcaagtcatagaaggacaaatactgcatgattccacttatatgaagtatctaaactagccaaatcataggcacagggatagaatggtggttgctaggtgctgggtagagggaggacatgatttgctgttcaacagctataaagtttcagttatatgaggtaaatacattctggagatctgatatacaaggctgtacttacatttcatagtactgtgtttcacagtgtattagtctgttctcatgctaataaagacatacctgagacttggttatttataaagaaaaagaggtttaatggactcacagttccacatggctgaggaggcctcacaatcatggtggaaggcaaggaggagcaaagtcaagtcttacatggcagcaggcaagagagcttgtgcagggggaactcccatttataaaaccatcagctctactaattcactaccatgagaacagtatgggagaaaccacccccacgattcaattatccccacctgcccccctccatggacatgtggggattattacaattcaaggtgagatttagatgggacatagcaagaccatatcagaaggttaaaagtttgctaagagtagagatctcatgctaagttttcttatcacaatataaataaaataaatagatacctttgtcctaaaataaacaaactaaaacatgtgactctatgccatgcatacacatatataaagctttgaataaacaaaaacactgttattttactcacacacacgatgttgaaaaggcatgattatatgaaaagcatgcaggacatcatcagaagtttggcactgtgagagcacaggatgtaaaaggtaaggtctaagagaaatggggctggagaggtgagccaaaatcccattttagagcctgaattttagaaacccgtgggactaataaaaggtattatacagagagtgacagggttagattttgtctttggctttagtggtataattgaaaaactgtcccaggagtttaaaaaagaaaatacggggacctaactaaaaatggaggtaaaactgagagaatttgaagatcctctggaggtacaggatgagggatggtcttaggacaggctggctctcaaatttttaggggaacagccactggggatacctgagaggagtggaactggacaaaccaaagggaagagggacctttcatttttggacatctatggtatgcttgacattgcttctatctttcataccttcataacgatcctgcaaagtaagaattattatcttcttgggaggctgaggcaggtggatcacgaggtcgtgagttcaagaccagcctggccaagatggtgaaaccctgtctctactaaaaatacaaaaattatctgggcgtggtggtggacgcctgtaatcccagctatttgggaggctgaggcaaagaattgcttgaacccaggaggcggaagttgcagtgagccgagattgtgccactgcattccagcctgggcgacagagtgagactccgtctcaaacaaacaaacaaaaaaaaagaattattatcttcattacatatgagaaaattgaagctgttttatgtgtccaagatcacaagatcatatagctgagaccaaatgtgacccataattgtctgcattctgaaacctatgattttcccactagatcctctaagttcctttttttgctccagatttcaggattctaagcacacaaattaatttttatctgttcgaaattgaaataaggcaagtcttagtggaaatgatctgactttataccaagcctggttatatactctcttcatattaaacatattcatacagaggataagcggtacctataaatatcattccaataaaaatgaggccatgtattcctgagtggtaatacgctgcttgggtcagtgatataaaccaggaggctgaaggccaaacaactttaaccagcccagagattcaataagttaaaatatgttttggaagacagctttaggccagacctgctttttttcttgacaattatatgaagacaccttattcagcacaagcaggctggctacagggtgtgaatttttgtttaaaggggcagcaacaagtcatacaggcaacagtgatttgaattttaacttcagaagtagaggtgggtaaccatggtctttttgttgttgttgtcgtcgtcatttgttttgtgttattatttgaaaatccgtatccacaaaaatctcactaacagattgtttccttctcctgaaatgctctcccgactccaacactttttaatctggaaacttcctatagggcaaattttagcttcttaattgggggagattttgccttccaaggaacacttatttgaatatacctacagacaattttggttgtcacaacttgtgtatgtgtgggtaaaggacctctaaaagttagagttcagggatgctaatattctttttttttttttttttgagatgaagtctcgccctgtcgcccagactgcagtgcaatggcgcaatcttggctcactgaaacccctacctcctgggttcaaattattctcctgcctcagcctcctgagtggctgggattgcaggcgcccaccactaagtccagctattttttgtatttttagcagagacagggtttcaccatgttggccaggctcgtctcgaactcctgacctcgtgatcccccaccttggcctcccaaagtgctgggattacaggcgtgagtcaccacgcctggcccagggatgctaacattcttcagtgcataggacagtccccaaaataaagacttacccagtccaaaacattaatagtgctaaggttaagaaacgtgatatagcaataccattcaggacataggcatgggcaaggacttcatgtctgaaacaccaaaagcaatgacaacaaaaaccaaaattgacaaatgggatctaattaaactaaagagcttctgcacagcaaaagaaactatcatcagagtgaacaggcaacctacagaatgggagaaaatttttgcaacctactcatctgacaaagcgctaatatccagaatctacaaagcacttaaacaaatttacaagaaaaaaacaaacaaccccatcaaaaagtgagcaagggatatgaacagacacttctcaaaagaagacatttatgcagccaacaggcacatgaaaaaatgctcatcatcactggccatcagagaaatgcaaatcaaaaccacaatgagataccatctcacaccagttagaatggcgattattaaaaagtcaggcaacaacaggtgctggagaggatgtggagaaataggaacacttttacacgttggtgggactgtaaactagttcaaccattgtggaagacagtgtggcgactcctcaaggatctagaactagaaataccatttgacccagccatcccattactgggtatatacccaaaggattataaatcatgctgctataaagacgcatgcacacatatgtttactgcagcactattcactatggcaaagacttggaaccaacccaaatgtccatcaatgatagactggattaagaaaatgtggcacataatacaccgtggaatactatgcagccataagaaatgatgagttcatgtcctttgtagagacatggatgaagctggaaaccatcattctcagcaaactatcgcaaggacaaaaaaccaaacactgcatgttctcactcataggtgggaattgaacaatgagaacactcggacacaggaaggggaacatcacacactggggcctgtcgtggggtgaggggaggggggagggatagcattaggagatatatctaatgtaaatgacgagttaatgggtgcagcacaccaacatggcacgtgtatacatatgtaactaacctgcacgttgtgcacatgtatcctagaacttaaagtataaaaaaaaaaagaaacgtgatatagggtcttatctgattctcaaggtaaattaggtcctccacgatttatgttttcacagcaaactaaattcttctttcacagcacacatcacatgttgagagacatgttatttgtatgattactgctatggtttgaatgtgttcccccaaaaccatatattggaaacttattacccttgcagcagtgttgggaggtggggcctaatgggaggtgtttaggtcatgaggtgtctatccttttgaatggattaatgttgattataaaagcacttgaggcaaggcatggtgtctcaggcctctaatcccagaactttgggaggacaaggcgagagacttcttgcttgagtctaggagtttgagaccagcctgggcaacacaatgagaccctgtcaccacaaaaaaattaagaaatacagctgggcatggtggtacatgcttgtagtcccagctactccagaggttaaggcaggaggattgcttgagcccaggatgctgaggctgaagtgagccatgattacaccactgcattccagcctgggaaacagagcaaaaccctgtcaaaaaaaaaaaaaaaaagaaagaaagccttgaggctgccagtttaactcttctctctgtctctctctctcttcctttgcccttctaccataagatgacacagcaagaaggcgctaaactgtgacctaataaatttctcttcattataaattagtcagtctgtggtattcggttatatcagcacagtatggacttatacagccatctaatagctttcttccctatgcaacggactctaggagggtgaggaacagcattcaattttctcccaattgtatcctcagcagctagtataatacttggcacatattaggtgaaaccctgtcactacaaaaaattaaaaagttctgggcatgtaatcagtaaagacttgtgaatgaatcaacacgtagtaaaagagagaatgcaatcagtcaatacattatgcttatgaaattacatctctacttcagttgaaaaaattgatgaaaaatataaattgattgattaattgattaaggaaagtataaaccaggaatcatttgtcaccatggtgctgcagacccacacagtactaacattaaccaaagtaaatgccagcttccattaaccaacgtaaatgtcagtggtagtcagctcccaagatggtccccaaccatccctacctcctgttattcacatccagatgtagtactctgctacttccaaggctagttcatgaaatgtattataatttctttcccttttctcttggctcacttactctagtgaaagccatgtgccatgtcataacatactgaggcctctgacaatagctgtgtgagtacaccatattggaagtggatcccccagtcccagtccaaccttcagatgactgtagccccagctgacatctcaactgcaactttaagagagaccctgggccagaaccataagctaagtcactctaagattcctgactctcacaaactgtttaagataataaatatctgttaagtggtaggaaatttaaatttaaccaaagaacaggaactttcttgagtaccgaccgagaggctggcaggtaggactaagaaattaggttatggagtcagaattgagtttgcaaccttattttatttaggtttactccgatgttataactgaccctgaccaagttacttaggtcttttcattgcttttaaaatcagaataatatctacttttaagggccacaattaaacacaaattgagtaatatgtagtggggtgagttattaatgaattaagaggtatttgagaattttttagaggaaagagggaggagcgtggctaggaactctttaaaatgagaattaaaaagcaaatgtccttttcattgtgagttctgggcttgcttgtccaggtaggaattaagagttcacttttcagatccctcgactacacctcacaggaaaggaggaggagacttttgtgcttcagcagcaagagaagaggggcatggcttgattctgaacacaagtgtagaagtctgaaaagctggaggaggattacctgagttgcaagaacccagacatggtcccctgatgtcacaatctgaacacataacatggcagcctcaggaactggagccatagccaatgtcctggcggccaaacttagtgtgtggggcacggacactaccagcaaaggttccagggcacctcaggcctggacgactcccatcacagaggcaacctggagggaccaaagaccagcgattcttcttggacttcctgtagtgatagggtacgccacagttttttgtttgttcgtttgtttttaaagcctaaagagcgggaggaagggaatgcaacaatgatagagcttggatgagccactagccacaatggtgaaagacaagatgttttattaaattcatcaaaatagaagaaacctgattatgtcttgcccctggtgtcatccagcaagtcctacatactgaaaacagatgtaaatgctctgtcctataactaaatgctattggatttccttttctttcagatgccgagcataagcaagttaatcattgatgatactgtctaggttctccccaacagaagagcttctaatgtcggatgccctacaggagtcaacaacattgccacgggctctattttcctccctgccatgatgggcaatggccagagaggggtgcactgtccttgccaccacactgtactgctgcacccacctgccccaagccctcccttgttctatcccactgttatacctgatgccaactccctacctcacagttaatttgtctcctacaagcctgtgttttccctcatgtcttgcttctatttcagctaattccaggaaaaaatgttacttaaactcactcagttctaacacatatgaacatttcctgccctaccttttctcagaccttgcatgaaatgtctttgtttcctccctctattctgtaagtcaactaagaacctgaaaggtaagagggctattagcatacatcaggaaaaatgggaaaaaagtaaaataataggttttgataagaaaatagaggctgacattttcctctactgaagggcgtttgctttactaatctttcttttggtatttctcaaaaaaaaaaatccatttcatttttcttaccttaacccacatatttatctttctttttaaaaaaataactgccattttgcaatgacctacagttcacttggcttggcataggaagaagtgaggagctacagagtcaggcagaactagctttggttcctagaaaagattgcaacataatcacagctgcttagttctacccctatcttcagagatttatggcttcacagtataaggattggaaaagcctgcccgggccctgaaaactcagagggagtatcatccatatgcaagaaactttgaacagctttcagaaggtggaattcacatggaaaaggacagaaaagggcatgggtggtgcagggaagaaaagatttctttcctcatcggttgctaggttcatggctgaggcacctaaaacaaaagacagattaacaagagaaaagcatacgcatctatttaatacatgttttacacaacaaggaagtcttcagaaaagaaggcccaaagaaagaggaaaatctgattttttttaatgcttacatttgatgaagagtggacagttgtgccaaaatataattggaaaaagtggggattgtctaatggtgataaactgaagggaatttagcaagatctattttgtaacgattcttctccatccccctgtgtcttcagagataaggacgttcctctcctctgggaataggaagggcacctctggaataagggtcttaggactttcttcaggggagaaggctgggggaaggtgagatatcctcctacttctgctgtctacccaaatgccaaggtgccatatttgggggtagcatgttctgaaccccatcgattgtgaagtcagtaaatccatcttcattgtaaccctttttaaaatatgcatgtatattagggaataatttgaacataacacaaatgtttgattatgcctcatttcacaggagagaaaagcaggtgactggagaaaactgcactcagatgaaccaaccacgaaggaatacacaaaatgtatgcactcatacacctcaaacatctgcttccccactcagattacagtgtgtgtcagccacatctggggttccaactttccctcccatttcagacgatcttccatacaccatttctcaataacacacaagttggaatctgatgcccacttacacacagactgcatctctttcaaagtaaagtaccatatttattgtagtatttatgtattccttagctatttaacatgtctaaaactgagctaagatttttcctaggttcctattgtttgggtcactgataaagtttttaaatattgtatcctaacttcattcttcctataagccctgtaatttttagtgtgcaattttacatatcgtggcgatatttaggaatgtataggtcacatgacatcagaactgactgtattcgcaagcgttgggtgagtaaagagggtagatatcaacagaattgcatggaagagtcagggaagactacggcttcctatattcccgaatacaacctgcaagatgcccagtaaggcaggattgtccaaaacaaataaggaggaaggtaaaaatgcacaaagtctatgaagatgtgacaggtcttttttttttttttttaattttactacttgatggatatgccttcaaaaatggtgaaaatgtgtatcttccttagcagaagacacacttgtctatgtaatatccatctctctccccggccctcttcttcacttctggcaaacactgatttgcgtggtatttactctttaatgtggctatgcattcatcaaaggagatccccctttatcccatctcaaggtttattccacctcgagaataaatattgaagaatctcagtcaatcatgataactattttcttcaccagtgatcggttaacctatgggcatgggacctcattcttgccaatgaaacgtgagcagaaatttacattgtgcatctgggaatatttgcttaagagattcttaggaagggatgtccccaggtccacaggaaatgtctgagggcatggcagctatcttctgaccaagaggacggccagcctaaagacaaagcccacacactggggttgacagagcagaaaaacctgagtcaatcatgatgtttttaaaataatgaattaagcaattccgcagcttaggatatgattggataccttgttatatgatgtgacacattttccatatggtataagtcattttgagttggctttgttacttagagctgattattttactatttgtttagcaatactactttcagaagaatcaaaactatgagcaaagagtgacataaaggggaattcattgaatcattatttgttcagtgcaataatgaacaactagaaaaaactaaatacccaagatgagggagctggctaaatagattgagcccattttacagaatcctctgaaaccattaaaatgaaggtgatataaatgtaatatacattgatattgagaaatgttcaaaatgttcttgcccctcttgctcatttaagtcatttgtcacagtattaactctgctgaagcccatattttctgcctactccgagtctgctggacaagtgtgaggaaagcagtgacccatgctaactggtctcgttgtaactcctgtctgctaacctcaagtgctcccttggtatttcctggtgatcctttacatttccccatttcagtctcattttcagactcccacactgtttcctactttatggagtctcttcaaacctccaacacctccacgctctcctcactcttagctgataaccctgcttcctgtttcatagagaaaatggaagttccatggtgagaacacggcacatgtcagcttaactgacccatccccatacattctgtcttccctcctttttctacagcagaaggacctatgccgcatctaagaccaactcttctatgtgtgagtgagaccccctgtgctctcatttaccaaacgtcatcccaagagcagtgtccatcctctttggggctttttccctttccattggatcatttccctttagttctaatatttctcaaattttataaaataccaacaactccccaccttttgatcagagaacatcttcaggtactgtctcctgtctctgccttctttgtatctttctatacaattcctctcctgctgctctcccttgggcctgtgtaatcagatttcagtacccacaattctttataaattgctaatgttaactcaccaatgacctctctgttgctgcatctaatggtcaattctcagtccttattttacctgaactaccaacagcatttgacacagtggatcaccttctccttttgttctttttttattacttggcttcctggaccctgccctcatttttcttcttacttcattggctgatacttctgtctcatttgatgattctgcctcaaattttccaccttaaaaatccaagggtcccaaagcttagcactagaatctccctattctacctacactgagaccctttcacctcctccagctttacgtctgcaaagctcgtgcataggctgactcccctgctaacatctccgtcctctacttctcccctgaactccagactggcatatctgtctacttgatatctcacccaaaatatccaacaggaatccatctgaaacttaacagatgccaaacctaaatcccaatctttctctgaaacctgctcattccagtgtctttcctatctcagttaatagcaactccatccttccatttgctcagtctaaaatacctggggtcatttttgattcctctctttctttcacatcccaaacctactttgctaccaaattccattggctttatcttaaaactacatctagaattctactacttctcatcactccctcctactttggtctgagcctccaccatctctcacctgcattattaaaatgcctgctcagcagcctctctacttctatccttgccttcctttagcttgttgtcagcagagcagacaacatgatccatttaaacaaaaagccaaattagtttcttccactctttcccttactcactctattccaaccacactggcttggaacacgctaaccagtctctcccgtgaggccctttgcactttcttttttgtttgagacgcagtcttgctctgttgcttaggctatagtgcagtggtgtgatcccagctcactgcaacctctgcctcccgggttcaagtgattctcctgcctcagcctcctgagtagctgggattacaggcacccaacaccatgctcagctaatttttgcatttttagtagagacggggtttcaccatgttggccaggctggaactcctgacctcatggttatctgcccaccttggccccccaaagtgctgggactataggcgtgagccactgagcccggtcactttgcactttctgttctcactgcctggaacagccttcctccagacagaaatttgccttccctcaggtctctgttcaaatgccacctttaaagccaggtctttcattgaaaataaaatgtccctcccacacaggtggccagtacaccctgtccccattatcctgcttttttttacctgacagcattattgccgtctgatttactatatattcatttactatctgtcgcactcaactagaacataagctccagtgagatggtgtcagttttcccactgtcatttcagtgcctggaaaaatgctagacctacgatgcgtattcatgtgtttggtgaataaatgaaaatattgcgttaattaaaatgcacacaggttataaacaattttttgtttttgtgaaacaaatctctaggaaagccaatagttactggatatgtaatttttttgtcaacttttattttggaatcaggggtacatgtgccagtttgttacaaaggtatactgcgtgatgctgagggttggataccaatgaatctgtcacccaggtagtgagtgtagtacccaataggtagtttttcagcccttgctaccaccctccattctcccttcccctctagaaattcccagtgtctttgttcccatctttatgtccatgtgtactcaatgtttagctcccatttataagtgagaacattttctgtttctgtgttagtttaagttaacggctttcagttgcatccatgttgtgacaaagcacatgatttcatttctttttcgggtctgcataatattccagggtgtatatgtaacacattgctttatttgatcctccattaatgagcacctgggttgattccaggtctttgctattgtgactagtgctgtgatgaacatacatcacaggtgtctttttggcagaatgatttattttcctttgagtatatacccagtagtgggattgctgggtcaaatggtagttcaactcttggttcgttgagaaatctccaaactgctctccacagtggctggactaattttaatttccactaacagtagacacttactttgtaccagtcattttcttgggcaatttcttatgtcatcaaaatcataactattcaaagaaataggcacctagtatctccactgtaaatttgaggaaactgaggcttgaaaaatgtagttaacatactttgtattaaataactagaaagtagcagaggtagtatctggtttgatgatctattgtctgtggtatactacctcaaggtatgtgtgtctgttccacaaaaaaaattgtaaaaaaaaatacatacatgagaggatcattccttaataaaacaatagattaaaaggaataaccaatagatgtgtacaaatctgattaaactaatggttaataaaatgaaataaattaaaatggtatgggtttttttctattctattggcaaaaatatcaagcagcagtagccataatgtattaacaaaataatcatttacatgtgggaagatttatgtgcaaggattttcattacagcattgagcataacagccaaaaattatctaaaaacaggagcaggttaaataaagtatgtacatctcaaagatggagtactatatcgtcattaaatgatgcaaaatattatttgagatgtgaaaatgatgagtgtattatttcatgaaatatgcaggctacaaaatagcatgtatatcagaattcaaatggcgcatcgacaagaacaaaatctctttgtatatgtcttgatctgaatattaaaattctggaaggaagtcatctttaataacaataattacctcctcacagagactctatgtgtaataattttccattttaaatttatgtattttttaatttaaaaaaacatagggctgaatcaggtatctattggtactccaacatttagtggcttaaaacaacaataattgattatttcttatagttttctgagttagcaacctgagctgttctgctagaactgctcgatgtcattcaagtagccatagtcatctaagctcagctgaggctgcatgttccaagatggcctcactcatacaactggcagttggtcctgactgttggttaggacactgattctcttcatttaatttctcattttccaggagaccagactgagtttcttcacagaaaggtggccccagacactgggagggcaagagcaaacattcctagtcagtcaaggcgtttgaaaacctcatttctagacttgcacatcatcacttctaccactttctattagtcaaaaagattcacagtcagtgtggatttaaggggctggagacttaggctccgcctcttgctgagaagagtggcaatgtcacattgcaaaggggcatgggcatgggcatagggatgtatgattcactgagaaccattactataacactttatgcattgtaacagattatctatcacaaaggtcatccttcggcggtaggaactatggcaccctcagagtttatcacctatgtaaccatagctttaagcttgggcagcaatatgagaagccacccttagtgccaaggcaggggaggagaaaatggcagtgcaaaccaagaagtctaaataacagttcagaaatagcaccagaatcacctgggatggggagctttaaaaatacacttactcctagagcccacagaggattctgatttcaatgggataggcctggggttggactaataactcttttggtaaatccctcccaggtaatccagatgcttaacctggttttgaaatctttgcactaaacacaggatatcctgagggctcagactcattttgaggaatactggagagaggctccttttttcctagcagccaaattgttttgagactattgctgtgacctggagacatgagatatatttactgactcatcttgcacaagtactacaacaatgtgggttaaatacaattctctagattctagccaccatttacatcacttttcacccggaagaatgtattgtgtctttcaaatatctgacttataagatgacttttgcaatatcatcttttgtaaattgagggtggcctgtaacttggttgccttagcaacaaattggactgaatgttaacagttgagtccagatgttcattccaggcagacaagaaaacacagcctggtccactttgaaatgcactcatcagtactgcccacatcagtgtttgacatggttctcagatgcctcatgttgtctttaacccaactcggagccatgggcattacccgtgccagattacattttttctttttactaaagagacagcaatgtggagtaaaactgatcattgatttttaaggcaaaactattccagtgtctaattcagggacatcatttaaaaaatcatatgggacttccatatgacttttttttcatagcaagcatgaccctagacaagcacagttgattggttgattcaactattttgataatttttattaagaagccatattttgctaggtcctatgctatgtcctagggagatgagtctgttataatttcttcccttgaggagttcaagcctagagaggagatggtatttaaatgacttctacatttgtgagcaaggacaaacaaagatatatgcgaaactggggagtccaggggacaacagaactatctgtctctgagtaggtcaggaaagacaccaccaagaagccacatcttgctggataaggtggactgtgcagggcagagagagtatgaaggaacatccctgcaagaggaattgtctttgcaaaggtgagaactggaagctcatggtgtattgagggaataccaagcacgcttgcatgttcaggaaaaagaagagaaaggaaaggtcttgttggtcacactaagtcctcaggctttagagaatggagttatggagggaattagagcaggtagtgtgacatgatcaaatgcacatcttggaaagttggtagcaaccttgaggacgagttaaagaaagacagtgaaacagtgtgggagtaattctacagtagggataagggatcgggtttttaacagatgaagctatactgggaaggaaggaaggaaggaggatttagtggccagatgtgggtttcgggaggagggtggagccgaggaccccctaggtttctggcttgggggtgttgggtctactttttaaccaggacaggaacacaggagcagggacagttttgataagcagataggttgacgcagatttcaatttggagtaactaaaaaatgtcaaaacagtaataaataaataaataaataaataaataaataaacaaacctttatttaaaaaagtctctatcgggatggacatcttaacgcattacaggtttaatgtctccgaagcttactgatttatcccccttttccctcactctccaccatctcttctgaatattccctgacaagataatatgcaaggaaagttctgccaactcaagacaatgtttaacgtaaaccttggcaggggttacggagttaggtagtggaaaaagtgttaataatgataataataatatttatatcatattccatagccttcaaactgcttctacctaattattttacagtaataatgtctgtaaggaaaatacaagcattattttttaatcagcactttgcagaacaggaaacacacacatacacacacacgaaaggcagccatagagcactgaagaacaagtgaacagagagccggaggtggattcaaacaccttctctgcagctgatgaacccaatgtgaacttagacattgttctctccgagccccaatcccctcctttaggaaatggggttagcagagaggatggcatgttgcaatggatgtgcccagtacaggcttaaccaaaggatgttaaatccccaggcatcatctctgtcactgccagcccgatcaccagccaagtggagaagacagatcactggaacaagcctaagccgttgaaactgattgccacagtgttacattgtaagatgttatcttaaatattttgtaactgctgctttgctggggaagcagggtgtcttggttttccagagctttctctctaccctactggtcacagctggtggacatctgtcctgtcctgggacaatcagacccttagtggtgggaatttgaaattggttcgctctgattctaatcaggctaagaactgttaggtggtctacaatggcacattctgccaggtgaaggaggggagcagagaatagagaaaagtgaatgaagcaagtttgcagagagagcacagaggtgtgggagatggggagagaaggacagagactcagagccagccactgcctcagtttctgttgtgggttttggttccccaaaacatccctgacttgagatttgtgttagccttatatctttccagcaaattgtcctcttgattaagccaggtggagtgggtttctgttatttgtaaccaaccaagcctgtgctaaaacagatgagggcctattttcagataattgggcccaagaggctggaggcgagcatgcaaccaacacatttgtgaaaaatgcaaagaaatttatatgatcattctcagaaagatgccctgtttgctcagggaggatagtgcagttaaaaaaaaaaaaaaaaaaaaaaaaaggaaaagtcagcgacagctaaagacttcagtattgagccagttctgaaaggcattgagactgacccaatgacccacatccaataatatgcggcatttacaagacagagagggaggcggtggtgtgggcacacaagaggaaaggggactcaacagtctggcttccaacaaagaaaaagcgataataatgcttggtgtggattgtaaggcatttaatctggaggaacttgcaggatttgtgaaaacatctgctgctactcatgccgctttgtgttttgctctctcagggggactgtggtttgggggtgtgtgtgtgtgcatgtgtatgtgcatgtgtgtgtgtgtgtatacacatgcgtgtgcttgtatatgttcatgcatgagcatgtgggtattacaaggaccactataacatctgattctgtgaattgttaaaatatacagctgacatatataaaaatggcacagttttaagaaggcaatcattatttaattattctcaatgcaatacttacggtagagaatgtagataatacataaaagaaaacaaaaagtcttagtctgattacccaagaaatcttaatactttcatgtgttacctccccccttttctttttcctactcatttttacatagtttcagtcattctaggtatacgatttttgcattttgcatatattgcttatattatttcgtaaacttgcatccttgattattgaacatccttatcaacatttttaatgactctaatattccatggtatgcaaataccatcatttacctaaacatttctctatttgttcatattccaatagatttttcttcacaattataaatgataccacaatgactagctttgtgagcacaagtgtttttttaaccctatgttggacttgtactgttaagcatatcacagataaacagataccttcctcaagtgcatcaaatagttactactactacctacatatgaagacaaggtgacaggttgtgtggatgagctttttaaagtatgtgggatttaaaatctgacctcatggttacatttcaatattggataaatgaatccctttctgctttgaagactttcagtcttcaattgctccctttaaaatgcaagcatcataataccttgggcaacagggaccaaaaccctcttcaatgaccagatctgtagacaaagtcctgtagaaaagtgcagggacttggacctgtgggtctctgctttctcacctccactcttcttctccaccacattcgctcacagtagtgatggttctgactttctaatctggccctatccaaacctgcctggttggtacaggtgacctattctcactactcgatggcttatcctgctgccttttgtacttagaaaaatactgggctcttttctcctcattctatgggagtctacctcctcacccctctaggccctctgggattttgaccccatttccaacaaaagctccagttcttcaaactcagaacttcattctgatctccagatcaacagaagccctggactcagctgagcttcttccacattcaaattcagacccgttcacccaagaacaagatatggttgagactggctagatattcaccaaagctaattcttctcctgggcacacagttggacaaagctttgcatgtagctgtggtcatatgtttgagttctcaccaatgaaaaagaggtggaagttactataccacttctaggcttgattcatgagatcctgtgtggaatccatcactctcctttccctggtcagccatccagaccctgcaggggacttgaatgccttaggggatgatgaagacaccaaataaaaagagcctgggtgcttgaatgactgagtaaagatctcacctccacacaccctccaacattcattcaaccatcattcttaaacaaaaattatggttttctggtcattatttccattttttgcctgtgccagatcatctattcttacagcatcaaatagaaaaatttgactacagggcacttagagaatgtgatgtggtggaaagaggccagattcatcaaattcaagctgtatgactttagacaaggccattctgctctcttggcctcagcttccccattagtaaaatcaagaggctagtctacattgcacataagaattctcctaaccctaacattgtatggatttgacaaattacaagaaaatttcaaatgtaaggaactaaatatgactgctatgtcttataattttcaaaatgtcaattgaaattcccaatatcaattgaaaatcccaattgaatagacatcttgaaaaacgtaacagtcataaacaacacaaaagccaaagatataaaacaaaattggataaaaacaactgaagtatgagattttattttttccagtagtgagattaattttttgtcatgacagataaatgagacaaaagtaagcatgtgaatagagggccaattaattatatatatatatatacacacacacacaaatatataacatatcatatagcaccattatgcactaaaagaacttgaagtcctatgaatgtacagtctttatgtccttagatataaatataaatatatgtaaatttatatatacaaattgttcatttggctaaaaagaaatcatcatacattctgttatacaagtgatttcgcaggccacatttcttttttttttctttttttttattatactttaagttctagggtacatgtgcataacgtgcaggtttgttacatatgtatacatgtgccatgttggtgtgctgcacccattaactggtcatttacattatgtatatctcctaatgctttccctccccaatttccccaccccacaacaggccccggtgtgtgatgttccccttcctgggtccacctgttctcattgttcaattcccacctatgagtgagaacatgcagtgtttggttttttgtccttgcgacagtttgctgagaatgatggtttccagcttcatccatgtccctacaaaggacaggaactcatcattttttatggctacataatatttcatggtgtatatgtgccacattttcttaatccagtctatcattgatggacatctgggttggttccaagtctttgccattgtgaatagtgccgcaataaacatatgtgtgcatgtgtttttatagcagcatgatttataatcctttgggtatatacccagtaatgggatggctgggtcaaatggtatttctagttctagatccttgaggaatcaccacactgtcttccacaatggttgaactagtttacagtcccaccaacagtgtaaaagtgttcctatttctccacatcctctccagcgcctgttgtttcctgactttttaatgatcaccattctaacttgcaggccacatttctaatcataatataattcaattaaaaagaaagccttaacttcttggaaactgaaaaactttatcttaaatacacagaccctagatcaaacaggagatccaaatgtaaattataaactattttaaaaataatcaagaaaaagagacaatttcatgccaaaacacgtggaggcagctagggatatatccagagtaatgtgatccaagcatttcaacattacaaattagaaaaaaaggaacaaaataacaaaataaaattagaagaatataagagctaaaaataatgacattattttctttttagcgaagtaaacaataataatgacataaagaaaaaacatgtatctaaataaaatcaaaggtcgtcctttgaaaaaacatggtacatttggtgaagcaaatgaaaataagagagtataacatattaaaaaagagaaaggtggtataaccataaatagacaagatattaaattttaaaatattatgtataactctgtaataagaaatttgagaatttcgagagtgataatttttctagtaaataaaatgaaattcaaccgaggagaagaaaatcacgtaacagtttaagaaagttatttaaatacctttataaaaaccacctcaggtctagatccttttttttccaaatgattttaaaaatatatcctttaaggaaagataactctgataatatttaaattatctcagtccatataaaaataaagcttttccattcattttatatatccaacataattttcatgccaaaacaggatacaaataatgcaaaaataaaactagagataaattttacctataaatacagatggaaaatgttaaacaaatggaatcaatcagtgcatccaaagtacaaaccatgactaagcaaggattattctaagcatggctcatcatcaacaaatatattaagacaatgtattacaaacagaaattaatgggaaaagccatctggttgaatcaatagacagtgaagtgacatctgttattgtgccacccagtagctattttcccttcttctggtgactgataccaaagctttcctctgggaatccacctgctcatctcctttaagcagatgtagaggggatgagatcctacccagctcaggggtgaagcttgtgatctacatttgagccaatcagcacatcacatttccctggtcttaatgattgtgatttagaggtaagactatgggcgtaccaatcagagagatgcaataaaatattttctgggagccctaggaatccctatctcttcctctaccactagatttgaagctaaatgcttacgagttttacagttgttgcagctgattgaggggccacgggggaagagtctgtaagagttacctgatcctgataacacagtttgaacccttgtatcaagctggtctcaagccagcctcattctgagcattttcagttataaaagccaatgcattcacttttcactggagtcaatttgggttaagatttcctggaatttgtcacagaggaagttttcattgatgtatatgccaggatacatttgataaaatccagtagacattcctaatgaaaactttaaccaaaacagaaattgatgggcagtacttaaatataataaagacttttgaaaaaaacttcagtgaaccccttattaaggggcaaaattctgaaaccatttcctttaatatcatgagcaagacaggtatgcttaccatctccatttctatttaacattgttttggtggttaagccaatgcacttagtaaagaaatgagatactcaggaaaaatattttaaaaagaagagacaaaatagaatttatctacaaatgatgtgactctaaacttaaaaaacttgagtgactacttaaaaaatgtctagaatttatccaggagctgataatttggctagaatctatctaagtacataaaaaatcaagagcaataataaaaaaatcagaagaaactcccaatcataatgtgacttaaataatatgagacaaggaaaaaatacatttgatgggaatggttctaaacttaaaaagatattaaaatgcaaacaactaataaattttattgaaacatataaaaacatgtcctgaacaaattttttaaaataccacatgtatgaatgagcaaactcaatattataaatgtcagtcttcccaaaaccaatacgttgatgaaatacaatttcactcagaatcttcataattttaattcataaaattaactaccaaactattttaaagtgtatatggaagagtatatgtctaagaaaaccaagaaaactgtaaaagtaggaggaaccacgatgtttctttattaagcttacaataaagtaaataaaattgtatattattggtccagaaataataatttagtagaataaaacagaaataccagaagagattcaattttatatgagtatatagtaagtgacaaatatggaattttaattcagtaaaacccgtgcgtgtgtgtgtatgtgtgtctgtgtctatcttatttaaagaaattagattaatatgtaaggtgatgttttcttgataaaattaagaaaaagtaagtattctgctggcaacaaaattagggcatgcagtcagggaatctacaaggcatatgaagaatgatcacttcaaaacaactaacctttagataggaaactggaccttttgtgtgaaatctatcctgtgtttttttttttcctattaggataaaattatatattggctatacatgggtgaacagagaattaaacctgataacagaccaatccatcttgcaatacaaaaatgaaattataaggaaaaagattatctaactatctcggtctgccttctgctgctataaaaaaatacttgagagtgggtaatttataaacaacagaaatttattttctcacagttctggcatctgataagtcctagataaacagtggcagattggtgtctgataagggttgctctgcgcttgcaagatgtgcctcttattgggtaatcacatgggtgaaggggaagatagctccccagtatctctctcataagaacgctaaccccacatgggagggctctgccctcatgacttaatcacctcctaggggtctcacctcctaatactatcacactgatgatgaaatttcaacatatgaaacttgaaggaacacattcagaccttaccactgatagatctattaaacgtgggcttgttatcctgaaatagttataccattgcaatcaaaaaaagttagaacaaaatccaaaataatgtcaaattgaaggtattatttgtagccaggcacagtggctcatgcctgtaatcccagaactttgggaggctgaggcgggtggatcatgaggtcaggagttcgagaccagcctggccaatacagtgaaaccctgtctctactaaaaatacaaaaaattagccgggcatggtgtctcgcgcctgtagtcccagctactcaggaggctgaggcagaataattgcttgaacccgggaggtggaagttgcagtgagccgagatcgtgccactgtactccagcctgggcaacagaacgagactctgtcgcaaaaaaaaaaaaaaaaaaaaaaaaaaaaaaaaaaaaagtattatttatacaaactgatatatcaacaatgtcttgcattataaaagtgccaataggttgctggaaggcaaaatatttgaaaggtggagcagtctgaaataaattgtgtctctattttgtttctgatgtagttttagaagaatgttaaaggaaatataacggaactaagatgatgcaaattagagtttggttggtcccttcaggaaagagtttggcatggccatgggccaaattcaacctttgctctatctttgtaaagttttgttagaatatagcaacacatttttgttacttaatgtctatagctgctgtcatactatctacttggcttaaaagaaaacttgtttaattctagaaatggagcagactgcagtctctgagtacaactcagtaaatttaaaaagaaatcatgaaagtaagaacaaacaaacaacccaaaccacttggaaaaaaaggaaaattttaaatatataataaaaatttgattcaaagaagtcaaaatctcggtttgttccagaaattttgaaaaacaacggtaactatgatgtttcatgcaaaaacttagggaatactgccaaaactgcatatttcattgtttcattacatataggaagggtgaaaataaattattgaaagcatttaattcaaaaatattggtgaaaaaagcataccatgaaattctgaggtactcagaaggaggaattaataaaagaaaagtaacaaaggagtaggtttaaaagacatattcagattgaatttgttggaaatcaaacatatttccatctagataataatgtagatgagccaacagctaataaaatcaataaaaatagaaatataaaaatatgtacaaatgcacctaacagcagttacataaaacgaaacaaaaatacaccaccaacaaaaatacataaaacaaaactgagaactggaaagagaaatatgaaaatccacaactatatttgaaaactttcctctcccagtaattgatagaacaagtagagggaaaattattaaaattagagaaaatctgagcaaaacttcaaccacttgacctaagtgatgttatttcagactccattcaacaacagcaagatatacattcttttcatgtgcccctggcaaattcaccgagatagaccatataccatactatgaaacaaatcctaacaaatttaaaagaacttcaataacaggaaatgtgttttctgactatagtagatttaaactaaaaattaataacagaaagatatctgaaaaattccccaatatttgtaaattatacaaaacacttcttaatccatggatcaaagagtaaatcactagaaaagctaatgcacattgaattgattgaaaactaaaacgcatcatgtcaaactatgtgtggcagtgggatacagctaaagtagtacttagaggtaaatttatggcagtaaaatacttatattagaaaacagaaaagttctcatatccataatttaagcttctaaattaagaaactagaaaaagaagtacataataaatgtaaaggaagcagaaagaaggaaatactaaaggtaagaacagaaatgagtgaacttgaatatagaaaactaatgaaaacaaatggtaaaatcaaaagctgattctctgaaaagatgaacgccaggcatggaggctcatgcttgtaatcccagcactttgggaggccgaggcgggcagatcacttgaggccaagagtttaagaccagcctggccaacacggtgaaaccccatctctactgaaaatatgaaaattagccaggccaagagtttgagaccagcctggccaacttggtgaaaccctgtctctactgaaaatacaaaaattagccaggcatggtggtgtgcgcctgtaatcccagctactcaggaggctgaggcaggagaatcacttgaaccagggaggcagaggttgtagtgagccgagatcgcaccattgcactacagcctagccaacaagagctaaaccctgtctcaaaaaaaaaaaaaaaaaaaaaaagaaaaaagaaaagatcaataaaactgacaagtctctagccagactgatcgagaaagaaaagaaagaagacacaaatcgttagcatcgagaatacaaggacgaacattactacagatctttgagatattaaaaggaaaaataaatattagaagcacttaatgccaataaatttgatagcacagatgaaataaacaaattatttgaaagacacaaactaccaaatctcactcaagaattaggtaacgcatttcaccaagaaaaatccatatgaaaacagtttcactggggaattctaccaaatatctacaaaaaaaaaaatagtatcagagaaagaatagtacttttaggaagcagtgcttaaacagatatccatatgtaagaaatcaacctagacccataccttgcactatatataataatcaactcagaacataacataggggaaacattttgtgacctttgttaggccaagaactttgagatatgacataaagtacaaaacaaagaaaggttgattagttgaaattcattgaaattaaaaactcctgctcttcaaagggcactgtcaaaaagataaaaagagatgtcacagacagggaggaaatatatacaaaacacacaaatgtgataaatgattgtatccagaatacacaaagaactttgaagttcagtggtacaaagacagttcaacttaaaatataggcaagcagtttgaacaaagatgtcatcaaagaagatatgtgaaggacaaaaagcacatgaaaaattcccaacagcatcagtcattatggaaatccaaattaaaaccactatgagctctaatcacttacacactcacctactcatgtggccaaagcaggggaaagggagacaatgagaagtcctcacaaggctatgaaatgactgggactcttcgatacagtgcaaaatggtacaaccactttggaaaacagttaggcagcttcttataaacttatactttacatataacccagaaaatcaaatcctggatatttatccaagagaaataaaaatgtatgtctattcaaagacttgtacacaaatattcataacagttttacctatagtagacaaaactgggaacaacacagatttctatccatgaatggatgaactgtgatatattcatacaatcaaatactactcagcaaataagaagtaaagtactaatacatgcagtagcgtggctaaaccttgacagcaagatgcctcatgaaggaaatcagactcaaaaagctgcatcctgtgggatatcatttacatcacattctagaaacagaaaaactatagggacagaaagcagatcactggttttcagggccgagcacagggaagaattaattttaaaggggcatggggaaactttttgggattatgaaaatattttttatttcaatagtggtagtggttatacaactatacatttatcaaaattcatttaattttcctcctagaaatggtacattttattatagataatattttttgaaacttaaacacatacaaaattatttatttgggcaaacaagcagaaacaaagatgacattagagtgatacggcacgatatttttgcccaaccctaccaccattttatttgaaaacctggatggatttccaagaaaccacaaatgaacaaatttgactgaaaacacatggaaaagctaaataaatcaataatcataaaatgaactaaaacacataagaatatcaagaatatcccagtggtttgagtgcttctcctatactctccccaaagcaccaggacattcagttttaggaaagagtattttcattcctttaagaaaaaagtaattcctatatccatgaaatggtactaggacataaaaagtgaaagacaatttaggaattcctttttaaagctactctcacccccatagcaaaacttaacaaaaggtaggcttaaaaacccccaggccaatcttacttatgaatatggacgcaaaaattttaaattaaatattgttacttgagcagctcaataaaataccatatcttatgataaaatgagatttatttcagctgtgcaagatggttcaatattagaaaatgtgcattcatgcattaccacattaagagatccaacagaaaatcacctgatcatttctgatcctactggtttatacctttcccaagatctcacatggctcaccctacaaggcattcaaacctcactcaaagaacacctccacagagaactagccttcttgaactatctttgatatgtcaccttcctaccagcccagaaccatcactctccacgagagtagagactttattttttgtttgagacagagtcttgctctgtcacccaggttggagtgcagtggcgcaatcttggctcaccgcaacctccgcctcccaggttcaagcggttctcttgcctcatcctcccgaggagccaccatgcccggctaatttttgtatttttagtatagacggagttttgccttgttggccaggctggtcttaaactcctaacctcaggtgatcagcccgcctccgcttcccaaagtgctaggattacaggtatgagccactgtgcccggccaagactttgtttactgtctacagaatgcctagcactactcaaccaatacttgatggatgaatatcagtagatattgacaagggttttaagaaattcaatctctatctatgataaaaggcttggtaaaatggaaacaaacagctactttttaaaatgacaaaagagaaaagtatctcatatccaaattttgctttctgtttaatgttgaaataatccaagcatttctattagattcagaacaaaacaaggatgtcctctattccagatataagtgccaaagcaattaaacaagagactgaaataaaaggtatgcctgtttttaaaaaggaggtaaaaacagttattatttgcaggtcagccttggtgaatcagctgaaaaactattagaaaataaatagaagatcttactaagggagctggttataaaattaacatgaaaagccagtagcttcacaatgtacaataaacagaaaatgcaaaggaagtaatgatcagttcaaaaatgtaatgcaagaagaatcctatacataaaagtcatcagaaaaaataatctaggagcaagtgaaactagaaatctgaagtacctatgtgaataaagctatgaaattctactcagaaatatgaaagattttatgaagtcagaataaattcaatattgtaaaggtatcaattcttcctaaattaatctataaattcaatgcagatagaatataaatccagtaggatttctattgcaacttacagttctctcccacttatctggaaaaataagtgtgtgagaatatccagaaagtgtttgaaaaagatagcgggagatagatctatcaaatattggtaatgtattggaaaagtacagaaggtgaaactgtatggtaatcgtgcagaacagcccaacggaaaatactacagaatagagtccagaaatagaactgaaggaacatgtaagtaaaaggcagcagtagagcctagggcaatggttgggcattaggttcaaatcccagttttgcctcttcttgctatgggaccataggcaagttgcttacttttattcatttagtcactgattttagagaagggtcttgctctgttgctcagggtggagtgcagtggtgtaattatggctcactgtaaccttgagctcctgggctcaagtgatcctcttgcctcagccttccaaatcagctaagactacaggcatgtgccaccaagctcagctgggctttttgtcttttttgtttgtttgtttgtttgtttgttttttgtagatacggggtttcactacactgcccaggctgcttttgaacttccagcctcaagcgacagtcctgccttgacctcccaaagtgctgggattataggtgtgagccaccatgtctagcccagttgctctgcctttctggaaaacattgttctcctgcatggtagtggggaagaatagtattataataatagtaatgacctcagatggttttgatataattacatgaaataatctataaaaatgctagcataggacttggcatttaggaaatagtcaatacatgctagcatacatacctgcatacatatatgaaattcttattttaagtttgtagaggaaagaagttgttagcacaactagttagctatcttggacaaagtgtgtacatgggagtgatgctgtatgaggatggtcatctccatcattatttataggggtgaaacattattgatccacatgactaagaaaaatgaacataagagacctctatatattgatacaaaaagacaatgttatcttgttgagtaaagaggttagaatgcaacatgtatatagcacaaacttgcaatgtagaactgtgttcataaatctaaatgctttctcttcctgtagtgggttgaatggtgactcctaaaagatacatctgctcagaacctggaattgtgatcttatttggaaataggctctttgctgatgtaattaagttaaggatttcaagatgagatcatcctggagtagggtgggccttaaatccaatgacaagtgtccttataaatggagaagaggaaagacacacagaggagaaggccatgtgaagactgaggcagagactggggtgatgtgtcaatgacacaagggaagccaagggtcactgcagttaccagaagctagaagaaaggcatggaacaaattatccttctgagcctgcagaagaaatcaagcccgcaaacaccttggttttagacctctgacctccagaattgtaagagaataaatctctgctgtttgaagccatagggtttgtgataatgtgttacagccgccacaggaaaaaactgtacttcccaacatcatcaaaccccagtatttatctttgaaaatccactcgttcacctcacagttcagtttctccctacctccaaggaccgactggccttctatttgctgcccctaagttaaatagaagaaattgtttgcaacctggccctatgcataattcatggctgactctggctgtatctgctttgtcagcttttgatctcctggttaaagagataaaggtgttatctgtattagagtaacagtgtccaataataggggattgggtaagtaaattagggtccatcaacttgataaaatattacatagtgactgaataagataatgattaagacaagcaatgtggaaaaaataaggtctttgacataacgctaagtggaagaaagtatgttatcagattgtatctacaatataataacaaccaggacaaaattcttcctagatgtggacaaggacttaaaacaggtggatatgttgggctgtgggactgtgggtgtttcttcttccatttagagtcttagaaatgctattataatggtgtttgtgctatagtaaaaatggaaacaaaaaaggcaccaaagcctacagtttctcacagggtgcatagaagctggagagggagaaaggatgccctatcatctccaagtaaagggccctgtacagaagctctatcaaactttgtcctaatagagaactgggcacctccatttacagtatgaagtcttggatttttgagtaatgattcaaattcatttttgaatgaagctgaaattcctcttggcagattccaggtaaatgcaaacactggataagatacaatggcagacaaaataaccccgcacctcagcccttcctatgacctggctttcttggattttacccaagcagcctcctgccattctcttcccccaaccctatatatatgttgttcttcatggagattcctccctatttcctgaacatgccttgtttcgttgtttccctgcaaacacaaaaagaggctacccctatattccttctcctcttttaagttagaacttaaatatatattttgctgggggagacaaaattcaatcctccaggagagtaatctccctggaatttttagggagaaaataaaaggaaaataacagttagagaaaaataatgaaataaaaaaaaatggacaagctaatatctgttttaaaacttcattcatactttgaagcaaacatttactgtatctagcatgcccaagatgaatgaataatatgaagatgaggaaggcttgacatttatttgtctatttatttattcattttttagagtcaaagtctcactctctcacccaggctggagtacagtgtcatgatcatagctcattgtaacctcaaactcctgggctcaagtgatcttcccacctcagcctcctgaggagttgagatgacaggcatgagccactgcacccagctaatgttttaaaagtttttgtagagaaagggtctctatatgtttcccaggctgctcgacattttttgatcccctacaatgttccagaagttctcacacataagctcattttatcctcagagtgacattcaacaggtatttgtatcccctcattacgcaaataaggaaactgaaatttgtcaagtgagcaattgaagtatgatttgtctggactgaaacatgctgtaagtggaaaatgcacgctgtatttcaaatcttagtataaaaagtataaaatatcttgttcatatttttatattaaattacatggtcaaatgatacaattttggattacatattactaaaactatacattattaaaataattttacctgttttttaattaaatgcagctaatagaaaattttaaattacatatgtgactcacataatgtttctactaaaaggtgccagtctaaaatgacagaactgagaatgatgagtctagcttagactctggctcagggctccaaaactgaccacattatcagccttacttaggtctctgcctccacagcaaggaccatgagttagaaaacaatgtttcagaaataacacataaatagttaacaactacatggaaaaaaatttaatctagccaataatcattaaatgtgtggtttatggctgatatgtgaaagacaataggaagatgaccaatagcttgcactcaaaatcaatgtccaaatcagagcagaacagagagacgcaaattacctggacacaaagatgggttcccaggctctcaggtatgtactgccgctcagatctggagaggggtagggtattcagccaggaccataggggccgggtcatgttatgggaaatccctgctgcagcacataccccagtcttgaccacaggagaggctgtcctggctgtaggacaccctcccccggcggaggaggaagctattaaagatgaatctcctatctcctcttgcctttgagaaagacttcccaaatttcatacaagctgcctcccactataagtaaaacatcagctcccagaggagagagatttgtctgtttggtccatcagcgtatcccaactgcatagaacagttcccagcatataatgagtgttgaagaaacactgaacaaatgaactagcaaatgaatgaatgggttgatttccccccacagggtgctgccaatagtgagacactgtaacagctacaatgagcctggttttctctgtgacgacttttgtgtgtccctctgatgcatgaggcccctgactttcagtgtcagtgttccaactgtacacataggtccatcccacccaatatgtggccaagacagaggttgagcctggctcaccagggctggaataaagttcaagctcagttgcacatgcacacaatttgcacgagcatgagggaaagaggggttcattgctttagcaaagagtgaagagggaggagcttcaaggtgcctacagtaccagggcagcaggggaaggttagattttgggggaaacatgaacagatggcttcctctattttagcatgtctctgctttgaaccacctccttttcttagaactttgcctcacaactctaagactcccctccaggcaatagtactttctggcatgtggtttagatgttaagcactgtggatgctggaacttgaggctggggtaaggcagctttgagtactccttttatccccctcatgccctcttttcttctccctctcctaggatttcctctcctccagccccttccctacctccctggttctggttacttcctcctataatttctgtcctgacagtagaggatcacctgaagaccttctgtacctgtgaagtgaccttatttgaaaataaggtttttgcatctataatcaagttaagatgaggtcattagggtgggccctagaccaatatgactggtgtccttataaagagcagaggagagacactgaagagacgcacacctagcgagaacgccacgtggagacagaagcgagactggagcaatgcagccacaagcccaggatgccaaggattgctcataacagcagaagctgtgaaaaagccacggcacaggttttccccaacagccttcggagggggtggggacctgctgacacctcgattttgatttctgaattccagcctctgagactgtgagagaatgaatgtctgctgtctaaagccacctggtttgtgatgctttcctatggcagccctgggaaaatcatatcgggttgctatgtctgtctgtcatcagttatgacaggtgacttggttaccaacaggcacaatttcaatgagaaaaagtgaaccattatgtaaacacatttatctgagggcctgaatacgactgtccaatgcctataatctctgagtttggggttatcatgaaaaaggaatgctgaactcgttttgactcagataaatgtctgagctccggtgcttattctggccgtgcaccacttcctcaaccccacacaaatgcttctttgctctgattgcaaacaaaatgcatgcttgttagaaaacccggagagagagagagaaaaaacaaacaaatcataaagggaaaataatttgcctcccttctccttacgccaggctaatcactgttgatgttgtgttatgttctcttcctctttcctcattacgctggtctcacaagggattcaactcaccttgctgtccagcacatactcacttggttactgatgtctgagccactgatgtagtcctcacagcccccaccttttgagggggattctggtctgtcttcgtctgtccccagagtgtgaagagcccaataaattgttagtagttaagcaattctgaaaccaacccctaccaacatgggtctaggaccaacccccgccaagacctcacaacatttgggggtgttgcagagaacactgtagtggggtttgggaattgctgcggataagtgaggcagctatggaagaagcccctgtcagtagttgaagcaacccagagtgcacttctgaaccttaggaaaggattaggattggtgacaggggatttcaccactgcctcttttgagtttaaaagctccaaccttgccctaagtcatgcatagctcacccagaggtgaatcatattagcccaggtgtctgttcttggttgatccagaactgcttcttctttatcttttaattctccttggaatcaggtagatcccatataaaccctcaaaaagtaaagtctgattacctcccatctttctgaaaaattagatgcagtctgcacttctcttctcaacgtaatgacatgtggtgtttccagcaagttcctgaccccctaacatacacacacacgcacgcacgcacacacacacacgcatgcacacacacacacacttttttaaaggagttgccaagtgcagcaggttgggtggcggtctccaaaagatacatctatctggaatctgtgaatgtgaccttatttgggaaaagtgtggagaaagggacaacaggcaggagattatcacagtcaggacaagaaaccaggagacgttgacagtcacgactaaggtggtaggagtgaagacagagttgtgggatttcagggacatgtggaggtagcacatgagggtgatgggctgacagggtgtgtgtgtgtgtttgggggaggagagcagacagtgctcatggataagacgagtcaatatcattaaaattgccatactacccaaagcaatttataggttcaatgctatccctattaaaaggccattgacattcctcaagaaactagagaagaatattttaaaatttatatggaaccactaaaaaccctgaatagccaacacaatccagcaaaaagaacaaagctggaggcattgcactatccaacttcaaactataccacagggctatagtaaccaaaacagcatggtactggtacaaaaacagacacagagaccaatggaacagaatagagaacccagatataagaccacacacctacaactacatgatcttcaacaaacctgacaaaaaccaagcaatgtgaaaaggattccctattcaataaatggtgctgggataactgactagccatatgcagaagactgaaactaaaccttttccttacaccatatacaaaaatcaactcaagatggattacagacttaaatgtaaaatccaaaactataaaaaatctggatgacgacctaaccaataccattcaggacataggcatgggccaaaatttcattatgaagatgccaaaagcaattgcaacaaaagcaaaacttgacaaatggaatttaattaaactaaagagcttctacactgcaaaataaactatcaacagactaaaaagacaacctacagaatgggagaaaactttttcaaactatgcatctgacaaaggtctaatatccagcatctataagaaactgaagcaaatttacaagagaaaaaaaacccatacaaaagtgggcaaaaaatatgagcagacacttttcaaaagaagacaacaggcggcaaacaaacatgaaaacatgctcaacatcactgatcgttagagaaatgcaaatcaaaaccaccatgagataccatctgacaccagtcagaatggttactactaaaaagtcaaaaaataaacagatgctagcgaggatgtggagaaaaaggaacacttatatactgctggtggcagtgtaagttaattcagccattgtggaaggcagtgtggtgattcttcaaagacctaaagacagaaataccattcgacccagcaatcccattactgggtatatacccaaagcaatataaaacattctattataaagacacacgcatgtagatgttcattgtagcactattcacaatagccaacagaatcaacctaaatgcccatcaatgataggctggataaagaaaatgtgatacatatacaccatggaatacaatgcagccataaaaaggaatgagatcatgttctttgtaggaacacagatggcggtggaggccattatccttagcaagctaacacagaaacagaaaaccaaataccacatgttctcacttataagtgggagctaaacgatgaaaacacagggacacatagagggacacaacacacactggggcctttcagagggtggaaggtgggaggagggagaggatcaggaaaaataattaatgggtactaggctgaatacctgggggatgaaataatctacacaattagctcccatgaaaaccttcacttgtacccctgaccttaaaagtaaaaaaaaaaaaaaaaaaaaaaaggaagagaaagactaataaaagaatcagaaatgagtcaatttctctgccagggacttttgcatagtatccctttccaccatgtggcaaacttcacagagtccttgttagtctccctgcttataggctaggtatcaggccccagggaatgacacgtcacccagggttagtggcacagttagactgcatttcccttttttatgtgattctttgcccacaacccttctaatacaccctcagtctggccccaactctctcagcctgtggcctcatcctgtgcccaggcccctcactggtctcagccttcttccagctgaagcctctttatttccagcccctttgatcagagcttgggttgatgcaatgcaccactctaggggaagcataaacccagaaaaacatcagggggttgtgctgttgacatcacaatcataattctggaaacttatttgaaggaaataatttaacaagacaggaaaaagcaagttcataaaaatgttcatggaaacctctatgattttccataatggataaatgttagaggctatgtgaatgtcacataaggtagttaaataaatcatgatagtgtcacttgatgggacagaatgtggccattaaaatgctaacaatgtaactatgtatcattttacatgaggaaaaagcatttaaaataataaagatgcaataattacagaaaaatttcatatgtatatagacaggtactaggagaaaaaaatgaaacaaaagtaagattctgagtaactgataatttgttttctgttactacattttataaatataaacaactaactttttaaaacaaatttaaagcttgtgctaaactgtgacttagcccccagtaaatctctatttatttggcatctgctaaaagaaccaaatgctcttgagatgctgatgggaccaaccttaaagcatttaggttttttattttttattttttggcccttaaaacatttttgttcttgtcatgactttggacactcaagttttccaaacctcaaaaaacaaaacctttttgtccccagctgaaatccaatgtcacaggtgcactttctctgtgcaaaaaatactcccaatttactgacagaaacttaaagcccagattgcagctttcaaggttactccaagggcattgttatcctaggacccatatgggtcaggctgtaagtttcctaccagtggattccagagccttgggcagagaacaccagagctggtagtaaacaccttccacctgcctcccactctcaaactgagggatacttgtctgagggggctcgctgtgcctcaaaagccttaaacagcaagcaaaatgagcttccctgtgcctaatttgggaatgatttactcatttacacaagcagctcaagtttggtacaattagctggtgtaattggaagtcactgtctatgaggatggatgcagcagcccccagaccacaccaagtgcagtgaaattacagcaaattgcagtgctcctgggcactgtgaaacagactttgccatagcagccatggcacatctttttgtcagatgagaacacaaatataaaacagtccttagcaacatctttcttcccaagacaagaacgcaagagggaatctaggatgcctttaaggtattatgtagggagatggttccagtaagaatcctgttaaagagagttgcctctctctgacgtatgcgtggaaaaagatggatttaagcaaatagacacggctgacaaaagtgtatggaaaaagaaaacaagaaatgctttttgttttctatatttctttgacattacggaatttactgctcagctaaaataggacaggttgagggggaagaaaggccaattctttctttgtgagttacgtattatgagtaatatgggttctgtattactcaaacatccagtatgcatccactctctgctaggtactcttctagatgtctgggaaacattgatgaacaagacaaaatccttgcctggagcgtgagatgcacacaagcaaacccacacaaagattactataacgcaatgcagtcattgcaatgacaaaaatactccagaatgttacatgaggggggtgcataaaccagttagaggaggtgagatgaagtctctttgaaaagaggtaatgcccattctactcggtgacttataagtttgaatttttaagttccaaatgtaagtgaaatcatgcaatatttgtctttccatacctggcttatttcactcatcataatgtcctccaaactagggggtgaagaaaatggggagatcttggtcaatggatgcaaaggttcagttatgcaagatgaataagttctggggatctaatctacagcatggtgaccatagttgataatattgtattctatacttgaaatttgctaagagagcttattttaagtcctctcaccatgaacaacatcataactatgtgaggagatggatatgttaattagattgattgtggtaatcacttcacaacgtatacatatgttgcacaccctaaacagatacaatttttatttgtcaagtacacttcaataaagctggggtaaaagagaggtaatgactgagatgattgaggcaagcagacattatcccagcaaacagccagtggatgagagagggaggccttgaaggcaaatcagcgttatcaatgtgcaaagaagtacaaaggtaaagaggagcttctggaaggggctgccaataagcagtttggtgctgccagaacatagaggtggaaaaagcagatgatcagaaagcaagctaaagaggtcatgaggagtccaggggtacccaaatgctggattaaagagctgtatggttcgtgaaagttgtctgtgtgtttcatagtgatacggataggagtcagggaaatactgggtagaagagggttccctggcaaaacccccaccctcaagcctggaaacccacagccctaaatgggaacaggcattcctcttttcatgcccaaatgtggccttttggctcaccacactcccctatcctgtacccatataaaacccaaaccccgggctccacaagcagacaaacagaagagaagaagagtaacagaatggcatggcagaggagagaagagaaggagcatccaaacatcaagaggagttcagctggggatgttcagagaggaaaccggctgctggatgaccaaaatccaggggaaggtcatcttcccactccatcccctttccacctccccatccaacctgctgagagccacctccaccatacaataagacccccacatttaccatccttcaagtccatgtgtgaactgattcttcctggacactggacaagaacccaggtactaagaggacactgaattggttaacacttaagccgtctgcagatggcagagctaaaagagcactgtagcatgcccactgaggttttgggagttgcagacacccacccctggatgctgctgtggggccagagcccaaaagtgctagcccgagctcctgcacctgcctgtctgtgagctccccctcccgtaaggggtttgaatgtgcacagtggctgaacggatgagtcacacccctgttgtgtgtcctgcaaggggggtcagggaaccctcttgtttcaataggttggtcagatggctgatgtggagggtggatcttggagaaaggaccaggggaagccagcaggtgatggatgcaggagtcctgagaatttgagatcccaaccagggcaaaggtaggagggcagaggtcagtgcagacagatttgccacagtagctgtcaaacatggtggcacaagagactcctctgggctccatttataaatatttcctggccccacccctgaagtttctgattcagtagcttttagaagaatttggatctgcctgtcttttaagcctccagagctttgaaagctcagtcagatttgaaagccattgatttagaaagtaaaatccatccctcctcttctcccccattcttttctttctgtaacagtctatttggcacctactgcatggcaatactttactgaggttaagaagtaccatgggagttaaagaatacacaaaaagggaaggtctttcatccttttaagtgtttctcaaacttaaaaacttgttagcctgcaaacctgtaaaacttataaaatctgtcttagtttgggctgctataacaaattaccacagactgggtaacttataaacaacagcaatttattgctcacaattgaggttgggaaatccacgatcaaggtgcctgcagattcagtgtctagtgaggttttgttcttcatcgatggcgccttctagctgtgtcttaacgtggcagaaggggtgaacaagctccctccagcatctttcataagagcactaatcccattaataagggcagactcctcccaaacatccaagcattttatcatctcccaaaggtctcacctcttaataccactgtcaggcctctgagcccaggccaggccatcgcatcccctgtgacttgcacgtatacatccagatggcctgaagtaactgaagatccacaaaagaagtaaaaacagccttaactgatgacattccaccattgtgatttgttcctgccccaccctaactgatcaatgtactttataatctcccccacccttaagaaggttctttgtaattctccccagccttgagaatgtactttgtgagatccactcctgcccacgagagaacaaccccctttgactgtaattttccattaccttcccaaatcctataaaatggccccacccctatctcccttctctgactctcttttgggactcagccctcctgcacccaggtgaaataaacagccatgttgctcacacaaagcctgtttggtggtctcctcacacggacgcacatgaaaaccactacattgggaattaggttttatcataagaattttggggaaacaccaacattcagactatggccacccccaggcataaatgtgtggacacctcatgccaaagggttccatagattacagttggagaaatgctaccttgaccatactaccacttacagtcactgggttcacccatcaacattgaggttatagaagcagtcatcctggtggcccaggttaggtttcttttcatttttctttttaaataattattaatttgaaagtgagaaacttcatgaactgccatggttcttgtttacagacagccctgtccattttgacatttctgtgcagatgtaagagacgaaattcttttttcaaaattgacttggtatgggaaacttttttccagtaatgaaaaatattagcccaacttgccttttgcaattttcctttgatgttgacacaccagacagtgcctatttgtgtcagagccctcccaaagccatcaggtcaagcatgccactcagcttcacaggaggggaaggatgggctctgaatatgtctactcagttgcaggaatgttcaggttgaatggaatttgcaaatacaatcatgacgatgaagtcacctccattgtgggcatgaaactcaactcatcccatttgttttttcccactcatttccctacacaagccttgttcatccaatactgacagggcacccctcctcaaggatttggcaattcaagcttgggggacaccatgtagactacatggtttccaagccaaggctagatccagacctcagtcaccctcttcattccaaaactgcgcctttactcctccccaccctacatctgcaagcttatggccaccctaatcaagtggattgatcatgattgggaaattcaggttaatttcaccatcatttattgagtgcctttggaaaaggcactgtggctaactagttaagtgggcaagctttgtattcacacttagtaggaatctaggttttgtttagtagtcaggtcatctcaggcaagtaacttccttcttctaaggctcagtattaaatggggatagtgatccttaccttgaagggctgagacaaaatgcatgatgataagcactctcagtgatacatggtaaagataatggggtctccatgggattcgagcaggaaatagacagataattcaagcagagttgactaaaggcactatttacaaccctgtgagccggttgagagaatcggggcagaggtatcgtggaggagtgaactaagtaagcgagagtgggaggggtggaggagggagcaggtcctagaacctgaaaggtcaccttgggaggagctgtgacctttctggaggggagaaagctgcagcagtcaacacccttcccttggtctcctccctctctcctcatcccctgcaaggcgctctttcagatgaacagaaggcaaggcaacacagtgatgtctgagactcaatctcctgtgccagggcacaggcagagaaaggtggagggaagacatgaaggaaggaagggcaggtagcagcaccactgccattcatggatgacctatcctatgccaggaagtctaagaattctgagccaagttgtagacagatgtagaaatccacaatcacagtatgggggaataaattctattataaactaacaagtaggaagccctcatccaggtgccgagggtcaaaatatgccccaaagaacccttgagcagggtgctgaggatgcaagaaaggaggaagagggaaaagatagcaaggggagtgtagtgtggctgtaatgtaaagtctgtgcatttgggagtggggatggaaaagcaggagagggaactgggcaagcccgcaagggctgagtcactcatggaggaaactgttggccaagttaaagaggaggttaggttttatcctcagagctgttgggatttataaggattttaaatggtacagtgtctgtataatctgtattttagcaaaatgattttggtctcttcagggagggaagtgttggtttctctgattctaacccatgagcaaggtccccacggtccacggtccagggtccacggtccacagatataactgggcaaggggaggaatttcacagcagggtgaggaaatcctgacgtagcaagagcatggttcagggaaagactggttccaaaactgaggctccagtaaatgttcctggcatgatggaaaatgcttggcctgcagacaactcagtactgtacgtgctgaacttcaacgtgcacagtgacaacctggggatcttgtaacagtgcagaccctgactcagaagacctggggtggggacagagatagcactttcctaaaaagctcccaggggatgctgataacagaagaacacagagaggttcagcttgagaggcccaactgcttcaacctcttcttctgcaggtaggctaacagaggctgtggaagggcatggctggtgatgtatcataaagttggtggcaggaactgtagaaacctggctgcgagtccttcaattcagagttcccatggggcttccaggaccctctgggagatgactggggaccaggcaatctacttgctattgaagggcaaaggggaaagggagtgaacaggaattgatgaggcaagagtgtctccagcaagtccttggagagtgcaaatggatctgccaacatgcatgatacgcttttcacacatcagcctgctctgagagtatcatgaaagctgacataaatctctggtgggctgccaaaggccttcttcccagacatgatgactggcataaaaactcaacacaatacttaaaacacacactcacacaggtgagatctatgtgcagtgcaatttggcaatatgtagcaagagttacaaaagtattcattccattcaacccagtaatttcatgttcgtgtgtgcggtgggggtgggagtgtctaatacacaaatactctaaacagaggaggaagaaaacgaactttgacattgaatggatactggacagctaggactacaatacattttgaattcttataatattcctgaattgtaggcttaatattgcttctcctacacacaattttattaaaccaataagatcattcaatttcagaggttaatttgcccaaaagtcagccacctaggcaacgttagatctaggatttgaatccaggtcaaccagatctgaaggtcatgttctttccaccatgatgcaatgccaccataaacatgaagtttatcatagtgttatcaaatatataaaaaataaagggatggataagaaaattacggtatatacactaatggacaattatgccatcattaaaaaagatgaactatttccatggttctataaaggcatcatgattgtgattaaacagttaatgaaaaattacaatagcaaattttatgtaattatagttaggtaaaagatgtgtgcatattaacaaagataaaatacaaggcaaaattagcactgtggtagaagagattataggtgatctttttctctgatatccaaacattctataatattgttataaaaattggccaagaaaggctaagataacagaatgcatttgttggtggggagagcagagagcctattgtacatacaagatccttaacgggatttcctacaaaatcttgagacctctgcacctggccttatcttcctgtggttctgcccttcagtcatgaagactctctagatgacttgctctaacatagactctctcacctctggcatcattttcaggaaggcttctatagctctggtctctttatccaagtggtaacacaggtaagcatcatcaaaaagaactgcctctcacaacagcagatagaacatttatacagtaggtgggaacggacacacagggcctttaggcattgcaactgacagcatggctgctgctgggagtgaagggctagtcttcaggggcatggctcataggatgaggagagagtagaactaactctatcttgttaagagacaaaacagctatgagagaagggagacgcccaagccatcctcagttcccaccttccccatgtcttcctagataatcgcagtctaagcctcacttaggacttgatacccaggagcctatggcaccagtctgcctaacatagcccttcctgggaggctgctgaatcaaacctgcttgcaagagtcttgacacattctctgcacctccacacacaggctagggtcttgctgtcactaggctgatcctcagagacctgagaccactgcttgttttcacttccaatatctttggtacttttgtaaactaaacgtaaaatcctaagctcccaaccaactgaacggacgccttcttggccaaggggaccccagagaaacctgaaaaccggaattcttggccatgggggaaaggaaatcacacgttactacattccctcccttttggattttaggcacaattgaccagcattaattttaaaacagactctttgtggcaatacaaaaccaaattatgaacaaggcctaaagtcatgcaaagcaagggttaagtcacagctgcaggccatcaatccagctacatagcatctttatcttaactgaaaacattcctttctgctgattccaagttttagacagagccttactcctttaaccaattacaaatttaaaaatctctgaatccacctataacatataagccctcacttcaggatatctcgtcatttggggccaaactaatatataccttccatgcactgatttatgtctttgcctgtaaatcttgccaccctaaaactataatccgactatcttgggcacactttctcaggatctcttgagactgttttcccaggccatgatcactcatactggctcagaataaacctttttaaaagattttgcaaagtttggcttttctgttaacacttttgactcaccatgttgagttcagtcatgagatgggtgggactctgacacggacatgtctggactttgctttaatctactggcaaatggaaacccagctgccgatgggggatacagtgtgtgggaagtttccccagaacctcacaccatctgctttatcttcttgttggcccataatgctgacgtccctgcagatactgcaacacagtccactaggattacaactgttgtgaaaaggattggaaactgcaacatgcttatactgcagaaaaaaaaagaaatccagaaattacctaattaccataaagacagattctgtaggatgaaccaatgagtgagggcagagcttcacctatccccctatcaaccttctgagaagaggccagagacagcaggcagggtataccttgcaggctaaccccattctgttggaaatgaccagctgcagtgctgtgccatgatgaaagggattctgaggccatgttggagtgcagtggaagagcatgccctgattgattattgatgtccatcatgggaatggtattagggaggagtcagggcacacacttgccctatattcatctccctctgctaggaaataagcaaactgaaattcaagttttaaaacaaggaggaaaacaggaccaccacttctaacctcgagtttatggatcccatccaaatgtgtatgtattgtttgactctcctccattagatccatgtctactgaacatagtgagctattatttagaccacagttctacaatcaatggaacgcatgtgaatgccactgcctgctactgaaaaatctattgagagggaaaaggaaagcagaaattcaaactctcctaaccagctgcttaaaaagatccagttcactcttatcatacccccaaaattatatctaacattctagtaagatcaatcaacacatcccgaataaagtgatttgaaagtaaatacggtccatatgttcagggaatggagagccattaaatggaataaatagattacacagaaatgagaatatgttgggcatagtgaaaattaaaaaaaaaaagtcaccataaccacgtcaaagctgttgcaaatgcacaagaactagaaagaaaataaacccacatgaagatggctagtgtgttatttccactccctatttttctaacactatatactattgttatattgtcactaacatttaatgaaaactaaattattttaaaaatcaagccatcatagcgatgtcgatatttgaatatctcttacgcctgttgccttaaccttgactcaagtttggaatgcatttttatttattaaacaaatatttattgaaccctattttgtgccaggatctgttctaggcaccggggatatacctgtgaatacagatctttaaccttaacaagtttatactttagcaaattaattctatgagttaagtataaactcactggtcactggaacctcatatagtctattagagattattataagacttgggacataatcttatgattttggatggtcctataaggtcatatatatggactaatggatgctaagagatacttctgttactctacctacgccttcaaagggatctcatcttcataagaaaagcccatcccatcttcataagaaaaaaaaaaaaaaagaggccaggcaccgcggctcatgcctgtaatcccagcactttgggaggctgaggcatgtggatcacttgaggtcaggagtccgagatcagcctggccaacaaggtgaaaccccgtctctattaaaaattaaaaaaaaaatagccaagcatggtggcatgtgcatgtaattccagctactcaggaggctgaggcataagaatctcttgaacctaggatgtggaggttgcagtaagttgagattgcatcactgcactctagcctgggtgacagagtgagaatccatctcaaaggaaaaaacaaaaaacaaaaaacaaaaacaacaaaaaaaagagaaaattttaaaaagaaaagaaaacaaaaagaaaagaaaaaaagcaccaccaaatttgagaccctattgtgttccaggtactaggtaaggtactgagttctttccagagatgagctatgtatatatataggagtgtgtgtgtgtgtatttatatgcacatacttgcttgtacatgtgtatccctatattgtgagtccctttgtttataaatgtgtgtatcccttggcacttacaatataaggctagacatttataaagaaataaaaaataattgtgaactgtggtccatgttatccaaaaatgggaagcaatggtagagacagtggtgagtgggcaaagccctacctgaaggctattaggcagggcccttctgaggtggtagcattcacatcaatacctgtagtaggagaatgagttggccatggaagaggaagtgaaagagctttctggcaataggaactctgcgtgcaataagcctgagacaggggcccctagcatgctagagcacagtaaaagaaggccagtgagaccagagggaaaaagagaatgggaggtgcaagtctttcagacctaaggtagcagtttggattttatgtgaaatgcaatagctctaaaattaaggtaataaaactatgagagatattaaagaaaacctaaataaatatacagagattgaatatcataaaatgtcaattacccacatattgttctatacattcaaggcaattctaataaaaacaacagatgttttcattaaacttgataagtagatactaaaatgaaagagccaagggcaagaataaccaagatattgctgaacaagtatgaggaggaggaatcttctctaccagagatcaggacactgtgaagctgtaataaatatgactatgcatggttacagtgcatggaggccagtggaatagagagctcagaaaaaaattcatgcatataagaaattttggcataagtcagatatggcctggtagagcagggaaggagagactgtaaaaaggacttggataaagtgtttatcaatgtaataaaaaaataaaattttcactccatctctcaccctatgcaaaaattaattgcagatagatcaaaaacttaaatttcaggagcaaaactatgcaacttttagcagaaatataggcaatcatctttctcaccttggtttagggaagaatttcttaaggacacaaaatgtgttaactatataaacaaagtgataaaattggctataattaaggacttttgtttttcaaagataccttagaagaagtaaaaacagcaaattacatttgtaactggcaaaatattatcaaaagtatattataaaactattacatatcaataaagaaaagagcatataacccagtagaaaagtaggcaaaagacatgaacagatatcccacagaaaatgaaatacaatattctacctcattaataatagagggaatacaaagcaagacaacaagataccattttatatctatttagtcaaaatgaagaatcttgacaacaccaaatgttggagagggtttgaaatcataggcactcataatttgctggcatgagtgtaaattagtgcaaccagtttgggaaagagtttggagtatttttgtaaaacttaacattcatttaccatctgacctagtttctagatagaaattcaggagaaaatcttgcacatatacaggagaaggtaggcacaaggatgctcatttcatcactgctgataaaggcaacattctgaaagcaaccccaatgtttatgaaaggatcatgagtgaaagttttgtagtatcttcgtgcagtggagtagtagacagcagtcaagatgaatggactacagctgcactcatccgtggggatgaacatttgcaatacaatatggaataaaaacgtcccaaaagcttatacacaacttaaaatcctttattaaaagttaaaacactaaaaaacaatatgcttataaggaattcacacaagtagcaaaactatataaaatatacaggaattatatacaagatttagaagagtggaggggtcaggaagatgggatggggagacgtaagtgagtagaaacagatgtgcttatgtagatcataagtaaatgttaggtgttgtcagcattctggttgtcttttagttggtgtgttactgaaaaattaatgagtaaataaaaagaaaagagacccatgcacagaccaatacagaaacagtttcatgaaactaggagtgagattaatctcattttgggcacccaagtgatagttcatagcagaaagagctttttgaatctccctggtccaagcctcctaagccacaaatgtggaaactgaggcccaggttgggaaagaagccaactagttcaagtacactctgcaatgactaaccaaaggtcaatcttaaatttactgtttgcacaacccactatttgacgtgcagcgatacacacgttaaaaacgtgcataaaataaaacagaacaagaaagcagtgaattttctttatgccatcttgaaggaccctggagacatggtatgtatgtatgtatgtacgtatgtatgtatgtattgaaaccataatgaggtagaccaagatctcatacttgggtgtcagttttaaggaattacttttctcttggtaaagagtaagaaaaagcagtcaaaagaaaaaatgcccattgacttaaggtgaggggagaaaaaccacctgctagctcccgagctaatgaaaagacaagcaacaaatcacagattggaattccagcctccagagacttcagaacagaggctccaaatgtcctgatgatagatgaaaatatgcaaacatttttcattttgttctgaccaaaacagaagcgaaagagccagttaaaagcagcaaattcatgctgcattgcccagcctaggcggaattccaacaggggtaacacggtaaaacatccgagatgaaaagagaacaacttgtgatgtttaaagagacacttcacaacttaagtgctgcctctgggcacagtttattgaaaggaccacagcagccagggagaaagttccatctctagccatgtggccatgtgcacagaaggacaccctacaaaggcctctgggtgcacacgcagtgcagcaaaatgcagtttccctcccagataagaaacatgaagaaagcccacgccctgacaaatgcagaactcactcttcatttccttcccttctctctcctaggacaactgtagatgcataggattcaatttaaccgggagacttttgttttaatccaacatttttctttagcaaaactctggagacaaattatggcagacgttcatgttaaacagctgggagcccactgaaatgaaagaaagtttctcccctggtgttaccatggcacggatatgaggtgatcacaggcccccctagtttaggagaaaacagacatagccctgtgtctctgatatctctgtcagttaactctccaatgaaatagaacaatcctaaggatgaagctggaaaaatggatacatcaaaggatgaaagcttcacacagacatgccaccaaacatacaattatatgagtgtatacatgtgacagtgtagaactacataaactcacaaaaacatatgctcatacacacaccccaagacaagcatacttattcacatgtgcgcagtgcaggaatatttttcatgcagcaacctttattgttttccacagctgaactgaatgattaatgtttactgtgaaaacctcactggcaggacaacatggtttgctatccttaggtaacaagtgctacacatctgttgatttccactgtcaagttacctggctccatcacaaatacctgtgtcgtaatagaaaagaagaaacaccccaaggcaaatacagaggcaatcctaatataccacaagtggatgaccagcagctctaatgcgaccaggtacataaatgcaagtcactcacatcagaatgcaacttcttttccttccagactctgagtgccagaaatcattcttttcaaccagagctgttgctactgaaacacctgtcagcttccctgtcagcccgaatgacctgtatatggcatctaaccagggatgcctgcatttttcaagtttctggaggggaaacatcttatggaggttgaatgatgagctgtggactagaacaaatggctcctagacatcccagggccctgacttttaagatttagggaaggcctctgggcaaatctattgttttgtgtgtgcacatgtcttttttaatctcacaaaaaaaaccacaacaggactgacttccactattcaggagagggaaaaagatttgcaagggaaggtctgtggtgggctctggcatcagagttgcaagatgccattagtaacatgcaaagggatattgacagaacgatacctccctatgtttcttcaattactccacacactgtttagcaaccttgagggaaaaaagaccaatgtttcttgaatttaatccttaaaaaaattaacacttagcaactgcctgtgtatgagtgagttggctgtagcgtaacatcagatagaggtggagtctggcagagtgagagtgaagataggttaagccaggatcaagactgggtttatttagaaggtgtttagctaggattacatatcagaggagaccgactggattcaattcatgcaatgcttcttcccaaccctggatgtttttaagaaattctcaaggaacttaaaaacaacaaacaaatacagcatatggatagcgccccctcccctagagattctgatttatttggaccgcaataaggcccatccatccatccctgcattcattcaggtaactagacgcctatttatttatctatacattgtttcaagctctcaaggtaggattttttgtttatttttgttttgtttttgagacagtctcgctctgttgccaggctggagtgcagtggcatgatctcaactcactgcaacctctgactcctgagttcaagcgattctcctgcctcagcctcccaagtagctgggactacaggcatgcgccaccacaagcagctaatttttgtatttttagtagagacagggcttcaccatcttggccaggacggtctcaatctcttgacctcatgattcacccacctcggcctcccacagtgctgggattacaggtgtgagccaccacaccaggccaaactagactttattttttcagatcagttttagcttcacagcaaaattgagcagaaggtatctcaaggtgtgattctaatcttcagccaagcttgagaacagctaaattagttagacaaaaataatcatcattgccccttgctaggatagagcacaaatccatacatttatccaaagaatatttattgagtacatactatgtgaaagctactattttaggtcctcaggacacactgaaaggcaaaaataaatatagcatatattagttgtttctttctttttttttttttttagacagagtctcgctctgttgcccaggctggagtgaagtggcacaatcttggctcactgcaagatccgcctcccaggttcacgccattctcctgcctcagcctcccgagtagctgggactacaggtgcccgccaccacacccagctaattttttgtacttttagtagagacggggtttcaccgtgttagccaggatggtctcgatctcctgacctcatgatccgcccgccttggcctcccaaagtgctgggattacaggcgtgagccaccatgcccggcctgtattagttatgtcaagaccaaatgctgtcaggctagagaactggggaaagctgatgttgcagttccagtctgaaaggcatcggctggggaattccctcttactcaggagagctcagtcttctgatctattcagaccttcagctgatgggatgaagcccatcatatgggatgaagctcccctatgttatggggagcaatctgctttactcgaagtccgcccatgtaaatgtcaatctcatccaaaaacaccttcacaaaatcatccaaactatggtttgaccaccaatctgtcaaaccgtggtccagccaagttgacacataaaattcaccaatacaggacccataccctcacgagggttcaagtctgttgcgggcctgggtgatacaaaagtacacaaatgaaacaagtgcagattgtggaaatggtatgaaggaaagcaagttgttaagagaggaaacagaggggaacctgttttagatcaagtggacagtggagggaaaaagcctcttggaggtgaagaagaggaaggagccagccctgacgagtgtagagtgaagagcattacaggcagaaggaatgacacagagtggcgagggctgccaggaactgggtgagcttgggaaatgccaggaggctaaagctggactgcagtaagcaatgggaagaggagcggcaggtgaagatagagaggcagccagtgccagatccttcagtgcctcgaagttaagatgaagccaaagcagacgaggaacaggatcagatttacctcttaagatgttctgtctggctgcagtgtggacatatggaacaggtgaagtgtggaagggggtgggcagggaggaactgaaatgctccaagcatctgaggggtgctcagaacaggatgtggcagcagagatggtgccatgcggcctgacctgtgtctattttggcaagagaaataatcaaactttctggcggattagctgtgtggctgctgggggcaacggatgacgctctcatttctggcttgaacaatttagaggaaacaagagcttttttccttgttaccagcctggctcgagttatactcaatagcggcctgcattatgcaaatcatgtgtcctaattaacgtagatccagtttgaattatgcaaatttttgctttgggctgtattagtcacaatccagctgatttcctcctgcctagactacctcctgcccatctggaacacatcccattctccacactgctcctctgtggaccagagtcatgagccagtctggggtcagtgagccctgagtggtcagtgcagcaaagctgagggatgggaggaggcatgctcatccatccagacagagccaggaaccttctctgggcctctgtcttaaagagtttcctcgtgagcttatccacccagctggtcccctctctccatcaatgtctgtgttcaggctttcgttctgttcagaactcctgtctcggaagacgctccagcctccttgtaatgcactctgatggcttgttgattcctggggcccgtgctttttgttcagattgaatccaaccatctgtgtgctgaaaaaaatattgacaaaccctctgacctattgtaccttttaaaggcgctcccatacaggaatgccgccttgttttattgaagcgaagtctgttttatttaactctgaatgccaggcacctagaatagcttgtgagataaatgccaatcaactctagcataatcaagacacccattcctgcctcattagggtcttctcattccctttaagcttctcagatttatacactgtaattagaaacttggtgattttgactgctaaacagaaaggcttactgggaggcttcatatgtctgaattttaaatattttcacacttcgttaacccagttgcaagtgtaacatcttctggcccaattccctcacactgtgtgatttttatttttggacgaagacgagaacaattaattgaattgaaacacatattgattactgttttccatgaactctgaacagcttgtctctgaatgattttattgaagggtttttagacaactgtttggttggattgcttcccttggtgacctcattctggctataagtgcctgtccgcaattgcgacggtctgtgttcttggtgagttgtggttgttcccaagagctgagtcagaatgagagaggccacaccacccttctgcacatccacaccctgattagggaaccctgatgccttaatcaaacccaaaagcagggttctggaagagtctatgcagatgtcatgatttccatattcctgatgtaaatattgtttagacgtcaggtgagcaggaatattccttactgcattaaatgatcacgttattcatgcaatgactgcaatgttttcatcaggcagagctttccagaccagttgatattcccttaccacctctaccaccctcttgtgctgatcacaattgtgagatttgagaatgtttcttaaaccagtgctttttatgctttaatgtacacatgaattatctggggatcttgttaagaagactgtgattcagtgggtccaggctggggcctgcgattctgcatctctaacatgcctgcaagtgatgttaatgatgctagtttgtggacacaaggccgttggtgctgcctctatctgtgcatgatctgtcactctgttaggggaatgatcatagaattgcattctgcatctcccactaaagtgcaaatccccaaagatctgaggccatggtctaattcatcttaatacttcctgttgcagctcagatgaggccggaaccagtgggctctgacgaggattctgagctcccctttcagtgggcagagagagagtttgaggctgctgcagaatgagacggtttcatagccctggagtggtaatagggtcagggtgagacacccatctttcagggaaggtgggcccaggatctaaaggtccatggctccagggtgctcatcaagataataactcattactaaaaagagggtgtcaaagctgggctagcagcagtaaagaggcagctgtaacaacactttcacatcttctgctcaggtataaggtcttttaataaatagttcatcttaatatcatagatgatggaaatgtccttgcctcctggtgcattttccagatgtttccaggatgcttgtgtgcccaccatctcttatccacacaacagctggatgaccttttaagaatataaattggatcccttcattcctctgtgtagaaccctcctagggctttccattcctttcaggataaaatgcaagttctaggagtcctgccatccctggccctacccaccctttcccccacacagtctcatcactgtcctctgtgctcaggaggccccagtcactccggtctcctttttactacatttttaagacttgcctaagtcatttccacctcagggcctttgcactcactgtttttattcatatgtcttcatcttcactactttaccttcagagactttggctggcttataggcaagaattaaacaactccaaaaagaggtagaatttttgatttcatgggtttgacatagatttactttccccttcattcttacccagttgaagccaagaacagtctgacaccttcatattagaaacagaggactgaagactggagacagaatgggacttaaagccactcacattttggggggcagaattgtctgaggatggactcagaggctgtgacttggacttgtgcagaaggaaatttaatctgaaccacttggacctgctgtatttaacaataacatagttatagtaatgaaacttccctccttcccctcccttattttttctttgcttgtaactttgctgaggccaaggttgtatatagaaggccacagacaatcctgaatttctcttccatttgcattatcctatttttctttgtaataaaatattctattttgaggccaaaagagggtaatttgtaatttatgaatttctctcttgaaattacaactagaacctaattttaaaaatcaaattggtttcatctaattaaatttgtaaattgcctcataaacacatgctttgttataaatgtttttaaaagcaaggtctcttgcttactgtctggggctggattgggttgagcccagagtaacagttacttctcatctctctactcaagagaacatactctcaattgccaaaagtttctcaagagtagtattttccagaacagtgcttctgaaaccgtaatacccataggaatcacccaaggatcttgttaaactggagaggcctgagctgctacatttctaactagctcccaggtcatgctaatgccgctggtctatggaccacgctaagttgcagaaaggggcaagacatctgtacctgcatttaggagtcctgggtttggcatctgggtaatatgaacttggtcttttcattttaaccctctgcactcaatttcctcatttttatgtaatgataacagctaacatttataatgttatttctaaatgccaaacactgtacaaaacctaatttaatcagatcttcagagtaatcctataaggccattttattattaccttgatttttctgataaaagacttaaggttctgagaggccacttgatgtactcaaggtcacagagcaagtaaatgtcagagctgggattcagatctaggctatataggctcaaatgtcaccatccttattttcttaggcctcactagcttttgatacacaagattacactcatgtttatgctcacaatacaatggcctaaatctacaacctccttagctgtctttacagcatccctcaataattttggcatattccgcaaaagtagcctcaaatgcttacaaacaactcaaccagttacaatactctggttccggttctctgcaaattatagcccaagtcacagcgaagaagctacctgaagatgtctttcatcatagttgtctcccatagaatccatgggaatgccaacatccctggcatctggtctctgaaaatccacaaggcatcagattcacacagaagtgagaaggacaacctgctctaatctgtacccacctttgtgcatggggcttcagagagtgcactatataataatgcctcaattgcaggaggttctactcaaacacagagtctaactcacagttgtgtttagacccttgctctccctctgtttctttcttcttgtcatggaattttaatcatgatatttctcatccagtctaatgcatcattctactagaggaaaaagtgtattactctcaaggatccaatctaatgcatcatcctactagaggaaaaagtatattactctcaaggaataatatgtgcagagatatgactccacctgcaacatagccctacagtagtagtttccaaatgcaggtatgtacaaggaccagggcttttccatgacaaagttgccatcaatccagtgcaaaattagaaaaaataatgtgactgtcatgagttagtaaaaaatcataaatttattcaatttgaaggatggacttttattctgaaattatatcctttctatatttttggaattatgtcttttataaaacgatgtaaataaaagatgttgaagtaccctaggttagtcccccaagcctttttaaatgctactggcctgtgaattccaaaagtcttgaacatctggcacacagcgtcttttacataacagtatcaagtaacttaacttcctaaatcatgggtcctttccttctgctttacaaagaaaagtttgccaggcacaacacatctttatttcatgtaaatgtgtgtgtgtgtgtgtgtgtgtgtgtgtgtgtgtgtgtgtgagagagagagagagattgtggtttctgctttacaaagaacatgtagatttgaagtgactggattttgtttcagttaaattttcgaacctctctttcccaaagaagttttgaaaatgtgctaggcaaggtgtattagtatgagtacctgccctcctctcggggtactccccaggaagaaagcttctcccaagcgtgtggcctgagaaaactcataagtgatggggatggatgtctgtttcctccttccatctggtaatcctgagagctgcgccaagctccctgcaacttctaagagggagatgttagctctcctgaggaatgctagttttagtgagataaggtgttttcttaagcaccttgtacatgttggataatcttctccctcagagagttctcaggaccacctgtgactctctagagaggttatcggtctgttagattaatcttgagtacttttccttcatcaaatactccttgactttcctccccagagctcacctttccttatggcagcaatattcttcccccaagcccactccctatacatgcatgtttctgcatgagctctcagtgacttaagcctcttcgtgggcctgtggtacatgtttcagtctgggatgcttgtgtctttccccctcgtcagattccctagagaaaccctgaagaagtgattaccacctttattttacaggtgagaaaaatgaggcttaaagagaggaggaatctaccaaaggtaactcaggaaaaggtggagctactaggacactaggctacatcattccagcttcggtatccatgcccttccctctgcattcctgtgtgtttccacttgatctagtattgtaatcttatgttgtgtaagaatacaaggggtgggaggagactcaaccttactcgtattgcaatacttgaatcttagctatatcagctctgttggagatttttttgttttgttttgcaataaactttcatacagtttgtcttatttttgcaacttttctggaaggcacattgtgttggcttgatgggtacattcctgcttgagtaggttctggttcatctctgatatggtaaggcccagctaatgcttggaatgggggctttggatgccatcacctgggtgacaaaatatgccttgggcacagagcaatttaaatctgaagaatcctgtgtccctggtgcagagaataacattgggattcttttcaaagcaaagagactgatattcgtaaagtgagcatcatgtgggtattgcagtttcccagacgaactttcagtactgtttgccaggcctgggccttctcttccacataagaacaatctgactccctgggttttggctcttttgtggatgaggtcagttgtcaccatagtcacttcaatgcatgatgtgtacaaatttctttgttcttggggctaccaggacagctccactgtgtgccattatgtttgcaccccattgtactgtcagaaaccttttggtatgtctcatcttactcacctttatacgttcagcagaatgggtattcaccaatgtcaggctgaagtgacttgaataaagctaagccaatggatgcagcacaagggacctccttacctcgtagagcgtgatgaccccattggtctcattgggaggtttccactggatgtagatcttctcctcaaagggccccccttggatggattctagaggaacagctcctggaactacagaatggaaaagttatgaacttgatgtcaccttccacatcatttctccagccccgctgacctagaacaggggttgacaaagttgctgtaaagaaccagatagtaaatattttaggtctgatgggctgtacgttctctgttacaactactcaactctgtcattttagcacaaaaatgactatagataatccataaatgaatgagtacggtggcgttccaataaaactttatttatgaaaacaggcaatgggctggatttgacccacaggccatagtttgctaacccattttcagaaggctgatcaggcttttcatctgcagactgagcaagtcggtttatgaactgaaccggataagggcagaaaggacatgagcagtttccagttctgccagaggtgggaatctgaaatgaggtgtttgcttcaggggtgtctaatcttttggcttccctgggccacattggaagaagaattattattgtaggccacacataaaatacactaacacgaacgatagttcatgagctaaaaaaaaaaaattacaaaaaaaaaatctcataacgttgtaagaaagtttatgaatttgtattgggccacattcaaagccatcctgggctgcatgcagcccaggggctgctggttggacaagcttgttttaggatttgtatttgagaaatgcaaagtgagcttcccatcatcttaccaagtatcattttcttcactctgccaagttttctctaactttaggagtgcttcatcagtttcttgactaattcctgaatccaacatgaactatgtggcttgaaaccccaatccaattagaagaagctcgccttgctccaagaaggcagctagcttgacttgttgttgagtcccaatgcctggcatgaagtagatgcataataactatttgttggttggatgaataggtgaatgaatgacctacgccagcattttgaactaataagtgcaacctttcctggggctccttctataagccggtcagtcttcctgccagcatcctcctgctggatttcactattcttacaacagtctggaagacggtgagccagaaaacaaattattccccaaactttctgctgtaaccccttagaaataatgaatttcagtaaattgttgccaaatctatttatattttggtattataaaagcacttactcttggactagaattttacctacattatttcacttaagccataaaacacctctgcccagtaggtattatctcctttgcgtcgataagagaactgaggctgagaaaatggaataacttgctgaaggtcatatggctcttaagttgtaaagagggaactaaacacctgtctgtgagttttaaagcatatactcttaatcatcacgctacgcctctctacatatagccttggccatatgttgcaatcagttcccctttgttaaattaaaatatgtttagttttgctcattatggacatgctatacagaatttgttgaatattaagaatatataaaaaggttaaaaaaggaaaagaacaaaattactcataattcacatgttcaaatattattttccaatctttttatgcatataaaattttattaaaaaaagatatgcctatgcatatatatattttttatttttaaaaaaatgttaactcctactgtgcatatttcattgtgaccttattttatcactaaagaaattgcaggcttctctggggccatacatttctctggggccatgcattttaatggctgcttagagggggcgttgcccctttatagtcactaatcctttattattgggcattaaagttggtttgaattcttcatgattttgagcaatgctggaatgagcatgcttataggtaagtatgcatgcaactctgcagatagaccttaagattaatgctttggaaattaatttactgggccaaagtaaatgaactattttatttttaaggcttttgacatatattaccagattgcctttcagaaagtttgtaccattctggactccccaacagaagactatgtctgttcttgccaacactgactatttaaaaaattaagtgcatgtgtatgtgtgtcttttttagaatactggagagtacagattttgttttcagcctaattagccattcacattgcttcttttatgaacaaattatctataccttgtgctcattttcctgtatggctcttcatttttgctcatctttgtcttatgggctcgtcattgtaatttcattttaaggacgtaagctttcttgcataggttgcaaatatattttcgccagtttttttgttggcttttgaaatcacttaggtatgcagaagcttttaattagtcaggtatcctattgctttcccttatccacccttcctttccagaaatatttattatgtatttaatatgatgaagggacagcgatggacactagagatataccaataacaaagagagatgtagtcaaatccatggtaaagcttgtattctggaaagagagacagacattaagcgattatactcaaaactaattcattacatttttttaatcaggactctgacataaagggatatggtactaggagaattattaaaagcagagaacaacctagaatggcaagttaggatattaaatggcacataagttagagttgcttgataagtagaagttatcagggcaaaatggggaggaggtgctgtagtgtggtggacagctttgtgaggttgagggtggaaggagaaaaatcagttaggaggctgtcattgtcatcctcgggagaaagaattgtaacgtggactggaatgatggtagtgtagaagtgaaatagattgtacagatgtggactcagaggatggcaacatggaagatcaatgacttggtggtgatagataagggtgaaggagggaagggatgtgtcatggagaactgcaacccttttgttttacacaactgggggatcaaaatgttgtttatagagagggagccttaaaggatgaccaattttggagaggaagctggtgagctcagtttttgtcatactttatttcaggtatacatagaacatccaagtggcaatgctgagtagcagttggatatgggaagactggggccaatgtttggaaatggaaaccgtaggcagggaatagatggcaagagtatagagcagagaaaaaaaaataggtctaagactaagtgaagaagaactccagaattaacaattaggaggaaaatgaatggagaaactgggagtcagtgttcagagaggcaaccagaaaaccaggaaggtaagccgtcattgtagcatccaaagaaggaaagaggctcaagaaggtactggtcagcagtcacaaatatggctgagtagtcgagtaagatgtggctttaaacttgcccattgaacctactgtcctcaaggtgactcgtgagccaagcaagagtaatttaagggagaatgttggcatcacaagccatcctgaagagggttgagaagagaggggaaggtgaggtgaggcaagtaaacaatgctggctgtgaaaaggaggggaattcaaaccataacaagaatgagatatggagccaaaataatgactctcttaaagacaagagaggttatgattaaagcaactaagaaaaagattcaaaatagaggctgggcttggtggcccacgcctataatcccagcactttgagaggccaaggcgggcagatcacgagatcaagagattgagaccatcctggccaacatggtgaaaccctgtctttactaaaaatacaaaaattagctgggtatggtggcgcgcacctgtagttccagctactcgagaggctgaggcaggagaattgcttgaacccaggaggtggaggttgcagtgagccgagaccatgccactgcaccccagcctagtgacagactgagactccatctcaaaaaaaaaaaaaattcagaatagaggtaagaagaagagtgagaaagaaagaggagataacttacaatggtagggtcctgaaagcaagagcaagggtgggttgaaagaagggttctctccttttgtgagagaagaggagaggatggaaatgtgctaatgctttgtacggaggaattgaagtgtcctaatggctctgttttcttgagaagtggggtgaagccatctaccaaaagtgtagtgggggacgaattacatcaagaatttggaaagacaggagaagctttaatcacagagtagaaggcaagcagaatagagagatgaaaattctattcattcatttgagggtctatctgacggaaattgaggagggtgtgtctgatggacaataagaagtgtctgtctgatgaagactgtgagcatgaaactcaagctaatagatcttggtctttccaatctggggaaaattctctttctcacaccagatcagatgaatggaaagtacagatgaatagttgttctataatttatttattttctgttttattcccatctttttctttttacaccttacacgttaatatttctgaaattactgtgtataccatacatggtagaaatctataattccttacaattttctcaattgtaaaggacaattaattgaccagtcaaaacttgccccagtgatttcaaatgccatcttactaccatattaaattattttatattctagtgtatgttgtttggctttctgttctatttcactaagttgtagcttttactgtgacagtatttctctatcgcattaaaatgacatgttttgatacttggtagaacaagtcttattcttcttttgcaaagctttttgaggtatcactacccatgtattcttccagaagaatttaggaagagttttataaaatttcaaacatatttcatcacaatttttactgcagttgcattttttttctcttttttgggaagcagagagtatcacttttaaagtgagtccttttatccagtaaactgtataaatcttcatgtattaatgcttctttttatgcccctcagttaaaaatgtttttcttttatttcttacaaattgcatttctaggactttattattgttcatattgtttttgtattgtattaaaaagtttcttttatagtgttttgcaatatattaaaaagtatacataataatgtatgaatagttcaaagaataattattaaatacacatgtgcccactatctgctctaagaaataaaacattactatactattgaagcactgtttatgcccatcactattgtctcctttttctttctccatcgttaaataaataaataaataaaataggtactacaggtactatcctgattttccttttttttctttttcttttctttttttttttttaagacagagtttcactcttgtcacccagactggagggcaacagcgtgatcttggctcaatgcaacctccgcctcctaggttcaagtgattctcctgtctcagcctcccaagtagctgggattacaggcacccatgaccacgcccggctaatttttttttttttttgagacccggctaatttttgtattttcagaagagatggggtttcactatgttggccaggctggtcttgaactcttgacctcaggtgatacacctgtgttggcctcctaaagtgctgggattataggtgtgagccactgcgctcagcctgaatttactcttaatcattctcttcatttttattcggagttctaaatatatacatatatcccaagacaatatatcatttagtttttcttggtttcttttaaatctatgtggattgagtgttttctattatatgatttgcgtttgtcactcatcattttcagattcatctattttgatgcacatagttgtatctaattcatccccatcttataaatatattcctatttattccaccattctaccgtatatgaacagtagagttgtatccaggtagggtttcttacaatataatttattggaatacttttgtatatttgattgaacatatatataagattttactaaggtacacttaggaagagagggtctattcctatgactgaagggcttatctatctttgtttttacagtgtaatgccaaattgttttccaaagtggtggcagcactgccccaagcaatgttctgaaagttcctactcctccgcatctttataaatatttggtattatcaggttttaaaattctagaccatctagtaagtgtaaaacaatacttcattaaggttttacatgcttttacctatttactagcatcttttaatgtttgttggatattattgtccttttcctgttgcatatgtttgatactaatcattttattggctatatgtgctactgaaaaacttcttttaatttgtgtcttgtgtttctctttatgttacctttgaatatggatcagttcttaattttaatgtactcaaattgatcagattttagtttttgtatgggagaaagagagagacaaatttagtagcagacactgttgatggcctgcctatatcccactgaataatgcttactgcaaagtacaaatttacctaaatgctgtgggagccaacttgttctccacgtagaagaagcaagaagtgccagagagttaatgccccgaagacatccttcaagcaatgaaagacaggaagttgatggatgaacatcccagtttccttactacttggttgggttactctgagacatgttttactagcacttctcaaactatttcaaacactgaaaccattgtgatgatgataatgataattccaaatccattgtggactcatgatatcataaaatacaataaaaatgaattaatagggaagtataatttttaagtaaaagtgaaattgaaaaagcaaaaaagaaaaatactaagctccttctttttaaatactttctctttctgtacttgtcttgttatggattagagagtcaatgagtcagtgctggtccttggaccacactgggaatagcactgttctagaactcagttattcacatggtaattttttgttaataaactttgtattgactttcttccctttcctgtttcactttccctctttcttatgagtgtgtcctgagaccatctcctaaataaactacttccatttgtatccttatctcagggtctgcttctgaataaacccacacaaaagagtttttcttacataagaaacactttctctatcctgaagtcatgagaatatttgtctaaattttcattgacatttaagagttactcttttaataaaatgtcctcaattcatttacaactgtgttactatgtataacatgaggtaggaatccaattttaattatttctcctcatcctagggagattgaaaaaatacttttaattcctcagttgatttgcctgataattttaacttctgtcacatttccacatatgtatgggtctacttctatgttctattatattcaattgtttctgttagactttccctgtgtcaataccacatcttaattaacaatgaggtgtaagtcttgctatctggtaaagtctactactttgtacttcatgttcatgactgtcttgggtactcttaccttttctctttacataaacatttgaggactagcttgtaccttttcaaaaaatgtttggtttttgaattttagttgcatgtattatagatcaaatgggagataatatcatgtctttataataatagttttctcatccatgaacatggtatatcttttatttaggccttccttaacgtctttcagtgttttatagatttatacgtacatcttgaaaacttatgttaaatgtattactaaataccttatatttttattgctattgtacataatgtctttaagaaaataccacatacttgttaggttaatagaaatggaattgactttttaatgttaatgtcttggcaaacatgctatattcttatattaattctaataatttgtttgcagatttctttgggttatctatgtagagataattgtagcatctgtagttaataatagttttgctcttttccaatcttttattttcttatcttcaatgatagccaccaatacagtctttaatagaaatgatgatatgtctatctccaatttcaaagataatgatgatattgtttcatctttgagtatgatgtttgtaggttttttagttatctttatcaggttgagggggcccatttttattccaggcatacaagaatattttgttttttaaatcatgctgagaattaactgatgctttttctgtatctactgtagtgatgatatgtatttcccctctcctagtatgttactgtagcaaattacacaaacagatttactaaagttagactaacactaattttttaaactatttttttgcatatttatgcagtttcagatcatttgctaatattttgtttaggtatttgcatacatttttttctcataagcttttctgcttttaatatcaaggttatagtcttgtcataaattgaagggggaagtgcttcttctttttcctttctcataaagtgtgtaagattaggattacaaactccttgagtgtttgactgattgcacttgtgaagtcacctgggactgatgtgtactttgttgcaaaagtttaaattactgattctatttctttatttgttgtaaaactatacagaattgcttttccttaagtcaagttttttaattaatagtttgccatatcacctaaattttacatttattggtataagattatatacactatcatcatttatcttggttactgtgaaataaacacaaaagcataaaacaatcatctcattaatttttcagtactgaacttcatactgtgaccttgcttttccttatacttttcactccttaagcacatatccctaaatacaatagagtttatcatcaaataaataagaataataaatagtgctaaactcttttacaaaggccagtctgggagaactaatacctttacaatcttaacttccattccatgaatatgttctatcccaggatttatttagatattcttactgagcatgcgtattagtttttttgttttgtttttaaaaatcttgtttcttgcttcaattgttagggggtatttactttgcactatcagatttgttctttacaataagaatgaaagcatttttaaaaatctgtccagtaacctttccgcatgcaacctcataagaagtggtgtgtgatggtctggtttaatgggtcattctgctagttaccatgtaagtccttattttaaatatttccaactcacagggaaaggaaagaatttagatatattcatacattacttggctggataagagttctgtctgacctgtggggcagtggtatgaggggcagttaaggaagggaaataattaggcagcaggaagattctccgtggcaagagggctttttaggtgttttgaggggcagcctgaagttagttaccacagacactaccccttcctgtaattgtttctttacaatgagatccttccactgaagccccttttcttgtttgccatatgccctggacgtaggcttggagggggagctctcgttctctgcatcatggactagcaaataaagatgaccagggcactgacctctctcctttccccactcccatccaccagctccaacgcccactcctgtttttagcactggttggtcaaagttggaggtacttatgcatgtagacttggaagtcttctcctccaattccctaaggggttttctttccaggcagtctcagcctagtcatctctttcccatttgggactccctctcccatgacgtcttgcattaattctttcaggagcagccatggcatcgttttacagttgtcagtgcagatacaaaggtgtttttctctatatttctttaggacagtagtttaagaagagtgatcaaattggcatttctaatcaaaagtcttattgtcatcactgagacctaaaaggcagtattgtagaattaaacaatgatcaagggttgaagccacactgcctgggtttatgtcctgttcccaccactgtattaccttggccaagctgcttaatgtctctgtgtctcattttccttactttaaaatgaggataaaaatactacctactacataggttgtcctggggatttgatatgttaatatacacaaagtgcttacctaggtgtctggcacaaagtaaatactatgtttgtctgatcctccccctggccccattgcattcactctgagaacagctctagggtagcctagagatcactaatttgatttttttgtagagacaattaagattgttgctatttcctgtgatgtccttacctcaatctgctctatccgaatgatgttatattgctaatcatagaagctatatcttctcatagcttactgagctttctacgatcttcttctgatttctatggtaaatgatcttaaatctaatttttctctgaggactcagaattcattcgttcaataatgtatttattgtgtccttatttgtctacctggcactgttcttctaagtgcttgggaagcagagtaagaaaaacacaaggaaaaaatcttgtctctgtggaatgcattctagtgggagaagacagataataaaacatatagtgaaatatacagtatgtcagatgataattgctaaggagacacccaaagctggaaagagagacaaagagtgtgctgtaggagacttccagtttttaatagaatggtctgagaagagcttgctgagaggtgacattggaaaaaagacttgaagaagctgaaggaaccatcctgcttatttggcagaaccttactgtagccaaaaaggatggcaagtgcaaaggccctgaggcagggatgtccctgatatatgtgaagagaatgataactgaatttgcatagtgaggcacaagtagcaagagatgacacagaggcaaacaaaagtgggaattctggtcacctggagcatgtgagctaccgtgaaacttcgggtttttaatgtgagtgacaagagaaaccatcagagggttgggagcagagggagtgatatgatttgcttcatgatttaacaagatcattttggtgctgtgttgagaaaagaatgcagcggccagagctgaagctgcaaagattatttagaggctgctgcaataatctggggtgcagagcacagtggtttggacctaaggggtagtagtagaggctgtgagaaatggtcaaggtcttgacatacattgcaggatgaaccaagagaatatgttattggttcagatgtggggaacagcaagactgctgctttgtacaaagccagggggtctcaatcaaaagcaataaagggtgaagaggttctctttttctttttttgagacagggtcttgctctgtcacccagcctggagtgcagtggtacaatcatggctcactgcagccttgacctcccagcctcaagcagtcctcccacttcagcctcctgagtagctgagatcataggtacacaccaccacacccagcaattcacctgccttggcctctcaaagtgctgggattacaggggtgagccaccatccccagccagaagggattttctttggagatgtaaaagccagggcctcagttctgacaaaagtgagaagtcaaggtttttggctcgagacactaataaaacagagttgccatttactgagatggagaagacagtgggaagaacaagttgaaggaggatcacaggctcagttttgaatgtgtttaattccacgggctgattagcaatctaggtggagaggttgaggagacagctggataaatgactccggagggctgggcagaggcctggcctggaggtatcaattgggaaaattattaacatatggatggattttaaagccgggagactagaagaaataattagggaaatgaatgtggatccagggtcagcaaactatggctcttgggttgaatccaaccagctgcctgtttttgtaaataaaattatattggaacactgccgcacccatttgtttatccattgtccctggctgttttcctgctacaatggtggcatcgagtagctgctacagaccctctcatggataaagcctatactttaagacctggccaacctctggtatggatacgaatgggaaagagtcccaagaactgggccaataaggttgggatgtgatatggtttggctgtgaccccacccaaaatctcatcttgaattgtaatccccataatctctacatgtcaagggagacaccaggtggaggtaattaattcatgggggccatttctcctatgccattttcatgatagtgagtgagttctcaggagatctgatgttattataagtgtttggtagtttctccaacgttcattctcctttttgccgccttgtgaagaaagtgccttgcttccccttcaccttctgccacgattgtaaattttctgaggcctcccagccatgctgatttatgagtcaattaaagctctttcctttataaattacacagttttaaccagttctttatagcagtatgaaaatggactaatacacgctgtttaaaaggaaccagcaaactgtaatcccaacattttgagaggctgaggtgggaggacggcttgaggctgggagtctgagatcaccttgggtaacacaatgagactctgtctctacaaaaaaagtaaaaataaaaataaataggccgggcatggtggctcatgcctataatcccagcactttgggaggccgaggccagtggatcacctgaggttgggagttcgataccagcctgaccaacacggagaaaccctgtccctactaaaaatacaaatttagccgggtgtggtggcacatgcctgcaatcccagctactcaggaggctgaagcaggagaatggcttgaacctgggaggcggaggttgcggtgagccaagatcgtgccattgcactccagcctgggcaacaagagtgaaactccgtctcaaaaataaataaataaataaaataaaataaataaaacaaataaattagctgagcacacttgcacatgcctatatgtgcctatcccacatgtcctagctactggagagggtgaggtgggagggccgtttgagcccaggagtcagaggatacagtgagctgatcatatcactgccctccagcctgggagacacagtgaaaccctatctttaaaacaaaaacaaagaggagaagccactgcagaaggagaaaatctagaagtgtgtgatgaattggaagcaaagtacaaaaagtgttttaaggaggatttaacaaccagctgtgtcagatattgccaactggttaagtaagaggatctgactttctgagtaatgactattggatttggtgacttgaaggtcataggtgatcttgaaataattgttttggtgcaatggcagggatctgagttactttggttgaatggattcaagaacaaatagaaagaatggatgcataaggaggggatggaatagcttgaggagaagatagagctgggtgtttctgggttttttttttaatctttttaaagatgggagaaatacagcttgtgtggagggtgagaaatatatccagttacaaagggaaattttgatgtagggtggaaaggggacaattgctggagcaatgacattgagttaaaaaaaaaaaagtaagtgggatttgctgcattaagtagcaaaactggcctttatttaaaaagcaaatggttcatccatagaaacaaggaggtgagggggaggtcaaatatgtgggcaacatgtgggcaatgagagctggagggaatttctttgaatggtttcagttcctcagtctattaggtaacaaggtcatctgtggaagtgagaacaggtggatgtgctgttagtctgaagataggagaaatattctctgggagactagagggatgaatgggccagggaaagacagtattgccaggcagctttaaaagccagctccagtggtgcttctggcttccaagtgagagtggttagcgcagtggtgtgcagcagctacggaaggaaagacctagcacaggcaggaaatcagatggagctagggttgtgaatagctggaaatgagaatgaggctgaggtgttgggggattatgcaaggatgtaactggaatgatcagtcaaggaatttaagctgggtagagaagggaatgagggcaatgaacaaggtagcaagtcctagtggggctgaatttttggagctacaatactagagggaataaattgaaaagagaagagatgtggtcagagtgaaatgtttaaaatgagattacagaggggttagaggttatttaaaagtggccttttgcccagggcaaacggaaattttggatagagctcttgttttgttttttcctgaacaccctgaaataaaaagctctctatgatgtctgatgttggccacacactacttagcaaagctcttggcagacagtaagttaagggctttacacagactttcatgtgctacagcctctgtagcgagccattttacagatggggcactgaagtgtacagaatgcgagtccttaaaccaaggttgcatagtgaagtagtggatgaagcctggatatagctcaaactcttctatttccaaggcatttcccaaatcacccctttcttctatcacctggtaggtctgtgggtccagaaggctaaaaggctgtcatcgcatctttaagcagcaaaatcaggatgtctcaccccaagtaagaggctctttccacccaccacattaccattccatagtcaagatgtcctttgcaaggagatagacttactttcctttgattaaactaggtctctctctctctctcattgtaaaaagacttctcggcaaaaaattcctttttttgtcttatcttctaattctgtatcccttttccattcctttttctttgtaattctttaatgaatccacattttccctttccacaatttcatttcttcttctatttaacagcatggaactttccatccttttgacagagttctacaacaaaggttaattactttataatttcattctcttaaaaaaaagcacactaaaattgctaattttaactgtgcttcttgtcagtgggttcatgtaaattcactgtaattaaaccagatgttttcttgtgccttaaagtcaggtggtaatttaaggaagattttcatttcaacataaaggaggacagagtgttatcaagggaagttttctcctctcctctcccctttcctcccctcccctcctctcctctctttatctccatttctacatctgaaaaggggttaacaatggtgaactttgggggtagatatgaggaataccaaggtagtatatataaaagcagatagccatgtacaattcaacaggagtttcccttgatacttgtctatgtcatttttttgtctctccacttcagttgccatatttctttattcattcattatacagaggcttggaactaacttaataagagagatttagataattttagtctcatatttcctagtcgtgttggagaaaatacatttgttccagataaatctttacatcttaattaactatagccttttaattgaactatacagttgtatgctactaaatgtttcacaacctgctctccagggaaaaataaaaacaaaaactttgccaacttccatggtgtaaatatttccaccatggtttatttgaagcaacgaatgtggtactactgaacttggaggtgggaagagatgcaagcaagtctgagttagctttgaatatagctaaaagacgtcatacatatcccccatcttcacaaacaatacccataaatgggacactatggtatcacgaaaagggcatgaacttttatgtggaatggtcatttattcatccatctattcattcaacaacgagcccatactatggattaccagagtgaacaacacaaaacaaagtttctattcccattaagcttatatccctcaaagagagataataaagtaatcaatatacagcatgaggtagagaaaaataaaacagagaacagcggtagaggttttggccaggtatagaattatatattgggtggtcagggaatgcccttcaggtaagattttgaattctatttactcctcttctgcacaactgtatcgatagcatctacatcaaagtatttgggaattgactgtaagaatggagagtatcagcacaatgcctagttcatagtgtgcacttgaaaaacataattgcatttctctttgccctttataatatctcaagaccatcttggtaaacatctcaaatgtactgagctctaatacagtgatgccttcaggactcactaaggtgtgaatagctttcactcttacactaaatgactctggactgctttacttattgccttgttgttattgctttttctgctttttctctcacttttcccttttcccggttttacatgccacatcttgttactacagatgtactcatccttagcaacatgcagcctccttctagcttactgtgacctgagaaacctgatcattggctcattagaaatgtacacttaataaaggtactcattcctgaggcatgtcagtcttccttacaattcaagtacatgagttttttaaaaagtatgatgctaaatgaaataatatatgttttgtatgtgattaactgtattaaatatcaataatattatggtatatattaagttattaattataatcaattacattatatgtaattattatatgggattctacatttccttatttgtaaaatagaaaaaaaaacactctttgctccttcacatttagtgttcagattaaatgaatctacactgctagtgaaaacacaaaatcatacaacttctatggaagagtacctctcaacagctaacaaaacttcatatgtacttactctgtgactcttgcaatcccacttttaagaatttaccctaaagatacattgccacaagtaccaaacaacatatgcacaatgctatttgctacagtattatttatgatagtaaataacggaaacaacctgggtgtccactggatattggttgaataaattacagtatttccatcaacacaatgaaataccatagtgtcataaaaaataaagagcaaattctgtagtaactgatatgaagtgatttctaggatatactgagtgaacaaaaacacaagatgcaaagtatatcaattatgctaccttttatataagaagtaggaagaagaaaagtattacatatttttttgcaaaaagaactctaagaaagatcaaccagaaaggaatgaaaatagctacctttcaagtgtggattggaatagtgaaaagagacaggaatggcggtaatattttttggaatatacgttttaatgtagttttttaatggtgtttttatttctaatttaatttaaagttctgagatacatgagcaggaactgcaggtttgttacataggtaaatgcatgccatggtagtttgctggacctatcaacccatcacctaggtattaagccccatatgcattaactatttatcctgatgctctccctccccacactcccccaacaggccccagggtgtgctgttcccctccctgtgtccatgtgttctcattgttcagctcccacttacaagtgagaacgtgcagtgtttggttgtctgttcctgtgttagtctgctgaggataatgacttccagctccatccatgttcctgcaaaggacatgatctcattcctttttatggctgcaaataccacattttctttatccagtctatcattgatggccatttgggttgactccatgtctttgctattgtgaacagtgctgcaatgaacatatacatgcatgtatctttataatagaatgatttatattctgttgggtatatacccagtaatgagacacagtttttacttttgaaacatgcaactgttttgcatattaaaaacaattaaattgaattaaaaagcataggtggaaggcaaacctttaaatggaaacaaatgaacataactgggtatcaaattgataatataaccatacagagaaaagaactgaacttttgaacatagtattctcactgcataccctcagtggtatacagcctaaggagataaaaactgaaatctttaacctaacttagtataatagctttattgttttttagagggattggtgttgtaattctgaaactattttatgtgtgtttcaggaaatgaaaactatgtggatgttgagcaccagggttctcactgcaggagaaggaagatatatgtataaaatgtgttgaatttgaatcagtatgagctcatgacttaaaacaaaaataaattatactccctagctctacctactgaaagaacctacaggcaataacgcatcaccgagcacacctaagatgtatatcttagtgccaaaataccactccccattgaaagcaaccacaaatccctaataagtggttggcctcaggtctggggcagggacattaaaagaatagtctagaatatttttgttgtgccagaagcaaggaagactaatgagaacatgtcaaaaggacctgggaatcagcttgaagagactgccactggccatatttgaggcaatttgagcatcacagagaatggcagtagaggatttcaatacacggagtcaaaaatgatctatgaatcaacagggagaccaaaaacagggaggaagatgaagagagaaacaactcttctctaaagaagaaggctaactagtaagcgtagggagaattatagatgtttaaatcacccttttgtaagcaccaacgtaataactggttcaggtgaagactctcaggacgtgttaaaaccattgagtgaaagctttaggggaatacaatactcattccatctcaaagtttcactccaaggatactttacaaaagaaaaaaggtgccacatttacagtggagggaccgggcagttcttgtcttatctaagtgaccatatgtgacatcatcagtactgggactccctgacattatgaacttcttgacaaaatacaatgagaaatatacatcgccaacataatggttttgccaaagatatacggaaccctggttctgtcacatagaatcaggttaaatattattagaaatgtaaacaaactgtatattacatgattttaaaattaatgcaaaatttattagaggttaaatagcattgtgggtatgtagcataaagttcttatttttaggtcttgtatgctaattggtttagaaatcaactgtcatgatttctgcactttactttcaaatggttaaaatattgtatgtattcataaatatatttacatagcatatgtcacctatcatgtagatataagatacacacacatgagtaaatgcagcaaagtgtttacaaatgttgaatctagatgagaggtttataagtctcctttgtactattctttcgatttttctagctttgaaaattttcacaataaaatcttgggctaaaggagtacaggagccactgtatataatatgtctatccgtgcctagcacagtgtaggtgctcaataaatagcagtcaaagtgagctgccaagcaaaaccatcaacatggttttcatctttcaaggtgcaagcgaactgtggttttgtctgagacatttgtggaaaagggaaaaataaagaatctgtttagtttcttatgaacagctgctacccaaatgaagccatggggctcagcagccatgagctgctctctagtgctggatttcttcgcaggccgtcaaatgcactgaggtgctgaaattacaaattctgcaaattccccagaagacaattttgtggcacggatgacagcagcatgaattcagccattcagccaactcaatcctaaaggttgcttgctggctcccggaggggggtttcagttaatctactagagccacgctctagcctcatcttgtccttgaggtgaacgagttacccagccaacagaagtggtgcttcctctctctttagaaagaatggaacttaaccctggcatacagcagggtcctacactgagactctccttcagtccagtgggttttgaggcagagcctcagaatacagaactgaggaatcatgtctcgtatgttggtgtttttagtaatgataatgtccacacatctccatagagcaggaattgatgctttattaatgatgtttaattaaaatttaatttcaaagcattcctgctctcatgttgttttgataaaggcttttttttcttggtgacaggaagaagaaagagagaagttaaggaacgccttaaagctggacttggggtttgctgaggcacagggaggtaatcctcaaagagcagctcaaggtgggcaaagaatctttaaaaaggtgccctgagctgctccttgggaaaaccttattgttcatctcctgagtcctgaattttcatgctgattttcagcagtgacttctccctctctaacaaccaggaattccctgtgaatatgagtcactaaaccatccttttgccctgactctgtttctcatatcaggcaccaagcacactgccactttttgagcatctacagtgtatttcccacaaccagttagatttctagatgtctggacatgtctacagctctgaagaggtttcctaggggagctgggaagtttctcaactgccggggatagatgctcctttgtgaatacctttttgttttttttttctcctgtgattcaccacaaatatagtaccttataacatgctgggtattagtccaatttctttatataccatgccacttaatgtgcacgagaatctataagataagtactttaattattccttttttgtttgagacagagtctcgctctgtcacccaggctggagtgcagtggcgcgatctcggctcactgcaacctccgcctcccaggttcaagcgattctcctgcctcagccttctgagtagctgggactacaggcatgtgccaccatgcccagctaattttttgtatttttagtagagatggggtttcaccacagtagccgggatggtctcaatctcctgacctcatgatctgccctcctcagcctcccagagtgctgggattacagggtgagccaccatgtctggccaattaattccattttacagatgaggaaacaaaggcactaagaggttaaacaacttgtccaggcatgcttggctccagagtgtacattgtctgacagcgcacaattctacctgctggaggaaggggctacagatttctgaaacaatgaagtcagatctagggaaatcttcctagaactggaagttttacagagtctactccaaggatgaccccaaagaccagtgtgtggggtctgcaaagaggatggctacgaggatgaactggaagggtgtaagggagggatggatcatcaaagtagactgtgtaaaacttccagatctaggatgggacatggtggaagtgagaattaggggcagggtgagaagaggctggcactatttcccttgtcttctcatgagattttgcagctgagaatgtgaatctgggttctactcagggtcataactctgaagtatttagaactcgcttagatgaaacaagagtactagatcctactgaatcccaggaacacacaaagaaagaagaaaatgaaaatgaaaaaaagaaaacatgtcctaaacagaattgccacagtagaggctctgtcttcaagttctaaggctaatctgagtcaagccgggtattttctttatgcagctgacaatgccagtgctctggctagacctttcagacctctttatacaatttttgtgagactctatcctttacctgcacatgcagagagacaaaagttactgaaattttacctctgaatctctcctccccatcccagaccctaactgttggctggcagcttccttgcctaacttaggacatctgtgatgcatggcccaccctgaacagttccctgaaggctcaggttgcagccagtttttgctggacttggccaaaagttgcaccttggctttctccccttccttgtcccacttccctcactcccctcccagtctcccctgggaaaactttcttaatcagtcacatgcacacgaatcttcatctgagtctgattctcaggaactatctaaagccatcccacaaggcaagaggcagcctgggctggctggaggggaaactgaaatatggtcatggggaagtgtttcttaggtaagccctggaactggcgaattctatgctatcactaaggtaactgcggtgagcctgggaagaaacatccaagtcaatctggggcaatcaaggaaagcttcctggaggaagtaacatttgagcaaagacttgaaaggtcaatagaggtttccttgcaaacatggaggacaggtcattccaagcaggagaaatggcatgggtaaggacagagaggcaggaaaagttatgtgttctagcagtagtggctctaggttcttggagtctcaagttatgaggaagataaactgcaggaagcatacccattagaaatgggggtatggaggtggggtgggtttgggagggagacatggaggctcctaggctggctttcaggtctctatcttgagttactaggtgcagttcattgagataaggaatacaggaaagtcagtatagaattggagattagttcaatttcagataccttgagcttgagatgactgtcatccagccagatgaatattcagttctgggtggatccaatgtgtacgctaagctttttatatctattttctgtttttaattcttacataattcagcattgtctgacttccaaattcaacatgtttaaacaatgtgatacatgttttatctttctggaggcatcagtgcagtcaaaccttggacagagaaggtggttgatatagtttgggtatttgtcccctcccaaatctcatgttgaactgtaatcttcagtgctggaggtgtgattggatcatggaagtggatccctcatgggttggtgctgtcttcgcgacagtgagtgaattccccggagatctggttaagtgtgtggcaccgccaatcttttgcgcctgctttggccacgtagtgttcctgctcctacttcatcttccaccatgagtaaaagctcctcagcctccccagaagccaagctatgtcagtgctatgctttctgtacagctgcagaactgtgagccaattaaacctcctttctttataaattacccagtctttataaattacccagtctccggtgttttttttgttttgttttgtttttttggtagagatggaatctcactctgttgcccaggctggagtgcaatggtgcgatctcggctcactgcaacctctgcctcccaagttcaagcaattctccagcctcagcctcctgagtagctgggactacaggcacacgctgccacgcctggtaatttcttttgtattttagtagagacagggtttcaccatgttgcccaggctggtctcaaactcctgagataggcaatccacctgcctcagcctcccaaagtgctaggattacaggcatgagtcaccacacctggccacaggtatttctttatagcaatgcaagaatggtctaatacactggtataaagcaagaagagggatgggggtacaaaagggccaaagctgagtgcaagtctatggcagaactgtcactgtgatgggaaagcactccctggagttgtgcaatgcacagtttacatagtccttcattgaaggcctaagaaaagaaaggtgtgtgtgagggaattaaaaatgtaggaaaaataaaagcctcataactgactgccatggccctgtgaatagattcaatatccccattcccatgtaagctctcctcccttgctcaccgtcttcctcagtctgcaccaccagctcctcgctctccattcggccctcggggttagacagcaagagtcgcagccggatggtcatgaaggggcgcaggcctcgcagggtgtagtgggaggaggtctggatgacctcctcggcctcgtactgctgctggttgaacacatactggtactgcacggtgaggttgtagctatggcagcgggtcaccgcgtagccgaagggctcccactgcagggtcagctgccgggctctgatgtctacgatttccacgttctgtgggccatgtaccggatctgcaaaacatgcaggcaagaaacaagggttctgaagagaccatcgggaagctggggtacatgttctgctacaacagggaacacagcttttccaaacatatctccaccattcaatcactgccatcatgatttttgacacaggcaatataatttagagaacatttttctttacatcaatctcccttgtcttatttaaatacatgcatctaatagaaaacataaatatataaaaggaaaacatcttaaataaatgttaaccataaaaataaatgtgaaattgttaaattcttaagggtgcatcaaagtgccactgaaaaccttcttggtaccacacacagcacactcctcgcttctgggatacgcttatttagacggctgctgagagctgacctgcctccttatactgaattcagccccagcctgtccccttggaggtcagcctctcctcttcagccaacaacatccagatgcactagctggaaactgagtcacagcctcaacccgcaacacccagtttatccatgcgttcatcatgacccattaaccctgctttaggatttcctctcctttccttgactacacagttcatcatttcctaacctcctacaacagtcttccatccctctttttctcccctggtccctctgggaacatcattctaaaagctaatctgagcatgccttctcaccctaatgctgtctcccactccatgcctcctattgatcttggtcccagatcaccatacataatgttgtctatgtctaattttattaggaatattctatttatactttatgcacattaaatagatttttttaatataaaacaggttataataaacatgatgtttttcaaaaatcctcacatgtaaagctcattttatgttgaggtttaggcatttgtctttggggtggcttgttttgtttctttgagatgggagtctgactctctatcctaggctggtgtacagtggcacaatcagagttcatcccagcctcaaactcctaggctcaagcaatcatgatcctctagcctcagcctcacatgtaggtgggcctacaccatgcttggctaattttttatttttattttttcacatatggggtctctctatgttgcccaggctggtctcaaactcctgggctcaagtgatcctcctgccttggcttcccaaagtgatgggattgcaggcaccatccaccatgcctggctcttgggtcaggcatttgttatgttagaaacataacttctcatgtgatagatacacccagaaattcttgtgtcagactttcttatctgggaggagtcaggcacaggctggagattaaatcagtacttctccccatacctacagaactttgcccaattatgtatcctctttggatccactttttaattcatttgtaaaatgatgataataatagtagctaacctcatggcagggggaagaggaagttagatgagatgcttgtaaagcagttagaactcaaacttaataagcactctacgtatgataactggggtgtgttgtttgttttgcagtaatagtaataatatatatgtaatagtaataataatagtgttccgcatgctgtgtctaccttgaatgccttgtgagtggcagtgctgggagcacccttatgcaaaatgatggactaggtttccatcattgctccaatcccctcagagcatttaagggtaaggctacctctgcaccaatgcagcaataagaaagaggggatgctattggtgctagttgatctgtccctatggggaaaatatcctgtaacttgtgtcggcgtcctaccaaggaacatagttcacaggaatgtcagggaacctggcaagcccgcacagagctgcccacgtggctgcaggagtgagggtgttgaggatagtgggcagccctggcccctgatcaactgaggaattcatgatcactcttacagcccaattattcatgctcacaggtcctttgggcaaagcagagccagcatccccaaatcaaatgggtgaccctgagaatgtgacattgaacaagctgttgctgagggcctattgtggaatggaaggtgaaatgtggtccctgtagctggggattatgattggtgggattacggctgctggctaaacatctcgcagttgtaccgactgcaatgagagcagatgtacaggcacacagagagcaataaatggcttgcctgggaagccccgagcatccccatcagcgttgcctagctggggcctgtccacttgtccaggtgccagaactctcctggcagagagccactgcccctgctcagggcctcttcgacactcctcccctgggtttgccctccaaactgatgccaagccccaatacaacagtcacccacatggcactctcacctccctcctgaggcagggagaagaggaacacttaagacccatttaaacccaaggctaagaccacatgttattgaacatcttaaaatgtaccatatctcatgttaaatataatttttgaggtctttattatggccttaacccacaaacaaagctataaagacaaaacaccactgatggaactgtagccacaagtgctgggctctatcttctgaaccatcttatgaccctaggagggaaggatggcccaccccacattacagatgaataacctgaggtccagaaatgtgcaggaattagtacagagtagcaaggccagcaggtgacaaagtgcggttttgaacttgtgtctgcctgaccccacatgtagtgtgcaaagtaaaaactctctgtaagctatcagttgcactctctatgttgaaaatctcactacctgggaggaaggcatcactagctctgtcctagaggaaaccaaagctctttgagacaaaataattggcctaaagccacagagtgagaggcacagccaagatatgaggtctgccagagtagaaaacctgtgttttctcagcaccttgacgccaccggagactgagaccagggaaagaacataaatatgaggcatgtcgccttcatcagaagtctggggagacttgaagacaatagtgagagaaagccaaaatactacaaggcaaaaatgacttgggtctcaggagcctaggacctgcgggagagagtggtacagtgatgtaaacacatttagtgcaaagctgaccgctggccttttgatccctggtctccattctccctggagctcacctctggaggtgtgcatatacacacatttctgctcctcttaaaggactaaacaggagcatctttttaaagaagacaaggatatcgtgatcttgccacacagcaaagagactctttgagaccgggaaagttgggatacaggaaaagccacttgttccctcttgagcatgtgtgactgtcacggcgggccccgggtacagtgctgctgactagagcgtggcttgaagcgagactctggcactcactatctgggtgaccttgggcaagggcacttcattgctgagcctccatctcctcatctataaagtggaaattattacactagtctcaaaaggttgttaatgagcataaaatgaactgtaaagagagagaaaattgcctttggctaacagtaggtactccttttagagagaattgcctttcttggagaaatgcctttggaagcttgtgtggggtagaagctgcattcttggggcctcagtatcacttatgctgagactccagtggaagagaaaaaataaacccactgggggcttggatagcataagagaggtgtgagggtgaacaaatggcagaatattgggtgaagcccaatatgatcactccccaggtgatttttagatctccagcaaggccctcaaaatacaacaaagacctttgctgtgcctggatctcctgtgggttctagaaagggttgaggtcggcatgccttgggcctaataagataccacgtgggaacacagggaccagaggcaaaggaaccttggaaaatgtgctcatgtgtgttactgaaatcttgggagatgattttggggagatgatttttctactggctatgaaaattcagagattcaaggaaatctcagtttgtattccaaaggcaagaaggactctggtgaacctagagattcggtacctgcaggtgaaagcattttgtaaatctgagaactcgcattcaggaaagggaaagacaatggctattaagtagcaactctgggctaggagctacccttagcacttgtgtcctaaaaacaactcgacggtataggaagttgagactcagtgaagagatgtaacttacccagggccacatggccgagcccccattctctgggctcccatgaatgggtcagttacacatgtatgcacacaagcctgtcccgaacatgtgcaaaatcacagatgggtctgggataagaatacacattttagtctgtagccccttcccccttctccttccaccaaactgcatctcttcctgcagggggcctcacatataagtgtgcagcgacctcagtcctcaggtgcaagctctgtccacttcccccagacatccactctttggccatggcactttgcactgttgtccaacacacacttagcatttgtcacactgcccaggaattgcttgttcatgtgtttgtcccccctctcaggctgcaacagaccatgttctgtttgccagtaacctcacaacgtggcacagggtctgtcaaggggcagttcctgtgagatgaacagatggtgacctgttcttgggaactgagctcagactctctgactccacagtccttgttctgtccccttcagcatgtcagccaggtctttaagggtaatatatatatatatattttttttgcattcaagcaagagaatatcctgaaatcctattcaatggaaactaggttttagagtgtgatggaagcattcatgctttcagtccgacccctctaaacctcatctgccaaacccagcttctgctgggtaattgcctgcagcatggagaatctggggtttacattcgggttggtgcaaacaagttggaaattgctaagaaagccttgtgtgtgcagtggagattggtttgttgaatttacatcccccgtgtaaatacagccaagcctagagcctatggtttctgcctccagataaagccctgtccgtatgaccttcttgagtaatagcccacaggccaagaagatgacaaacagtgggaagagtgtggcttgtctgggaagctggaaaaccatcctctgatagaaaatcaaagtggctctacctctggatgcaccttctgtatgctcttaggctagacaacagtggccttgtcctatgccctgtactttagagagccactttggcccacttcagactgtccctcttctcggagcaagggatcgggggccaatgggctggccaaaggatctggttctgtcctctcccttctggtccaggctccacatttatgaccccctagaattccctgccacgaggccctacactcagtttcttcctttgttctgtccttcctgtgagtggccgttggcctaaggatggccaaaggatggctgtctgggggcagtggacagaacttgcacctgaggactgaggttgctgtgcacacacatatgtggggcccttgtggggagagatgttgttgggtgaaaggagaagggggaaggggccacgggctgacatttttattcctatctcagattctgtgattatgcacatgttagggacaggcttgtgttcatgcatgtgtgactgacccactcaggttttcagaaccttctccattcttactgtggcctcaggaaggcacggtggtcctcctcacctctgaaccctgctcctctttctacatcagctcttattaaagcaccatgtccatcctgaagtaccattttcatcctaatacccgagcccaccctgcaacaggtaccttcctgcccccaaatgcccctgagtcattttccacttctcacttatcaaatcctgtattcttaaagcaaagcaagggattataaatgccttcacacctccaagcctctgcccagctatttcctctgcttgggatgccaccaacaaatcctcattcaatattttcaaggcccagctccaatgccaccctttacttgtgactttctctaacagtctcccttgcccataattaatgcctcgatgacattttttttccttaacctgctatcatatgtctcccatagctcttatcagacttcagggttattgttcatatgtttggttcatgttcacctccactgccaacctgtgagcccctagatctcctcattttataactataacatacagctgctgaataaatgaatgaataagtacataaatgaataaatctagaaagtagtgatagctgaagaccaagccacccgaatttaggtgctaatagagggcaggggaaaagcaataagtagagggttgaatcaggatctccttacactccaattgttaagggtaatcatgtggttaagtcagaattggctcccttttttgttctgtatggactcagcctccatccctgctgtcaaaggcaatagctgtagaatcttctaatgaccttaatcaaggcagaacatcttattaaaaaagaagcagcaaaacagattttcaattcatgaatttgctacgtattcatgtttgcatgtggagttgcctgtagcatatgtactgttcaaagttgaacctaaattaagataatttggggatggggctgaaaatgtggaggtggatagcttgtatgcaaaattaattttttatccatttggagatgcaatttgagttcttttcaaattaaattgcaatggagtcctaggcagctggaaacattattgccaacataatttgatactgcaagagcagaaatatgttgacagatagttcgatgtgaccattaatttgcactttctgcatggaaatgatacacgaagggaataaaaaggtaaggggaacaaaaataaaatccatcttctttccagcatcatcgaaacccactctcttgcttattttccaccacctcttctaatttattgcagatgtttggtggacaagaatttgttgaatactagttcactattcctaaaccaaaaatctgaaatctgaaatattccaaaatctgaaactttctgagtgccagcatgatgctcaaaggaaatgcacatgggaatatttcaaatttcagattttcaataacagggatgttcgactggtaagtataacacaaatcttccaaaatctgaaacatttctggttcaatcatttcagataagggatattcagcctgtattatcatagatatcttataaatataagcaagcataggaatccaggagctccatttggagatgctggtaattccacaatatagaagcactagatcctacccgtgctgatgattagaatcacctgaagctggagcatgtcaccttgtgagaaggcaacacggttgctaccctcccatagcaatgccacagagaaggtaatccactcacgtgttcattgtctcatttcttaattgaaaactactcactgagcatggaggcatcatgacatggggaaaagaacattggttctgtgatcacctgaacctaagcacatcacttaccctacctgtgtctgtgccttatttttctcatgtaggaaacgtagatgatactccttcactcttagggctatgaggtgaattaagaagataatatattccagagccttggatggtactaaatacagttgcactccctcaaacccagagtgggaggtgagacagaacagccactgagacaaacaggggttgtggaggtttctgtggatctctgacctggttctgagtctagttgactactggcctcattcttttaaccaactatagtttagtgttagaaagcttccattaatgcccttgcagttattgctgtatctactccttccattctacatacatatcctgaacctctgagatgggccaggcattagggatgtaggtgaatgggacacttgcttgcctttgtgaaactgatgctagggggatgcaataattttgaaggatgatatgatgaagcttgataagtcttttgcaggggaagtactgggcttctggacaatagatacagtacagcattgaaacccagctaagccaatttgatgatgacgcatgcacaaccctgacattcgttatcatagaaaccaaagccatcaaagaaatttaaggtgaacgaggattaacgattccccaacaactgcattattagatgataataaaagcaagccttaggccaaattctactacacagatggacacagtatacaagcatttattagcaaatgggcacaaaacagctcaaacaatctatttcataaagtcccagcaatagatgaatcagttaccatttttcatgaaaggttcattcgaggcaagtacaacaatactctaaggcagaagtaggtgagcttttttttttttttaagggccagatagtaaatatttaaggttttgcacctttgcaggttagacagtctctgttgcatctttccatctctgctattatagtgcaaatgtagccatagacaacatgtacgcaaaataggtgtggctgagtttcaataaatgtttatttacaaaaagctagaaccttaggctatagcatgcttactcttgttatggaggtaaaataaatgactatgattgtcactttaggcagccggcaatcctcctaatctcatggctaacacagtactgtttaggaatcaaggttttgacaccatccctaaggtcgaagactagaggtcttacaggattattctttataatgtccttctggagagtattttaaaaccattttggccaacccacatagtttaaatacctttcatttcaccaattagaatttacttctaacatttattatgctagtccacaggcccttgatttcaaccacagtaatcaattgctaatatttagtttgctaattagcaacatggaggttgttgatcaagatatggtatcagaatagttgggaaaataggcgtgtactcatcacatctggttagttttttttaattttttttttagaggcaagtatctcactatttgcccaagcgggtctcgaaatcctggcctcaagtgatcctcctgcctcagcctgggagacagagcaagagcaagaccgtgtctctaaaagaaaaaaaccatacacacacaaacacacacacacacacacacacacacacgcgcgcatgtatatatatggttatcatatgttattttgatatatgatatcaaaagcatgtggtgtacttagagttttctctgaggtatgggttcttgactgcaacactagtgtacttatggtgtgttcttgattgtaaggctcttaataccggtactagctctcaatagcttgaccaatacaactcacccatcacaccccactgtgtaagcttaaatatttgagataaattaccaacaatgtaatatttagtctagaggccaagaattctttcctgaaaaagggaccttgggcaaaggatggataggattaaaccaggtaaaggggaagagtgtgtatagaaggggacgagagagggagaaaagggagcgggaagattaagccagagataaaggaggcagcacatttaaaatctaagagacaagagcaaggaggctaatggccacagagattgccatgcttgagtggaccgtccacaagagcaggaatccctgcctttcaccacacatgcacaccccatagtgatgtgctaggccagtctgggtgttacacattggtcctcctaccatccctaagaagaaaatgaggataacaactagggcagttgtaacagtatggtaagagtattctttgccaaaagtaaagcactggacagagtcatttgttttgtattttgagtttctaccatgtgctgagaactatactggatgtaggagtgaaccaaacaggcaaaaaccctctgtgcccttatggtgtatatattctagtgggggtaggagattaaataatatatcagataaatcagaaaagtatgtaacacatcagatagtagtaagtgctgtggagaaaaatcaaggagggaagagagactggagggttgggaaaggcttatgtctacaattttacttctttgatttgaggccttggcatcagctccttgatctttcctgatctttcttcttcatttaccctgaagtttttactttttttcccacggcttagctcgaaatattttttgagcatctatagggtggcaagctagttttgggggacatagtgttaacaaaaatagacataattcctgcctcctttgcactaaatctggtgagaaaaacagactaaaacaaccatcatggcagccaaacacatgagctaaccaaattgcatgtgttttgaaggaaatatagatgttataatatgatgataatgcaaataaaaagtgttctgaaggaaacacaagggatcgattggataaaaatggcaagctatgtacagtagtcagagaagacaactgaagaggtgacatttggactgaaaggtgtcactcttccctctctattcccacttctctcccagttttcactcattcttctttgtttttgagacagtctcgctctgtcacccaggctggagttcagtggcgtgatcttggctcactgcaacttccacttcccaggttcaagggattcgcctgcctctgcctcccaaatagctgggattacaggcatgccaccacgctcgactaatttttgtatttttagtagagatggggtttcaccacattggccaggctggtctcgaactcctgaactcaagtgatccacccgccttggcctcccaaaataactgggattacaggtatgagccatcgtgtccagcctccactcgttctttaggccttcctttaaacattagttcttccgagaaagctgtcactcaaaagcttctctcgcccagttgggtatgtgtcccaccccatcccactcagatgaatgtaaaattgggtccaatcagggctagtccaacagccctatcccataggtcctccagtcagtttggggtacagagggggaacccagagtcaaatataatccagattcacaaagcagcctattgactgaggtcatggccctcgggcccacagtaagcacaaaaactgcagcccaagggccttcagccagttattcagccattgtctttggctccaaacatgccctctgtatcttgctttacggtgctaaggctaggatggcacaaatcacatgtgctctactgtctggctgcatgctagtatctgcccatagggggcgatagagggagcctgcggggcaggaggacggggagacttcagcatcaggtatccaagtagccagttcattctgtcacagcatttggatctagcttgcagtttccccaacacttacagagccagcctcattgcagcacctcagagacaccagcaccagcctcttttcgttcttttcaaccctggcagtagctgctccccacagttgccacctttgtctagtgttttcatgttctcttttaatgttttccattttctaggcaattctttatatacagttaaccagaggttcacagtgcccttggtgttttggtaatttttttttcccacagatcctaagccaaaaaacatacccaacagtttcatgtattagttgttgcaaacaacttaataagtatttgcgtcctaacaaataagaagtggtttgagaaaacagtacacacaaatcaaaataaagctatttttttctttcttaactacaattactccctaaaaggatgcatgtatctgttgagcattacacaatttctcaaactgaagattcagattagacagacactgccactttcgttgcctgttccatgttgattttggcacaaaacttgcatttcatcatggcaattgccagaagcccaattctgccaagatatgacatcagaaggaatgtagcccaatctcatgttgaaactctgggccccttcaagtagtcatttgtagcgtgtctgacagatgatgctgtgttttccacaatactggtactaccggtgctcttgtgagttaagagtggtgtcttacactgtctcaacacagtttgaaaaccaggatagttaacaattctgtataggcaattctgtctgttataagtgtcatgatttatctccaaaatagaccttgactgatgcaggaccccactgcctaaacttccttaatattccacgttcccatctttgtctcccagtattccactcagcctaggcacctcatgcccagaaatctgatgtcctcctagctgccacattctgcttcccagctccatctcagaccttgatcttccctctctgccccatccagatgcagtcccctggactgtggctgagccagggagcagggtggtcagctgtgtgcctcctgccacatcaactgctcaagtgctcaaatgctgggaagaattaaaggaacagaggcaaaagactgcagcctgaagacagagactttggaatgtttaaaaattacttttgcgctagaggaaatcgggttgggaaaagagaagcaattttgaaattacgtggtttcagtttccagagaaaggaaaaaagatttggggtgaagaaaaggagaagtcaaacccataacatctgggttagtttcacttcaattcccacttgattcatggcaagtcgctttattcatttaaagaaattaaaggaaaagaagaaaagctggagaaagaataaaacctgaaacatttctgatggtcaaaagccacctagcactgggccctggtgaggtattaaacattctaacactttacttgtcctggctgtgaacaatagggcactggaattagaaaagtctcagcgtagctaatttgccattactgcctaagaagccatgtgtaaatcaaattgtttctagactatgtaaaaacaaacaaaagtaatatctcctaattggactctgatcgcctcccttctagaagtactacctttttttttcagctggagaatttggcttttcatattcagatccagggtttttcaaagctgaggctgctcatagctgacaactcccccatcccaggacattcttgatcttccaaggaatcacattaatctacagacactactcaggactgctggaccttgaagagccctgctgtgtcagcagccccagaaatgcctaccaagcttttttatgatgtccaaagctttattctttgaaatgtacaagagtgtcattaaactgaaggaacactttcaaatgaaaaccactgtcagttgagggaggcttattttctgtcgaatctcatttgggacttacctaggcaatgaaaaaggcaattgacaaaacaaagctgtccatctcagttaacttgtggcaaacaagaatggaaccccagtagaacacggatcacagtacaacagtagctagaagacacattatctgactgcttgcctcactcacttgcgaagtacctgctggccttgttgagcacctctcagaaaagatgaggggttaaaatgcacatggtctgtttcctgactgacccctctaataggggctgacacttggccatgacattgtgagacacaatcctagcacaggcttttacataagccaccaaatgatacttcttcatatcagaatctcaaaaatgatagctacttttcctccttgactttcatttttgacttagccttctaaggatggcctctacaaaatatagagctctccttaaatgtcatcagtctcgatgccttttccactttccatcttcctccatctgcaaatagtcttgctcagatacttgatgttttcacattttctatctcttgcacattaaaacttatttatgaactgtgtgacattgaaaaaataattttacccttcctggccccagatttatatttatacatacctcctacatttcttgtagggtttaaataaaattatatgcatgcattgttagtgggatgttgtcaccatagtgctgtataacaaatcacccccaaagccacgggtttacagcaacagacatttattctcaagctcatacatctgcttgtataatctcctggtgtggatcagccaggcatggctccaggctatgagttgtgcccaggtctgcctgatgtatgcttattctacaaaccaggttgaaggagcggtagcccctcagagtaagttctttccatgatgaatgcaccagagccgagccaagccaacccatgtaggagctcttaaggcctccctcatgtcaagcttgctaataccatattgagagagcaagtcacacaggcaagctcaacatcaatgaagccactcgtcccacagttggaaagggtgggagtagcagaggtgagtgaatatttactgaaagataactcaaactatcagatcaatagatgtgtatgttttggttaacatgaccggccaacactccttcacatagtacaggcttgatcccccgagggaggaaagtctgactttgagtcaggtgtgtggagagccagaagattctgctaaagccataagatttaagcagtttcctgttctatgttcattttaactattatggaatgtgtctcttggagagaagggcagaagtctaatagagagatctggagaagccaccctggcatttgcagtctttgtcaatctcaatatgaacattctcatctaccagccaaactggtcagatgagttcttcctgtcctcaactcccaaatgctgtctcagaccacatccctgcacacacaccctgatatcctctgccccaaatcaaaactctacagtaggcaaaaatatcagcccccaaagaggttcacatcctaatacccagaacctgggaatctgttatcttacatggcaaaaagaacactgtgaacgtgattaaggatcttgaactggggatatgatcctggattatccgggtgggccccatgtactcataagggtccttataagagggaggcaagagggcagagaggagaaatgatgttaggctgacagcttcaaggatggagaaagaacagcaagcaaaggcatagaagtggcctctagaagctggaaaaggcaagaaacagattctcccccagagtcgacggaaggaacacagccctgcagacctatctcagacttctgacctccagaacaataaatcagtgttaactgctacgcttatggtgaattgttatagcggcaagacgaaactaacacaaacctcaaagattgctctgcttatttctgtatgtttattgacactcttcactttcactgccttccttctgtagacccattatgttttatacactgtcttctgcccgaatgagttcttgtaaaatacatgtaattgtttactatgcatgtatttttaattatgtagattggaatgtgttctagctcgtttacctttttgtcactcagcactacacttctgacatccacccaggctgctgtgtgcccttatttcatgattttcaaccattgcatggggttctggggtgtgttctctccatcatttatcaatctgctccccactgacagacactgtttgcttcttactcatcactgtcagaaatcacactgtagtagaccttctcaggtgtctccttctagatttgtgtgaattcctttgtggtctacattcctaggggcagaaatactgacatataggctgtgtgtaaacttaatttgacaaagtactgtcagattgctttcagaacagcagccccaaaacttttagctgtatgtaaaggtacctgtgaacccacattcatccaacctttggtattatccaatttttctacctttttaccaatctgatgggcactacgtattttttaccattactattttaatttatattgtttcagtactaaggagtttgagaatttcttcctatatttttcagccttttggatttttatctttataaactcgttgttcaaatcctttgcacaatcatctactcatttgtagaattctttgtatattctaggggttttttttgttcatgataatctctaataagtaagagtcctttatttttgatgtaataaaatcaaccaagtgccaggcgcagtggctcatgcctgtaatcccagtactttgggaggccgaggcgggtggatcacctcaggtcaggaattcgagaccagcctgaccaactgagaaaagccccatctctactaaaaatacaaaattagccggacatggtggtgcatgcctgtaatcccagctactctggaggctgaggtaggagaattgcttgaacctaggaggtggaggttgcagtgagctgcactccagcctgggcaacaggagcaaaactctgtctcaaaaaaaaaaaaagaaagagagaaagaaatatgaaaaataaataaaatcaaccaagtttgtgtgtgtgtgtgtgtgtgtgtgtgtgtgtgtgtgtgtgtgtgtgtgtgttctttgctgattctcaaggttttattttatttttatctttttacctttttttaaattatactttaagttttagggtacatgtgcacaacctgcaggttagttacatatgtatacatgttgttatttttttgaaatgtctccctaatggtagacatgaaatctgttctcaaatattccacgtcccccttgttccaggcacatggtcaggttgtactttcctttgaagttaggtatagccatgagactttccttgcccagtgataagtgagaagatatcacctgtcactttcaggactgttttaaagcccaagtgtaattggcccatttcactttcccctgttgacctatgtgatcacaacacactagcgagagagagatttctgttgcgggttaagccatcagattttggggtcatttgttcctcgagcatacctagcctatcctgacttttttttttttaatttattttatcccattccccactctcctaccatgagcaaccattttaatatatttattttgtgttcttagaaaatgcatcctattacatgtgcatttttaaaatttagataaatggtgttgggttgtctcactgtttcttactttattcactcagcattatgcttttaaggtccagccacactgctacaactgcatatcaaatctgttgttgttaaatgctgtgtgggtgagccacagctgtgatttccctctcttcctttccctatgaaagacacaaactttttttgaagaaatctttgcccaactctagtctacaaagtcattctgcaatattcttttctaactttgtagctttatcattcacactgacatcttaggtctccaaagtccattaccctgggagtaggtattaaggtggcattcagttttattttcccctgcacagtaaaaaaagttttcctcaaaaccatttgcttactattcagtccagttgatctgtagagccatctctatcacacatgaagtttccagacatacatgaaatggttcttgagctttccattctgttctattgatccactgcctattacagcatgcatttttatagttatggcttaatagtatattttatagattcatgtatggaagggtacatcttctgtgtttttaatccctccttgaagttgactactatgatttttcccctctatatatatttattagagaaagtttatcaagttcgttaaaaacttaacagaaatttttattgacactgaattaaattcatagataaattcaggggggattttcacttgtgtaatatcttcccatccatggccatagactttttctccatctattcaggtcttcttttaactctcttattaaagttttctccattgagattttatatattcttagactacttaaatcctaaatatttgatcatttgtattacaattgtcttaaattagattttctagttcattattgctggtgtacagacatgctattgatttttataagttaatcttatatctggcaaccttgttgaactctcttattaccacaatttttgattgcaattgatttttctaaaaggattatcatatcatctacaaacaatgagttttatttctttgcaatcctcatacatcttatttctttttctttccttaaagtttgggccagaaactccagcattatgttaaatagcaatggtggctccactcttctccctgctccaaaaaggaatgcacctgcattttctacattaggtataatatttgctgtagaattttggcttataaactagcaatctaacaaaagtttccctttattttctaagggttttaaaaaataatcataaattggtgaatacctttatcaaatgcttatcacctattcactcatttaaggacatttaagttgtttcaagtttggggtaattataagtaaatctgctatggacattcatgtatcaaatgcttgtctcaaggattgaaataatcatatgatttttattctttagcatatttaaagtagtgaattgcacgaacattgaaaaaaaacttgctcctgggataagccccatataattattatttttgtaaaacagtgttgacttcgttagttagtatttaacatacgatgtattttctatacattcacgcatgaaatgggcctgtattttcttttcttgtattcttatctgatttttcagtctgataaccaagagggctactaagcgactaataagtgagtagcatatatagcatggatatgttggacaaatggatgatgcacattctggcaggatggagcaggatggcatgaggtttcatcacagtattcagaaaagtgacatttttaaaagttatgaattgtttatttctggaattttccatgtactatcttcacactgtggttgactgtaattgcaaccaagaaaagtgaaactgtggatcaagggggaatactgtgtcaagaggtggagcctttaggggtccaccttcaaagatgggatcagtgccttagaacagggcttgagggggcaagttttcttctcccgtccgtctgccatgtaaggacacagcgtttgtccaccctggatgataaagcaacagcgtgccatcttggaagcagagagtgaatcctcgtcacacaccaaatttgccagatcttgggcttcccaacttccagatctatgagaaattaatgtctattatttctaaatcacctattctaacatattgtgttataccagcaggaatagactaagacacttatgctatctttttatagacacaccctttctctcctccctgccatctaaaaccccaggcagccactaatctgttctccatctataatttttttatcatttcataaatgttatataaaagaaataatatactatgtaacattttgactcagcataatttttcacttagcataattctcttgaggctcatccaaggtgttacaggtacaatagtttgctctttttattcctgagtagtatatcatgctataggtgttttacagcttgtttaactattcactcatttaaggacatttaggtagtttccagtttggggtgattgtgagtaaatctgctatggacattcatgtataagtttctgtgtgaacatgagtttttgcttccctggaataaatgcctaagcgtataattgctggatcatatagtaagttcatttttacttataaaataaacaggcaaagtaccttccagagcggctatatcattttacatttccaccagcaacgtaggagagatccagtttctttgcatcctcgctataatctggtgctatcactactttttatatgagccattcagataggtgtgtagtgattcctcactgtggttttaattttcattttcctaatgactaatcatgttaaacattttcttcatgttccttttttttgccatctgtatatacaggtcatttgtttttaacttttgtttcctgttaaataaatttaaacttttagactttcctctaagtgttgcttcagcctgttgtgcaaatatagacttgttctgctttcattattattcacttcaggattcctttatgatttcctttgtaaccaaagtgttgtttagtaacatgttatttagttgtcaaattcatgagatttttaaatctgtcctttggttattaatttctaagtttattgcataacagttggggaacatgctctgtgttatatgaattatttggttttaattgggctgcttttatggcctaatacatgttctatttttgtgatgattttgagtgtgctcaaaagaatgactttctctgtttgcatttggagttctatatattaaaattatttaacactaatttgtcaatatgttaataagcttgagtttattcattctatttctcagatcttcaatgtctctagttattttttgtctacttgatattgttctgcttcaatagattgattccctagtatggctgctaacttgtatccaccttaaatgataaccacaaaaacaaccataatttgcaaatacctaactgcctcatgtaaagttttaaatactatgtgccagggacttggctaagcattttgctggtgtcacatttacctcttacacttacaagtcacaaagttcctgttttacagatgaggaatccaagagtctagaagcaaattaaccatggcatgcagccagaatggcagagctggcatttaagtgcagatttgtgttctaagtccatgtttttaatgattgtattctatgcctcagtttactcatttgtagaaggaggaaatttggaggactttgaggggtttttttttaagactaagaaactcatcatcattattattgtctgggttaacatttattgaactcttcctctgtaagttctaggttctgtactaagcacagtacgtcagtgatcttatttcatcctcacagccaccctataaagtaggtgttgaaaacttagtgttacagatgaggaaacgagggcttagagtgagtactcagttaggataagaactcattggtgaggtcaccagggcctaaggtcctaatcacaatgctagactttgatcttccacactgaaccggggactttatagatgacatttcacgtagccccacaacagctgtcagagggaagaagtggtgtgccttcttaaccacatccatccaaaagttttttggttgacccctgggacttcagaaagaagtcttctgtctttcttatttgattgaaatgttcctttcaattgcttggactctgaagcccagcatcctctttttctctccccaagctgctcaacacattcctaaaggcagcatttggcccagctcatttcttcctcttcatacccctccatttaacctccccatcttcagtggaggtacacatactcaatcacattgcccatcctctcctgttgtcttccagaaaagtcttaccctaaaatggactgataagcccatacaacttatagtatattttaaatatgaagataggggcttttctcaatcatctcgaccctttcatctacctgtttttttcagagtaaagagagagaagcagtgagttattgtcatgttaagctgcactaaatggctgtatattatggttagagacctctggagaaataatgatgagatcactgcatcttttgttcttggaaaaataatgtggcaaaaagacacctctaatcctctattttaatttgtttttattgatctctttgaaaattagggaaacaacgttttctcattgcaaatgttataagaatgcatggggaggttctagttataaagaataatgaagtagaggctatgaaagagagtctcttcataaggcatggatttagcggaggacggtgggtgagaacatacctgtaaaaggaaatacacagagtaaagaaacctctcagatatcaatgactaactctcagttgtgggtttgggaataatgtgtcatcaaagaggcattccatgagctcagtaaaaactcccgcccctcccccaactatcatttcactatcatatcaatctcctttattctcttggcacttgcaggaattaccttgtttatttacttatatgattgtttacttgtattatttcccccaccttagcctgaaaaattaattgtacaaaagaaagaactttgtgtatttgttttctgccatttcctggtacctagaatcatagctggcatataataagtagtcaaatatttggacagatgaatggatggatgaatagatggatagatacgtgaaataaatgtttcctctatccccaatcttctgtgatttccaaattttctataatgaacaaatgttactgctctaaaaagaaaacattaatttagcatcacatctttctagaaacctttcctgtttcctcgggcacaagtgaatctccctcctctaatctcccaagaatattcaaacctctcattggacactgggccttgtcatcctgactctcattatttgcctacatttcttgtcttcctcactgaaatttaaggcctctgagtgttagactcataaatttccagagcagcaaagaacttaaagatcatcaggcctaacgtccccacttatagatgaaaacagtgagactcagagatgtgagctatccagacccaatggcaaaagataatccaggaaagtgctacactcttaatgccatattttctttgttcaagttgtcttaggtcactgggtaagctgtggtaggttcagcactttaactgggcacctagccctctaccctctcttctctaggccagagggcagtgccttctgcatttgcaattcatatttcctacctcagtggctgaaaggggcagaaagggctggaaagtggaggagtctcacctatactttctctctttatttggcatgtccatgcacctggcatcctaccctttatgcccaaagaattaacaaggagaagaagaaataaagcaataattctctggcaactgtcaaaaggcacacagaccatccacaagtggtttttctgataaatatgtgcaaagcctctttcagttttcccgttagagtctcagcgctcccttgaggaagaggtagctcaattctaaaagaattttagataagctatttaagacataggggaaaatacaggttaaaatataacaaattccccaaacctagcacctaagatactgaatttagggttcagcatttccatgtaggtatccatgtttccttttcatatataagtttctaagaataacatagtattgactggcagacttaaaaactacatacagttgacccttgtatataatgcaagggttagaggtgccaacctcccacccccacacagttgaaactccatgtataacttctgacctccaaaaactttcctactcttgaccgaaagccttactgataacatgaacagttggttaaaacatattttgtgttatatgtattatacattgtattcttacaataaagtaagctagagaaaaaaatattattagggaaatcataaagaggagaaaatctatttactattcattaaggggaagtggatcatcataaagctcttcattttcattgtcttcctattgactggcctgaggaagaggagaaagaagaggggtcggctttgctgtctcaagggtggcagaagtggaagaagtggaggaggtggaaggtgaggcaggagaggcaggcataccccatgtaacttcacaaaaacacattgcaatttgtctttttcacttttttatttctctcaaaaatgtttctatgtggtaccaatttttcttccacctcttgctttagtttcagtgcctgtttcacagaagtttccatgtcctaaaagaagtcaaaagtggtcttgaataattggaaccgttctgtcagataatctaatgtaaatctgttttctggcaccgctccttctatgtctttcctcatcttctggcaccagttcagaagagctcatctctaacaagttgtccgctgttaattcttatgatcttgtgaagtgtctattagctcctgaatttctccaagatctgtatcttgaaatccttcactttcaccaccttttttttttttttgccatatccacaatctctttcataatgtccttgattgcttcggtcataaattctgtgaagtcacacacaacatctgcacagttttccctagcagtaatttattgtttcaagcgtggcagttttcatggttttttgtataacgatgatgacatcttcaatggtgtaatcctttcagactttcatgggctctctttataccgttgacaatgcattccatagaatacaatgtgtaatgaaacttaaagatcctcatgacccctgaattagagacgttgtgtttgggggcaagcagaccacttcattgcctgtgatgttcaactcattgggttctagggggccagaggtattgtctaatagcaaaataaattcaaaggtagtcccttaccagcaaggtacttcctgacccagagaacgaatggaaccaattcagaatttgttgtccaggacttcttgtacaatcagaagtctagcagctggtgtttatcttttcccttcaaggcttagggcttagcagctttacagataagggtagtccttgtcataaacctgagtgcatttgcacagaatcatagatttagcacatctcttcctgtcttaaatcctggtgctcacttctctttcttataactgaatgtcttttatggcatttttcccccccagaataaggcacattcactggcattaaaaacttgttcaggtagatatcctttctcctcaattattttcttaatggcatctggggtattgtctgctgcctcttggtgggcaaaagctgcttctcctgttatcttgattttttttggtttgtttgtttgagacaaagtctctctgttgctcaggctgacctcaaactcctgtgttcaagcgatcctcctgcctcagacttccaagtagctgagattataggcacccaacattgtaccaggctcttttcttgacatttttttaaacgaaatctttttcaaaaattaacaagccaccctttgctggcattacataccccagctttagatcctttaccttccttttgttttaagttgtcatataataattgccttttactccaatgatattagagtctacagatatgcctttcttatagaaatcctgcaaccacataagagccgcattctcaatatgatataaaaaggtattttgcaaaaagtgcaaggttttcatgcatgctggtatagctgtggtgatcacttcacaaatttccttttctattctttttttatttacaatggtccttgtgctggattcatttatcttgaaatggcagaaaactgcagctgtagacctcaatctagggtacatatcaagaatttaacctttcttttgtaatgtcatgacttttctctgcttctttggagtgcttccagcatcactagtggtactttgtatgggtatcacggtgtttttcaaggtttacactattgcaccaaacatgatgaaaaatacacgagaacctcaagagatcactttttattgtggtaagtgatgtactggaaagatgaactgatcatatggagatgtcagccttgtaaatcgaaaataaaattctaagccccccagtcaactgaacagactttccttttggccaaagagatcccccaaaacctgaaaataaactagttcaggaaggcagggggcaggggcggttggacatgtctcattacaccctcttccctctggaggttagacaaaattgactagtgttaacattaaaatagagatcttaaggactgacaaaacagactctgtagcaataagacaccaaattccaacctgattctagtgtaacatcacatgacagatagtgggtcctaaaggaaatcaaagtattttgctccaaaatatacttccctgacatattttgaaatgggcctgaaaagctatctcttgcgggggaagttatattctatagagactctccttcccctacgaggtcttttcaggagattttgacatcttttagctctaataagaaacatgcacatctattctctctgaactctgctacttggaggcttcatctacatgacaggaaccttggtttccacaactcgacctctcttaccttaccttaactcaagctgactcaactcttcaggaagagcttaattctttcaaccaattgccaatcaggaaatctttgactccacctatgacctggaagccccacactctacccggctttgagatgtcccacctttccaggccaaaccaacatataccttacatatattgatttatgtctttgcctgtaacttctgtcttcctaaaatgtatacaatcaagctgtaacccaaccgcctttgggacatgttctcagaacctcctgaggctgtgtcacaggccatgattttaaccttggcaaaataaacgtctaaattaagacctgtctcatactttttggtttatagcctcaaatggcattttaaggagatactcatgacatttgaactcacagcaatagcaacaggaagtggctacaaaattaactgtagtacatactgtactactgtggcaattttgtgcagttatgatctaatactgcatctttatatttgcttacatttctctcgactgcaaatggtgccatgtacagtctgtatatgtgtaagttttgataaacttttttttttttttttgagacagagttttgctcttgtcacccaggctgaagtgcaatggcacaatctcagctcactgcaccctctgcctcctgggttcaagcgattctactgcctcagcctcctgagtagctgggattacaggcatccaccaccacacctggctaatttttgtatttttagtacagacgcagtttcaccatgttggccaggctggtcttgatctcctgaccttgcgatccagctgcctcggcctcccaaaatgctgggattacaggcgtgagccaccatgcctggccaattttaactttttaataacagattttagaatattttatggtagcaaatgataaaatagactactatctacatctttcatgacatacttaaaaattttttgatttttgatatttctgggctgcatgatgcgtctgcaagtttttcaaatcattgcacacctccaacaagatgtccaatatatgtattgaaaataacccttgtataagtggatgctttcagttcaaacctacattgtccaagggtgagttgtaattggtatcatatacatacccttcttcagcttctatcattttagttagattcattcattatgatacatggagcttaagttcattaattctactgctatccagttttccattgtatgactatatcacagttcattcattattcttttgatgaatatttattttaatttatttttagttctgtttgtaatttgagtttttttatccactaacatggtatgtctcttaacttacctaggtcttttaaaatttatttagcataaattttataattttctaggtcttacacatttttcacttgttttgatatatgttttatttttgttgctactgtaaatggtgtttttaaactttttatttgaatataaagtacagagaagtacacgcatctctgaatttccacaaacttcacccttgtataaccagacaaaaatcaagaaagatgttaccagaatcacataagcctctttatgccggtctactcactacccccatcagcaaggtaaatgctattttaatatttttgaattaaattttataattattatataaaaatgtaaatgacttgtatactgatctaatatccagagactttgatatagcatattactatttataatttgttgtaatcaaaaatttgatttatattgtaatcttttttcctctctagacaatcatgccacatgtgactagtataacattgttttgcttcctttccagtaattattcattttactcccctttaaaaaaattctctgcccttactggctgtctttaacaccaagtgaaatagatgtagtgttggtgcatcccttcctcactttcccttggttttcaaggcaatgttttcatatttatcatttattatgatgcttattgactgaagatgtccctcatcagaataagaaagttcttttctattcctagatttataaggggtatttttagtttaatgattttatgcacttagcaaataattttatgcacttaggcagctataatttttctattttgtttgattaatgtggtaattacattaatgtattttccaatgtcagacaaccctcatagtctctcaatgaacccaaaattgccttcatctatttactatttttacttcttaagtttaaacttttaattgataaatacaagcaggtcataaatcataaaaaagcagcaaggtgaatttccacaatactgacatctcctatgtaacagatcgataacaaaatattaccagccctcagaagcccaccccatcacgcctttccccgtcactaacccccacaagggtagccagtatcctaattgataacttcattgtttgtatttgcctatttttgaacttttatctagaataaatcataagcatctgctcttttgtgtcatttgttcaaccttaggtttgggagagtccaccacagtgttttaagtaacattacttcatccattcccattgctgtataaaagcgcattacatgaatatcccacatttattcatttattctattgttgagaaacatttttgtttcaagttaataaacattaggaatagtgctatcatgaacgctacacatattttgctgaagatatatatgcatttctgtgagaaatatacctagaagtggaattactggggtgtgggtagtatatatttactttctatatacaccaaggatctacaagctacaacccttctcttccgcctgccaacaatttttgttgataaagttttattgaaacacagccacacctatttgtttatgtatgtctatgctgttttagcacctcagtggcagtgttgaatagttgtgatagaaacagtacaacctgcaaagcttaaaatatttattatctggtttttacatagaaagtttgctgttccctgttgtatactgtcaaacagtttttaaaagtggttataccaatttatacccccacttctctagctttgccatgatatgttttaatatgcattcttgaattttgttcttatgtataagtgacattaagctaatatgccttcattttttttgtcctggtgtggttttgatatcaaaatatcctagacttacaaaatgaattaggaaattttcctatatttttcattctctgaaagagtatgcaaaaagaaagaaagaaattatattttctttgaatgcttggtcaaatttgcttgtaaaacaatttgggcttagcattttgagaagattttcaattattgattcattttttaaaattatattcattttgtttacttcttgagtcagttttgaaagttacatttttcaaggatatacctttttagtctcacttattgacaaaaagttattatattcattcatcattaagtattttaataggaatcatttcatatataaaaagagcacttacaaagtatatgtagtgaaaaataaaattcacttctgtctatgaaacatcttccttaagaaacagaacaatatcaatacatttgaaattcacttgtgcccctccctacagtatccacttccaattgcttttggagggataggcactctcctagaaaaaattacatatgtatacaaacacacacacacacacacacacacacacacacacacacacacatctcaaatgagatattcaaatattattggaatatattttgcacgtttctgaaatatatataaaaggaagaatatcacatatattcttctttgccttgcagttttcactaaaacttcacgtttttgacaacagttatccatattgggtaactcatttttgtgctggcttactcatttttactgtcttacaagatcagactatatgaatagatataaactattaatacaatttactcatcaattctccagacataaacatttatgttggtgccagattttttagctattagtgagcaaggctgctctgaacattcatgtatttatctcctgagagtacatgtgcaagagtttctctagtctaggctacatatctgtgagtaaatcactggatgttatgttatacacatcttcaatttaatagatgattgcaaactgcttatccaagtggttgtagcaatttgcattctcatgaggagtatttaaatatttgctgttctaattaattgcaaatacttggtgtttcaggctatttggttattaccaatctgtaagtttatttcttggacttttaatattagctgtatgttaaggtatcctcttttattcctaacaatttttgtttgtgccaactttttttctggagagaaaaaaggagtttggtgtgtttttttatgccttttcaaagagttttggctttgttgatacactctgttttagcttttcttatttcattgatgtattctctaatattagttatatcctctttccattacccttaggtttaatctattgttcttttttaccgtaatatgattgcttaaatcattaaatatttggatattcttcattactgtaagcatgttaaagctaggaatttccctgaaattgtgagtttagccaaatcccaagagttttatttgtattatttttatgatcattcaattctaaatagcttatctgttgcctttaagacattttcatgacataactattttgtaggagtgctttcaaacttccaaatgtataaactttaataaaagtaaaatttttgcttttctttctaacttgatctcattgtgattagagaatatagtttgtgtgatgctgactcaaaatttttgagacttgctttattgattgatttttgatttttgtaattgttttatgtattcctaagctaaatgtatattctctaatctcggagtgcagcattttatacttgtcaactggattgttcttattaattgtgtcatataaatcttttctttatttactagttatttgtctactttgtctgtcaattacagagatgtatctggtatctccaagcattcttcttatgccttctgctcataccagtctccctgcttttcttaaaacaggccaagaactctgccccttcagagccagtaaacttactgattctaccgtttggaatgattttctcaaatctataacctgattgactccctcacttcattcaggtcaccttatgagggaatcctaccttcatcacaatctaaacaatagctcccttgctccttaattttctgtccctttaccctcatttgttttttccttttcagcccttaccaacatcaggcatattaaatatttttttcattatcttttccatccagaatataagcttcaggggaattgtgatttattcattataatttcctcagtacctagaaggatgcctggaataaaatagaggattttatttttaaatgtttctaataataaaatgttattggtaatcctaattatgtgtgggcccaaactgttgcacaacaacttgtgtaatcccatctattcatttattgttcaattaattcttgttcagcaaacatttgttcaatgaatgaatgaataaatgaatgttaaaaaaaaaccatctcactgacagatttgcaatttcctctttgcaactgtctcaaatttggctttacatattttgagatcaagttattatgtgcatacaggtttagaattgttggaactttcagaataaacaaacattttataactgaaaattaaaatcttattttaataaaataatttatcattttgctttcagtctaatttatctgatattaataatgtttcatcaacttttttcctattaccagtttcctgctatatttttcccacctgtgacttccagcctatttgcattattacattttatgtatgtgtcttttaaaattgtataatttggattttgttttctaatcaaatgtaacattttcacatttaaattagggagtttagtttaagtacattttttgagaatactgataagttgaaaattctttctcacatcttacgttgtcttgctttttaaaatgccctttccttcctttccagcctttctttgaatttactgagttttaattatgttttattataaatctagcctttggtcctccaaatattttactaggctctgcaggtcagtagaaataagttatgcatacacatctgtgaaatttatgcatgcaaatagcctccattcgataggtccgatattctgggagctgggcagagcatacctacgatatactatttcatggaattcaaatcccaatgaccccctataaaaaaggcactttcaagtttctactgaacttgctcttccctttctttcccctcttttaaccccaaccaaacaagttagccattaagcctactgctctgtgtatcaagtgattcttaagttacgtaaatatgcctggtagcattcacgacttcattcttttaattattttatttacttagttttattttattggacagcctccaccaaccctctggaccagaataagttcagagctactcctgtctttattattattattgttattttgagatggagtcccgctctgtctcccaggctggagtgcagcggcgtgatgtcagcttactgcaatctctgcctcccaggttcaagcaattctcctgcctcagcttcctgagtagctgggattacaggcgcccaccaccatgcctgggtaatttttgtatttttagtagagaccaggtttcatcatgttggtcaggctggttttgaattccttatttcaggtgatccacctgccttggcctcccaaagtgctgggattacaggtgtgagccaccaagcctggcctcctgtctctactattttaaatagccaggtgacaaattgaactcttcaattatttgttgaaatgacagaattttagggtcatagaaggagggtgagtttcatatgagcaacaggaactactggcttaaatgtgaaaattaatgcatctctgcaaatcaagctgtggctatctctctgcttggtctccaaaggacatatggtttacaatcctctgtgacactgaaaagagaaaagaagcaagactatatttgccatttgactgcttttcattggaattggattaaagcatatttcactttgttcattgtcctttttaaagcattcagctccacgaaaggttgagccagagcaagtagttgaaaagattttctatgcccctttcctcccgcgttgtatgactggtggcaataaagtcactttcaggcagaaagatgcaaagccattaactcagggttacatacatcccaaaccaggctcaatgggaagaacacatttgactgtctccttctgtttatttagccatcttcttaacatttcttttttggtgtatgttttatgtacccaaattgtatatgtaatgtacatataatacattactctagtaatgtatacatacatttatcaataagtatgtgtacatatggggaatatgtgctcagaaatgttttactaatttgatttgtgatttaaaaatgagtacactggtgtgtgtgacagatttggaagcctggtttctcatccacacacttcaataagcatagccctatagaccctctcaggtgtattatcccagttcatatcttgggccttctttattgacttaattccttaaggtgatactgatgctttccagttgaatctatttccagagtactttcctcctatcttctcttttttctttaatccctttgtccaaggcccagattactgccacttaaattcagttgtatctcttacctttttctccattccaggttgtgaacaatgttgcacaataatttgtgtaatccctgaatatatctttcctgacttgagaaaaaaatgagaatatctttcagtatcagggctccttggaggtcagggacattgaataatggatggtattattcccattatttatgtgaaaaaaaacactgagattaggtgatttttgtgtaaggttacagaatcaatccgtacgtttttaacctcaccttgagattctgagtcttgtacttttccctgctgggatcctcagtgagtctatgttttctcaacctctgaccagaggctatgcctgtgccctgtccttgtttttcatatggtaaggaaaatgtcctcctggatcctaggatctgaccacatcttattaatagagttcaaggcagtagaaagagcaaggtctttgaaagtagacagaagtgcattcaaatctcagctcccaggtccacataagttgtgagacctcattatgcaggagtaaaaacacgccccaaatcttagtggcttgaaaaccaccaatatttgtttcccactcactttatatatccatgggcaggttagaaggcccaagatatgaattgggataatatacctgagaggacctatagggctatgcttattgaatcgtgtggatgagaaatcaggcttccaaatctgtcacacaaaccagtgtactcatttttaaatcacaaattctaattatatgtggacccaagctgatgaagcagatgccagaggaggagcacatggtgacccataactagctctttaagcttccatggagatgagacatatgtcacttacactcacacggatgcacccaacccaagaagggagaagccttcttggccgagaagggaaagcccatcgtgtgctcaggaggagaaccaaaaacattggagatacaccactcataattatcacgccaatgtatttagcatctctgagccccagtcttctatgtaaaaacaggacagtgataaggatagaaatataataaatcagaactaatgtcttaatacatgaaatgtacagcacaatgcttggccagcggttgagtcttaacaaatattagttcaatcctgtctgcattttgttcctttctctctagacctgagaatagagggaattggtaggaaaatgccagcgggccggtttctaattccaccaagaagacaaggaaaatgggttgcaacagcagccagaggacagaaggccagggtagccggtcaggtcccagggatcaggtagaatttcattactcacaggactttttttttttttttcagcacaaaataaccttctagaaaacccagctgaggagaaagttcacaaaggggtcacataggtagcccaagctcttcgaggtcaatgcatggtgtgcctcttgatgcagcctggcactttcattaacgtatttaatcatgcttttatctttaatcatcaaatggcttaatagcatgcattgtattcccaggcctgaaataacaatggttatgtggctctgtgataaatgtttttaataaaatcagtaattaccctttttgtgtgtgtgtgtgtgtgtgtgtattatattaacatctttccatttccttaattttggcttttagatatgcaaaaaaaaaaagactaaggtagaatactcaaaatactgttttatgtttggttttgtttctaggagcgcctgctgaatagcaggaaaggtgaattctaagctgtggattttaatgcaaacttcatctaagaacagttggggttgggagagagccctggcttcagggccaaccaaaggtggggtctgaatcccagctgtatgagagaaggctactcataggaactctccaagctgaatttccaaatctgtaaaatggtagagcactattctttataaagttgtggtggagaatataaagatgcttaaaagtaattacatttaacaaaaaatagaatagcccttactatgtaccagaagctattctaagtgacttataaatattaactcatttggtcctcaacgcaaccttaccaagacaggtattttgagatgatagataaataaaaagagaggttaagtaactttcccatcgtgccatagctagtaagtagtagagctgaaattagaacccagacaatctgcctagagaagtacattcttgatttcatactctaaacaggtgagctattattactgttgttattggtccaataaacatatttttacttaatagacctggcttttgtactggaaactctggtcattgtacatttaatgatggctgtttatccttacacttaatttatatttaatttataaatataaataatataatttataaatataaataatataatttataaatataatttatatttaatttatagatataaattatataatttatatttaatttatagatataaattatataatttatatttaatttatagatataaattatataatttatatttaatttatagatataaatcatataatttatatttaatttatagatataaattatataatttatatttaatttatagatataaattatataatttatatttaatttatagatataaattatataatttatatttaatttatagatataaattatataatttatatttaatttatagatataaattatataatttatatttaatttatagatataaattatataatttatatttaatttatagatataaattatataatttatatttaatttatagatataaattatataatttatatttaatttatagatataaattatataatttatatttaatttatagatataaattatataatttatatttaatttatagatataaattatataatttatatttaatttatagatataaattatataatttatatttaatttatagatataaattatataatttatatttaatttatagatatataaattaatatatatcaatttatatttctattcaaactgtttgtgttgtaaggtgttccttattcatttatcaatgcccgatatagaattggcctttatttatactcactgtatgtcattctgcagaatagctcaggattcttttaagtaagtctcatcctctctacttatattgttgaaggcaaatcactctgaaccttagttcatctctctgtaaaattaggctacaggttgtacctgctgtttcagactgatgtgtcttatttatttagcaaatatgtattgagcatccacttagagtaccatacccattcctggcgggaagtgtcttggtaattttaatcaatcctgacataccacccacagggacctctgatcatatagataggaacagtcttggataaagaaggaacctgggctgtgaagtcagaaattgagctcctccacttgtagaaggacatgtcacctcacctgaatcctatctgtaaaatgggttgacctaagagaacaagaatctgagaaggaaaaatacatggcatagtgctgggcacacatcaaggacaaagagggagactgtctagtctacttctaatttggttttatgaagcccaagagacaaggacacatggtttgctgagtccaaaagcaccatcatgtgcataagttcagggccccgttgtgtttccaatacctaaccccccttgaaaatgccccaggaagaattggcttgtatgaccacagcagtcccagcaaatttgcaggatggtgcagtcctacagcccttccctacctaggaacaaaagtttgtagcctatattcttcttgaataataggaattatttattttgaaatgtattcctggaactttgcttgggttatagttttaacttccataggcatgaattcacatgctataacgtgtgtgttttttaaaaaaggagccccaatacagacctgctcacagcaagatgaagggtatttactgggtcatacaagatgtgctatggtgtccagataagagctcagaccccaagaggaaagttatttttccagccctaaaggatagagtaaaacaacctttcccattatcttgctaggcaagaaaccaagacaaagcggtagaactaaggggtggcaggcaagaatatacatacaaattacacagactggaagtaacagaaccgtggagtcctgcaagcaggtggcaaagccatttctctctattcatcgtgcagaataaattaggggaaagccacatttcccagccagagaagcaataaaaatttaaaatgtaaaataaccttgagcaaaagcattagcaaaggccttgcctgttgctatggtttgaatggcccctccaaaactcatgttgaaacttaatccccaatgtggcaatcactgagaggcgggcctttaagaagtgaatgaatcatgacggctctgccctgatgaatagattaatccattcatggattgatggattaaggggttatcatgggaagggaactgatgactttgtaaaaagagagagacctgaggtagcacattgcatattagtacagttagcacatggccacatgatgctccatgctgccttgggacttctaaaggagtcctcaccaataagaaggttctcaccagatgtaccctctgaacctcagacttcccagtctctggaactgtgagaaatcaattttgtttctttataaatcacccagtttcaggtattctgttataagcaacagaaagcagactaattaacctgttctgcaaataataataaactcttgatacaacagacttatcctagccaagactagtgtgaggcagtaacagtgggaagtctaggggaatggagaccaggaacactcaaggggaagagaaactcgaaggaagccaggacaggacttttgtcttatttggagttgattgaaggctttcaccaaatgcactgaatatagtactcatcgtttgtggacttttttttttttcatgactatggtcaagaagttgagggtaaaatgtattccttttcagtcaataatttgaatctgatgctattacttctggtgtggttccttaactaggagctcgataaagatcacgaaacacatgtatctggagatcaggattagatatgcccaacttaactcttactctaatgattttggtaccaaatgagtaataactggtaaacaccctattttttttttttagataccaatgtcttggcaaggtctatttccttctgaaagggctacaccctgggcctttgcagactcgcctcctgctttctaaatctagaccaagttcctaccaatgacagcaaagcactccattctatagcaacctcttttcttaacttagaacgtatagtgtgtacattatcattcaaagtttgtacatcatgaatgaacaaggaacaacattccaaaggcaagaagagtaaataggaaaggttctattcctccctctccctgagctgagccatctgtcttgtttctctccctggaggcaactactcatagcaattttggatgcaaccttctaaagatattctttacttaaacatatataagtaaatgtttaaattatcataccaaatattcatgaaatttaatacacaatttatataaatttctatgaattttaatacatatatagatttcatgtaaccaccaccactatcaggatacagcatggtttcatcattccaaaaaacttccttgtactatccttccatagtcacagtgtccctaaaacttcccacacaactcctaacccctggcaaccaccgaactcttttctgttactatggttttatctttttgagaacatcacgtaagtggaatcacacaatatgtaggcttttgagtgtctccttttctcagtataatgcctttgagattcatccagttgtgtgtattaatagcttgtcccattttaattgctgagtaatattccaacatgaggatgtaccacatctcctttatctattaacttgttgaaggccacatcttcttggtgattatgaatagatctgctataaatatttgcgtatttattttggtgtgaacatactttcatttatctaggataaataaccagtatttgggttgctgggtctaacaagtagtacgtgtttaatttattaagaaattaactaaatgttttcaagctgactgcatacactgttctgcattttataaaaatcagtgatgcatcctaccaatcattttggatgtgtcagtttagttagatctacctcatttaaaaaatcaggctgcaatgttttaatgttgtcattgtgatgttttttgttttttgttgttttgttttgttttttgagacagagtttcgctcttgttgcccagactggagtgcaatggcatgatcttggctcaccacaacctccgcctcctgggttcaagggattctcctgcctcagccttttgagtagctgagattacaggcatccaccaccacacccagctcatttttgtatttttagtggagacagggtttcaccatgttggccaggctggtctcgaactcctgacctcaggtgatccacccacctcagcctcccaaagtactgggattacaggcgtgagctaccatacccgacctaatgttgttattgtgtttttcatatgttctctattgatggggtgtgtgtgtgtgtgtgtgtgtgtgtgtgtgtgtgtgttttccaggtgcaaaatcactgggccaattacccccctagcttccttgaagaagccattgtttttcttaattttgttaatttctggatacccaattttctttcttctacttttttcagtttattctgttgaaaaaattctaatttattgagttaacttcttaattcacacagattaacaaacatgagagagtagacattaagtccagaagttcactgttttagttgtatcccatcaggtctgatatgtattattttatacctatttgtattattttgtgttcttattttctagatattttgcaattttaatattggtttcctcttttacttgaaacttgcatgagataattttttgttattaatattctattacatttccaggtgctgggaaatatatatgctacacataaagtgtaaagaacgatcatcagaagaacactcttcaccagcagtttgagaaacaacattatccatatctctgaattccactttgctgcactcttctaattcatacatttctttaccccaagaaacacccatttttctgaatttggggttagtcattcaactgcttatatacataagcagtgataaacctccaatgaaaaatgaacgtttaagccttgatgtcaatggaatcatagtgaatgcattccgctctaatattcatttttctctgaacagtatgtgtggaattcatccattttgatactggtggctatagtttgctcactttcactgctgtgtagtagccccattgagcgtaaatatgacaatttacttctcattttttctatgatggtccatttagattgttatcaatttttagcttgtacaaacaaatttgctaggaatgttcttgggcataatccatgataaacatgggtttatttaggttagctcctccaggatggaatggctaaaatatacgatatattcatcttttgctttataataaaatgccaatgtttgcctgaagtggcttgaccaattgatcctgcatgtatcggcaccctcctgctccccatccttgctcatgtttgataatgtcacacttttaaacatttcttacatatgggatatgaagtcatatcacctagtacttttaatatctgtttctaagattttaatacaatttctcagttctttgtgatcatccaactttataaaatgcattttctttgttcacgcttttcttttcttttcaaatgcctttttaaaattgattcactgagattcatgatttactctagatacttatttgttgctggctttgtatgttgcaaatattttctgccagtgtgtggtttgtcttttcaattgatttgggggtgccttttgaagaagagaaattcaacgttttaacacatttgattaacattactatttgtataatctttaagaagactctacctcacagtcaaaaagtattctgtctatatttttctcttaatatgaaggtttaccttttataaataagacatttattcatcaaaaattgattctgtgcatagtgagtgataggatcccagcaatttttccaagtggaaaatcaattattctatcgctatgtaggattgttgtcataacaatttacaaaaccgttccacatatgtataggcctatttctgacttttcatcctgctctacttgtaaatccctgtactaacttcacattctcttaatttctgtaacttatagtatgacctcattaccgggagggcagcaatcttcatgattttctcttttggatatcctcttctgtaaaaatcagagaactctcttgtcaagttccactgggggttttatcttaattgccatcggatctatagattagcttgagaataatcaacatcttaaacacactgggtatttttatccaataatctatctctctatttaggtcacgtttaaaacttttcaatgcaattttataattttttttcataagaaccatggacaagtttgggcatggtggctcatgcctgtaatcccagcactctgggaggccgaggcaggcggatcacaaggtcaggagtttgagaccagcctggccaacatggtgaaaccccatctctactaaaattacaaaaattagtcaggtgtggtggcatgtgcccgtaatcccagttactcgggaggctgaggcaggagaattgcttgaactcaggagggtgtggttgcagtgagctgagactgggccactacactccagcctgagtgacagagcaagactccattaaaaacaaaaaacaaaaaacatggacgagtgttgttcagccctaggaagttatattttgctattatacttattatcatttttaatactttttctgtttgcagctggggtacagaaatgcaatgactttcttgaataagctttttattgaagtacaatagatcaaaaatgtgcacaagtcataagtgtacagttttttaaattttcaaacagcgtggtccatgtaaccagcacccagatcaagaatgaacacatctttgccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaagaacaaaaaaccaaacaccgcatattctcactcataggtgggaattgaacaatgagatcacatggacacaggagggggaatatcacactctggggactgttgtggggtggggggaggggggagggatagcattgggagatacacctaaggctagatgacgagttagtgggtgcagcacaccagcatggcacatgtatacatatgtaactaacctgcacagtgtgcacatgtaccctaaaacttaaagtataataaaaaaataaattaaaaaaaaaaagaatgaacacatcaccatgatatgagaaccatcttaaccagtgacttcccctcataaagataaccactatgttcatcccttttaccacatattagctgtccatcttttggacacttatggaatgacagagaatgtattcatttatgactagcttttcccccttgtttttgtgagatacatcatgttgaatatggctacagcttgttcattctctttgctgtataggtttatattacatgactagactataacttatgcacattaatgttggtagatttttaaacagtttacatttgggggatatggctagtatgaacattcatgggctcatctttttacatacttaggtgttcatgtctgctcatttgtacttagaagtagaattaatggttaagcatatacttagtttttgtagatcctgccatacgcttctggttttccaaagtggttgtaccaagattcacttgtagtagataagaattccaatacgaaatacagcctgtaatttgacattttaatatttcttattatagaaacattggcaaattctcatatgaattctaagattttatctacataataagctagcattctgagaatgaattcgccttagtcatcatgtttttctttgcataaacctggctcttgcaatttttttgctaataaattgctaactaactttggtttctgaatgtgcataagaaaataaagctataatttcctttctcatgctgtccttatctacttttggcacaaagtttatgtttactaagtataattaatcagagaaagtttcatttcttttttgtaagattttatgtaagattagaatttccttttcctcaaatgtttggtaaaacttgcctattaaatcatttgtacctgatgttttcattttggggagattgttgacagattataaagtaatcctttaaagattacaggactgctcagatttttttttcactaagttttaatatttttctacaattcactcatttcaggttaattctttagggtaattagcatagagattataatattatcttttacatcactgatgcatttataatcgtattttttcacatataatatggcttatttgtaccttctctctttttttcattttaccttggcagaggtttatcaattattttagcttttattatggaattaactttgactttgccaatctttctattgtacatatgcattccatttaattaatttctgtttctaccttaattatttcttcctttctgtgttctttgtttattctaactttgaagtgtgatgcatagtccattaattttcaactttacatctttgctaacataaacatttatggcttaaacttctccctaaatactgctttaactgcatttcacacattttgacatataatagtttcattatcattaagttctacatattttccaattttcactgtgatttctcctttgactccagagtaatttaggagagatttaagtccacacacagattttaaaataaagttactttttattgattttatgttaattataaacaaggaatgtagtctgtgtgataacagattgagttgaggattcattcctaacaaatggtcaatttttatgaattctcatgtatgcttggaatgaatatgtggtttctagtcattgaacactttgaaattgttcaaatcgtcatcctgatagtatatattctcctgattaaaatgttacttactgagagagaatatattaatattgcttataattataatgtatttgtcacattctccttgatgttctaacatttgctttgaatttttaaaggcatgttaatactgtcatactcagtttagaggtggttatatcttcaggatgaatttgacttttgtcggtatattaatggttatatttatctctggtaatgcaaactgtcattttaatagtgtttcctagtgtcccttttcctctaatttatctgtaacctttccatgattttatgttttaagttgtgactcctataaacagcataaaactggatttttttttaaatctaggagacaactttggtctcttctcagataattttgtatctttgttttagatatatttctaccaccctgttttgtgttttctattagattgctgtcaagattttactgtctggatttctttcatggtcacagttaacagaatttaggtattcctttttgtgttagtgatagtattttatttttcttgaaagttatccatttcacataaatttttaaatgcattagaatatggtaatcaatagtattctcctattttaaattgtgccatatctgtagactaactataattccccttaattctttgtgtgtgcgcacgtgcgtgagtatgtgtattgtctttcttccttttggctttgttgatcttctgggattttttctgttccattaatttttgttcttatgttaataatttccattattttactgtctttgaatctataaaatagtttctttttctggtttattagcttgaaaaactagcttaataattttcagccttttaaaaaataaggattaaagaaaataaatcttgctttcactataccctgtgttttaatgtacagtattttatttattttccctgaaattttattttgaggtaactgtagatgtacatgctgttgtgagaaataatatataaagctctcatgtaccctttatccagtttcccccattttaacatcttccaaaactatggtgcaatgtcctgatcgagttcttcatgtttatacagtcaagacacagaacatctccagcaccagaaggctccctcatgctgcccttcatagccacattcacttctttttgttccgcaactccttcttaacattggcagccactaatctgttctccagtttttttaaattattgtttcaagaatgttatataaatagaatcatacagcatgaaaccttttgggattagagttttccacttagcctaattctctgaagattcacccaggtttttgtatgtattcctttgtattgctgagtagtaatcaatggtgtgcaggtaccaatttgtttaactattcacccaagggacatctgtcttgtttctagttttgaggttgttacgtatgaaggtgcaatgaacactcacatgcaagcttctgcataaacactgcttacacaaaatatatagtagctttatttagagtaggcaagtagattttaatttattatgatgtctttgttgacccaggagtggttgtttggaattaaaaaattactaatctacatttaatagggctatatttttgttgttgacttatttcttctgtctttccagatagacagacagatatagatattgatgtgtgtttgtgtgtattcatgttttgaattaattgagtccttatttgatcaattttatgcatccatgtgtacttgggaagaatatgtattctgacgtccaaacatagaattctttaattttttaaagattttattaattttgttaaatcttttaactcctcattgtggtttatatgcttggtttacaaattactgagatgtgtaaaatctcccactatgatgtgtcatttgaaaatttttcctcctagtataatcaagttttatttcatatgttttaacctgctttatttggtacatacaaatttagaattattgtacctgactagtgaatttatcctttcatcacatagcttcattttttcataataattttttttgccttaagctctgttttgtctgatattattataactacaccaactctctttttgttagttttgcccagagtatcttattctattcaaaaatattgtatgaaacttctcaacttttttacttcctgtctttttgaatacttatattggcgatgtgtctcttaaggaacatgcagcttaaaaaatgaaataaaactttctattgtaaaatatagtataactatagaaaacagaataggacaaatatagagcttaatgaatatttatgaagcaaatagtctcgacatcagcactcaagtcaacaaatacaatttgctggccatcatggaatccccgtcccagtaacatacccttttcggcccctcaaagtaaccagtatcatgacttttataataacccctttcttcttttatttatagttttgtcttccaaatacacatccccaggcaccacggcttagatttttctgttttggttgtatatttttaaagacaatgccttcagtctcttctagtctatcagtcctgtctccagcctactactctccaattttcccagtgcaatttatttgttaaaatacagggtcattgcatctacatgcttactctaacttcatcttgtattttctctgccccagctctgagatgaactatttatctaaggatgcctagttccttttatgggagatggtatttagaaaccaagatctgcatgctagttgtgttcattgttactaggatatcattctttccagggcttgtcagcagacagagcttggaaagacatatatatatatatatatatgtatgtatgggtgtgtgtgtagatagatagatagatagatagatagatagatagatagatagatagtaactcatgcctaaacacaaacccatatctatttatctatctacctatcatctatctatccgtccacccaccaacctacatacatatgtgactatctgtctgtctgtctatctatctatcatctacctatctaatccatccatccatccatccacccacccacctacctatatacatacatacatatctctctctatgtgtatctacctatctaacctacctagtgacctacctacctacctacctactcacctgtctatccattctgatatttctgattccagttcaacaaatttcattcatgctttaccaagattttggccatttcatatgagttcaagataaaataccccttaagctcatataaaaacttacgatttaaatttaggactacaagttctcctatcttacaaatgtattgcctttcttcttcaccaagaatcctggttctcacggagataagggtaaaatagaaattagaatgtcatgctttctatgttgtacacctaacagtctcagaatgacagaagtaatttcaatactacgtccatttatttgattattaaaacaataaattgatttatagatccttttccaatattcctgcatctttaataggtgtgctgaatttatgttgtcagagcatatagccattcaatactgtacttttttccatagaatatttatttaatgttcaccagtagcctttatgctgatatctctctaatcatgttggttgactgaaactcattgagtagattattcaggaagaacccattagaacaatattatctgatttcctgcatgttgatagcaatttgcagtttttaatgcttgaaagtcagtcttgctgtatataaagtgcttggtttacatttttttacttgagtataataaatatatcactttattttattctggcacaaagcattgctgccaaaagactgataacattctggttttctttcctttttgtatgacttagtcgtttttcctggaagcatgaaagaattattttcttttgaggtccaaaaattttactaaaacatggctcagtgttggcaatccaggttggtgttctcaagtaggtatgaccgccctttcaataagtaattattgaagttatttcagaaaaagaaatagtacaacaagaactttttcttaaattttactttttgatatttgtgcctttgctttgggtttcttctttgggaattccagtataatgattttcttagcctgtcttgtaactttttccttttctcttggatctagttgcctcttgcttttgtaaaagtttccttctttaacttagttttctccaggcactagtggttgtgtgaatttattcgtgtgtgacttctaccttagtctccatttcttagatatattttcttaaatttataatttatttcctgagtcctatgactacattctgagttttctaattctgatttttgttgttgtgtctcatatcattttcttaatgtctttaacgctttctgaaatagttctcatctgactcgtaggcacatttatttggcaaactttgattttctggaggggtgttattctcctttttctttgagatggagtctcactcactctattgctcaggctggagagcagtggtgcgagttcagcttactgcaacctccgcctcccaggttcaagcaattctcctgcctcagcctcctgagtagctgggactataggtgtgtgccaccacacccagctaagtttttctactttttgtagagatggggtttcaccatgttggtcagtctggtctcaaaccctgacctcaaattatctgcccaccttggcctcccgaagtgctggtattacaggtatgagccaccatgcccggctttctttttcttgacactaactttgcatgtgtttttatttcgattatcttctgtcttcccatttatatgaaattggtttccctgagcatttagaagagaatatagtccaaaatttcatttctaaactcacagagctctcttttctcctgtatatggtatgcacgaatatggtggctcattttctgatactcgcagatcttcaatttcttgtcactgttgtctctgtgctactcaatttagatccttaatttcattgtttattcctggaagggaattttgactggttccttctgagagtccacagggcctagactactccagacacataaggtcttactgttgaccccttgtttttatcctctactgaaaattgcaagatccttcacagttttagctacaattctcaaatttgatgtttgagctttccaggaagtacctgttagttatgtgtgactctgaagcccatacgatgccttattactttcctctccttctccctgagtagtcctgacaccatgcagatcttgtagctgtcagtctcataataatttgatcgtctttccttgacaagtgatttagttttgccttgaatgaacacagaattcatttttcttttaaagtccagaaattttatttgaatgtctcattgttggacaacctgattgtcaatagtttgaccctctctactcattatttgtaatttatagggataacttgcctcctaggtgttttgtaaatattgttcatggggttttgttttgctgtttcagtttgtttgtgtgagggaatttggaaaatttaaaaactaagtcaccagtgtcattttccagccaattgcattttcttttctttcaacaacttaatctgacaatgtctcctttgattggtaagtttagtacaatgacgtagacatatattgtagttattgataagtttgatattagtttttcaacttattctatatttttacttcatgtttaaatttctaaacattttttaccctctctttaattccattttttccctctcctgtttcagaaattaatatatatatatctgcatcttttagttaaaattgtagccaggcacagtgacatgtgcctacagttctagctattcaggaggttgaggcaggaggatcacttgagctcaggagttgaaggctgtagtgtgctatgttcacacctgtgaatagtcactgcattctaacctgggcaaaatagggagaccctatctctaaaaaaaaaattgcacacatctcagttgaagtctaagtagtatcaatacatcacttccacagcaatccaaagatcttggaatacattaaatagaaactccctctcagtttacatgttatggttgaccaatagtttagttgtatcatgttttctacacacacatataccaacttgaactttactattttttatatagtcagtgtttatttagatttcccattctgcttaccaatttccttgctcaccactgatttttgcatagtaggcttttcttcctttctggggaaagagattgattttccctttcctcagctaaaatgctttgactttcctatgagattttattggcaatttactcttaggttttgtttattacaatacctttctcttacccatactatcaaccatgtatgcaatttaaggtttgtttctttccttctctcttcattttgcggatttttcgctgttttctggctttcattgctgctgttgagaaacctgctttgagttagtcattccatggcaagtgatctgtatacattttcagcctctttgaagacctttctgttgctatgaaatttcctgtaataaatctaagtgtcttttgattctttcttatttatcccgcttaggataaactggctttttgaaactgagaattggtgtctgtcatcagttctagaaagtacttggtcatctcactttgaatattgtcccttccttcagtttctacttacagaatacatatgtgagactctcatcccactaacatgtttctttattcccttcatgttttccttttttttctctctctctcttcttggctacaatgagggtattaagttctagcctccaaccaattcattaattctcttctcctgtatgtctcatttccttcataatatgtctgctgagtttgtcatttcctatctaaattatatttgattcttttaaaaatatgcctcctcaacatttggtgttctcaatccattatcccattattcatgcattttgagacagggttttgctctgttccctggagtgcagtggtaagattactgatcaccgcagcctgtacctcccgggcccaagctattcttccacctcagcctcccgctgggactatatgagcacaccaccacagctggctaattttttaatttttatttttgtagagaggaggtctccctatgttgcccaggctggtctccagcctgaattcaagtgatcttcctgcctcagcctcccgaagtgctaggattacaggtgtaagtcattgttcccggctcatcttttatttctgtaaatgttttaaatattttttccatatttggtcattcactgagggtatatgatttcaagtacataagctttattcagggtggagcctttgttctaactccccttaataaaactgaaactcaaggttctttttattgagaaattttcctagggcaggcagtgctgtatattcacttacaactctattctcagctctcttttcacttttgtcccctggatatttcccttaatttcacaagcatagtcattcacttaaaaacacacactcgtcctctcccaacatatacgtaattgttacagaaggatttttttaggatacacggttttcaatattggccatagtgaaagtaagttgggtaatttccacatttccatttccctaattatctcttcaaatttctctgattacctcttcgagtctctataatatgaagagttgtgatttttatgaatgtagaagctacagcaaaaagactaggcagagaacacggaatctatctgttgttggctagagtttatcttctaataatttaacaataaacattaatggggaccatattcctgaaattgtgtgtttatattgtccatctcctgtacttatatgtgaatggcaattttgctggttgcagattttcagggtcaaactttatttctctgaaatatttacagatattattctactgtcatttagcatttaatgttactatggagagtgtttttttttttaattttgtaggccattgatatgtttgcttgtacaccaaataattctttgtttagatttaaagtccattaattttacttgatatatccttgttttgaatattctaaagagtgtttccccagaacacaatgtgatatttccttctttaggtttaagactctcttaatttctgcagcaaattcttgtgttctatctggattttttctcttatcattcttcagtgttttctttggggccaccacatatgtgtatgttagactcctttgtcttccatgtttatcattttctctctaatgctttctaacgttttactgatttccatttccttttcctcattgttgttcatgcctttaatgttttcagaagtgctcattcttctttgtgatgcttccaatatggcccctttgtttctgtgatgactttattttgctattctacttcactcctaatggaagcaagatcatactttatcctctgcttgatacttctctgtgacatatttttggtagaaaagataattgcttaattttcttttaaaattagtagtgataaatttggtcccagtttttatctgtgacaacactttctggcaagtgttctttttttaacttgtctttttcctatgcttttccatgattgtattataagtttttgtgtagaatctgttctggtatctctaaaataactgttattaccaatctctgattgagttgagtcctacttgaatcagctatttgtagaaggttttatttgacgtggagcagggccaagttctaagatagcagaaattctctccagtttatagtaacattccttatggtacatagcattggttgtgtacattgcttattttagccagcaaagattaatgtcataggattaagtctcttctactctaccgttctaagagactgacttcttggttcttttttctttttttttttttttttttttttttgagatggagtctcgctctgccgcccaggctggagtgcagtggcacgatctcagctcactgcaagctcctcctcccgggttcacgccattctcctgcctcagcctcccaagtgactgggactacaggcgcctgccactatgtccagctaattttttgtatttttagtagagacggggtttcaccgtgttagccaggatggtctctatctcctgacctcgtgatccgcctgcctcggcctcccaaagtgctgggattacaggtgtgagccaccgtgcccggccgacttcttggttctttattcagtgtttccttccttgattctccatggtgccaaactgtacccaggaattgtcccatcctatgtgctttatccctgaaattgacatcgaagggattattggcttatggtacactgtcagtcttgcagatatgctgactttgtttaaggtctgcagccacagatgtcatctctcagcatctgaccacacccttaatgtacacactgcaacctgccacctttcctcatcattattttccaacataatatattcttcctagttttaccacagcacttgcatttccttttctgatttttcttcttatggagaaggggaaaaaaagcagaaggagcagaagggtctttgctatctcaaaatcagaagtctgttcctcacctttcttaacaacctttgatatggaaaaatgttggaggcttttcacaagcctaagtagattgtaggctgtccctgaaaatgtcatttgtaattaggttgtctggaatttggaatgaattttcttataggaaccaagttgtaagtggtatttggcaaccaagaccagctttccaataggcagtttagctggatgcattgtgttaatagcattattctggctccatagaactaccatttattaagttatttctaaggaaaaaataaattccaagttctagttagtagaatatagaatcttttaaaatgcaaaactatgccactctcttgtttaaaatccttcaacagttttccactgttcataggccaaggatgaaatcctcagcatggcctcataggcccatgatctggctcctgtcggcccttctaaatttgaaccattttccaaactggccttcttattgttcctggaacatgttatgcttcttccagctctcgggtgtttgcatatttagttccttctgcctagaagatctttctctcacattttgccttttcatgcttacccacccttcagaactcagctcaaatttcatttatttgggtagctttcacaggccgaacagccctgccatataccatctaatagcaccagatttccctgtctttatgtccactttatgtctttatgtcccaatactgctcacagtgtctggcgtatactagatgttcaataagtatgtgtggttagatgaatggataaatgaatatccattcattatccattcatctaataaatggataatgaatggataaatgaatagttcaatatttcatgttaaagacaaagctcttaatttcaaacctacttttctgaagttaaggaaatgtttgtcccccttccactcctgatgccctgcctggaatatcttgggtctgggtctctgatgaatcatgtgtatgttacatacaattccaagtgtcagcctcaggataaccaatgctataagtagtccttacgacaattaagggcaaactctgaaaaaagttactaaaaacggttcattatctgaatcctcacagtgttacagcttaaatccctgaaatataaatactaagacataaaatcaattgcattttatgcttgcttaatcttagatatctctatctcaaaacattccaggactgtggccatatatcctggatttttccgggatagtttcatttttaaaatagattaagcctttgctgctagaaagtgcatctcacctgtcagactttgtgtcctgactttttgttcatacaactcgctctctatgaccgtgtcaactatcagtttgtcacaagtatctttttgaaccattgtatgcttcctgcgagaactagctcttgtgaaaagttggagaattttaaaacctcaatatgaaacagaaacgaccttttaaattttaaattaacgtgctcaagtttcactacataaccctgattcagcttcctcacctataagatgtcacgcatggtgcataggacttcgaagatcctcaaaaatggtgtagggaatataatttctgagttcaaaaagatgttagtttaaaaatccgcttggtaaaggtaataaaaggtatctgaggtttaaaagtcccagtgaatagtacggggaagggcaccgtgagaccacgactgtctaatgagccgggtttgacacatgtgaaacaaggatgaccttgttggatcatcagatatggatggaagaatgggagaaggaggagccaactgctgataacaggtatcatcaagtctgaaaacactctctaggcgccttgcacaaagtcaattttattttatttttttggagatggagtctcactctgctgccccggctggagtacactggcatgatctcagctcacggcaacttccacctcccaggttcaagcgattctcctgccccagcctcccgagtagctgagactacaagcatgtgccaccatgcccggctaatttttcgtatttttagtagagatgaggtttttccagttggccaggctggtctcgaacttctgaccttaggtgatccactgtcctcagtctcccaaagtgctgggattacaggggtgagccactacgcctggcctcaaagtaaattttaaaatatcaaaagacctaactcttattcctgtgcaacttgttagaggaaaaaaaaaaaaaaaaaagaaaaaaaagacttgatggttttgtcctttgggcatacaactgcctttttattgaaacattactacctgagccaatggaaattgatttatttaactcatcgccttctcccaccatctccctgctttcttgtctcgccgtttctttacctgaaagagcacagcaaggctttttgttacattgggttgtgttgatcctggatgagtttataagactgtggacttgctccttgcttctagctattagttgatttcatctatcttgagaaaagagaaggcttgtacataggccgatgaggtagtttccacagattcactgagaaattagaagtggttcactgtagcaagccctgaggcatatctctgaaaggagcccagcctttaaagatcaccttctttcacagaaagtgggtccaaccaagcactcctaccaaccctctctaagtcacccagcgattcattgctcagtcactgcatgcccgctgcatgccaggcaccatgcaatgtggctcctatccataaggagtgtggatcctggtggcagagacagacacagataatcacaacataatgtgttaagtgttgggggaggtataaactgctgcgtgagcattgaatctaaaacagttagcttagcctgaagacaccgtggaaggctttgaagaggaagtggcttttgggatcaggcttatgggaagaagagttaatcagatccatgtgggaaaaggaaattcaacctctgagtaccacgttttcttgttctcttctttatgtttttgaacttgcatgtgcttctcctgtggaccaaggcttctttctgatccggtggtttgtcccaccatcatcaccccaggctgtcacttgaggaaaaaggtaaagggaatagagcggggagattcaggcatccagctttgcagtacttgtgcatccaggagccctacttctgacttggtggggtgggatagtggccaagtatttgctttttcaactagaacctgggataaattggatgtcagtggtttccggagaaacatggcccagcaccttccctgtgacacagtgcccagcacagtgttccacaccttgaacccaatacaaaacacaggaaatgcttaacagagaagcaaacgacatcatccttagaactaaaatttccaaatgtaactcctactgccacctgttggtggtatggagatgtgacccacctgcggtttggaagctatctttctttgtaatcctgtcaagttggcaacttaaaacctgaaatttccggagttaatatatactgaagtgccaatggtggttttcttcaggggtactcttttttattatgggctgtgaagttctgaaatgttttgcaatgagttactattttgcaatgagtctatctccttttctattcagaagaacagagtaaagataagagaaaattaaaaatttacctatggggtagacaaagagcaatctacttagttaaaaggggttatgaacaggcaaaagggcatcaccagaaattgagaaagaaaggaggtttctataaattgattaccttcttattaattatcatttttacttggggatggcagatatgcccgactcactggtgctggttaggcgaggccttaatcaaatcgtcaacagccattctcaggcactcatttagcaaattcatactgaatgcctcctggctgccaggcgcccttggctgcagcctccaacagtttcattttggggtatagccaaccttgagaacaagtggctgtcagtggaattcagactatggataaatgctgaagaataacgccacgtgcaagcaaccaagtacaggagcaaggactcccagtgctccgggaagtacctgtccctctaaagagacagtcactactttggatagatgttggctgtcctccacaggcttacagatgcagcttcacagcacatgagagatagaggaaaccgcagacctcagcagggaggccagccctctcattttactgcaagggaaacatatacagaaaagggaagggactcagccaagcatgttttatttgagaagccgtgctattgtctgtctgctggagctgggaagatgagcgtgccctcatgggagcctggtgggatagacagatgcttaaactaacaatgtcactgtagtgtagtcagtggccgtaacttgggctggggataggcaaggctatggggacgagaggaggcagtgctgtgggaccctttgtctctctcgtgcttggggatgaagaacaacagagctttctggatacagacccttggaagaagtgtgtggcttagggcacaaggtcagctgccatgggtccatgggttcaagtcccaagttcattaggttctttgagcctcagcttccatctctgaagtccccaccccatagggctgtttgtgaggctgatataaggaatgcacaagtgcttagcacaaagtgggatgtcagtgcatggcatgattctagaagtcctccagcaatccattcacatccttctataaaagggctatatccagctatggccagttccatctttttttgagacagggtctcaaatccattacccaggctggagtgcagtggcatgatcatagttcactgcagtcttgacctcctgggctcaagcaatcctcctgcctaagcctcccaagtagctggggccacaggtgtgcaccaccatgacttgttaacttttaaagaaaatgttttggtaaagatagtgtcttgctgtgttgcccaggttagtctcaaattcctggtcttgtgtagtacttccaccttggcagttccaccttaaataactaaagaggccctgaggaagtgcatttgcttctttgtgtcacaaccatatccttagacctgaaaccattcccccaacatctctcccacgaccctgggaggtgcttaggcttgaccagtcatgggctccaggtataaacccagtcctttcaatacagacattttcttcccaaagcagacctacagctcacgagggagaggcccacagtctacacccccaataaagatgccccactgagccccagagctagttatgcaagtcgtttagcagagcctctcaaatccccactcttaatgcagggagagttatgggagccccagcagcgccttttaatgcaactggattaattgcctgctcggaaaacagctcgattctaaatgatcctaaatggcctctaatacctgtaatcttccctccgccaggttgccctgctgcattactaaagcgggactggttctggaagcccatttgcttagtaaacagcgggcagcattgcaggaggccaaaggctgagaaattgatgaaatcgctactggcctattcaccagcctaatttgattctagaaaatcaagcagaggcatttggactggactgttccacaagctcagtgttcctttgcaggactgggtaatcaaatgcgggtgtgccgccgggtctcaactctggtccttcccagcccggcagtgagccgtctctctcaggaatcttgatcttctttctgaagaccacagatggagctgacaaggaaccatgatgtctttcagtcaatcaattacctggaaaccaggagtaggtgggggatggcacacaatgggcagtgtgttctcgctttgggtttgcacttatctggtaaacaggtgagcaccacaattaagagaaaaaactcaagttggtgttttagctctgccattactagctatgtaactttgggcaagtaacctctaggtgcctcagtttcctcatctctaaaatagggatgattacaatagtacctacctcaaagggtgacagtgagaattaaatgccttaataaatacaagatgccttgaggtctggctaacagtcaattctataaacgcatttgctgtcatcgcagcttcactgcttccatatgggcaggcacatgccctccctcagcctcagtccctacttctgtaaattgggtcaatggttgttgtgcaagggaatgggggtgaagggtgcataaagtgtggcattgaggtgtccagtaagcaggcttcctctcctgccattctcatacacgctaccactctggaatgcttcttctctgcagctgccctctctctgtccagatggacagtttccatagagatccatgtgaacactgaaggaagacaggtcacctggccagggaggcaggtcgggagaaggtgagccagacccacttggaaaacaaaagatgagcagacaggtgtctgcattttcttcctgtagaccagtgagggtgagggaaagaaatcagacaggctgtgttcacttgaaatatccggcatttgagcctgacattgccttcattgggagctttcaccaaaccagtgtccaacagtgagaacgcttttgaatccttggcaaacagataccagcagacagtgtgtgtggatttccacaaggacagcatcttgcatgacaaagacatcaagatacaaaactaggctgggcatggtggctcatgcctgtaatcccagcactttgggaggccgaggcgggtggatcatgaggtcaagagatcgagatcatcctggctaacatggtgaaaccccgtctctactaaaaataccaaaaaaatttagccgggcatggtggcgagcgcctgtagtcccagctactcaggaggctgaggcaggagaatggtgtgaacccgggaggcagagcttgcagtgagccgagatcacgccactgcactccagcctgggcgacagagcgagactccatctcaaaaaagaaaaaaagatacaaaactagagtgctacagaccgcagccaaacaacactggccatatcttaatcaacattatcatgagtgactctggtgccaaaagccatgtttgtcctcactctgcagtctggatgcctatttatctactgactggctgccacttgatcactctgctcgattgctccctctgtaaaatggggccaactatcaacctacaacataaggtgactgtgggaataaaagcagcatatcaacaatggtacgtatttgttgagctctcagaatgcacccagtgctgcgctaaatgtttaatgtatgaattctaacccactgactcttcccactcgccacggaaagtgagccctgctgttaatccctattatgcggataagaaacagagggaaaaggaggttaatgaacctgcctgaagtcatatatagctagtaaataaggcgctgttaccaaagtccctggcacaaaataagtactcaacaaaaatatgcagacacacaaaaaaaatgagatcatgtcctttgcagcaacatgaatagagctggaggccattatcctaagtgaaccaacacaggatagaaaactgaataatgcatgttatcaactataagtggagctaaatgatgagtacatagggacacaaagaaaggaacagcagacactggggagtacttgagggtagagggagggaggagggtgaggatcaaagactatcttatagggtcctacgcttattacctgggtggtaaaataatctgtacaccaaccctgtaatatgcagtttacctatatagcacaccttcccatctaccccagagcctataaaataaaagttaaaatacatatgatgtaagttggtagagccacttaggagaaaaatttggcaagacctatatctaaagcattacttctagacagctagctatccaagaacatttttgcaatggctaaatagagctattgtgggggctaccatcagtgctaacttttggggaataaaagggcctcatggcctcagggaggcaccagattagttaagagtgaatggttgatgggaccaagtaatgcctgagaatggccctgcagtgatagggccctgtataaagaggttgagtgcacttatctggggtccctgtggcagggcaaagtttgaagcgggcttggttcaggcagggtttggagttgcagatccatagcctattccatggccattggggtggccagatcaggggcaacacaaagattgcaggtactgccagaagtcactttctcatcctgagttcagtgacctcatctataaactgcatatacagataactaccctgtctattaataggaagcttatgaggactcaataagatcggctagtctggttattcctcaccatccctcagggaagaaagaataatctcctgcactaggtttaaagcagaaacgaatgctgcaccaagcagaagcctcagagctctgccagggacagaaacttgagtgtccctgccccggcagagctctgttttaaccatttcataagcaacagcttcccatgtgccaggaagactttattttttcaattcaaaagagcacctaacatttctcgaaagctgcctatgccctatacattatctcctttaatccttacagtaacaccatgagagaaatttccttctgattttatagaagtcataactgatattcccaagaaattaaatgatgtacccattggcagatggctgacaatttggaaactctacatttgcacctaagactatctaccaccaattttcttattaatgatttttattctacctgcagtccctaatacttctttactctaccgtagcacatttgtcaggagatacctgcattcctgtgtgtgaacattttaccattattcactttatgggctatgggaatgtcatgactgttctgggccactgattacacatctctaaaatgaagacagtaacagtttactcattggattgtctcaagattaaataaggacatacataaagtgtttatcagaacacatgagaagatgttcaacttctgtattaattaggaagatgagatgccatttttggctcattagactggcagaaatgaaaactttttttgtaatattaagtgtcaaaaaagatagaggaaatagacactcttctatcactggcagaaaccagagatttaagttggtagagccactgaggagatcaatttggcaagacctatatctaaagcactacttctagatagacagctatcaagagcatttttttgcaattgctaaatattataaccaacctaaatgtctattgatgaactaatgactgaataaccatgatatatctcttgtgtgaaagataatatcatgtaataaaaagaattgggtaaatatgtagtaactaagttgaaaatttctctaagaagtagagacaagtggaaaaaaaaaaccctaagttttagaatattatcaaatgtcacttaggtcaaagaaaaaactcgaaaatgacaataggttttacagatatatatacgtgttggaagtgcattggatgaagcctgcaaatatatacattacactgttaagagcagtattctggaatggtggagaacagccacgagtttaaatggacatagtattacctgatgttataaattttacaaagtgaatatattcatatatgatttgtacacttataaaggtaaaataataacaataaatgcagttataatctgtcaggtgttgactctgaatcttcattttctttcaaataaaattattcatttagaaaacaaacttattgtgtgtctactctgatttactttcatatgacatctttcaacagaattttttcactgaaagggaaattatgtttttattttgctgatgatgaaagtgaggtttggcttaagtgacttgctcagttagtaaggcacagagccaggattgaaaaccagctgtttgcctccaagttcagttctctttcaattaatccagcaagtctttactgagcactgtgtatgtcccaagctccatactaggtattggggatgcaacaggagacaggatagacgtgctccctgttttcatggcatcacggtccagcgagaaaagcagacagagcaacatgtacttacaatgcagtgtgcagtgcttagatttcacgggtaatggcttattcttcactgacgtctgaaacaaagtatggacgcacaactaaacaactagtttaggtctgattcatcagcataaggtataccaccaatgtatcctgctgctccaaatatgttgattctctaatagatctctgaatcaatagtaataatgaagatagttattgagtattaactatgtgtcagatatcattccaacatttaaatataacagatgacacatttaattctcataatatccctattaagtaagttctattacaatctttatcttacagatgtggaaaggtgaggcacagagattataaaaaagaaaaaaaaaacaaaacaaatacacatctgcttaaggctatgcagctagtaaatgctagaaccaggattcaactcagggctgtctaccttgcaaccctactctacactgccttcccaacaaaaggttccaagctgctcagcaggacacccctctcaaggttccttttccaagtcttctctgaaatccgaacatactaatagagtatcagatgtcatccttgtacaagaatcaggagtaggtaaagagagagagaacaggtggggtctttgggctaaatctcatgtcccctgttggaagaaattaataggtcctagaaagagggaacttatttttcagtaaacacaagcatgtaaaagcatcttgacctcagccccctaatcagaggagcatcttgctaattgccactaatgtgattagcagaattaattggccgctcagaaatattacacatcaagtcacatggcgattaatctataccaaaattgggaacatcattgctcagtacagagacagtgagacaactgacctccaaagggaatcctgatgctctcatacattcctcttatgcatcgtgagtatgttgtgcattagacaaaggcagggagatctttctaaccactcacggaggctgcttcactaatagtaatctgccacttccagtccagctagaacttcttcctgcccactctccacattggacacattcatactcccactcatttctccatgttgtttgtgcactgtaatgtatcctcctgaatctttgttgcattttggcaaactcctattcattttccaacaagaggttcaaatgtcaccaatccatgcaactatcactaattctccccctcaggtatttcacattgatttatgtacaaactcctatttcactagcactgttggaccaccgtgtgtacacctaccagtctcttccattggcaatgggacctcagagtcagggatcatgttgttcttaatactggatcttcagagcctaagtacagatcttggtattcagtaagactcagtagttgctgaatagttgactctgtatctccagactaggcgtggggctgagtacacactaactgtggttcctaggcttgagggtatagacttaggaaatatgcagattgaatcaccagggaattatgtgaaaataaccctgttgctcctaccatgtgtttctgatcttggtgaattacaaaagtggaggatcaccatcactttttttttttttttttgtggtaatcgcagggttgggcctggttagtacttgaatgggaaaccatcactttcttgatctctcattgcttaaataaatgatcaatttatcaatgtccttaattgtgatctaatctgccctctccccactagacttgtcttagtctaggtttcacatttctcatcagacacagatacctggagaaagcatcaaacatgaaagatagagatcaaaacaaacaagcagaacaaagcaatttggagggacttgttgacaactaaaaaaaaaacccacatgcatttaaaaaaaaaaacaaactattactaacatccccagagagataacagaccatattgcaaaactgtgaacaaaatattagaaaccaaggaacattcagaaaacaataaaaagctcttggaaattaaaaataggacactatatattagaagccaataaaagggttagaggatgaagctgaggaaatctcttgaaaggcagagcaaaacatccgaagatttggacaataacaaaagtgtgggtattacagaaccaatccaacagttccaacatccaaatactaaagttccagaaaaagaaagcagagaaaatgaagggagagaataaccaacaaaacaggtcaacaaaattccctagatgtgaagaatgagtatttccagagtgaaacagcccaccatgtgctcaaccaaataaatggataaaaattaatccacattaaggtagataatggagcaattttataatgatgagacactgatcatgtcatacaagtttggacagggaattgggaaaaattcatacttaggaatcagaatggctttagctttctcaaaagtcacactggatgctgggatgtaatagaacagcaccttcaaagtagtaaaggaaagttatttccagtcaaattcttccctgagtgtgagagtcaatgacggaaggtcttcacatgctgacctgctgtgaacactttcttaggaagctactaaagaaagtgcacctccaagacaaggcaggaaaaaaagaaaaaaaagaagtgaggatggagttattggcaataggagcaggaatacagcaggagtaaagcataatacccttcttgaaggtagagtgaaagtggaggaagatcccagaggacggcacagagagagcacaacaccagcacagagcaagccagcagctctgggagagctttctgtaggaggatgaaattgaaaaaataactgaagcatctgaatatcttgagtagagctttagataattggcaaagtgttggggctgaattagtaataaaaacataaaaatgaagcaaacaaaccataaacaagtcaaatattagcttcagggaaaacataatagttgtgcaggaagggaaaataatcataatttactgcatggttcagttttgaatagcatttacatagtcaaaatagtgtaaacattgaatgttgatctagccaaaattaggatataacttcatcgggaggatggggaaggtaggtggaagggatgcctgtatgagtgatgggtggggagtacagggaaagcaaaaccattaatagataatggtacagtggaaaagtcacaagtaccaataaaggtagctaattcagaaatatgttttgcataattataaccaggtgaaaagtgtttgcaactgggtgagagaagttggagtctacacttgctcctatcatatgccaaagaacaatttgatgatttaaactatgcgcacatagaacttggatagatttttaaaaatataaaaaaatatacaatgtgatgtcaacaccccataggttaattccaatttaatgtgatgccaataaaaacaccaacaagataattctaaattttatgtgaaaaatgaacaaccaacaatattagacaactgaaaatgatgagcattacatggggtgaaggtgggtgttgggggtagattagctatctatgatattcaagcatactttacatttcagtaaataaaactgtataattccagtatgctagtagacaaaggaatacagtcaaaacttagaagtagacaaaattacagcatggatttaggatataataaaggtggaatataaatcagtaggaaaagagatacactagtatctagtactagtgtactagtaaatagtaaataagtatttactagtaaatactaatactagtaaataagtatttactagtaaatactaatactagtaaataaagctgagtagccatataggaaaaaaaatgcagctggaactatagctcacacaaaggtaaactttagatggagcaaataatcaaaagtttaatggaaaagatgaacctataaaaataacaagagaggctactatttatttatacacttggagagaaggaagcccagtgtgatacaaaacccataaaaggaaagatggataacatatattgaattaaaattttaaaattttaaaaaattttaaatttaaaattaaaattttaaaaaaatctgtgtggctaaaattactgtaaaactaagtgatacggtttggctgtgtccccacccaaatctcctcttgaattatagctcccataatccccatgtgtcatgggacggacctgatgggaaaaaattgaatcatgggggtaggtttttcccatgctgttctcgtaattgtgaataagtctcacaagatctgatggttttataaaggggcagttcccctgcacatgctctcttgcctgccacaaggtaagttgtgtctttgctcttcctctgccatgattgtgaggtctcccaagccatgtggaactgtaagtaaattaagcctctttcctttataaattacccagtcttgggtaggtctttattagcagcataagaacagactaattaatatactatgtcaaaaactttaaactgaaaaaagcataactcatagttttcctaatatagaaagaagtactacaaatcagtcaataaaaaacaaaccttatttattaataagccaacagaaaaactggcacaggagatagtttccagggggaaaaaaaatacaaatgactcataaacatttgaaaagatggtcaaattccagacacataaaatgaaattttactgagatacaatttttcacattttagacaggacaagttaaaaatgtatactttgttgtgaggatgtagaggaaacaagcactgttatgtaattctgtaagagctgagacgtgacacaatctatgtagagaagataattgaacaaatctatggaaattacatctgcaattaccttaggacaaagaattctacttctaagaatttttcctactaatatactcacacatgcatgaaataatgtttataagaacaaatgactgcaaactacttatatatctattagcaggggactgttaaatccaccaagtttcattcatatcatgaaatcatagccattttaaaaagctctttatgtaatcaagtgacttccaagatatattgagcagtgactaaaagaaggtactgaacaagaggtctataaaagttatgtgtacactatagtctattaagtgttcaacagaattatgtctaaaatacatgaacattacttactgaaaaatactttgttgctgaaaaatgctaaggatcatctgagccttcagcaagttgtaatctttttgttggtggagggtcttgtctcgatgttgatggctgctgactgatcagcgtgctggttgctgaatgttggagtggctgtggcagtttttaaaaataaaacaacagtgaagtttgcagtatcaatggactcttcctttcacagaagattactctgcagcatgagatgctctttgattgacagccttttacccaaatgtagaacttctttcaaaattagaatcaatcctcttaaaccatgccactactttatcaagtaactttatataattttctaaatcctttgttgtcattttaccagtgtttacagcatcttcatcaataaaagattccatctcaagaaaccactttctttgcttgtccataagaagcaattcctcatttgttaaaattttatcatgagattgcatcaattcagctatatcttcaggcttcatatctaattctatttattttgctatttccaccacatgtggaacgacttcttccattgaagtcttgaacccctcgaagtcatctgtgagggttagaatcaacttctcccacactcctgttattattaatatcttgacattctcatgaatcatgaatgtccttaatggcatctagaatggcgaatcctttcctgaaggtttcccatttattttgcccatatccatcagaggaatcaatatctatggcagctgtagccttacaaaatgtatttcttaaacaagacccaaaagtcaaaatgacttcttgatccatggtctgtagaatggatattgtgttagcaggcatgaaaacaacgttaatctttttgtacatctccattagagctcttgaattaccatgtacattgtccatgggcagtaatatttagaaataaatcttttatttctgaggagttggtctcaatagtgggcttaaaatcttcagtaaaccctgctgtaaacaaatgtgctgtcatccaggctttgttgttccatttacagagcacaggcagggtagatttagcgtagtgtttaagagtcccaggatttttggaatggtaaataagcacagtcttcaactcaagagtcaccagttgcattaccccctcactagagagcaagtctgtccattgaggctttgaagccagacatttgtttctctctagctacgaaagtcctagatggcatcttcttccaacttaagacttttgtctacactaaaaatcatctgtttagtctagccaccttcatcaattatcttagctacacatgctgaataacttgctacagcttctgcataagcattggctgcttcaccttacacttctgttatgaagaaaacttatttccttaaacctgatgagccaagctctgctggctctaaaattttcttctgctacttcctcacctctctcagcctttatggaattgaagagagttaggaccttgctttggattaggctttggcttaagggaatgctgcggctggtttgatcttctgtctagaccactcaaactctctatgtatcagcaatatgactgtttcactcctgttgtctggagcatatcacagatatgtaagaaaacccactgtatgccagactttgggtagaggggacatttattgtctcagcacttgggagactttccactcctctctcaggagagagcacagagagtagcctggctgtttatgtgagaatgcaggcaccaaaagcctagtaagcaagtaagatcacatggtcttgcattcaagtcttgtgtaagctatacattcctgagcttttaagaataacagacatgggtcttctttttttatttaaaaacatttttattcttaagagagacaaggtctcattatgttgcccaggctggtctcgaacttctgagctctagtgatcctcctgcctcaacctgccaaagtgctaggctactggtgtgagccactgtgtctgacccagacatgggtcttctatggctgtacactccccagcttcgcctttagatccaaggcctgggcagaaaactagcagtgctgtgaaggaacatacggccagacaccaagccaagtgcctcagggctctgttttccttcctggcttgcccatgcacatttaacttctgccacttcagacctgcctggatcctcagaccaggccccgttaaggtcatacccttatctatccacctgtgctggcaaagtaaactctgctggacttttaccttggaattccgtagtaccggtcaagccacacaccttttcccatgcttcttatatgtgtgaaacaattctcagttacctggcaaacaggagtttttaatccaggggttcatcaaaccaccctagtaggattctgcaagtccagctagaagcagccagagccagctgacagcagtgtgtgcagccctccacacaaacggccatttgcctgccaccaaaagccactttttgcactcaatgcacacccactatggcgagattctttttttcccaggtaccattttgctcaacccacactttcaattccccagcctatcctgaggaaacaaacctaggctttactcccctacccagaaagagtcttctcttcctactcaaactgaaacacaatgatttatatccacatcacatgtttaataaaagagaaccaatcttgattgaaaatcttttgagaagtggtcagcactctcacaattggttgaaggcacttgggctgggtctggttaaatctctattctgggtttgaccctagggcaggtcacatggagctggcaatgaaagactcccataggctgttaggccatcttcactcacagaagttagcaacaaggtccacaagaatagcaacaagttaggagaaattaaatgcatctgtatgtttctaagtgtgtgtcttcatttcctgttttagatattgtttatatctcagatagacatttatatgtatatgtgtttttttctatattagtttaaatatctatatctataaatagttatacataatatttcttatatctctttcaatacatacaaatacatgtatacataggtaaacattcctggtgtatttgtgtgctcattatagtagcacttttaattttcttcaagaactttccatttgcactgataaaagaaaatcttcagccaaattaaatttaaaggtgtttaattgagcaatgaacgattcacaaatcgggcaaaccccagaattacagcagattcacagagactccagcgcagccacgtggtggaagaagatttatacacaaaaaaggggggaaataatgtacagaaattgaaggtgaggtacagaatggctggattggttacagcttggcgtatgcattatttgaacacagtttgaacactcagcagtgtatgattggttgaagtacggccactgggattggccaagacttagctattgttacagctgcatactactagttaggttttcaattctaacaaacaacagacaaaaaaagaaaaaaaaaacaagaaagaaagagaaagaaatacggagtccttctcaggccatatttaatttcctttaacagtgtttccaacttaactaactgctttgtgtaagaggtccagcttggtgcctgtctgtcttggctttcagcatgccttcctcactaagcttaatcacgtctagctttggatttaaagtgagagacctgtgactcttcctttcacttgaacacttagaagccatcgtagggtaattaattggcctaatttcaatatttttttgtttcggggaatatgggggcccaggagagggagaatgacaggagaatggatggtcagtggacagtcagaacacatacaacatttacccactatgtttgctcattgctagaaaggcaacgtttgtgcatccccaaacaattacaacatcaaagatcacttattacatatcactgtcatagatctaatagtaatgaaaacgtttgaaatattaagagaattactgaaacgtaacacagagacataaagttagcacatgctgttaaaaaaaatagtgccttatagacttgcttgattcagggttgccacaaaccttcaatttgtaaaaacatacaatatctataaagctcaataaagcaaagtacaataaaatgaggtatgcctgtgtacgcttttgtgtgttttgaattttgagcctcagaactctaacacttatttagaaaattacatgttacattagcaaaaatcttgtaaaaatgctacctaagaagctctacagtaagtgaaaagttcagaaaagtggaaacttgctaacatggacaccaagaaatactaaaattattttctatatccttgtaagttatctctttccttaattagtctgagtgacataaactttctatatgtatatgtgatagaaacactgtaaaatgaaaaaaaaatatattatttagagactttatagtcacagaagggaatagatgcattattttcaaatgaggaaatatttttattaatagaaaagcaagtcgagtcttagaataaaaatcacatcattaattgacagataaaagactgataaagttcaacctctacttttgattaaatctttcagcaaactaagaataaaagataacattcttaacttgttaaaggttatacctaaaacctatagtaaatagtatacatttttgagaaactgtagaaatattccctttaatattaaagaaaacacaaaggtccctatatcccaggttctgcttatcaaagaaagagaaaaggatcagaatgaggtgtaaatattagaaaggaagacatataattgtcattatttgcagataatacaatcatatatacagagaatgccacacagtcaacaaactattagaatcaataagttttactaggtagctagatataatatcaactccagaaaatcaatagcatttttctacaccatcaataagtaactaaaaaacacagttaaaaaagataccatatactatgataacaaaaactataatatgtttaagaatcaacaatcaagaactcctaagacctatatgaagacaactttttaaaaaatctgataaggtaatggacatgaaaaaactcaacaaatccaggcattctatgatcttggataggatacaatgatataacaaatgtgctatattattattaaattaatttacaaactcaatgcaatcttgtaaaaattctaattggactcctataagaactagataaacttagcttaaaatttataagaaagaataacaatccatgactagctaagatgaaggatggtgacttgcccaatccaatactgaaacagaacaaaaggcacagtaatagtggaattgaataatgagctctgagaaaggccaatgaaaatataaaaatatatcatgtaataaatgttaaattgcacatcaataaaaaagtgatggacagatttgtagatatgttggaaatactggatcaccctatggaaaaaaataaaacatgcaaagatagatttcaaatggatcaaataacaaaacataaaaactgaaactataaagttattaagagaaaatatagaagactatacttgtgacttaagggtggaggacttaagacttgaaagacacacatcataaatcaaagcactgaggaattttattatctaaaaattatggatgtatattcagtaaaataagcagaacacagattgggaaaagatacttgtgatgtcttaaatcgacaaccaaataatatccaggatataaatgcaactcgtgaaaatttaatagaaaacacaggaaccctttctccaagaaacgcgcaggtgttatgtgaacagtcaataaagaagagggaaggcaaaatattaaggagcattggactgatgctccaactcattagttatcagagaaatgaagatgaacacaatgtacagtcatttacactgaataggttggcagagaaataagaaagctaggtagtgctactccagggcagagctggggagctctagaaactcacctgcagctcgggagcatggactagtgcaggcattttgcaaaacaatctgttatacttagtccaactaatctaatgtaaacccagacattcaactccaatttatagtccagagaacttctcacagggccctctgggtgaaagtgtatcagaacatcataggcagtagcggtgatttggagacagtctgctcaccgattacggggtaatggataacaaaagtgtagactatgatgcaaagcttagaagtaatgtgtgaaatgtacatacagtaatctggatggaagttaaaaaaatagtactgattgaaaaaaaaagggtgaagtagaatgagtgataaatgatttatccgtgtacgtttaaaatactcagattaacaaagtaaatttttcctgaacacaaacaaagcagtgtaaattaaatgtattaagtgggcagtggggttggggagggacacgggagcagagaagaaggagataagagggttactcaataaaagaaacaagcaggagtgctttgtgtaccaatgtgattgaatgctataaactgtggcccatcattaactcaactacctgcactagagatcaacagaaaagtcaggttcatctcacctccatgaaataaatcttggagaactatccatgtgaagaggcacctgtttattcatctgcttagagccatgtgtaaacacatgcccctcagtggcaaaccctcgccacagctggtgaatgggaggggaaggttgtggtttatgtgatgcacagtctctagtagccagctgcgacaacactgccttatttcccattgatcagacacacctagggcatctcaacactactgtggaaaatcgtggtagtgggtcaagaaaatctccagggcagatatctactttgatttatttctatctcaaaaattaatggaataaatacttcaaaactttgccaaaagtgcttagacaaagaccagactgtttgtttcaaattgaaaatgggcatgaactgtgaatggctcgagattttgtaatttttaggaagactgtgggctaatttgcaattgaaaaatcacgagagccatttatagaatgaccactctgtattgaatagctatcgctttgtcttctgtacgccccttgcttttgtgaattgtcactctcctccatgttatcctgataggttgccaatcacctccccaactttcttgccataggggtacgtatgtgactttaggaaggacagtgagagcctgccattaaagactagaagtatctccagaccaccgttccaatttcttgaagggactcactagcaaatgaaaataacaaagagaaaagcagtgatgtgagtgggaagggaaaggggagagagggagagagggaggaaatgaagataggcataaggcaaatgccacccctgagcttttaaattatatgaaccatgaaattattctttggattagggtttttttttagttgagtttctatcagttgaatccaatagaatagatatcccacctcaaaacacacaaccagtgaatagcagacctagttgcattcttgatccaaagccaagttaccccctattaacccatggtatctcttgcctagacacaaattccgactggtacaaaggaaccactttggctcctggcacagacatttattgcattgcggggctaagctgcatcctttataggtagatctaagttttagaaattgctcaagattacacctgtggaaaaaaagagaaaacccagattacatctgtggaataaaactgaaagcccttccagaaaacactgaaaggaaataagcatgatgcactatgtatctatcatacacttggttttgaaagcatttctcagtgtgtctaagtctgatttgagccatggcctcctcattaccacaagtaaattgccaccaaaggaggcttctttgaaaagatacagggcacagaatgtggtcatcggaattggactcgattctccccttactgtgtgtataactgggtaatgtacttaacctctctatgcttcaggggcctggtgtataaattggggtaatgatagcttcttcatgcattgtttttcatagatgaaaggtaatcaaacacataaaacatctggaagaattcttgcacattgttgaccctcaacaaattatatatctctttatataaggggtatgttttatggatttatgcatattagacgttttaaggcattaatcctggtgtattgattaaaacatctgccttgttactctatcatcataccctgcaaagagctgggccactcccatttcatacacttccccgtgggctcattcttttagaaatagtcatcaggcacacacaaaaagcaatttaaatggttcatctttcctcttttcatccatagacaaatttcaataattatcttagtcaacccattaattagtctaaatttgcccaagcataattgatgctgcctacactattttctataaaaatttgaaatggatggctaaacagagattttttttgtttgtttgactaagtgcattttccctctatgcaaaatgtgttagtcaatgcttatctggtgtaataagcttagcttttagtgttcgtgtctacatctgtgatagaaagaagtttgaatctctaagttcaaattatgcattggcaatttctagcttgttgacttacggtctgccccttgaactctctgagaaaacctgtggccttacttgttgaatgggggtctggctgactagccctgccttctggaacccttcacctacctaggttttcccagataaacattggtatgactactatacccacatccttgagtactttgttttcctggaccttccccattccttgcttgtttgttttccctagggttccagtcattcttaatccctttctactatttagcaattcctggataatctgactgatctcaaactttcattaccacctatacatgaaggggatgcttctcttatgttaccatcagtctataacaccaactttgctgtgcatcattcttttctaacctctagagaattcttttcaacaggtgctgtgttcctcacagaaactattaagggaataaatatagggaaacctacaacagcataaaagcctcaaggtttgttgctggactcatgatgaagatgagaccagatgaaggaatacatgaaaggaataactttcaaaccagcttcctgagcaatttcagataccctgggaatcagatataggcaaacaatacctccttaacctgaattgggaagagagatggcagatgccactgaagacacatatgaagcacagagcaaaacatccagaagcaaacacaaacataaataaaaattcagaatctaaagatcgatcaatgcagcagaacaatgttacattattcaatagtcttgccataatgggttaagtgtgtgaaaaatatccaatcttatcccaaaataaatgctagatgaaataaagctctcagtgtagcacaaaagcaaacaaaaatgacaccacaatttagatgaatataaaattttttgcacgaaaatgtttttacaatacatcgaaaccaaaaccattaaaaataaatacatttaatcacataaaggatcatattttctcatgatcctaggccatcaacacattcaaaggcacatgtctaaattggaaaatatttgccatgcatagaaccaaccaagattaatgctgttaatacataaactgttcttacaaatcaatgagaaaactaatgagtatccccaaagaaaaatgtacaagggaagtaaattcgtagtttagaaaagaagaaatacaagtagccaggaagcatgaacaacagttccactttgggtatcaaagaaatgaaaattaaaacaataagatttttgatatatgatgtttttattcattaaaatgaaaaatagtctcaggtactggcaggcaagggcaataagaaccgccttgagtagcggtacagtcaattttagaggtcagcctggccctttttagtctatatctctattctacatctaaaatttcaaaatgtgaataagttttcacttggcaactctacttctaggaatttacctgaaagaatcatgtgaacttgcaatgacgcatgtacaacaatgctctctgaaatggtataataatggaaaattggaagtagcataaaattcaatgataggctagctcaaacaaaatctcttcccaaaagagttctttaaatttatttcttcttcctcactatgtgccattctgtgccaaacacacaccagtctttcttctccacacatttttcctttctttctcccacatatgcatttactttctctcagcccattttcactctctctcatttttaccttctatctcccccttccactcacatttactttccttcttactgaccatttttcttttctctaagccatttttgcttttcctctcatgcatgctgtcttcctttctcctttcccccaacactttttctttttctctgtcactgacttttaccttctctcttatatccatgtttacttcattctcacagttaatagttttacattctctctcttgcactttcattttctttcttacacatacttttacttgacctctctcccccacactttcactttctctcccacaccgtgacttttacacacacctttttatttttgttctcactcagttttcctctgtaacccagagaagagggtgaaatgtccagattagagtttatccagtcacggggcagccaggactgggttgagacctgaagcaggaggctgttgcagtattccaggatggagcttagttttttctaccaagcagcagtagcaggatggaggggaaaactgtggatgcagaagacatttctaaggtggagctgatgggtctgagcaaccgtttggtgaatgaatggtagcatctaagatgatgtcaaagtttctggcagggacagcagagtagaaaatgtcaccaaggccgcagaaagtggtaaaaggaaaaggcctgggtgttccttgatcctagagcacctatatctaaggcaatataatctttgcaggattttcagaccaaaaaaaacgttcttgggagaagagaaaagagtccgtaattgcctacagagagtccttgaattttgtttcttcaactgagcaattctccctcttgtatgccattcaggggcatccttaaaatatttttactccaatgtctataatactaatctgtatgtctttgtgtatccaaaaagcacttgtacccccaaacctactgaaattcttaaaaaaaaattctgtaaaacttaagcttcgtgcattaatggattttttaaaatagagctatcacaggataacaaattttgcccaccactagctaaatgctggctgcatcatctctttgcacaatgtcattgacacaattatatccccaaagggcttgcagactctgtgagggcagggaggctgtcctcactgctcagcacaggtcccaattgcctacaagagtaacagcctcttagtgggtactcaggaaatatgctgggatgaataaatatttaaaatctttctcatgttgtcagtcattattgttctgtaaaaactgaaaactgaagtgaaattatggaaccactcgcatttttgatgataagtgcaggcccataaacccgaggcaatgatggaaatcattaagcatcattggaagtggtacatttttagtttcaattggatgcttattggacttaagctggtcaaatttgtgctcaagtgtcaatgaaaagaacaaaattaaagatatattgaatgttggaaacagagctttgaagattttatgtaaaaggtgaggcaagttggggagttattattttttagatttcttgaagcaaacctcctcactccctaccacaaaaagaaaagctaagtcaaccgttccaacacagacatttgacttttatgcaatttttcaggaaagtattgtgttatggagtaggagctgcctgtcccaattgcttatcctagtatttcatctacagagacaggtgaattcttgtcagcagatcagattgtgggaggtgacagacagtccagctctccaatgtgaccttcagaataattcagagcattgctgctacactcctggggacagatggaaatctaatgggtacagaatgctctgggcctggaaggaaggatttaatgctcagagaggcacttggtacatcatccattgtttatcttcatgtaaaagattgtttaattaatcaactcaaagtattcatgctactttcccagggtctgaggatacagtcatagaaatactgataaaaatccctgccctcatggagctgacagtctagggcggccaggtgcagatagaaaatttaaaaactaaataagtaaaccatacagaacgataatagaacatgatgagtacgagagaaaaataaagcagcaatcacggcaggcagtttaggtgttgctagcaagcaactgcaactcccaatagggaagtcagggaagttgtgctaggatgtgttattgttcaatatccattatttcttccactccaagatgactatgcatcccggcatcccggacaccgccacgtaacttatagtccttccccgctggctgaggagacctccttgccccagagacaggaggtttgccatatgacttgttttgacaaatggaatatgagcaggtattgctgtacagaacatctaaaggaatgtacctgtgtcacttagctcaatctcttatgtctatcgtctaccatgaaaatgaaatgtcctagacaagggctggtcctcccacctgcttgtggaatgagaaaacatgtggcgagagccatgcctccagcaagcccacacctaggagggacgtgagcaaggaaaaaacaagtttgtcatgtaagccaatgataggatttttctgttaccaccataaagccgattaatataaaaaagcctttctaagaggtgacatttatgccaagactggaaagagataagatgataaaactgaggcccagagaagtgatgtaactctctcaaggcacacatctattaagcgacaaagactctattgaaaatctttctctctgcgtttgttcacactatctcctcaggcagggacttgcctagctcagatcacaaaacccacagggtcagcaatattttcccatcctggccaattgtatgtacagcctccatccttaagttacttgaggcacatggccctctcctgcaactgaagagaagtgtgactgagtctgcagctgaattcttccatctccttctcatcttttacatctcactagaaccctgcaattagcttgtgagacagggcaggatggtgaatatcaacatctcatatttacaaatgagaacacttaggctgggagctaagcgacttccttaaaatcatgaagtaagtggatattggcggtggaaaccccaccttcctgaaaccaagaatatcactgcatcacttgaatttttatatacttgagtatttgagcatcaattcgctatccctatatatatatatatcccctatctataatagatagatgaagaaattaaagctcagagacatgaagtaactctcagaagttctcacaacttagaagagcagattagaatcaaagatttttctcactccagaacctgtgcatggtatgagccctgtcctctttgtgactttctatgaggatgcagaatgatggctgttggccacgaaacacattgcacaatgttgttagtttaaagaagttcaatgaacattattgcttagtcaattcatcctcaactgagtgacattgctggtgcccagggagagccagattcaatgttcatgaggaagctgcatatcatgatgtgccttcaatcagaaagagctactccgcaccagggtctgagaccaccaccagccaaatgtctaagggaataacagtgagagggatgcgtgtctctctcccctgcacttttgctttgccagacacttttcgctactgggaaagactaacatcctatacatacagaaggcaacccagtgtggcagaggcaggatggttagggttggaagttcagctcttccatggaaaggctgtattgccttaagcaatgacctcaaaggcttgttttgcgggctcaccccacaactcattcattgattccttcattcacttatttaaatgtatattaagtactcattatatatcagttattattctagaccctaggaatacagcaatagcaaccagacagtctgctccgtgaatacctccaaacccttaccactgtttcactctaaatgtacagaatggctactctgctcctaccccttgctctgcaaaaagggcctctgcaactaacacagtagtcccccagatcacaggaggtctcagagccagagacaggtcatgggcaggtagaattcccctagaatctccatccctctgctaatacaagtaaaactgactcataaccccacctttcatgacacccttgggcagcccagcccagacaactctgctaccagaggtcaaactattagcccttctcaccatttttttaatgtttccaggtgagtagaagagcaaatggatccagacaatcaatagcaaggggacagaaagtcattgtggagtagcaacttttgcttgtataaaattgtaaaaacaaaaacaaactatcaagcaaaaatagacatacgaagaaaatggttgagtttcctatgtagagaaaaactggaaatgtgtacctcacctttgcttcctttacctggataagcccaatagcccagctccaatgttgaaattctcaggaaggctggaacagccattcccctgacccaggagacctttcccatggccaacccattgggcaattacaaatagaaatattctttcagttaaatgaatgaattacttgtttaactgaaaggtagttagtattgtcactgttggtgtttgttttaaacttttacattcaggggtataagtacaggtttgttatatagataaacttgtgtcatgggggtttgttgtagagacccctggtgttcatcactcaggtattaaacctagtaccctttagatatttttcctgatcatctcccttctcccaccttccaccctctgaaaggccccagtgtgtgttgttcccctctatgtgtccatgtgttctcatcatttacctcccacttataagtgacaacacacagtatttggttttgtcttccagcgttagttttctaagtttaatggccttcagctccatccacgtccctgaaaaagacatgatctcattcttttgtatggtacatgtaccatgttttctttatccagtctaccattgttgggcatttaggttgattccatgtttttgctatcgtgaatagtgctgcaatgaacatacacatgtatgtgtgtttataatacaatgatttatattcctttgagtataatcgtaatggggctgctgggtctaatggtatttctgtttttaggtctttgaggaattgccacaaaaagtaatctcatatactgttggtgggagtgtgtattattagcccagtcactgctgatcttgacaaacccataaagaagaaaatggactcacacggcacagaggggtatctcaaacccaactctactaatctcaaacccaactcaccctcatggattttccgattcccatcagtaccggcttagagttactcttctgacgaatattgcactgatgtaaccaccgacaatacagccacgtgcatttaccttaaagtgttgctccatgccagcttgtggctgatgcaaagctagctggccagaaataggatccttgggattcacgccagcttggggatcaacatccctaagactctgaacagaattctccatgtgaaggagttggacacactgtgaccaagatggaagctttcatgtgtcgactggatggtccccatcaaggctgtgtgagttttctgggtgaactccatgaggacaaacaccccaaaatgaggccaaaggccagatgttcctgcacggtctttccacagtcctaataatatccttagtgcttattatgaactatgggtgattatgctgatggaatagaacattgtagaggcttaaatctatataaatttctgcaaaattctgccctttgagcaggatttaatgtttaattccatgctgcctgatctgtgatgtatacaaggattccaagttataccattcacctgaaaatctgcaaaccaccctggaatttgtcttcatcgtctttctttttgtggccccagagaccatagttacagggaagcaaggctagatgggggaagcttctcgtcttagcaacatatgtaacttatgcaaagcagctagtagagtcctggcacccactaggtgagcagcaaacctgttttcttgtctctatgccatacttttgttttccaagaagttcatttgatagatttctaatacattccaagtttctgcctcacgatgtctaaaggcatgccattactattaaaggagggacagtaagtgaccagcaagagaatggaatgattaatctagagtctacagggcacggcatgacattatagtctcttccattgatgctctttgacccctgacttgaagaagctgggctctgagaagggagaacaacttggtctccaaacatctctgctgatgctattctaaatgcaaagaaatgtcaaagctgaaataaccataatgcaattgtacttagcctgtttgctgaaatatcagtcattgctttgcacagcaattccatttttaaagttcattgtgctagaaaaatgttgcagctccttaattcttacgttctcatccaagccgggtgggaggtgagaagtttttgaactgtatgaaaatccatatttcagcagcattaccgagctctctttcagcatcctgcacattttctcttccctgaacccagagaaatctcccacttccatggcctgccctcattttgacagcaaacattaaaagagcatcggcagaagcacagatgaaaaaagaacaacacagggttgctgagcacccatcctgttgtctgaggaggaccaggctcactgggaactctgggttgagtctggttcgctcaacctctaagggtatcaatgactgatgttctggaagccgacttctacaggttgcctcaatgggctcttggtttcgaacttctggttatattcagccaataggaggtacaggcatgggattggagaataggaggatggcgaggttgggcagtgattctctccctgcttttccatggtttgtacagtggctacattctcctacagcagcatttctcaacctcagttctattggtatttgaggccaaacaactgtttgtgatggagggtcatcttgtcttgtgtgttgttggatatttcaaagcattcctggcatctactcactgtgtgccagtagcacactcgccaggttgtgaccaaaatgtgaccaaaaatgtcctctgggggaatattgccaatttctcatagggagcaaaattgcctcagggtacatctctatagacggccctttcatttaattcccactgctaacccattcacaatgctctctgcaagtagctgggaccccaaggtaagtgaatactagtatatgtggtcctcaatatggattctctttgtatgtaattggaggtgctgtgtcctttagcagactgcaagccttctgagggcagtgactagggctcccgcataaagcacaccccacccaggaggcttcaagcacaatgtggccactggaaggaaacacttctaggtgctgctagaatcccaggggctttagtgaaactctctctttcctggattcctcctcagtggaagcagaatacacagggacactgctccctccactctccacccccagcctctttttataatgactcttcctgtctgtgggctacttcctcctggggaacagaaggtctaggaggcctctgaattggcaccagcgccctgtggttaacttgtgtctggcagcaaaagctgctggtccctaggatgcagcaatcacctctaaatgaggtctgcctttgctacatttaaggactgtaacaattgctttttctcccttggaaatataaccttagagatgaactgctcttgattcagtaaacgtctgtgccagtttccttagaggctaccatgagaaggtactagcctccttccacaaactcaagaggaaagcacaaacctgcaatcattgcccattttcctaagtccctgcatagggctgaggccaagggcagaggctgggccgggactctagaaggcagcagggaggtgtgttgggtctgagttgtttctggattgcaagtgtcattgatgcatatttaataccaatgacactgctctgctgtcactatcagtgccccatgcaagccttggggacatcttaaggaaaaaactggcataaatgatcccataggtgtgtccctgtgaagctgtgtttaaagttctcctagattatatttagatcctggcatggcttctccagttatggaactgtgtgtactgctgtttggttcttgccaggtctggtttttcatggagtcagggtgtgggcttagaatgctgatctccacacttggtcatgctgcttgcctttgccaagctagatgtgctaaaggagtgagggatcaggagaactctgttcctggcccccagtaagcaggtgctgccagttcacactgacacgcaccgctgaagagcataaaactataaaatggagtttctgcctcagtttccacatttgtgctagatttctgttgggactgctgcctcattgactgtaaccctcatactggctgttgttccccccaaaaccctctcagggatggaacctagagctagctgtacctccatccgattggtgatggaggaaatcacagttttattctcccctggctccagcgttgaaatcaggcagccttggtctaaaacattaactcagagccagtcacctcaccttctgggtttcagttgcttcgtctgtaaactaatgttgaatattttaatcctttcccactattttcttctgagctgtaatttgcattcagtaaaataaacaaatcttaagtgtacagcctaatgaatttctatacattcacatacctgtcatccaacccaatatagagaatacatttccagccctccagaattatcttgttccctaacctaggtaatgccacacccccatagggaaccactgttttggagttcatcaacatgagtagttttgcctgtttgtgaatgtcatatatatggaatcctacagtatatactgtttgcgtccagctttgtttgttcaacatataagttttgaggttaattcacattatggagtgtacagatagccagtccctttctgttgataaatagtattccactgtagcagtacaatacaacaatgtatccattctactttggatgtcatttgggttgttttcatttggagactattacaaataaagctattaccaacattcttatgtgggaatgtttatagaaatatgcattcatttctcctgcgtttattccatggtccagtaccagggatttaagcaccaaaattcattccacacttaagttcctcatcagcacattttgatgcccagaggcacctgaggctcagcaggttctacatggagtccatcaccctcatcactcagccctgacaatccctccaggctcagggctaaacatctcctccagggctacaggccagccatcctcagcttctagtgctttgaatatgccttattctccttctatcttcctggccttcagaataaattaaagtcagatgattacatcccctttatacagaaatatattctagaaagattaaaaactcgaaggcaaaacaaaacaaaacaataaaagtgctagaagaaaatctgaagtatcttttcatattcttgctttggttgcctaaaagtgtaataaggttaaaagcaaggaagaaagactgaaataaaaattaaaaacatctctatataaaaagagtataaagaagacaaatctgttaaaaactaaataaatttatttagtttattctttactactaatgtgtcgaaaaacacatattatccttaatacgcaaagggctcttgcaaaataataagagatgtgtaaagctccccaaagaaaaaaatgcataaagaagtagcaactggtaatataaaggtccaataagcaagaaaaagttgctcaacataatcaatcaacaaagaataacacattaaaacaagctattattttttactaatcagattagttttcagacaattgatggttttgggaaattagacctctcatatgctcttggtagaattataaatcaatacctcttttccaagaagatattcctatgatgatcaaacaccatataaatgtggccaagtaattcaatttctaggaagatgtcccaaggaaatggttgtatatatacacaaagatatgtaccagcctgttcataacagaagtgcataaaaatttaaaacctgaaacaacccaaatgcccagaaataggaaaatcatgaagtaaagtagggtacatacatataatggaattatatgcagccattaaggtgattggataaatatgtctttatcatggagagctgttcatatcctttttgagagactgaagtaggttgcaaaaaataagtcaagatatgattccattattgtgcatgtgcgtgtgtgcacacacatgcccacggcaagtgtttggaaggtgttctattcagggtaagtgaacctcagtaacctcaaagatttaacacaagaaagatttctttttcgctcgtgtcacagtcaaaaatgaatctgcagggtggctctgcttcactttgtcattgaaaagcccaggctccttctatcggtggctccactgtcccaaagagtcttgaagtccccctctggaccctctgtatctcaccatcagaagagggaagaaacagtgggggtggggtgtttacagggccagggctggaggtgactcatttcttcccaaataccactaaaacataaccacagggtaacccctaactgcaaaggggctgagaggtgtagccttgctgtatacccagcaaccgcctagtctccttcacagaaagaaacagcaaaattctaacatgattaggtctggctagaaatatttgggatcaactttgctttctcctttcactcttccacattgcccagacttttcccaaaagatgtgggctacttttagaataagagcagaaaagcccaatacagctattgccagccttccatatttgcaggttctgcatctgcagattcaaccaatcatggactgaaaatatttgaagaaaaaacaattagaaataacaatacaacagtaaaataccagcaaactaacacaggaacagaaaaccaaacaccgcatgttttcactcataagtgggggttgaacaatgagaacacatggacacagggagggtaacatcacacactggggcctgtcaggaggttgttggggggacaagggaagggagagcattaaggcattaagacaaatacctaatgcatgaagggctcaaaacctagatgacgggttgatgggtgcaggaaaccaccatggcacatgtatatctatgtaacaaacctgcacgttctgcacatgtatctcagaacttaaagcaaaataaaaataataataatacaaataaagaaatacagtaaaacaactatttacatagcatttgtattgcactgggtgttgtaagtaacctagagatgatttaaagtatacaggaggatgtgtataaattacatgcaaatacgacctcattttatatgaagaacttgagcatccaagaattttagtatccaaggagggtgccggaaccaatctcctgaggatactgagggtcaaccgtatttccattctgatggctttgcagaggaatcagacagtcctccactgtaaatcaagctgcaattagtgccctggtgttctggcgccccgggtccttcgtgttagagctgggacatgaagacagcacccgagaagaagggggcctgaaatatccctggctgcccttcacatctcaaaagacacagacactagtccccaaggcagctcacagcccacccacctggaactttctccatgcctgggaggcctcaaactgagaagcaaaccccacgttgctgtgtgacagggcctgcttctgtccgcctaggtgcacaagtgcatcccaccactcagaggaatactccccacaccaccatttgtcactgtcagcccagggagcaattatattccatccggccagaaataaacagacaccagcatcacacaggagatgacaggcagacacactgcctctgatgcacacacgtttttctcatgcccagctgtgactgagcctctgggcacagatgcagcccagagcctggtgggaaaagcaaatcaatgagggcccttagaggatctcgtaagctctctcaccacttgctcttttcaggtagaatgaacgaatttggggaaaagcctaacttttaaattaaacagttgtaaaacttctgataaaaatgccattaaagaaatttatgagattaaacacatctctatggcttctcctgcagatcagcctgtgggtctgaaggcctttggatcaaggggatgagcgcattggtgtgggagccggggcagggagtggggtttgagctcctgcagcactgcttaacagctgtgcagtcccagctgggtcctgtaaccttcctgccttccaaagggcaatattaccacttgcccttcctccctgcttttattaatgcaattttctctgcttcatatacactcctacatcctccttatggcagagacgacttgctctctcccaaattcactctcaccttccatcacacagggctgtagctaggaagcagctactcagctagagagtatatttcctaccctatgttggctatgtgtggcttcaagacaaggcttttttacattgtgcacatgtaccctaaaacttaaagtataattaaaaaaaaatagattcaattttatttatttattttctcttttgagacagagtctcactctgtcacccaggctggaggtctgtggtacaatcatggctcactgcaacctcaacctctcgggctgaagtgatcctaccacctcagcctcccaagtagctgggattacgtgtgtgcagcaccatgcccagctaatttttgtatttttcatagacacgggttctccctttgttgctcaggctggtcctgaactcctgggctcaagtgatcctcttgccttggccacccaaagttctgggattacaggcaccgcagccagctgactttaacgtttttaagaggagctttaggttcacagcaaaactgagcagaagattcagaacctcaagactagttttcaccaatgaaatgggaacagaagtgatggctgtgactcccaggccctgccctaaagtgccttgcaggtgttcctccaggcacattctctctttcagcttgctggggtggaaatgagcaggacaaacttggaagccatgcactgaggatgtaagtcagggctgctgtccacctaggtgaccgagtgaccaagtaaaggactattgctcctgttgccaatccaacataccacactgaatgcaatgaggtatctttgattgcatcctggaacagaaaaagcatgtaagtaggaaaaaaacacaactgattaaacctcaacaaaatctggtgttaacagtaacccacaaatgtgccatggcaatgtaagttgttactatttggtaaaactgaataaagagtagatggggactctctatattatcttcgtaacttttccatgaatctaaatttattccaaaagtaaatgtttattaagaataatttttaggcagggtgtggtggctcacacctgtaaccccagcactttgggaggccgaggcaggtggatcacctgatgtcaggagttcgagaccagcctggccaatatggtgaaaccccatctccactaaaaatacaaaaaattagccgggcatggtggcaggtgcctgtaatcccagctactcaagaggctgaggcaggagaatcacttgaacccaggaggtggaggctgcagtgaaccaagatggtgccaatgtacttccagcctgggcaacaagagtgaaactccatctcaaacaaaaaaaaataaaagagagagagagagagagaaaaaaaacgatttttaaaatagctgtattgagccattgtgcctttgggtctatttattactgcagccacgcctaccctaacaaatgcacttctcttcacctgtaaagctcctagtcacattttaagacttggctttgacattatctccattaagaagcttcctgtgattaccagggggtgaggtactgtacactttcttcctcgatcacacccaagagaagtaactcatagaactgcctatttcccaagccacattgaagtcttccttgagtcagaagccttgtctgcttcacagctacaacattcctcatggtgttcagaaatatttgtccaatgagttaatgccagcctcacctatttgttgtgaacattcactataccaaccagaataaaactgcttcattaactctgaagcactgcacagatgtaggggatgattaatcagttgcaaagtatttattgaacaacagacctgttttataattgtgatatattttcctggtggcctggagtgtatgcattgatacatggcacttggtctcatgattctgactgtcttaattagtattgatgaggcaaaatggcttaaatagtcaattcaatgccatctgttgaacacccaaagaccaaagacattataggtgtgggtttgcttttttttgctttttttttttttggagacggagtcttgctctgtcacccaggctggagtgcagtgacacgatcttggctcactgcaaccgccgcctcctgggttcaagcaattccctgcctcaggctcccgagtagctgggattacatgcacccaccaccatgcccggctaatttttgtatttttagtaaagacagtgtttcaccatcttgggcaagctggttttgaactcctgaccttgtgatctacctgcctctgcctcccaaagtgctgggattacaggcgtgagccaccgcgcccggctgagtttgcgtttcttgaatgcctactggctgccaggcaaacatgtgttgggggctttcactcctattatttcactgaatcccagtagtgaaatactccaacgttggtattattatcctccactttacaggtgagaaaattgaggagcagagagaacaagtgatgtgtttaccactgctcacttcgtaagtggagctaggtctccgaagtccacctataacctgcttcttttcaaaacagcatcttgacatatgattgatcgccaggctgtgctaagaactgtcataaaaataaattcaatttcttccatgcccctctgggttggctctcaaataaaagctgaatgccagaactcaaacaaacttccataaactgaagtccagttgttgaagctgggacttggggtcagaggtgaccctcctggcctacagagagctgtctgagctgctaaacccaggatgcttcaactgtcctggattcatctgggaataagaattatttcggctaggcacggtggctcatgcctgtaatcccagaactttgagaggctgaggtgggtggatcacgaggtcaggagttcaagaccagcctggccaatatggcaaaaccctgtctctattaaaaaatacaaaaactccccaggagtgatagcagatgtctgtagtcccagctacttgggaagctgagcagaagaatcgcttgaacccgggaggtggaggttgcagtgagccgagatcgtgccactgcactccagcctgggcgacagagcaagactccatctcaaaaaaaaaaaaaaaaaaaaaaaaaaaaaaaaaaatatatatatatatatatatatatatatataatttcaactttcatgccatgccagtactgctctaagtattttacacagcatagctcacccaacccttacaaccctaggaggagactactatgattccaatttcaaagatgataaaataggctcagaaatgttagtcaaaagttactgtgagtaaatacttcactatgaaattagatgctcaatgtctcctttcccaatagactgcaagccatttgagggcagggacagtcctgccttattcttcttcgtatctaaagtgtacatcacagagtcctgcacgcagtagctgcataataaataattgttgaataaaggcatgaaatgataaaagtcatacaaaatttggggagccacagaatctctggaaggcctgtaatgaatcaactaatgattgttgctatcacgtgaatatcagccaaatgcctgagtctgcaccctgtctataaactcactcctgcctgctcctctccaccagcctcaccctcaccagtccatgcactttctgagagcacccagggaggcagaactcctagatgccaaatgagaatgggttccattcagagctctctgcaccagagccatgctatgctccaggcagaaagaggcagagggctcttagcctgattctttcacacaagatcacttggccctcagttagcatgacttgtgttcaaggtctcaaaagttcccccaagaagacgtttatcatcatttagccacatttatgagctaaataaatgttcatttatttatttgtgtattcatgttgtatgtcactgatattttgtgctcggttccttacatagcaatagctgactattgcaaactactaagtctatgttacagaagaagacactgaagaccagaaggtttaagtaacttgcccaacattttatagaaagaatgaagctagtatataaatttaggtctgtctctaaagcagacaggcttctgctaccccacatggctccctctgtcctttggaaggacatccagtccttatacctggcaggacagccagtgtgtgtcgccagtgtgtgtcgtcagtgtctggggcatctctcccatctgtacctccttgacagtagcacaaaggtgacccttggacagatgctgtactgagtcaggatgtcacacctggaaacccgccgtgtccctgctgagtaactacccttcactccagagctctcctcggcacataaggatattcctcactttaatgtgtaaatgccattccaaatcagcaaccaaatccaccagccaggggagctccaggtgattaatgcatctctcaggtagtgaaaaccacttaatcttcagctgcaagtttctgactccaccaaacacagatctaatcgcccacaaatgcactgcctgatgggtctttattgcttaattaccaaggtgagaggctcataattaataagccatttactcctacatttagatgtctccagaaaatgtagccaaagattttccaaggaaattcacattatttgtcatctttatatctcttggtacctgaattggtcacctatctcattggtttctaaacttttctgcctacaactaaatatgagagggagagggaaaaaaagagacaggaagaggagagagaagatttcccctcttcctcctgactctatttttcatttataaagacccttgtgatacattgggcccacctgaataatccaagctaatcttcccatcacaagatctttaacttaattgctttaattaacttaattaacttaatctataaagtccttttttgcagtgtaaggcaacatattcacagattctggggattagaacacggacatagacattttttatcgggggtgggggtgggttattctgcccaccctaatgttcagcactgcaacaacctaagccccccacagaagaaaatggttaaataatctctccccacacattgcatgtgctgccattaaaatgcttataaagaactcttagaacatggcccatgctgatgctgtaatatttggtagaaagctgggcaaatttcaaaagtattacgctttgcataacaagtgtaaaaagcatgaacaatgatgaacaaataagatgacagggaaataataattcctatttattgtacttggtagttgaatcatgtacacttatttgtttctgtctgcatttttctaaataggaaagaaggatagagaagaggaagagagttgaagatgctgcattgctcgaggaagaggccatgagccaaggaatgcgtacagcttccagaagctggaaaaggcaaggaaatggattcgcctctagatactacagaatgcatcctgccaacacatcaattttagcccagtaggatgcatttcagacttctgatctccagaattgtaagataataaatttgtatgatttcaaaccactacgtttgtggtaatttgctacagcagcaagagaaaactaatccaagtgcccttgtgaatgaaactgttcacgtagttcagatttctattacaacagatctctagaagtggaattactggatcagaggatgtgactgttttgagagctcttgactagatgttgccaaactgctatccaagaaggctgaggggcaactttggtagatgatccaggaagaggaccccaacccccactgccccggggcagtcattcacttctttccatcttagtttcccacacccttgtccaagccatgccctcacctcccctggaaagaatgccccagccccttcactggtcttcccacttcgcctcttggcagccacagcttgtgtcccacatatcagccaggagaatctcattaacacctgagttagagcctggtgctctcctgtattcgtttgagctgttataaccacataccatagacagggtaatttattagcaacagaaattcattgctcacagttctggggactgggaagtccaagactgagactccagaatatatgatgtctggcgagggtctgttcctcatagatggtgactttatgcatgctcacagggcagaagaggccgggggctccctcaaacctcttttacatgggcactaatcccgttcatgggggtgggatcctcctgacataattgcttcctaaaggtcccacctcttaataccatcaccatggggtttaagtttcaagatatgaactttggggtggacacaaacgttcagaccatagcacatccttcattgttttcccattactctttgcataaagaaaactatccctgccctggcctctgctggccaccctctggcctcaccacccaccaagaaccctcaccccttaccttctctgctgtggccacatgggtcttcccccagcttccacccacaggccatgctctcatttactccagggccctggcacatgcctggaatgctctcctcacattcttgttggccccaacatctctcccttgtcctttcgagcccatataaaatgcacctttctcaggaaagcccccttcacctctcaggcaaggtccacttctcatgcattcccatactgtattcttctccttcatagcactcatcatgattacaattaattaactttttaattagttgtttagcttttaatcaaagtttggtatctatccaggaacttgcacatagcacaatctctatgaactttcacaaactgaacacacctgtgtaaacaccacctggagcaataaaacattctctgccttctcgggcatcccagaagctcacccatacctcttccagttactaagtcccctaaggcaatgcctaccttgacctctaacactagagataagtttttgtttttttttttttttaacatctaaacacaattgatagccttttttttttttggcatatatgtctccattaaaatataagctccataagagcaggacccatgtctgttttgtttgccatcctattcccaatgtccagcaccttagctcaacaaatatttgtcaaattacagaatgaattaattaacaactaattaatgttgtaggaattgggcaacaaggtgtaggaggtacagtgagcagggtgcccacaggaagatggaagtaagagaaacaaggtgcatctagccaaggaggggccagcaggaaggtcaaaggaatgcccctggctgcacaagcccagcctgcactgggcaaggcaagcaccctggccactaggggccttccacagtggcatgagtccaccccccacccacccaacctccaactccctgcccatgatggtctggataagatacccttcctccatagataggagcttttctggaaggacacaagctgttgagctccagagagggattgtccttggcaataaagagggggcattagacagtgttgtggtgagaataagctggcatctgttggtctcagactgggagaaattgtagcctgtagcccaagtttgaattgaaggacactgactgggtgactaccccatgatctaagttctgatttcaccagatcctgcttgcctccctactttccctccttccttccattcaaacttctgtccacacttatcagagcaggttctcctatgtgggggatgatacaaccccgttatcagcacagtggtctcaaaatggcaagacggaccctttctttctttctttttttttttttttttgagatggagtctcactctgtcacccaggctggagtgcagtggcgcaatctcagctcactgcatgctccgcccctccaggtttaagcacttctctgcctcagcctctggagtagctgggattacaggcccgtgccaccacgcccggttaattttttgtatttttagtagagacggggtttcaccatcttggccaggctggtcttgaactactgacctcgtgatccaccacctcggcctcccaaagtgctgggattacaggcgtgagccaccgcacccagcaagatagactctttctatgcttctgactgagggcagtttgggctcccaagttggagaagcattgagcctgcctatgtgggttgcagagccaggcagagcatttgacatttccggttggagggccatggcagccagtattttatttaaaacactcagagtttacagtcaaaaacccgtgagtctgaacaaattctttaactggcaattccctgcaaagggctctgcagtttgcactatttcaatcatgtgttcaatcaaaagggtattggagacgtaactgtacattatcactattgacatttcccagcctactccactttggttaaaaagaaagtgtccaaagatgccacttaataactttgggtatcatgaaaatgtcactttggcaagcagaaaagtggatttacacacccaccaaaggtgacctgcttagaaagagacagcagggattgtttcctggcctccaaaagagacagtgcacccaatgtccctgcaagttaccattgctccaggggatggagggagggagaggaagaacaaagggcagtggcagcccaggtgctactcagcccactggagcaggctcgggtggacagaaaggcttctagggcttcagcaacaaagctggggtgggggtaggggttgggcgaagaaaggtgatatggtttggctctgtgtccccactcaaatctcatctcgaatggtaatccccacatgtcgagggagggacctgttggaaggtgattgcataatgggggcagtttcccccttgctgttctcatgatagtgagttctcaagagatctgatgggtttataagtgtttggcagctcctcgtttgttctctctctctcctgccatcctgccatcatgccatcatgtaagacgtgccttgattccccttcatcttctgccatgattgtaagtttcctgaggcctccccagccatgcagaactgtgagtcaattaaacctcttttctttataaattaccctgtctctggtagtatgtttatagtagcgtgagaatggtctaatacacagggaaaaaggaccgactggtgcaaagctgataaaatgactgcatccggttctggagtcccagatgggggtaacacacacatagaaagacgcaggaaggtgggtcccagccaagagacccgtcccttggtcaaggtgatggggggcagcaagtgatcctgtggcccggtgaaagcaaggtcaaggttttggaaggaccgtcaagtgttagcagagctacagctggacagagaaggaagaagaggggccattttcccagaggagaaggctgtgaagagccagccaggcaaagtggcagggctcagttaaaaaccggtagaatggcaggctgaggcatggctgcaaagactgggttatccccttctccacttcctgggtttccatctcagcaacacgcaccaacctccacaatctaggtggcaacctcaaatctttctgtaacctcacttcccacagtgctttgcacctaacccaggggcagacaaatattttctgtaaaggaccagacagtaaacattttaggctttgcaggctctgtttattggaacattcaccctactcaactctaccgttgtagcgtgaatgttccgagaaaacttacaacactaggcagtgggccacatttgatgcatagaaaactgcttgccaacccctgatgtaacagattgccaaggcctgtcgatgttaccttctaaagatctcctgaacctgcccacttttctccagcgcccacaccctcgccacactagtccagccacaatcttctgttgcctagatgaccccagcagctccctccccgcctgcctcctccattctgctttcacttttgtctcctctacccagcagccagagtgagcatataaaatgcagttctgatcctgtcacctctctgcttaaaactcttcagaggttcaccatcgcttccagaaaaagatcaatactcctgacgtggcaacctgtcgagactcaggaccgctaggaaatcagctcttgtttacccctctatccattacactacgatccagctggggtaagtgcctgttggagcatctgcatgagttctccctcctgggcctttgtccctagataatctggcaggggcgcactttctctccattaacaattccacccttccctctcctcattttgactcatctcagtttaggcatcacttcctctgagcaatcctccctgatgtcatgaggcagtgctgagtgccttctctggaccctctgtttacttgcctgttaaatcctgaacatctggaagggagtcgtgttcagcaacatatctacgccttgcagcacggtgcctggcctgcagctggtgttccgtaaacagctgctgactgacgggatgcatcggtgagtcaatcaattaactctctctcacaataggaggatgaagctcagagaatatccaattggccatccttccccagaggccagaaaatgctgtggcttgagttccctggggctttgcctgccctggttgggatggctttctgccccagagttctctggaacttgcaagtctggagttttctgacccaggagttatctgtgtcagaaaaagaacctggctttcagaatcttctgtgtattataaggtggactaaggtttagaaagacacaaaggaactaatacgtttacacattttcctgggtaaaagcataagtaaattctcaatcatcttttctttagtatgattattcatttattaatttcttcacttatttattcattctacaagtgtcccctgagctcccaaggggtttctgcccctcaactagctgcttcatccacagagatggctggtacccaattcttgccttaccgtcagatgaggaagacagtccattttgatacagtgtggcaaatgctatcataaatgaatggtcagggacaatgtcagggagtaaaatgagggagagtaaaaatgacaataaagtacacaagaaagttcaggtcaagcagtattttagaaacaagtagacttaacaagctgaaaagaaaacaggccattaccaaggaagagtatatagaggcagttaaaaataaaagtagataggtcaggttaatgtcaacaatcgctataacagaacagtaaagaaacatcaggctctttacaaaattggatcacagaagcataatatggtttgcaaggaaatcaactagcattaaaaagattcactcccccaaaatggccatgcaggtgccagttttggccacacctctgcacaaggcggatgagcaaacctggtgggagggatacatcgcagaagccagcatgaaaggaccaccaggctgtgctgcaggctcttccaagggaggggctaaggggacacagacggagacccaggcatgcaggtttgagaacactggaaggagtgaaacctgttgtttctctcctgacctggatgcaacagagtaaataagatgatactgcagactggggatgtttagctcctctcttaatgaaactgcttcaaagaggtcgggggagtattcccttggcagtgattgtggttaaactgggctaacggtgactgcctagactgctttctccatctagttcggccaccacagagggtcagggctacccagactaccggccagggaggaaggagatcaacagcacggagatgtgtgtgtctcaaattaaaaatggtctggccagatgcaggcactggcatgctcagggagaagcagtctaaccaaacaagagaaaaaccttcagacctgagcaaggctgtgtgtgtgtgtgtgtgtgtgtgtgtgtgtacaggcatacccagtctaaccaaacaagagaaaaaccttcagacctgagcgaggctgtgtgtgtgtgtgtgtgtgtgtgtgtgtgtgtgtgtgtgtgtgtgtaggcatacccacatgtgtgtgaattcccattaggaggtgggacgctagcaaactggaaggcagagcccatctgaccctgagatcctcacactcatgcaaccttaatgccaagacaaactgaatggttgattgtgtcaactctcttgttttagggatgggaaaacaggcccagagtgggaaaaggagttacctcgagtcaaccaggagagtctacgagttgagattaggattgatccctggcctttctggaagcacactaaccagggattcactccttttgcttccaggacacactctattatttaatcctcatctcaatctcccagtgcagggtaaatggagaaaattatctccatgttaagagtataaaagctgaggctcagagacagtaagtatttttctgagggtcacagaactaatcatggtgcagatgtgattgcaatgaaggcctgtttaactccaaagcctttccactgtctcatgttgtctaatagatagccagcaaatgtttcaaacttaacatgtttgaaactgaactgctgatcttccccaataaacctgctccatcgacattcttccccatctcacttggcagcaatctcatccttccagttgcccaggcctagactcctctctttttctcacttccactaccaatccaccagcaaatctgttggctggatcttaaaatatatccagaatcaaaccatttcaaccagctctccctttgcagatgtcaccatctgccctatctcggatctgcaatcgcctcctacagtctattctcagctctgtagctggagtgatcttcttcttatgcaagcaactcatcttactctctgttcagaaccctgcaacagcttcccatttcatgcagagccaaagcctaagcccttacaatggcctttgagtcttgcaagttttttttttttgggggggggtcggtttttattatactttaagttttagggtacatgtgcacaatgtgcacgtttgttacatatgtatacatgtgccatgttggtgtgctgcacccattaactcgtcatttaacattaggtatatcttttaatgctatccctcccccctccccccaccccacaacaggccctggtgtgtgatgttccccttcctgtgtccatgtgttctcattgatcaattcccacctatgagtgagaatatgcggtgtttggttttttgtccttgtgagagtttgctgagaatgatggtttccagcttcatccatgtccctacaaaggacatgaactcatcattttttatgactgcatagtattccatggtgtatatgggccacattttcttaatccagtctatcattgttggacatttgggttggttccaagtctttgctattgtgaatagtgctgcaataaacatgcgtgtgcatgtgtctttatagcagcatgatttataatcctttgggtaaatacccagtaatggcatggctgggtcaaatggtatttccagttctagatccctgaggaatcaccacactgtcttccacaatggttgaactagtttacagtcccaccaacagtgaaaaagtgttcctatttctccacatcctctccagcacctgttgtttcctgactttttaatgatggccattctaactggtgtgagatggtatctcattgaggttttgatttgcatttctctgatggccagtgatgatgagcatttttttcatgtcttttggctgcaaaaatgtcttcttttaagaagtgtctgttcatatcgtttgcccacttgttgatggggttgtttgttttttcttgtaaatttgagttcattgtaaattctcgatattagccttttgtcagatgagtagattacaaaaattttctcccattctgtaggttgcctgttcactctgatggtagtttcttttgctatgcagaagctctttagtttaattagatcccatttctcaattttggcttttgttgccgttgcttttggtgttttagtcatgaagtccttgcccatgcctatgtcctgaatggtaatgcctaggttttctcctagggtttttatggctttaggtctaacatgtaagtctttaatccatcttgaattaatttttctattaggtgtaaggaagggatccagtttcagctttctacatatggctagccagttttcccagcaccatctattaaatagggaatcctttccccattgcttgtttttctcaggtttgtcaaagatcagatagttgtagatatatggcattattgctgaggtctctgttctgttccattggtctatatctctgttttggtaccagtaccatgctgttttggttactgtagccttgtagtatagtttgaagtcaggtagcgtgatgcctccagctttgttcttttggcttaggattgacttggtgatgcgggctcttttttggttccatatgaactttaaagtagttttttccaattctgtgaggaaagtcattggtagcttgatggggatggcattgaatctgtaaattaccttgggcagtatggccattttcacgatattgattcttcctatccatgagcatggaatgttcttccatttgtttgtatcctcttttatttcattgagcagtggtttgtagttctccttgaagaggtccttcacatcctttgtaagttggattcctaggtattttattctctttgaagcaattgtgaatgggaattcactcatgatttggctctctgtttgtctgttattgatgtataagaatgcttgggatttttgcccattgattttgtatcctgagactttgctgaagttgcttatcaactaaaggagattttgggctgagacgatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgccgagtcttgcaagttcttgtctccaggtacattcctgacttactctcctcccattttctccttcacacactcagctctaggccccctagcttccttgctgttctttgaacattacaagcatgctcctgcctcagggcctttgcaatggctggccgtatactagaaagtcttccctcctcccttcttcctccacccttcatgatccacgcgactaaatctctctcatctctttcaagtctttgtcaatatatcacttcctcaatgaggcctactctttaaaattattaaccacttctactgcaagaatttccaatctgcattctctctgctgcgttttctcttactaccttttagcataccatgaactctactcatttattatgctaattggttattttctgtctcccacatgaaaatgtaagcaccatgacggaaacgatttgtttcttttgtttattggtgcatccaaacctagtaagcagctgacacatggcaggtgctcaatgaatatctattgaattgcactatctctctaattggtggctgcataaaaaaaaaaaaaaaaggcttaaactcacaggagaggaaatttttctaagtcacaaagtcatttttttaaacattactccatccctaagtcttccacagaaggagctgaatgtgtaattttgacaaatgagtttgcatagagaaggaaataaaacatggaatgagactatgaaaggagttcttgggaagagaaaattgcattgcctttaagtaggaaaaggaaagtaatatttaaaagcaaagatgtttaaaacatcgcaattgtaggtagaaataactcagaggttgaagggggagggtgctgcaagatgcagtggaattctttcttatctgggctcctgcctaaagcattactgggcaattgacaggccaaatcaataagcaacttaaattctggtctaaaggaataactgaaatgaatgcacaacagcacagggaaacaaatcggcacttggaacaaaaaaggggctggaatgctggctttgactggcttgttcaccccagtgaaaccagcactccaggttacttgctaagtgctgtgatgattataataatggtggctttgtggggagagtgtcagcgcagccctctttccctcctgggtcccagtagatggatctgaatctggtctgttctgtggagagaagagaggagggaagcacctgtcttggtcttgtctgcaggctccctttcctggggtgtgaaggagctcctgcaggcttggtgtggagggctggtcccaaaggcaaggcctggggtggaggcccctggggagaagagaatgaacctcaaactcagggttggccagacgaagctctgaggctagaggtggaatcacaggctggaacacactgtccagaattcagatggacagagacaggatcacagcaggtcaccaacgaactggaaaaatccaagccacctgggctgccacctatagttgtgcacaaaaccacaggtcaagggggtgagtccgcctgaaattaaattagcctaggggccactatccctcacgtgggttgagccagttcagagggagggacatctttttgcaatctgttcacaaaaagaggttaccttttcaaaatttgcacagagactccccaaactctggcaactgtggttatctgtgatcaccctttagtggtttgttttgtagagtcaggcatgctctggtcaagagaagctgcaggaactggaagaaattaactctgatcttctcagagctcgcccaaaaaactggacctatagagaaacctatggaacatttcaggcttccttttcccaatccaaatttgagctacagatttgagccccaaattaatccccaaatggttctcctactgattcgttcatttcgttcatccaggtattcacagggttactaagaagtgcttgtcctcggtcaggccaggaaagagagatgacagacttggtcccatcggcaaactctttacagacaaaaaatccacctcactcatctctacagctccagggctcagcacaggggctggcacatgaaggctccctttccttaccttttcctggcacatgcaaatatatgttttttgagtatataaatcaatgaatgatgagaatatcttgcaactccttcaaaccgacaggtccacagagatgatcttgctcctgaccttgacaacagaaatacattcttagagactctgtagtcctaaatagaactttggggaatccttttaaaaatcaaacgcatacttggtaggagaactgacaatggcaaccagttgctcagagttatttgctcaaaggcctacctgcctcctaagcctcactgttcttcattaactgtcaggggttaaactttcaagagctactcccaaaagagctgcaggaaaattctgtctaaacagccatgcaaaagtgtctggggatcactacggacagaggatgatgacagagggcccatgacattgggccttgtcatggctgaacactgaccttccactgtcatggctgaacactgaccttccagtgcctacagcttttaaaaagagtaaaaactatgttcatgggtacacaaatacaaacatgcactcccccacacacacacatacatggacacacacagaggcatatcatgcattatcttctctcattcatcgatattctcaaatggcttattacacagatttacattcacaaatattctattatgtaaatgtaaatctattctattatgtgaatgtaaacctatataatatatttagccattttctcagttggatattttggttatttctatgttgtcacaattttaaatcacattgaaataaactaggcccctttgactcctttctttctctcttactccatgtggtagactaaatgtggctgctaagtttatttctcccactatgtcttccagccaattctagatttgagtcaattctagagaccaccatggtggagagtgcatatgcaggcacgccagttaactgatctggctgagcccagccctccagccatccctgccaaggtgtcaatgtgagtgaaaccatcttgaactctgcatattaacttattctccagctgaatatcaccaagagacctgtcttctgatgctacatggagtggaacaatctcccagctgagctctgtccacattcctgaccacaaaatcatgagatattaaataaaatggctgttgttttaagcatcaaccagtcttctcaatgctgccacaatcctcacaatggcccataaatctctacgtgatctcccactattctctttgatctcatctttggccttcccatggctgaacctgctccagccccactggcctccctgttcctccctgaacataccaaacatggtcctcccacctcacggcatttgcacttcctttcccctctgtgaggataatcctcccccagatgtcagcacggcatggtccctggcttcatgcaggcctttgcatacatttcagtcaatcagagaggtcttctctgatatcttacctaaaacaggagtccttttcttccacctcagccctctggagagccagggaacacctctctctccttatcatgctttatttttcttcataccactttcacaatattaatatttatatgtttattgtctatttagacctcctctcctccccacaaataaatgcacattctttagtacgaattctccgcaaacagaaacgttgtctgcttttatcattgctgtattcccaggacctaaaacagtgtcctgggtgtaggactgatcaataaatatttgtaaatgaatgaatgaattaattagcacacgttcttggatagaaatctctctattcatttctaattattcctcaaaataagttcctatgagttaagttgtggaggtgtaggaataacacatttcaaaatcttttagcacatattggctaaaattccctacagacaggctgcactggtgcttacccatcctgctagggatgtgtaagagtgctaatttccttgcatcatcaccaatataggataaagtcactcaaaaatatttgctacgtggatacatggaaaaaaatggttaccctttattttaacttaactttcttgatcctgtgtgaactgaactccttgttccacgtgcttattggccactacaaagtaagttccttgacagcaggggtttagatttgctcactgctatcccagcatcccagatagagtctaggatataagagatacatgataaatatttgtagaaagaatgaattaatatagatgttttcttttgttattgaaaggctattgactcatgtgtcctctgagaagtctgtctcttttttcttactgacttgaaataactccatgcatatagaatattttactgtcatctaggttgaatttttaatgtgtcatttgcactctattttgtatatgctattttttgacattcagaaattctagcattttatgtagttacatctatcattttattttagttcctctatttggtaccatgtttagctacagtcataatagttaacactgtatagcacttcccacatgccaggcacttttctgaggattttacatacattgtttattaaattcctacagcaatcctataaggtagacactatcattatctaatcatataaagaaactgaggcaatgagctatgaaatcaatcatctcctgtacaagattttatataaatttacctgtagattgctttatgatttcagtttttatatttgtgattattatgtaataatagaaatctattgggttactccatggagaagtgagggtctaattattttttcccaattaattgtcaagtgctccaacacagtttattgtaacaatatgtaacatgtctgtaacatattgacatatatatatgtatgaatagacatatgtatacatacatacaaacatatgtacatgaacacaatcacacactatatagcatttgctggtattcttactcagctcacttgtactgtcggtcctttttagttgtttagtaatttttgtggtgtgttcagtgaatcaaatttataaaatagaaatataaagaagaaacataaaaggattaccagcgattccctacaaatcctgattaaaggcacgttcaatgttgttctcatgaaatatgcacctgtcaaataaaaacataagcgcctccaaattgcattataaatgcacaatactttttggaaacagtttgcttcagaactttggcagccacaataataacacacacaagcctgtttcaccccaaaggaaatatctacaatacaaggatgtttagctccatcatttttcactgctttgggtttcttgcaaaaccattttgatttcagttgaaactaatgacagcaagcagtttatggtcaggttcacaaagtacatttctacccctgctgtggggaagggatcacaagaaaatagcttccagtaggttacgactcatctagctcccaaagtggggactcctccaccagagcctgcattttccactttttgccacactcagagaaggacttcgacctcaacatgtgatccagataaagagcatcctcctacacaacctcaaggtaataataacattttattggtatcttgtacatccgttggcattggcatttatatttttattcctatatcttcttatgtcaaagagagcatgctatacatcctgttcccaccttgcttttctcttaatgatttatttgaaaatggtttgtcattcatttctacagctgaataatagtttgctggatggctataccccatgtatataacccgagacagggtgaccttttgtggcccactgcctggcacttggcttggtctaacaaacagaaccttcatgcaccaagctggtcatgccaccaagtcagcgcagtcattgggagtgagtggtatgtgagtcctggctccctgaatgccctgatggaccccatggtccagccacactggctgggtccctgtaagcttagcctaccttgcctgagagccaaggaaatcccatcttctgcctcaccatcctcaaccacatttcagcaccaatgcaagatccagtacagctgctggaatccttgtttcatccagggtggacatggcagaggagtcagcaaccattttgtgccccagtgttcttcagataagttcccactcatgacaaactctagcccatactgcaactgaggtcccaaacatgcaattgcattgtttcccacggtgggctgggtcacttgctactgcaacaaggcagaggaaggacagcatcccagcatttacagacacattgcccagcatggggtctggctctgccagaatccaccgaaaggtatgagccctttatgaactagctgcactctgccctttggtcataagataaactcatatcttgacccaaggcagagccctgacatcagcatcagatcaaacttttgtctcaccacagagcaagccctgaccctggtcagactcaactctgacccttgcacggcctgagccctgacttgggccacggactgcaacccgaccctcagactcacgctgagtcatgacccagatcacagacacagctccaagccccagacttatcctgagccctaaccctgggcccagactcagccctcaccttggctgtgactgagcccagctggctatcttcaaatgcggtcacacaggaggtacttggcacagtaggcagatggctctgtgtgagccctgcctcggctctggatggtgcttatgatctactgcctatcacgagcatctagtatcttgccatggggaagaaatctcagtcccacagacctgagttcaaattctgccactgtttagctgggtgactttgggcaaattacttctagtccatcaaattagatgccttctgaagaaaccatttataaaatgggcacaaaatacctgctgtcatgatggtcatgattaaattatatgattgtaaagtacccagctcacagtagatagagttcatccctttccccagtaggcatcttgtcagctgcagctgaattattggtataggaacaagccctccagagctgtgctgtcctatactgtggccaccaaccatatggggctattttaaacaattgaaatgtggctggtacagccgggcacagtggctcatgcctgtaatcccagcactgtgggaggctaaggtgggtggatcacttgaggttaggagcttaagaccagtctggtcaacacggtgaaatgccgtctctactaaaaatacaaaaattagccaggcgtggtggtgcacgccagtaatcccagctactcaggaggctgaggcaggagaatcacctgaacctgggaggtgaaggttgcagtcagctgagactgttttgtgccactatacccagcctgggcaacagagccaaactgtccccaaaaaaaaagcaaataaatcaaccaaccagaaaaatgaaatgtggctggtgcaaactgagctctgctataaggaacacaccatatttcaaagacaaaaaaattcagaataagaaaaagaatgtaaaatgtatcattaataagtttttaatgattatgcatttaaataatatttgaaatatattagatcaaataaaatatactactagaattaattgcacctggttcctatttttaaaaatatagctactagaaaattttaaattacatatatggtttgcaggtccagaggtctgggaagagcagttcatgggtaataaagacagttaaaacagaaacaagagcaacagtaaaattaatacctaactaagtgtttattgtgtgctgggcacggcactaaacacttaagtcctcacagcaacctctgaaggtaggccctactactgtccccattattgagatggcacaactgaggcaccaagacgtaaagttatatggtccaaggtaaagagccagtaaaaggcagaaataggatttgagtccacaacacctggatccagaacctatgtcctagaggaaatgacacattcattaaaggctgcctcagtaaagtgcttcctacaaatgagtcacccacagggaagaaacatgccctggatcaattaaatgctgtcattgagacatgggcagcagcgaaccccactctccaagctcttacctacccacattgctaggcacttcactgcccatcagactggttggcactcaacagggtctttatggaggtgggggagttctctcatttaatcttgtgcatttctcagacatatgccaagttatctttatctggagaatcaaagaggacagctccttcaaacctttttagctttctccattagcaagaggtacctctgagagcaaaaatgataaactcaattgttcaaaaagcaagttccgttcttcaatttgtgtgccagtcataaacacagcaacttccatttgagcagaaatcccacatttcagcagaaatacttaatgtgtcatttctcctgcatccatcttcttcaaagcacttactttagaaagtagagaaggaaaaacaaactctaataacctgtactttgaatgggagatgggaactttatgataaagaactcaaaatgctttattgacatggctgcacacatcccccttcagctcctgaaactgctcctgagatgagaaaactttcctaggagccttgcaactcgacttcacacccagctaggctctgggggtaggatgcacactcactccagctcctgatctgttttgatcagccagaagtcctagttcaagtctaaacccagaatataaccatcttttttatcttaaatcatgcatttacaaatatctggcaaatacatattgagcactgtggcagattatattttccaaagatggtcatgaccacgccacttatcccacaagttcttacaatgtgatcttgtcactccccaccaggaggtggagtttatgtcccctcctctgggacctgcgtggacctttgtgatgggctggaccaatggagtatggagaacaggcttctatgtgacttctgaagctaaacataaaagttacaacaagtcatgaaagagaaaagcttttgctcttggagcccagccactatgctgggaggaagcccaagccacatgaagaggtcagagataggtgttccagctaacagccccagttgaggcccccaggtggcagccagcattaacctccagacttgtgagtgaggagtctggcttatatataactccagctctagccactgtcttatgcaaccacaggaaggagcccccaaatgaagccacctacctgagctagttatggttcatcaaaaaaataagacataatgaaaaatacattactgtcttatgccactaaggttctggtgacttagcatgcagcaatagataactggagcaagcacctactatgtgccaggcattgtgcaatctgctttaacaacagttgaagcagactttgtccctgaccttaaggagaccatagcttagtggggacataaaaaagtaaccaatcacaagcctgcactgtatgaacaggtgacagaggggcatgcaagatactttgggaacaaaccaggcttcgggaatgtaacaaggcctgaggacatcagggaagcatcctcagaggagaagattgtttaattgagtcttcagaaggagtcagtgtcaattagatgaaggaaaacagagcttttcattcattctaaggaattttgggaaaataatgtagcaaaaatagatagaaaaaactatgagaaagcctgctcacttaaaaacatattataaaacctcaataatcaatacattaataattaaaacctcgataattgattggcttattgacagaccatttgactaatgaaacatcaaaaagtgcagaaatagatctaaatgttacagagatttagcgtgtgtgtgtgtgtgtgtgtgtgtgtgtgtgtgtgtgtgtgtgtgtgtaatggggcattccaaagagggacttttccagaaatgcattgtactgcatgctatatacaccaagataatatccaaatgggtcaagattttaaatgcaaaaagaaatcccaatccactgaaattttagaagaaaatacagaaaaatagaattttagaaagaaaataattttgtataactttggaagtatctaaagtcttttttaaatcaaaatccagaaatattaagggaaagattgataaatttgactacatgataaaaaaaaattgtgtaatgccaaaagaaaaagagagggaaagagaagccttaagctaagtctaaaaacaaagacttctatgaaggttgaagataggtacaatgtcaacctgaaaaactgcagcttctccttagcaatcctaagatatctatagcttcttgaacctcttacagagggcctgaaacagagtagatgtttaataagatatattgcatgatcctgttacagaaactctcactaagatggaagttctggtttaatcttgactcagttatgtgacctggaacataaatgggtatgtgcacacacatgtgttccatgcactggggggaagtagagcaggtgattgcttccctactgccctaccacctcattcctggaaaaaacacatcaccactttcaaggtaatacattgacgcagtgatcaagactgccaggcaaggccacagaggcagcattaaagcaagcccaagaatcaggcattgttctatggatctcactgttcccctaacctgaggctcacttcttcaaaagtcaggatctggctgcatcttgctgaacctcaattttcccatcagtacagtaaaatgggcacaatgaccatggcttcagaaaccagttgagcatttaaatgagaataatgtatataagagaccgagcactggtggaggatatagcacaaacttcgttcttagtctctgtggccaccagagtcattatggtcatggtcagtttgctggagattcttttttttttttttttttttttgacatggagtctcactctgttgcccaggctggagtgcagtggcacgatctcagctcactgcaagctctgcctcctgggttcacgccattctcctgcctcagcctcccgagtagctgggactacaggcacccacaaccacacccagctaatttttttttttttttgagacgggtttcaccgtgttagccaggatgttctcgatctcctgacctcgtgatcctcccgcctcagcctcccaaagtgctgggattacaggcatgagccaccgcacccagctttgctggagattctattacgataaatatgtaggccaggcgccgactggataaataggcaacctccacttgtgcttctctgtctggaggagtttcttgcctttaaggtacattgcatagatgaacagaacacattaccaaagatgcacaggaacaaaatgaaagcatcaagaacaccctgacctgctactcaggatactgggccataggccccactctcatgatttcaggctgagagataaggagctgttaaagctggggttttgtttctcattcctccctaaacacagtgaagcttgggaggcattaaatggatcaagcatttttcagaacaaggtagagaaaaaaagacgtggaggtatgtcatgcttagaaaacacaaggctagcccctctgaaggtgctgaccgactccctggagtttactatttgtgtagaccttacaaagctcaagtttggggtgtctgcctgtcagtttctgcttcctggtttccatcatgaggcctctgaggactccacctaaccatgttatccagtccctgccactttaaatcaaggatctgaaaggcagcctctccatttagctgacaggagaggcagctttcaagagtcttctgtatcctttgtcagtgaaagtcacatgggggaataacccaaacttttcttccctttccagtgtagtgaaatggtaagtttcaagcatatgaaaaactcagccattggaacatcatggggtcgattaagccagtaatgactcaaaccaaagagctggggaatcttccgactaagtaatagggtagtgaatgcacagaaaggcagaggcaaaaaccgaattgtagcatctagttcatgagcctttgcatgactttggtctcaacaccggcacagtaatcatcatggaatctcagaatcactggaggagcaggatcccccaaaacccatctctgtgatcgctattggatgccaaaatcctccgcacatcttcatctagtggtcacccagcctctgatagcctccaggcttgaaactctactctgaaatattaagaagggaagctgtgttcaccactcagacacccactcctatttcacctccctgaagaaaccttccctgtctgccctctcagtcactctctaataccttgtctgactttgccttcttaatagatgtgttaggtgctgacccaggcatggaggttctgactgtgatgtcatgtagcttacttattgccatttagactgagctggcgagctcatttatctaatctgttaaaaccagatttggtggaaagtgaggacctcaatatttccacatttgctgacaaccttaaactctcatcgaagagtgggaagttgttgcttggaatcacattaagattaataatgacaatagagataatgacaactgcaaatatagcaactctcccactcacaatggcagtcccgattgcacaaagaatccagtaccaggaagggacacattttaagctatcttggaactgtttcctaatctgtgggataaagatagatcaaacaccactttgcattttttaaaccttgaataaataggtaaatagcccctttgttaagtaggagaaaatattgggaggagacgagtttaggcttctcaatatgtttccatctcattggccagcaggtctatggttcagagagaggttgaagctggagacagggatttcagaattatctgtagagtctcttggttgaggccttgggaattaatgaaattgcagtaccagagagtaccggaggagaagggaagtggggagctgtcctagagaacaagctagaatagaaacagtcaagacagccaaagcaggagtatccggagaccaacgtgaagggaaagaagtgagagacatgtggaagaggtggcaactcctgccaaaggggattaagaacaaggagttctaagaactttctgcagggctgttggttggagacgctgcctccatgcaaatctcatttgccgctgtcaatccagatcctgtcccaccacgaccatttctgagaaacagactcaagacatgaaaaaaaaccctctttctgtaaaattggttcgtgaaacagactacaggcattaatatcctttatgagtgacaatttagggccaatatttacactttgtaatgttcgttctctttctctcgggacagaaaagaatgttgccaatatcaatgaataaacattaataaaatcaaatataatcttgttccatctggaatcaacctttaaaaaaattcttaacatctgtatataatatacatacacctctatgtacaatagggaaatcagattttgcctgagagatgtgcacagtatttaatgccaatttatttggttccaccttttctccagactgctttagaagggtagcgtccctagaattgagattctgaattagtttcctctgactctcaggtacagaatgtccagctcaagccaagacatatcaaatatttatccactcccagattttcaaaaatccagctttctgtctcctcctgcagctgacctcctctggcagaaattcagcctcaaactgggagaaatgagtggatcaccagaatcaaagctgacgtcagtggtactgtgggttggtgtatgacgtgggaaccctgacaaacagaaatgaatgtttataaatgttagatctcaggtctgcaaggaaagatcttgctgtacttcacaaatggacttgctttttaatatgtctcctgtttcaggacaagtaatgttggtcagaactctgggggtgaacctaggggctcgtaccacttggggctgcgttgtcactcctgtcctcagcatcgcagaggccaaactgtacccagatgagaccccagggaaagagaaaagaatcttgggcacgggggtcattattcaaagaacctggtgtagtgcgtgggagatactgcatgcacctctaactcagacatatcattaattcacaccatccctcttgtgcctactaaaccaggatttctcagcctcaccaccattgacattttgggccagaaaattcttttcttgtggaactgctcagtgcactgtaggatgtttagaagcatccctggcctctacccagaagatgccagtagtactgtcccggttgtgacaagcagaaatgggtccagatacggtcaaatgtcctctggtgagagggtagcaaaatggcccctggttaagaactactgcagtgaattattcaagggaccatgagtgaagttttgaataatccacacctgagctaagtggtgccagagagatacttgcaggacctcagctttgttagtctgacatctctcctataagcccaccgactggagaccccaagcatgctgcagcccctacctaacagatcttcatttattccattacaggctgtgggcagcatttcttcatttcagatagaatcttccagagtttaggaacagagcaggctgccttctctcctcttgccaggaatttcagtgcgacattgaacatgtcactggagtttgcttgttgcaaggacaaacacttctcctggcacctcacccccacacctgcctagagacaaggctgcccaggctgtttaaagggaaatcagtactgtgccaggcctgtccaagtgaattttttctttgagcaaatacccctgcctacttgttcatttttaaaaccataggtcttcctggtgagggggcttcaaataaactacaacaaagagtaaagtctttatcccttagtaggaagagaagaagagcctccaacaataatttattcattcatccactggtaataaaggcagggctgtgatcacaagagaggagatacagacttcttggtctcaggggatttgcaaggcccagagtgtccagtggtatagatctatcaaggagaagcttccttggtaaacttagtgcctactgatccaggaaggaatatgtgctgctcacttcatccctctgtctccatgtcccacctggtaaaaatcagtcctgacaataccaaaactttgccaattctacttctgaaatatctcctggctcagatccctccatctttgcagttcctaacgtattaatagttcaggtatcatcttcgtttgttcctctgaactaatgtaattgctttctcatgcctttccttcccacttccatacggaataccacggcggtctttgtaaaacccaacagaatgagaaaacgctcatatccctcctcaccaaataccataaacaatgtttgaaaataaaaacaaaattgtcacgtggaagaaacaaaaacacttgcaatgtttgtaacagaaaacctaatatctatatttctgactctctcctggcttccacatatgtgaagaactctcacaaatcagtaagaaaatgccaaaaataggcaaaggccatgattaagcaaataccaaaaatgaatttttaaaacgaaaaatacaaatatgagaaatgtgcaaccttacttctaattgagggccacaaattaaacaagtatattttaacctcttagattagcaaaaatgtaagaggttggcaacagcaggtgttgacaaaaattcacaaaaatgggagctctcataatggttggaagtgtaaattggtgtataatttatcaaaggcaattttcctacattgtgtttgttttctactgctacataacaaataactataaatttagtggcttaaaacaacacacattcattttctcacagttttagtgggtcaggagtccaggcagaacttaactgggttctccgctcaaggtcccacaaagctgcaatggaggtgtcagccagggcttagatctcatcttaggctgagtcttcttccaagcgcacataattattggcaaaattcatttccttgcagctgcagactttttgaggcttgcttcttccaggctagcaggaaagagggtctctgacttccagactcttttaaaatgtctcagttgattaggtcaggaccactcaaaattaactctgttgattaaagtcatctgattagaaaccttagttttatcccaaaatcccctcacttttaccatatattgaaacatattcacaggattgacacccattgcctttgccatattctatggcgatatggtttggatctgtgtccccgcccaaatctcatgtttacttgtaatcccaatgttggaagcagacccagtgggaggtgactggatcatggaggcagagttctcatgaatggtttaacatcatcttcccttggtactgcatagtgagtgagttctcacaagacctgattgtttagaagtgtctagcacctcctccaacctctctttctcctgctctggccatgtaagatttgcatgcttccccttaattccgccataattttaagtttcctgagatctcctcagaagccagactgatgctgccatgcttcctgtacagcctgtggaacagtgaggcaatcgaacctcttttctttataaattacccagtctcaggtatttctttatagcagggtgagaacagagtaatgcatatgggttagaagcaagtcacaagttccacccatgcccaaagggaggggattaaagaaagacacagatcatcagagatcatcttataattctgccaacagcatatatagaccaaaacttaaaatgtttacaatctttgccatagtaatctcacttgtaggactatatcccaaagaattaagtggactagaacatatatatgcccacagaagccttttcatcattctgctatttgaaatcatgaatatatatactatagtagcaaccccaatatccataaaaatgagttcaaataatttatgatatatgcacatggcctatcgtatagctgttaaaaaaaaacacaagtgatcaaaaggtatttaagtaaaaagagtgctatgatgtattaagaggaaatagcaagtttaagtccatctacacttatatttatatataactgtgaaaatgaacctaaaattgtaaaataacatacagctattagcagacagtatcttcaggtatgggaatagatggcaatctttattttctgtgtagtttttatggtgtgaaactttttgaaatagctgtgtattccttttataacaagacacaacaaaagagctgttttttaaatgcgagagtattggtttgtaaaatgagtagtgtacaaaatagtatactcaagggcatcttatgttttgtaaaatatagatgagaagaagaaaacttgttagggaagacacaaaattttaatagaggctagatagacgttggtattatgggatgtcttgaggttctattttagctgttttctgcatttttccaatacaacatgtacattattttcatagtttttcaaaccaattcctgctatcttttttttaagtgtagaaaaggaaccatacatagggaaaaaaaaaatagccaaatgcagtctcacttccctggtctccaggcagagatggcctccaacatctgagcactcactgaccacagcttcctcccatggcttaacagtgccttctattgtggctgcctcgcccatcaggctgtaagggtactgatggcagcacccctcgttcacctctgcacctccagtgcctgtcacagggcctgccacagagtacttcacggcggctaaataaacgaatgaagaagatactggcaggctagaaccttgtaagcaaatcaaagtgttccaacaatcatcttatttgcaatggtgaaggatggagttgagggagcaaactggaggcagggagacaagatgccctggtttattaggagtaagatattgaggacctggtggcaagggagcagcagtgcagatgcaccggaagtggaaaggacagaattcagggaataatgggagtaagtgtccacagcagccaagcattgagggtaatgcccatactctggcttggacaactgggtggtgacatttgcctgaatatggagcaaaagcttttgagagagaaaacatgacaacttcaggtttgaacacacagggtttgatgagcagagacatctgggaggtgccacaaggagctccttatgtcatcctcccagctgtcaccacacacagggttgattctgcaaaccaccggagcttaattgatgcatgtcttctgagtaaaattcatctatccctcctcagggatgaaatgccccctgccttaggattctgtgacttcctcaagcccagagagatggggtgcaatgggagggttgagttacagtgtcaggcactgcataggctaaggagctccagggtctgctactctgctatctgggaagatgctcatttgcattggttccctctgcagtgggatgattttgtccttcatttgccttccctggatgatgcaggctgcctgcatccccactctgaaaactctttacacagaactggccgcacatttcataaagccatgagtgatgtcaaagagcatgtacaatggggagaagactgactctgggcattaattttacatttgtaatcaggggatcttaatcaaatgccaccaagctaccattgcaagacagccttccacaaacaccaccccttgcacagctcaggttctgcctggcactcaaattatctgcaaaatggtccctaccaccgtgcccacttatgccccaggcctctccatggagccacatccagtttcctaagcttactacatcactctttgtgttgtcctctcagccttgattgcccttccagatgtaacctaactagttcagccctctgcagccttcaaaacctagctcagtcatcatctgtcctgggggatctttcatttttattttttaaaattttacttattttggtttttgttgttgttgttatttttttgttttgttttgttttgagatggagtctcactctgtcacccccactggagttcagtggcactatctcaactcactgtaacctctgcctctcaggttcatgcaattccctttcctcagcctcctgaatagctgggactacaggtgtgcgccataaagtctggctaatttttgtatttttagtagagacggggtttcaccgcgttggcgaagctggtcttgaactcctgacttcaagtgatctgcctgcattggcctcccaaagtgctgggattacaggtgtgagctaccacacctggctgggattttttattattattattttttacatttttaattttatagatttaaaggtacaattgtagttgtgttaaatggatatattgtacagtagtgaagttggcttttagcgtccatatcaccggatagtgtacattgcgccgataggtagtatttcatctctgaccctgctcccaccctcctaccttttagggtttccaatgtctcttattccactctgtacgcctgtgtgaacccgttatttagctaccagttataagtgagagcatttttgactttatgtgcctgagtcatttcatttaaaacaattgcctccagttccaaccatgttgttgcaaaatacatacttttattcttttatggccgaatagagttccatggtatatatgcaacacattttctttatccagtcctctgttaacggacactaaggttggtttcatgattttgctattgtgaataataccacaaggaatatgtgagtacacctcctggcaatcttcaacccctttctaacagggtgggtttggatccctctgtcctgagtcaatgtcaaggcactgcattgaacctttctgtttatgattctgcatctctcacactactctgagttcgtaggttgctgtgccttgtctcagtaccatgctcagctccatccccacatctaccatgttatgtactagtgagtggtagctcccgcctgatagaatgagctactctccatagtggaaaattctttcccattgattccaaacagtgcaaaagaccccctttcagaatgaaatttgagggtcacctttggctcttctctgctgcatctccaacatacaatctgccttctacctgcaccatcacccctttcattttcccattatattattccagtggatgcaagtgattgcaaattaccatctcacccgtcacaaaagcattatctacaaatcgctttgtaggccatcaagcatcagcacatgtcacgattatctgggtgctcataaaatccttgtgagatttgaaggccagaaaccatcttccacattttacacacaagaaacatgaggctcagtaaattaatctagtcagatacaaagtttagactgcaaatcaagacttgtaattctcagacttggtctttttacatgttacctccattaaatagtctactataagagttcgttagggatggtttactctacaagaaaaggatccttttgtttttctccagtgcctagtttgggacgcagcacaacaaatcaataaatcaataaatcattactaaattaatgaatacatctcaataaatcattactaaattaatgaataaataaatgtccctttgcatcatgaccttagttttctcatctgtaaacgagcatgtttaggtgtgctggttcccaagaacatctctggcactcttttgtctctagctatcaatttctggctagcagactgactgtcaggcggaggtctgtgccgggcaggatgcaggcatggtgaacaccaggtgccctgggtgtgaataacaagcaacaaaaactgaactgagaccatttatgaaaataataatgaaaccacacattccttgataccagaaataatacagggctccatgccttgttaccggctctgcttctcaatgtctttgccatcccaatgtcgttcattcccactttgcctgaagtccatttttggtacagaaatgtaatttagtgggtggcttttcccacaactctgggccactaacacattcattttcttctctgcttttaaagtttatgttcctttgtgcacaacaggcagcacatcaccactttcctgcaaagtcacaggcaacagagaaactcctaaaagctcctgcaagtcttgggagagactggagcatttccattaagaccctcatgctactagattgttcttaggaacccctcagaagattcagcaacatgcaaagtgacttgtagaatgggataataatcataagggtaataaacgcctatttgatagtgcttactttctgccggacactggtcaaacggctttctatatatcctttcatttaactctcctgacaactctgtgagggaaatgctgtcaatatctctatgtttcagaggggagatctgaggcatagtgacattaggacactctacaggtcacattattaggaatgggcaaagccaagcttggaacccaggcagcatgattccagagcaaatactcttaccactatgttctttttttctcctatagctacatatgctcctctttcatgaagccttcctggccaccccacaaacaatgctaaatactagatggtgacagaacaaggagcaggggcttcacagtcagttagaactgatttccacccctggctgtgccaaattacttatatgattgtgggcaaattgaataacctctttaaatcttaacttcctcatttgtaaaatggaaatgataaacatttcacagtaccttggcaaacacttaagacttaagagtcagtaaatgtcctgcatgctctgaaatgggaagtcccaaggcagaacagaggggtgctctgttcccttcactcctcattcatttattcatttattcacttacccaacaattctttaatgagcaccaaccacataccgtgcattgcctggggtcctgggaaggttcctgttctcacggagcttacagtctagtgatgagtgacagaagttaaaaggcaaatacaccaatggcacacacaatttcagagacaatcagcgcaagaagacaataaacaggagatacgagtgatgtagtaatggtatgctggggaggagggtgtgagggagagaactgctttagactggcctgggagatatttgagccgagactaaaatgagcaaatgagcagcatcagccagccaagtgaagatccagggggctaggggtggggtggagaggggacaaacgatttagacaaaggaaatgacaagtgcaaaacgcaaacaggcaaaaaacttagagggttctaggaaaccaaataaggccagtacggctggagcatagtgcatggccaggagaatagaaggagatgagctttgagaggctggtgcgactagatcttgctgggccttgtgggccatataaacaaggagttcggatttcattgtaagtgcaataggaagctcttagggcattttaagtagggaactggcatgatgtgatttatgttttcagaagctcaatctcgataagaagtgaagaatggataaaaggagtggaatacatttagaagtggaacctggagattgtgataaatgttagacctcaaagcttcactccatagacggacaagaatgacatttcttctttatccccgtagatgtgtttcccaagacatccaggagaggatattggcgcaaacagtgagtcatcactctccacccaccttccagactccctcctccatgcatatccagctcttctcaacctggggctcccttagaaaatccagacaaaacaattgccacagagccaacatcttccttttccctttgtcttatggtaaaaacatatttgtagaagcaaatccaataataaaagattagcacataaatacactgaaaagtaagatcactgacaaatacaccaagtgtcggcaaacagttctcagtgtcttggcacatgcggagcccatgttgcaggtggcatcaggcagacatggggcctaatcagaactcccactgaagctggacggccttgagtcagcaatgttctagttaatatctctcctccatttgtccccccgctctgcatttcctggttttttcaacagagtcatctggggaaaacccacacattttatgatattttgtcttccccttcctctctgttaaaataaatgcctgtcacatttgatactcatctgaattactgatgttgggcatgagatggtggggccatgcgatccctctggagacaggaatctggtttatttggatccccaggagctcatgaatactgtgagttaggcttttggctcttaaagaagagagtccataatatcccagaacaatgcctcagtagcagatttagttctcttttttttttctcctgattgtgttcctttttacctagcactaatgtgggtggctatggtgagagaagaacatgctaggaagaggttctctcattttcatattcttctcatgcacacatccactagggagctaggtggagatgcttgcaccccaagagctctgggcccagccactcattggaatcaataagccttcctaagggtttagagttgggggaactgaggcccagtgatgttctatatctctcttctataccccgaagacattgagttccataattgtaccatactttgcctggcatggcctgcactggcatggctcatgaaacatgataggggcctgcccagttgacccaggccccccttgaggcttggtgtgtgctgagagggtgactcctgtttcaggcattgacaagaaacccagtccaggggtttgtgttgctgacagcaggcaagctatcagcaggggtgtctgatataggctgtgagactccaaggtcaaaggaggaaaagcatctcagagtctctgtcggttggagagggcagagatgaaagtagaactcatggagtgaggcgtgacccaagcactacagggagaggcacatgcaaggcacaggcctctatgaatgcctgaggagtccattcagaatccagttagacctgccccggagcaggtgaaggtgggtcacgtggtcagagctggacccatggctgaatccattcagccactttctgctcaggccaggactgaccccaggacacagcctgcagtaggggagctcactgcccttgcttaggggcaggcaaagagattcaaaagccaaggggggcctggtaacactgacatcccaggctcagttctgctcatcagtccctgagtgagaaaagctgcaggtcttcaggcccttgtcactccctgctggtgttaatttactcacttcttagacgtctccgcagaaaggtcaagggctagatgagtaatcatggctgagctaatgcctcagcctcagccatcgattctcgacctcaattttcacaaatgtctcactatcttatccaaatatgcttcataccttggaggaaagggtgttcctggtgaagtttgcaaatgattgatttaagtggttgtggctttcagaaactggcataaaaaagaatgtgagcaaagaccgatctgcacaggaaccaaccattggatgctgctgtggggaggaatgtggataccaggaaacgggctctctccccctcctacaggagcccagagcctcctacctcagtccaccgattagagggtcacaggtttcaggatgcatcagaattacctggagaatgtgtcaacatgcaggttccagggccctggccctagagtcagattctatagatgtggcgcaagacccagaaatgtcatgtggccacgatccttcatgagcctgatggaggcatggtctcagagccttgctgctcaaagtgtggttggtggactgcaggcagtagaacagaaatgaagaatttcaggctacaggatcagaatctgcctttaacagaatcgccagtgattcttgtgcacgatgttgagaaatgctggcttagaccacattgtgagccccgttggctcttctctgggcccagatttttctctggctgtgttttgtgactccacttcactcacctctaattccctgagggaccccttccaccccaagataaatagaactgaccttctgggccacacactcttgcagggagacatgtacacacacacaggcacctaccaaggctgatgtggtagggccagcccagcagatctgggacctcagcaaagccaatctgagggcaagagaatgagaacagaaaaagtatgggggctacagccttgccaactgctcacagatttcagcaaagaaaacagcaataattaattctgccaatactttttgagcacctgctatgtgccaggccctgggggaatgacagccgccattcatataataccttttggttgataaaacatgttcactccattctgtcagtgaactgcacatacgacagagaaatgagcctgtgatatagaaagcatgatccccattttacagatgatgaaactgaggctccaagaaactgagttacttgtccaagatttaaaaatagcttttgagctgggatccccacttttttggctttcttccctcacactcaatgtgattaatttatttgctctacatggtcatttgagcattacccccgacatttttttctgccttttctgccatgatgactgtccagcatggagaagcattgtgtccagttgccactgaatttccattagatggggccactcatcctgaactacaagtggcactgagtatgcccatgctcacagcagctattcatcatagctaaattttcatcacagctaaaatgtggaagcaacccaagtgctcatggatgaatgaatgaataattaaaatgtggcacatacatagaataaaatattatttagccttaaaaaggaaggaaattcttacacatgctactacatagattagccttaagctaattgaaataagtcaatcgcaaaaagagaaatattatataattctacttacatgagacacttaagagtagtcaaaatcatagagacaggaagtagaatggtggctaccagggggtgggagaagagggaaatgaagagttcgtatttaatggacacagagtctccattttgcaagaaaaagagttttggagatggatggtgtgaaggttgcacattatcaatgtatttaacgctactcaactctacatttaaaaatgattaagatggtatattttatgttacctgtattttaccacaatttaaaaaaatgggaggtggaggaagagattctaagcagcttcctgtgtaaaggccagatcttggaactggaagttaggactgagccaccaatcatgaacggaatgaccactgggactgcacagaaatatattaatatgtcagccaaacccaagattcagaggctgagcagggatacgcaagacattgctttgaagtgttgattccttatcactcatcagtgaaaattcttaaacttggagcaacaatgaaatgcttcctgaacacaagaaaataaaacaacaaaataaagaacaaaacaagccctgaacatgcctgaaccaagaaagccaggatgtgagggtgatgagcatgagggtgtgggcatgggcggattgcatggggctgggagtgcacagcgggggagcctgaatgagcaggcagagggacctgtgggcgcttgcttttgcttccgggtcttcttcattatcatgggcccggggaatctgagagggtctcacagtgcccacagccttacccttatcccaggtgcaactgctgatcctccctgaaacaccagctcataagggcatcctcatgtggaccagaagcaatgacactggccgtgtgtcacagcttacagagcatcttcatgtgccacccaatcatctatgccctggtgggagtactatctccactcattttacagatgatgaaactgagactcagaccagtaaagctgtctgtccaaggaataaccagagggtagacttgcatccagactccaggctccaaggcccaaactctgcatctggcacctcatggtctcatgtctccggaataagtactcaatagccacagctgaggtgcctcatgcatcatgggcagccacagcccctgccccagtccccttgtctgatgaacacacatcatgatgccactctataaagaggaccgttgccagaaaggattaattcattaatgaatatgaggtctctggaaacccagaacgtgatgtaaatacccgtgctgtcaaagctgcctctctgttgcagaatgaaaagcaccaaaatccctccattgtccttggataatagctttgatttggggcagggcaggaggaaggagactctgtctgggggataaacaatgctgggatgttccaacatagcaggatttgcacacaggatccagcagagatggcgtgcttttctcaatattgtctgggatatcaaatgggaagactggaacagccaggggagatttggatgcctgagatctggagctgctggagctgaaggaattgatttccaactagatttctcacacgcctcgtgcttgggctggatggctgaaggtcagcccagctggcactgtcacctggagcacggacttagggtcttgccatggggtccaggcttctcaccgcatacagagtgagttctgaaggagaagatcttcaagggaacaagtgtcctaagagaccaccctcaaatgccatgtggttccaacttttctcaaggggaaggtacagttttagccagcccagacccaagggaagggatcagagacattcttgatgggaagagtgtcaaagatttgggggccatgttttaaagccatcacagggaaggacgtcagggtttggtataggattgagtttgaataccctagtcccagacacccaccccgtctctatgaggaagataatacagaacactccaacacttttttttcttttcatttttgagacagagtctccttctgtcacccaggttggagtgaagtggcgtgatcttggctcactgcaacctccacctcctgggttcaagtgattctcctgcctcagcctcctaagtagctggtactacagacacacatgaccatgccgggctaatttttgtatttttagaggagacaggatttcactatgtgggccaggctggtctcgaactcctgaccgcaaacgatccgcccgcctcagcctcccaaagtgctgggattgcagacttgagccaccgcacccagcccccaacactttgaattaaaccattttcatccttgaggcataagttttagggtccttaaggaacctaggtccttgcctttatttattgatgacaaaactgaagccacgagaggacacttgttatggccaatgtcacatgtctgctaagtgtcacagccagtgttcaaaaggaggctgctgactccaaatccaacactgactctttgctcccaggtctggctgctatagcagctgggctgcctcgttctttctaccaagatatggaatccatctttagagctgagtaaccagctgcaaaccagagccttccagcttctcttcctctaggagaagggcaaggaacagggcggcccagggatgtgtgctgtctagggaggctgtaggctggcagacaaataagagcagatcagctgacccccactccccccagggcgggtctatgatgggcaattggataaacacattcagaacaggatgaatgtgcagccgagcgtgagcacattttaaaatatacatttcacctccatatgcagatcccagtgacatgtgacaaatgtgctgtggcctccaggagctgttctccaaggaggcacttatttcatttgactccaagcatccaacctcaacagatggcagaattcagatgggtggcgggaagcaggcttcaattactgcaggaagactcaagttagacaatgggaagaactttccttctctggaacaccagcttttttcagcgactattttgcaatgtgatacacagactcaacatagacactttcacgtgaataaaagtgctctctgtagaaatggggggaaaaaaacctggttgatagaaacttagacttttagctcagactcccagattttctgcaatacactcattccacaaagggtgtcacccttgtgagcacttttggcttaaatgaaggctcagtgtctctttttggagagcagacaacatgttaaggacataaatatgtagatctgcgggtttacttgttttgttttttttttttgtttttttttttgagatggggtctcactatgttgaccagtctggtctcgaacttctggcctcaagcaatcctcccatcttggcctcccaaagggctgggattacaggcgtgagccaccatgcctgacctgaaatatgtagatttgaacttgaaaacctgagaactgaagccctgtaaccttttccaaactaatctgtgagacaggaaggggtttagaattatataaataagtcacctgcttgtgtgtcaggcacattttttctttttctgttgttgttgtgggggataacaccctttgtgagataaaactcacaaccatacaattatacaattcatccatttaaagtgtataatgcagtgaattatcgtatattcacatagttatgcagccatcattgtaagtcaattttagaaaatgttcattaccccaaaaagaaattccatacccttcacttccacacaaactctttgcctaggcaaccactaatcttctttccgtgtctatagacttacctattctgaacattgcaatacactagtctttcgtgtctgacttctttcccttatcatgttatttcaaggtttgtctatgttgcagcatgtatgccttcattcctttttattgtggaaaaagtgttcactgtatggatatgctatatttaatttatccgatcatcagctgatgggcatgtgggcggtttctattttggggtgatcatgaatactactgctatgagcattcatgtacaaggtttcctgtggatgtatgtcttcatttatcttggatatggacttagcagtggaattgctgagcatggaactgtacatttaacttcttgaggaactcccaaactgcttttcaaagaggctgaccatgttacactcacaacaacagtgtatgaggatccaattttttcacattctctccaacacttgttattatctgtctttttcatggtggccatcctactgggtggggaggtgcttcttttatgttatctcatttcatcttcagaacgctgccataagggcaggcactaccatcccaatgtacagatcacaatagtgaggctccaagaggttgagcctgtcaaggttgcaaagctggtaaagaggcataaagatgtgttgtcaggtttgcctgacacctctcccacttccctgtatcccagtccactctcaggcccgtcacgccacctgcatagccctctccatgtgtttatctttgtgttccacgtgtgactcattgctgagatggtcaggaatgacagcgactgaactttctatccaaactcaccttccttccctgagccttgagatggaaccatcccctcctggctgtgggcattccttctgtcaagggtgagagccagcccagactgccatgaaataaaccaacatgcttctcttccccaacccctccatcagtgcccagatccagccccactaggctccacctggctccatagctatttcacccacctcttggagcacatgaggctcttgcctggtccatcaatggcttcagggatctcccacatcagacttccaggaaatctccctttggttcaaaaaatcgtaatgaacaggaccctaaacaacctagcacctcctaagacccatgctgacatgggcccttggtcgtgagttgcatcattcagcctcctgctgaatgaggtcagcacctgctggacccacccatctcctgactcttccccttccccaccacacaggaagacaactgatgcagggagcatcagtgtcaggtgtgttgtatttatgtgacgcacacagttccctactctcccaccattgttcttcgatatatgacaaaactcccaatttgtcaaatgcttaacagcagtcaggaaaatgtattctccacacatccaccgagcttttcattttgcacaactgtcagcaagaacagtttacaaattttctgtcatggagattctgaaagaatggggaagaggggagaaacaccccccaccccaaccccttctgtgagtcacagcctcaacttgacagaagcccaggcagcagctgagactcccctgttacattacacgtcatcactctttgcatttaagcccattttccatgcagccatttctgaatgcatttctgtttccatcaaatccctccccatggtgtaaaagtaaatattagacagtgccctcctcctaaaagaccttgtatttcaagctcaaaaaagtctcctagagggactcagtagtagacagctgtctgctccacagatgccagccagcttccctggctgacatgcaacagattatcatgcaaacccagaagcctcaagcttttaagacattatatattgaaaatatacactgaatcatctttaacagaaaaaaaaaaactaaaaccaaccaaaatttccaaagagagacaatcgattaaataaattatgataacccccaaaatggaccatggtccaccatggaaagagtgtttctgtggtgtgggaatgtggttaggatatgttaactaaagcaagtttcaaaactgtatttacagtatgattcccatttagtaaatgtatgtatgtatatttatgcatagggggaaaaaagaccagatggatagacaccctaaatgttaacactcaagagattatctgctttttaaaaagatttttattttcatgtattttccacattttcttccatgaagcaaaaactttttttgaaaaagttgtttctgctcaacagtctattcatggaccattccaaaaactttaaacttggcagactgcggccagttgtacagtaaacataatttacagcccaatggctttctggcagtgagcactttttcattcacaccaggtgatgccatactgaacagcagctgtccatatgattttaatcacagtaacttttgaaaccacaacttgcagtgccccttattttgttccattaaaaagctgtcttttgaagctaatgagcaaattctctgagaactggaacctagcaaatgctgaatcactgggcgaatagcccgttaaatccatactagttatgcagctctttgaagacacacacagcttaggtaacttgaaacttccctctgagaatatataagatctctggttatcatatgtaaatgtaagtcaatgcctaacaagaaatgattatttgcaaataccttggctatgatctaagttgcagatctaatttgaggagtagcagagtgatcactttagcacagacctggaggctaagattaccctttacagggaaatcctgaatagggttgagacttcccaagagacagattctatgagctactcacaattacaactgtctaagctgaaagaaaatttcaacactaaatcccttagtctttccttttcctttctattcagtctcttctgttttatctcctttcctacccaccttgaatatttcttgagctatctctttaataatacttttagaatgtgctttcaaaacgtttgctttcagtccttcacaaccacttgaaggggaaaagaaggaaaaggacaaaaaaatatacatcccttgtgtatgagtttgctagagctgctataacaaagtaccatagactgggtggggggtgggggcttaacaataggaatttatcatcctattgttctagaaactgaaagtccaagatcaaggtgtcagcagggtggattcctttgaagggctgtgaaagaatctgttccatgcctctctcctagcttctggtggtttgctggcaatctctggtgtttcttggcttgcagaagcatcaccctgatctctgcattcaatttcacatagcattctccccaagtgcatggctctgtctaaacttcccctttttgtaaggacacctgtcacaatggatttgaacacccccaacacacacacctaatgaccttatcttaatttaactgcatgcacaatgaccgtatttccaaataaggtcatattctgagatcagagggttaggacttcaacatataattcaggtccatagtaccttgtaccaatccaaccacaactttctttgaacctatgccccaatcagggtcctgagcactgctggagaaaactgtacaatctccaagtgatagcgtgggttccagtgtcagccgagctaacactcctttgtcaccacccccttctattccccactgcagcttttttcaactttcaccatgctcctctattccctcaacttcaggaaatgatcttacctcctacttcacagaagcaaacagaggccatcccaaaagaatgttctgaccaccctgcaatgaattatttccctttacttgctgtgttagttcattttcatgctgctgataaggacatacctgagactgggcaatttacaaaagaaagaggtttaatgcacttacagttccacatggctggggaggcctcacaatcatggcagaaggcaaggaagagcaagtcacatcttacgtggataggtggtctcaggcaaagagagagcttgtatagaggaactctcggttttttttgttgttttcttttttttttttctattttttttttaattatactttaagttttagggtacatgtgcacattgtgcaggttagttacatatgtatacatgtgccatgctggtgtgctgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacacgaactcatcattttttatggctgcatagtattccatggtgtatatgtgccacaatttcttaatccagtctatcattgttggacatttcggttggttccaagtctttgctattgtgaataatgctgcaataaacatatgtgtgcatgtgtctttatagcagcatgatttatagtcatttgggtatatacccagtaatgggatggctgggtcaaatggtatttctagttctacatccctgaggaatcgccacagtgacttctacaatggttgaactggattacagtcccaccaacagtgtaaaagtgttcctatttctccacatcctctccagcacctgttgtttcctgactttttaatgatggccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaatgagatcccatttgtgaattttggcttttgttgccattgcttttggtgttttggacatgaagtccttgcccatgcctatgtcctgaatggtaatgcctaggttttctcctagggtttttatggttttaggtctaacgtttaaatctttaatccatcttgaattgatttttgtataaggcataaggaagggatccagtttcagctttctacatatggctagccagttttcccagcaccatttattaaatagggaatcctttccccattgcttgtttttctcaggtttgtcaaagatcagatagttgtagatatgcagcgttatttctgagggctctgttctgttccattgatctatatctctgttttggtaccagtaccatgctgttttggttactgtagccttgtagtatagtttgaagtcaggtagtgtgatgcctccagctttgttcttttgggttaggattgacttggcgatgcgggctcttttttggttccatatgaactttaaagtagttttttccaattctgtgaagaaaggcattggtagcttgatggggatggcattgaaactgtaaattaccttgggcagtatggccattttcacaatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagaatttgctgaagttgcttaacagcttaaggagattttgggctgagacaatggggttttctagatatacaatcatgtcatctgcaaacagggacaatttgacttcctcttttcctaattgaataccctttatttccttctcctgcctcattgccctggccagaacttccaacactatgttgaataggagtggtgagagagggcatccctgtcttgtgccagttttccaagggaatgcttccagtttttgcccattcagtatgatattggctgtgggtttgtcatagatagctcttattattttgaaatacctcccatcaatacctaatttattgagagtttttagcatgaagggttgttgaattttgtcaaaggctttttccgcatctattgagataatcatgtggtttttgtctttggctctgtttatatgctggattacatttattgatttgcgtatattgaaccagccttgcatcccagggatgaagcctacttgatcatggtggataagctttttgatgtgctgctggattcggtttgccagtattttattgaggatttttgcctcaatgttcatcaaggatattggtctaaaattctcttttttggttgtgtctctgcccggctttggtatcagaatgatgctggcctcataaaatgagttagggaggattccctctttttctgttgattggaatagcttcagaaggaatggtaccagttcctccttgtacctctggtagaattcagctgtgaatccatctggtcctggactctttttggttggtaaactattgattattgccacaatttcagatcctgttattggtctattcagagattcaacttcttcctggtttagtcttgggagggtgtatgtgttgaggagtttatccatttcttctagattttctagtttatttgcgtagaggtgtttgtagtactctctgatagtagtttgtatttctgtgggattggtggtgatatcccctttatcattttttattgcatctatttgattcttctctctttttttctttattagtcttgatagtggtctatcaattttgttgatcctttcaaaaaaccagctcctggattcattgattttttgaagggttttttgtatctctatttccttcagttctgctctgattttagttatttcttgccttctgctagcttttgaatgtgtttgctcttgcttttcttgttcttttaattgtgatgttagggtgtcaattttggatctttcctgctttctcttgtgggcatttagtgctagaaatttccctctacacactgctttgaatgcgtcccagagattctggtatgtcgtgtctttgttctcgttggtttcaaagaacatctttatttctgccttcatttcgttatgtacccaagtagtcattcaggagcaggttgttcagtttccatgtcgttgagcggctttgagtgagattcttaatcctgagttctagtttgattgcactgtggtctgagagatagtttgttataatttctgttcttttacatttgctgaggagtgctttacttccaactatgtggtcaattttggaataggtgtgttgtggtgctgaaaaaaatgtatattctgttgatttggggtggagagttctgtagatgtctattaggtccgcttggtgcagagctgagttcaattcctgggtatccttgttgactttctgtccgttgatctgtctaatgttgacaggggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaacttgccagtctgtgtcttttaattggagaatttagtccatttacatttaaagttagtatttttatatgtgaatttgatcctgtcattatgatgttagctggtgattttgctcgtaagttgatgcagtttcttcctagtctcgatggtctttacattttggcatgattttgcagcggctggtaccggttgctcctttccatgtttagcgcttccttcaggagctcttttagggcaggcctggtggtgacaaaatgtctcagcatttgcttgtctgtaaagtatttaatttctccttcacttatgaagcttagtttggctggatatgaaattctgggttgaaaattcttttctttaagaatgttgaatattggcccccactctcttctggcttgtagggtttctgctgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcattctctgtatttcctgaatctgaacgttggcctgccttgctagattggggaagttctcctggataatatcctgcagagtgttttccaacttggttccattctccctgtcactttcaggtacaccaatcagacgtagatttggtcttttcacatagtcccatatttcttggaggctttgctcatttctttttattcttttttctctaaacttcccttctcgcttcatttcattcatttcatctttcattgctgatgccctttcttccagttgatcacatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcatctgaagccttcttctctcagctcgtcaaagtcattctgcatccagctttgttccgttgctggtgaggaactgcgttcctttggaggaggagaggcgctctgcgttttagaatttccagtttttctgttctgttttttccccatctttgtggttttatctacttttggtctttgatgatggtgatgtacagatgggttttcggtgtggatgtcctttctgtttgttagttttccttctaacagacaggaccctcagctgcaggtctgttggaataccctgccttgtgaggtgtcagtgtgcccctgctggggggtgcctcccagttaggctgctcgggggtcaggggtcagggacccacttgaggaggcagtctgcctattctgagatctccagctgcgtgctgggagaaccactgctctcttcaaagctgtcagacagggacacttaagtctgtagaggttactgctgtctttttgtttgtctgtgccctgcccccagaggtggagcctacagaggcaggcaggcctcctagagctgtggtgggctccacccagttcgagcttcctggctgctttgtttacctaagcaagcctgggcaatggcgggcgcccctcccccagcctcgttgtcgccttgcagtttgatctcagactgctgtgctagcagtcagcgagattccgtgggcgtaggaccctccgagccaggtgtgggatataatctcgtggtttgctgttttttaagccggtctgaaaagcgcaatattcgggtgggagtgacccaattttccaggtgcgtcagtcacccctttctttgacttcgaaagggaactccctgaccccttgcacttcccaagtgaggcaatgcctcgccctgcttcggcttgcgcacggtgcgcgcacccactggcctgcgcccactgtctggcactccctagtgagataaacccggtacctcagatggaaatgcagaaaacacccgtcttctgcatcgctcacgctgggagctgtagaccggaggtgttcctattcggccatcttggctcctcccccgaaactttcgtttttaaaaccatcagatctcatgagacccattcactatcaggagaacagcatgggaaagacccacccccatgattcaatcatctcccaccaggtccctccctcaacaagtgggaattatgggagctgcaagatgagatttgggtggggacaaagagccaaaccatatcacctgcctcctttctttccccctctgccctgtcctaaagcaaggtgcatccttccccctgggctctagatcgcctgccctccagctcctcgggccttgcccacaccaattaccctcttgcttctgtcttcaacctccccatctccactggctcctttccattagcatttaaacatgtccaaatcttttccctcaagaacacccatagctcttatctccaggtctctccaacaacctcctgtccccaccacatagccaaattcatcaaaagagaaaaataagttatctccacttttcttgtcctcaacccattctatcagactcttgccatcacctgtggattgtaaattctcctgccatggattcctccattgccctcttaaggggccgcttggcaagcatacaatgccattgacctcatcctcctttaaatatggaattccttggcttctgagtgatcctatagcctctcagttttccttctggatttgctgtgctggccactccctagatgttcaatggttgcatttcttggcattgttttcaagctctttcccttctctttctgatctcatctagtactatgaattaaactactacctagatcctggtgactctcaaatgtctacttccagtctacttttttctcctaaattgcagatgcccacattcctctctaatattacatctcccatgggtgacctacatccaataatagttatgaaagagaacagctaatagcagtaggctgagtgatggacttaggaagggcaaagacccctttggcagggttaagaaaagcagaggtgaaatgagagaggtcaggacagtcacctgaagtatttcatagttctctaaaaagtactctcagattcaaatttccttgacactttgctaaccgttctgcacacctacatcctaaaggacagggctctccttaacatgaattaaatttgaatatgcctctaccttagaaaatatattgttcctctaccagtgtcctggcatatggagactgcctactgaaaatcatgggtatgacattgatttgtgtaatgctagctttggagtacatgtagctttttctctatggacttaaattttttttttttttgagacggagtctcactctgctgcccaggctggagtgcagtggcgccatctcggctcactgcaagctccacctcctgggttcatgccattctcctgcctcagcctcccgagtagctgggactacaggcacccgccaacatgccggctaattttttgtatttttagtagagacggggtttcaccttgttagccaggatggtctcaatctcctgacctcctgttccacccaccttgacttcccaaagtgctggcattacaggcatgagccaccgtgcccggccagacttaaattttaagggaggcatttacattaaattatacttcccacaatccactcagcttggtctttggctccattgttgggtggaattacaattgctagtacagtagctggatgttaaatagaagtcagtgtagaacaatagatgtcgaaataaaaaacaagattagaaacagaaaagttcatggcttcaaaatgcatgttagcctggggtaaaaaaactgcatggatcttacagaacatggagtccagcactgatacggacaggagatagggaaatactggtttgaagaaggcagttcccgggcaaaggccccccaccttcaagccaagaaacccacagccctcagtgagaacaggcattcctgtttttgcatccaaaaagttgccttttggcctgctatgtccccctatcttgcatccatataaaccctgaaccccaggctccagaaagaaatgcacggacgaatggcaaaatggggcagcagagaagaagagaaaagaaggaaaatcatcttcccactccattccccctctagctccccatccatcccacggagagccacctccaccactcaaaaagacccccacattcactctttaagtccatgtgcagcctcattcttcctagactccaaacaagaacccgggtgccaagagggcactgagctggttaactttagctgtctgcagattgcaaagccaaaagagcatgctgtaacatgcccgctgggcttcaggagtcgcagacacccacccttagagacaaccagggggccagaggccaaagtccttgccctggctcctaaacctgcctgtctgtgtgctccccctcccgtaaggggtttgagcttgtggcagctgaacagagaggcatacccctgtcacatgtcatgtgggggaagcagggaactctcctgtttcagcaccttcatttttaaaacaaggatactaaggtttagagagaatagttacactttctcaaggttaaactctacggaatgggatgaaatggtgatagaattcagtgcttattccatctccatgtgagaggcctgagggacatggcatcattctgctagggccttcgagttattggaatttttgcaaagcatgtcaacatcccacccggcagaaactctggcatattcacttcatccacgtgcttcttctgggaccccttgttttagccaactccatacccatacttcaggagactcctgattttcctgaactctgagtcctggacttgtgttcccacacccagccttggctcttctctcaggctaaccttagccccatttgctctgctagaatgtccctttctgttttcttcctcctttggttctactgcaaccagcctcaccaaacagtattctgctcatctgtctaggagctctgcaatacacctgagctcataccctgccacacctgccccagccccacgaaggaaaacaaaacaatagcaacaaacaaacaaacaaacaaaaaaaaaaaaccctgctgaactcagattctgattcagctagcatgaagccatgacttgtaccaggcactgtcctaggtgctggggtgaacactgtcatatttaacttaacctaccagcctttcatagaatcctgctctgtgaaatttgcacaggggccaaagggaaacaaggcattatttataataattggcttgccattatccattctgttggcgctgcctgcaacaacatgatggacctgtatgctattcacagtctataaaaaagtagttctgttgtgattcaacatatagtaatctccattttaagaggacaatagaaacactcagctgttattcatcccagagccttaaacggcagagaattcctttatcaggaacataaggttagaacagcatgagttattaacattgaaagtagcccaatgcatttattgaggtgctcaaactattgaaaaaaattaacgatttttaaaagtaaaaggctagacctcaagtagcactttgggagaagtgtgtcaaaggcacaaactattcagaactgcttaggttgaaatgaggatggggaaagagtcttggtccccataacccaactcagttctgaatgttctgaagagagtaaaggagaaacgccaggcatgttcagaaatccagatttgaggggccaggagtggtgggaaatatgggagcagctgcaaatcatagttaattaacaatcattagggatacatgcataacacattttgtattcagttagctatttatttatttattcacagccacattccacaaagggcttgaggcagcctacaatggcaaaatgcaaacaagcgtaaaaagtcaggactagcatatacggtgaggaacaccttggccagaagggcacacatctgtcagccctaagggactccagaggtaccacagtcaagttccaaatttggcttgaggcatcctggcagccaaagtgaaaaggagacagggtcaggtccaagcattctctttaacaagacactgttaaatgtctttctttcaaagcaggtaaaaagctgaacactgacacagcggccccacaaataactgcagaatcagtggtctgcaactgcagtaaaatggatgggacaagggacaatggcaaaggagttgggttctggagctgaaagtcctcactgtgaggtccagcttaacctctactagctccagggtcctggagaagatgtttaatttctctggggcacgttcttattatgcataaaccagagatttaaaaagacttaatttgctaagtcgtgtgtcagaaagaagaaaaatgaaagagggagaacgaataaaggaatgaataggtatgtactatgaagtgaattgaaacatatagagcacctagcatatgaaacataccagaaccttttctagtttttttttttctttaattctttctgtgaaattgagtctgggtagcagactgttcctccatctgagtggctgtttgtcagtctctgtcttccctctcccatcctctgcccctaccactctcttcaacctcaactccagaggtagctggggctatgccacatctcaatctcagaacaccagggcacagagaagtaaagagacccaagtgatggatgggtgggtgagtctataattctcagaggaacattattagaaacaacaagtggtgatgggcacaggatcaaccaacacaatgagagagaaaaacagtcaactcggagatcaggtaatcagtgattgataatctgataatggttgaacactcacaaggaagggccatatactgaaatgagtccatttattttacatattcctaccttgagtgcttgttcacaaatatgctttacctaatccattctgattttgatgaaaagttccattttgtagaaatggaacttttgtagaacatttctacaaaatggaacttttcatcaaaatcagaatggatgccagcaatccatccaaaaccagaatagagccagcaatactggctgtcttgatgctaaacacttttcgatatcagctaacagcatgagactaactatcgagcttttgtgttttcagtgaccgtatttttctaagccaaacatttaaaaaattcacataaaagtcaaattacttgtatatattttgaggctcatctagtttaagaaaaaaaagctatcaaaaactgaatatctcttggaaattctgagtcatacagccactgcattaagctacttggacaggtgatcttcccatttttcagatgattctccttaccttcaagcttaggtaagaagtctctgctctctgttccctttgaacttgcacacatctccattctaacacttaccactctacagctgagtttctgattagactaagaacccactggccacaggatgtctgccctattcagttgcatgtttccaaaatttgctcaataacaaccaaagggaactgttttgcaagcgtagaaaatcagttcttcagtacactactaaatgcagcaagctaccctccttttttctacattgccctctacactttttagcttctagacttctcatcctgccttgaccagccccagctaggcctctttagttgcaagattccaagaagtcagagaggacctacattcacagggcctgagccagctcggagaaacgggccccctgggagtagccacagagggtcaggtggaatccatcatggtgcatcagggctgagagttgaatctgtacaatagcccaggccatgggaggccttcctaaggcccgacttgaccactaaggatctgttacttcttgggtccccaatctagcagtgagagtgaaggaaattctcaggttccttggccaaaacctcaactctctgccttcagaatatgagcttaatgagaattccctggatgagaaccactgtcattcatttaaatcacagctacacattaccgtgaagccttatcacactgggcctctctgatctcctgtaaagggtcatcaatttctgtatcttttacttttttttgtctgaataatgaacatactgctgaaagcaatgcccgggatgaccgggcacatctaggagattctaaaagtgtgagtttcagatttttggtacgattttattttcttcatgcttaaagtctcataaaattctggatccatttaatcatactacctaatcatatgtttatcatgaaaagtagcactaatgtggtaggcagactgtttttccatgtttctttctttctttctattttattttattttttatttttttaagagatagggtctctttcacctaggctagagcttattgcagcctcgcacacctgggatcaaacaaccctcttgcctcaacctcccatgcccatgtagctgggactacaggtatatgctaccacacccagctaatttttttaatttttttgtagagatgaggtctcactgtgttacctaggttggtcttgaactcctggcatcaagcaatctttctgccttggcctcccaaagcactggggttacaggcatgagccaccatgcctggccccatgtcctgtttctaaactaataattagcaaggtaaggcaaaaacggtccttttacctgtatttgagctcacatctacggaggcttcaacagaacaattccatgtcctatttttggaagaaagctccaatttctagccctagttttcagtgttgtggagtagttttatttcctgtctttcgtattttttttttaaaaaaagcttctccaacattttagttgcaatctgagacagtctgtttcagagacaaaattttacagccagatgctccagtgtgagccgctgcagtttgtttctaaggatgatcagtaacgaatggggaatgcttgtcatttgctcaaatattgtgaagtcttgtcttttcttgggcacatgcacacttttataggcaaggtttcatccatccgtaatgcctgctgggacaactgggagaacaggtcagtcatttgcagaaacagacctaaaaccctaaggcctaggagccatcacagcccccaccccatctggacattaacaagacacacagggtggggaaagaaggcaaatgggagtgcagtggagtcaggagataggcaactctgggcctccacttccgtgggggattttaataatctccctggagtcacagtgggttgttataaggaggcagagggaaggtaggatggttctgatacagaaaatagctcctcagtgggacaggggagatgacagcagagaagctttcaaccacctttttttttgtgatgccacaagtctctgcagctcacctgtatagcgctattgctctattccacgtgacaaaacatgagtcacctgctcaattagtttcattcagtccattatccctatagctagggagagctctctcccataaactggcaaatcattgttcaatatatttaatcttaatatggttgatccttccttttctttctttttacctctcttcctctctccatccttcttattcatccatccacctatctatccatccatttacctgaaggtatgttgaccatctactttgtgtcaggtactattccaagcacttaatatacaatatctgattaaattttaacaataccctggaagttagctcttaatattctttatgaatattatatgaggtttagagagtttatgtgtcttgtccaagattcagcaaaattcagcccatgggctaaattcaacctatttttgtaaataaagtttagttggaacatatccatgcccatttgtttacgtatgacacaatttcagcagagtggagtagttacaacagagaccatttggtccacaaatgctaacatatttactaactggcccttaactgaaaaagtttgccaacccctgttcttgcccagtaatacttagcaagaaagtagcagagtcaaagattcaaacccagatctatttaactcaaaaggccataattcttcaatgctgtgtcatgcaacagaagtatgtgagttttgtctacatgacttcttgacacctagggtgagatggccaggctagatttatggtaagaggaacagatctgacatatattacttagtaagtagccaattactgtggaagactctcttcatttgtaagaaaagccagtgaggatgctttttttttttttcctggtgaagtaattatagagacgagtgttgatgcatgttttgactttgctgcaaaagtagttctgtcttctccagtttaagtaattacattagtttctaaatagagcagatggaactatagttgtcaaagaatgcaaagatcagtcaactgcatttatggtgtgacattctaagcagagataccgcaaagtatcttgtgcaaaaccaactaggtgagtgctattgagcacctgtgagccagaagaaaacaggagaaaaatgtggctaaatggaaatggaaatttctacacaatgggatctggtggcaaacacattttcctaccataatgccccaacaattgcttgttttctaatgttgcctggttgggggaagatatattctgagtgttcctccaaacttgtagaactcaatttttctgggggagagggttgtcctaagatggtctgcttggtactcagagtgcaaagatgtctcctgcaagaagcaagcagcttatgaaggaagcaatgacttaaagcagacacgttacctctaaagaacagggagaagatcaaatccagaaccaggcagtagtaataagggaactgacctggcaataggccaaggatccaaacgacatgggaaccaggcatgattcaaaacagccactgctgaacacctacaccaatggggggaaaaatgatactcttagcgttagagtccacaactgctacagagtctcagctgtgatttctactgccgggtgtccccatagaagtctgcatcccaacccctgagacctgtgaatatgttaccttacttagcaaaagggactttgcagatataattaagctaaagatcttgagatggggagattattcttcattttttgggtgggctcagtgtaatcacaagtgtccttgtaaatgaaagtgggaggtaagagggtcagagtcagagagagatgtcaagatgctacactgctacctttgaagatagaggaaggggccatgagccaagcagtgcagacagcttctaggagctagaaaaagtcagccgacagattctgtcccagaacctctagaaccaacacatccaggcaacaccttgattttagcccagtgaaacccatttcagacatctgactcccagaaggccagaagataataaatttgtgtggtttcaagccactatgtctatggtaatttgttatagcagcaatgataaactaatacaacagccctgacttggggggagggtaaaggaaagagccacacaccaccaccctctcaccatgggaggaatagttgaaatgaacacatgacttcaggtccccaacaaagagctgaatgggtttcaggctagcttgctaattcattcaccaattctcagctctggtgttgcttgattcagaaggtaaagacaatttttaaatttccttaatttcaaaacttaattcatccaatgcatttaatttaaaatcatacattatttatccacaaatcctgatacacagggaaagaaacagaaatatttgctggacaggtggcatggaaacaaagggttattagcgattgccatgcaggcctaagtgaattcacaatgaccatcatgacatcatgtctgttgttactatcaagagcgttgctcttggataagtatcaataacctcagaactatggaaagaaccatgtgtggagtttggcaccacagatattctctgagtgattgaagtctcttctaccatggtgagtggtaccatggaagtaatcttgtccccaggcctcctaagcttacttatgatgaagtgatgagactcttacccaagaaaccattacagaaaaaaaaatcctcgcctaataaaattgtgccagtgaacaaactctcagatatatggccatattgacaagatctgcaatggtatcaaaagaggtcaagctaataacctgaggaaacaggaagaaaactccaattgtcttatacagaaggtctacaatcaataggatgaagtctaacactggcgagagtggggtgagatggatgaacttctctaccacctggtgatgaaatacattgggattctatgaaaaagcatttttttctaaactcaatttccatattaattttagagctatatgtaattagttaaaaatgttcctgaagacttaaatcaagataatcttttagaagtaacaaaatgatctacacatgaaaatactcaattcagcttcacatattgccacatgttatgttccctgagaagcagactctgagagtttagcatgtagatgttttaagtggtttccgtggggtcaacagctatgcagaataggggaagttagcaggaatggggcagaaatagaagtcaagctgtgaggtaggcccaataacatcttcagctaacctgctggggagctctaaggctggaatgtgagttgtcctgttttggggatgaaatggtaaaacatttaaactcttgattctctgagtcagtgaacattggctgccccaggaaggagcccaatcttgggcaaggcaactctctaaagctgaggggattcttgaagaagcttgtgtaaatgaatgaatgaatgaatgaatgcaagcttgtgcaaggttaacccagtggacttggggtactcaaactctgcacattttaaagagaagactggccccttgaccatcctgggagataacctataagcctttggaatacctagcctgatacaaatgtctttgtgtatctggggtcttgggatatgccagatagtttatgcaaacaatgtgatttatggtgaatgcctgtttttgttcacctggggccctggtcatgctgtattggttggacgccggagactgagcagtcatggaggtaccccaggcctatgtgactagcccccagtagaaaccctagagaccaaagctcaggtgagcttccttgttggcaatccttcctatgcattgtcacacactgttgctgagaggatgaagcattgctggcacaaccccaagatcacacatgctttctcctatgctgtttttgttgttgttgttgttttgtttttttgtttttgagacggagtctcactctgtcgcccaggctgcagtgcagtggtgcgatcttggctcactgcaatctctgcctcctgcattccagcgattctcctgcctcagcctccttaatagctgggattacaggcctggctaatttttgcatttttagtagagatgggatttcaccatattggttaggctggtctcgaactcctgactttgtgatccactcacctcgacctcccaaagtgctggggttacaggcgtgagccaccacacccggccactatcctatgcttcttttaaaaccagccgttcactgttaatctgtattcttttactatattatctatatttactatgtttactaatttttactgtattactaattttatatattatactaaatttatgtaatattactaattttactatattttactatatttattaatatttactatattaatatatatcttttactatattaaactggaacatgagtatagcagctttcctgagttctgtgagtccttttataaatcatcaagcctaaggatggtctcagggacccctgacatagggctagcacttaagagcagcctgctagctgtagtctcagcagctagggtaacaaatcctttcttgaagggatagccaggtggcacatcacagtatgtacctataaaagctagaaacaagtgaaatattcataaataggacatctatttggcaaagtagaagttaggaagtacccagccaagctctgcctcatggaataagagtgctttttgagaatgattccaatatctatcttcatttgctatacatatggagaaaacagtcctctcagtttggggagaaactctgaattattcttaaagaatctctggttatcccctctagcttacactgaacattctaggtccttgagaagatcctcatttcaaaggcaatagaaaccatctgaaattgattcattggaaaatgtatatgctattaacaccagagagcagaagtagactggctaaaatatagcaacttgaaatatattttatgtactggaatttgatcaaatagatggataacttctggaatgatgacagcaaacaatctttggaaaaacacatgactgtgcttggagaacggtatcatagtttttaagaaatgtacactgcatagctagatagcatagcagtgtccatttaaaccccaatctaacacttcgttgtaagttgacagtaggagaaaatggttattagaatatggtttgacaggccaggagctatggctcacacctgtaatcccagcactttgggaggctgaggcaggaagatcacttgaggccaggagttcgagacagtgcaaaacctcattgtctttacttaaaatacaaaaattagctgagtgtggtagcacacgcctgtaatcccagctactctggtggctgaggcacgagaattgcttgtacctgggaggtggaggtcacagtgagctgtaattacaccactgccctccagcctgggcaacacagcaagactctgaaaatatatatatatatatatatatatatatatatataataaaatattaatatattataataatataatttattatatataattatctataatatattataatataattattatatataatataatatataattatatataatatattataataatataatataatatataattatatataatatattataatatattatatattatattatatatattatatatatataatatatatataatatatatattatatatattatatatatattataaatatataatatatatataatatatatataatataataatatatatattataataatataatatattatatatataattatatataatattatatatatggtttgatgggttacttgataactgccaattcagtcttgagatgaggaacaaaactgaaatatgaaacatgactggtctggtagaccacaggactgcttctggtccaccgactgtgaacgttaatgatgtgtgttcattgctgggttgaggtaagtatgagttggtgcactaccccctatttctctctttctttgtcacagaggccttgaaagctccatgatagagatgacagagctataagatgaaagcagcccaaatccctgagtcaccaatgtttgaagaagagcttcccaggagaggtaccagacccacatgagacttcacatgattataaaatgaacttctattgtgttgaatctctgaacttcagggttgttttgcagcacagactacattatagtgacaagtagaggaaggtacaggcatgctaatttcattttaaaattaatcaaggattgtcaatggaaaataaagatttcagattccttgcaccttaaaaaagacgaaaaatatgtcttttttcttccccaacccctgcttatgtgaagcattatagtctaatagctggcattttagagagatgaaaaagatgagtttgcttcaaaatgtatatatgaccagactgtaaattcacatgcaacgcagtctgctttgggagttaaacatattatttaaacaaatcattataacttgacttattatacctcaatttgattataaaacaaacattaaagtgaaatctaaggtaagtcttttttatttccagttccaaagccatttccatttcttacttatctttgaatcctcagccccaagcacagtgcctgaaacacagcaggtatccacaatctttggatgactgaatgaaaaggaaagtttaaagtcaattacctttaatcttgcttgtggtttctcagagctaatttgaacactagatggagaaatactgaaaaaaaatatttttcagaaaggcaagcatcctcttggtctgagaggtttcataacaagttaattttattttaaatcagtatgaatggatggatgataaactttggaaagtcacacttagaactacattgaaaacaaatgaatgtgtccccagatgaaaaataataactatgtaaataaaatttgaaataaccacttgatagcaaagagaactccagtatcaagaaatattttaaattccatgcaatggttaattatattcctgaaatctatgcacaaaagggcaaaattgaagaaaaaaaagaatataggttaagatgaaattcgtgaacaagaacctgaaaaatataataggcaacaatgtgctgcatttccacatttaagaggctttaacatccatatttttctcccatgtgcaattacatgaacttataatccttgaaaaattgttattatttttgttgctaaaactgcttgtaataggagtcacagatatgtgtagtaatatgctcagatgattacatttgaacaaataccatggtaataattctcatatttggaaatgctagaatctgaattacacatacagtttgtggcatctcttttttgaagccttagattttattttattttttgttttaagaccaagtaaaaatccaactttcagctaatggaattctaggtctagttggtagaacgagatccagatggagttcaaaacacctgctgaatagtatctgtaaactgccagcttgatatcgtcaccaagaattctgcaagctgagtgtccacattggaatcttaaggacttgcatacagtgtagttatatataactcataagaactaattattaactactagactgtgaggactctttctttggcttttaaggaaagtcaccgagttaatgctgaatatatttctaaaaaattgtacttatgaaattaatagagttgaccgacaatttgaataatattaggctacagtaacctcgaacttgattactcttatacatggtaaaacaatccagaaatcctggggaagggttgtttattatggctgcatggaggttgcccaagccctggcattcttttacagtttcaagggagggcaaaagtctgaagtgggtagggactgagccatacttaataatttaaacttagtatcatggaacaattcacacccgttacatacaagttaaataaccttcatgctgtgttgcaaactgctcttcctgctatacttcaaacagatagaatcattttacaaaataaaattaccaaaatgaggatatacttcataaaactgttcaagggagaagcaaacctttggtgaagagtgtgatataatcaccaatggctttaagaatgccattgggaggatcttaaaatggagatgggccagatgcagtggctcacacctgtaatcccaacactttggaggctgaggtgggggcatcacttgagatcaggagtttgagaccagcctggccaacacggtaaaacactgtctctactaaaaatacaaaaattagctgggcatggtgacgcatgcttgtaatcttagctactcaggaggctgaggcaggagaattgcttgaattcaggaggtggaggttgcagtgagccgagatcacaccactgcactccagcctgggtgacagagtgagactccaactcaaaaataattaattaattaatcaattaattaaaataaaatggagatgaaggatggaagtgatggtgagatgtgcaagttccagcatgtgtggatctgatggcttttgaaagtatcaactgtagggattctatcatattcttacaggaacctaacagtgttgatatatatgatgaaatatagcactcaaaccttcatggaagatggtgcctctgactctggagggatacaatgaggagagagagcacacagccatagtcgaggtctccaagtctatcatgcatcagcatcaccaagagggtttcctaagatttagattgctggatgccacccccagagtttctgattccataggtttaagtgaggacctaataatttgcattttcaacaagttatcaggttattctgacactgctggtcagggaactatgctttgagaattactggtctacgtgtttcacttagaagccagaatggttcaccactgtctccttctcactgggctaaaaatccaaagtcctaaccattgccagcaaggatctatgtgatctgggccttaacaatctttctgacatcatctcctgccagtctccttgttgctagcaccactcaaggctcattgtcctccttgctgatccttacatatgccaagcttgttcccccctcacatcctttgcaattgctgcttgctccctcaacccagaatggggttcctgcagatcttcaaagggcttgctatctcacttcattcagttctttgtgcagagaagctttccataaccatcctacttaaaatcgctcttctccacagttcccctttcattactgtctgtcccttccctgaaaatttttcatatcattttcacctgaagaataatatttatttaccgattgtcagctcctctaagaacagggacttggtttgattcactgctgagttcccagtgcataagaaagtatctgacacacagtaggcattcaatacaaatttgttaaagaaaaggatgaataattgattgaataaataattttaagaaagagcaactgcaaatatattagccagcctccaaactgacaaagctaagagggtaaaggtctgagatttaaaaatcaaacttgcatctatgaaaacactctataaataagaatgtacactatatgagagaatttctgttatacataaagaagggtgaattgtatctactcacaggagccaattgtgcacatctcttcccaacccaatattcaataactttacactgatagggagaaatcagtcacagtaggaatatttacacccaggaaattggcaaacattacaattcaaggcttatttttatcagcacactactgattctatccatagataaacacattccattactcagtttgatagcctcacccatgtacctgtcacccagaccagaggtgagacaggtttgttgccaattaaaggagggaaaatgggacatctcagtataacagattgggatagactgggaagcttatctaaatcttacttcaggatgtccatttagcggggctgaacatctactttgccctgcctgagcggtcgaaacataaaacaggtggacatggggatgtgtgcttttgaagatactcacccttcgctcctgctctacatgtattatggggaaactgatcctaatcttgagtctatggatagaatatatgactcatattattcaagtctaaagttgggcccaacaatggattttcagttacacaagtccataaaatctccctctgtcttacttatgactaaatgaatcctgactatgctgtgcttttttaaaagcaggatataaaatagtacaaacccaagtttgagcacaagtaaatcaaatacatactcaagccacaagtgacagaatggaataagcaccgaaccagtaaaatttctttatttttttgttggtagttgtacaaatctattctttgtctaaacatttttgcttaaattttagtcacattgtttctgcaattaaaaaatccataatatataggttgaatttcaattttcttctctgtttataaactgttttcccacacattagaaagatgtctaagataaacccatgaattaatggagaattaaaatggcagagccaatttaaataccacatatttaaacaaacactagaaaaaaaatctcttgcaacagagattgctatagcacattaattataaggtttcagatagatttttgtaactcaaacataaattttaaagaaccttcccatttgtttctttaagttattaatgtctccaatagaaggacaagttgacctttaaatctgaaccagctcagaaaaaggcccaaatgcacacttgacctcttctacaaggagcctattttagtcacaatacaattttacccactcacaggtgctctgtagcagcctgacagtggcatttacatttttttttaaataagctaagaaataatagaacaaggaacactggtagtcacttgctttaattgtaactttgggcctctgttctgtcttatcacccattttagctgacgaatgcacttcctcattccctgttttcctcgtggtaaagtaagaaacttgaatttgaaaccagagccctgagtctcctatgccctggccatccactgcctttgcatgcagcctctgttctggccctgaatccgctctctccgcaattcccagagcattccttgggtctcaactctaaggaagcatattcctttcacgaatcattttgtaggggacacaggagggtacattcccctagcacagcctacagcatttcactaaaaagcacccagagaactttccctaaagtctcctccttagcccacagtcttctgggctttccaagctttcccactttttctcttcttgatgtccctgtctgttatattgctcctaaatttcaggacactaggagacacaaaccaatcaaaagatttcacatgctcttttaggtattataattcagtgtttacaaattatctagacattaattagatccctctcttctaccttcctggtaatcttactccattctttccaggcacctgtctttttactctggccatggtccgtcagcatttcaaattgtctacgccgcttctgctttacaaaataaccagaaaatccctctccccccaacccgaatgaagctgggaattttaacctgccatctgtcagcagctatggacctatatgatatctccttttgacagccaaacatcataaaagtgttgtctacacagatggagttcattctttacctgctacaatctggtttctgcccataccacacctctgtacctgccctcaccaagtctaacaagttcttaatcaaatgggcatgttgcaccttgtgttacttgaaccaacgtgaagtgtaaatcccacacattagaatattagagatttcataagcaccagtaaaatttatttttttattggtagttatatgaatctattctttgtctatacatttttgcttacattttagtcacattgtttggtataaagagtgtaacactagttaccattcactgggaacttcattcactgggcaccaatctttaagtatagagacttctttaaaaaaaaaaaatttttttgagacagtgtcttgctttgtcgcccaggctggatggaagtggcatgatcttggctcactgcaacctttggattcaagtgattctcgtgcctcaggttcccgagtagctgggattagaggtgtgcattaccatgcccagctaatttttttatttttagcagagataggttttcaccatgttggccaggctggtctcgaactcctgaccaccgcctcagcctcccaaagtgctaggattacctgccatgccacccagcgagaatcttctctaatcaacacaagtattgaaaataagcattgggaaaaaaatgtctagagatgtttgaaattagtggaagacttaaatctacattgaggatcaccattcagcttgcctgggctgcctctgtgtcagtcagattttgctttctagctggaaaccacccttactccatctgggaatttgaaatgtggattgttcctcgggccccaccattaatgacaacacaaacacatatttttacatgattttaatcattgtgtatgttcaatggtgtctcctggcttatttatttagcattatatcataagcatgtttaaggttgcccaatagcatctataattaccattttaattgctgcataatattccactaagtggatggtcatgatttactaagccattaccatagtgttgggaatttaggttgcttccaatttttgctaccataaattgccctgcatatagcattttcctaggtttgaattaattctttaggataatttctccagcattgattgctggtttaaagagcatgagccatttttaagacctttcatacacatttcctattccttccaaaaggactgtgctaatctgtcactagcgatgtgtgagaggccttcctaagggtaattgcatgaactgataaagtgtgcactgagaacagcctggaaccctggatgaataagcagcagtgagagctgagagtataggatatattgaagaattataggtctgcaagaattgtctttgatgggggctttatacattctctctgtctcctcgctccctcgcctgaaaatcatttacagagtcattaatgagggtctctatcataggtcaggcatcagcttttctgtaaaccaaagcctacagactttggaaaagtccctctaagtctgtgatccacacaaacactgtgagtatgctttgccatcactgggagccagattaaggctgaatgtaattctttccagtggacccagagaacttgcaaatggcttggatgagccatttatgactgatattccctggaaaagaacctaagcagttggaataagcagccacagagaccaagagtggtaaagagaggcaaggcaaaggctagagaggcatgatatgatacctccatgcccaggcaagacctggtgtcgacagagggagcaatgcttggagcctgaagtcccagtttccagtcccagctctatcttgactatgcagcctcatactgacttctaagcgtcttagagtgccctcttccaagaggacccagatacctgtctcacaggctaacatggagctgagatgggagagcatagagcttgctttgaaagatgcagggaactacaaggttattaaatccaactcagcaaccagactgtttacaccagcagtgtgcctgtccagataatattgaatatgtctgggaattcagcctggggagacaagtgagtgccaaatggtctgtttctgcaaggctgccactaagaagaggattcacacactcctggaaacccttcagagcagttcaggttattgggccaaagctagagggccttgggtgtgggctcagaattagattttctgcatattaatgatcattctttcacatcacactatatgaatgacttccaactatttccaagttattttccaactgactgagaaagctctgatccttactagttgtgggacgttgacagagttatggacctccctgagtctcagtgacttatttgttaaatggagataaaaatgcctacatttggagtaagatagggaatagtaataatcttgatggtgacaacaatgataataatgtgaataataatgtgaatctgtagagttaatacaatgtgctcactctgagctaaactaaggactgtatgtacattatcccacctaatcctcataacagcctccggaggtaggaacattaaatacctgagatcaatgaggtacccagtgagtggtaactagtattacactctttaataccaataattcccaaggaagaataacctaattagttagtgggagagcaggattgttgaaatgagtattgcctcaaggattaaccccactttgggaggttaatgtaaaaaaccaaagtgatattgattgtgttaatgaatacatttagtgctctccttggatctgtatttgacttgtaattgggtagtttcctcccactttgactctgggcttggccacatgacttgttttggccaatgggacaacagcaaactgtgggcaagtggatgcttgaaaaagtgcttgtgcatttctgcttcttctcttggatccctacttcttccacgagaagacaccccaaggccaggctagcttattgaatgtcagaccaggtggaccaaagtggagtcacccagctgaagccacctgagaccatctagttccagctgacctgctagttaatccaagatgcacattgagtattgttacgcagcattattatggcaatagctgactgatgcaaccagttccattacttcacacatactattttcttcatacatgctgataacacctggtgaataagcattttgccaaaattctacatggattgtatcatttattccttatacaaaaacccatgaggtacatgctgttattacccttactttattttatttatttattttttgagagagggtcttgttctgtcacctaggctggagtgcagtggtgcaatcacagctcactgcagcctcaacctcccaggttcaagtgattctcctgtcctcagcctcctgagtagctaggactacaggtacatgcctccacactcagctatttttttttaattgagacaaggttttgctacgttgcccatgctggtctcaagctcctgggctcaagcaatcctcccaacttggcctcctaaagcactgggatcacaggtgtgagccaccatgcccagctaccttcactttcaagatgaaaatataaggtgcaaaaatttaaataccttacccaagcttacagttagtgatgggcaagcatttcaagctgggcagctcagcttcagagcctccgccacaaccactatgcattgctttgtgcacactataagagagctcctcataccaagctgctttatacgactggttgcaaccctccccttgcctgagcataatgcctctatggacctcccttttcagccaggccaggcatcatgaatcaagagctggctgccttcctctctgagcttatggctccttctccttctttgacaaggtgctctgggaagagagaacaccatcaggaaagaaagccttctagcaaacacaagatccacagattgaaggagtgaagtgctcttcatgatgcagtgctcttaaaatccaggctgtgtgatgggcctgaagagacccgcagaaaaccaagggggccctaactgcactcttgccacttctcagtaaagtcccaagaatcccaatctgcaactgagccttcaacaggctgtgcaggtttacagccctgttctcatccaggcctcattgtctctgtcacctggacctttgtgacagcctcctcttagggcctgcagcctccagactcaccttttctaatccgccttacactccaaaccagagagacttcccaaaacacatgtcactctctgcttaaagctctgcaatgtgtccctgagatgaaatacctgaaaacatcatccaagtcccctcccaatttatcagtacagccttccaggtcttgggcactgatcttcatgtttccaaagcagagtacagggctttcctttgtctatgttcatgccccttctcttatcaatatgctcttcatcactaggttaggctcttacctgtgcatcttgtatttgggcacagatacaggggacaggggctataggatgcaatgaagaataaggtgttttgcatggagggtaatgaccctgggtcttcctcatctctggtcatgagccctcaaagtccagagactcagcaaagtggtcttcagtgtaaccccagagcctggccccaggagcactcagggactttctgggaggtaggctgtgagtaaggagctccagattcatacacattaaggtaaagacctgggataatgatcagcaattcatttacattgccttaatcacaacacttagtccttaagcaataacttatattcatatgtattgcacagattactaagtatgtgctcttccatttctcattgaaggtacagtaaaagccttgccatcactcccattatacagaggaagaaactgagacctagagaagttcagaaccttgctacatcaatcagaagtacaagccaaggctcatgaagtggtttccttattttctcaccccaagttagtaagtctgtaacttctccttcacagtgcaatttgtcacgcagtctatggcactgtagaatttggctatagatccctaagtcagaaaagtccatgtttggagaactactagtaagtcaagacagaggagtgtgacaaaggctgacaaaaccctacctgcagcctggaggtcacaggcagcctgctttttgagtctccctgaatggaggggaaggggctctccctgagggaatgtgctcaactctgggtcgtgtggaagagttaggaagttaacactccatgagcgaccctcatccaatgtcggctgggaatgggtggataaataccctaactttctaaggtatatgtgtgtccagcagggcctccagtggggatgaaccacagttggccacaatggtaacctgcccattaacacacccttcattggtctttattcccttccctgagccttcactgtgttttcagggatcacctccgaaggaaatgacttacacccaaatcaggatctgtttttgagggaacccaacataacacatggagagatgggtttcctatgaagaaggaaatatgggctgtaaaataccacggagagtcagagtaagtacaggcggctacaacaaagatagatcaggtcacggaggtctctgggaatagaggaaagccacccagaggaaaaaaggacatgactgccactagcaccatatgtatgtttcagatgggatgtgtatttatgtgtgtgtgtgtgtgtgtgtgtgtgtgtgtgtgtgtgtagggaggggtgacagagagagagaggcagaataaatatcttggtcattggttacaagccaacaaaactgaagtgatgaaactcagtgagttttatagaaatgtgctggagatgcttcaattactttctcaataggtctattttgataactgaatgaaaagaatccatgtgaagcacctaccactcttcctggcttgtagtgaacacacaaaaagaattgttgattattgtagtagacactgtagtgtacctcctagattctccttacccagccactatacccatccccattgctgtgaggtcaggtgcccaggaatcacagcatcccacccacccttcccttgctccaggcaatgccctcaactggtaggtgtcactttgcccagaaactaccattcttctccaggggacccacggccaagggcaaactggcataggctatgcaaggctggcccctggcagaatgtatgtggaaggggcaactcttcagtgtgctttatggaccatggaccaaatccagctctccatttgcttttgtaaattgttattggaacacagccaccccattcctttttgaattgtccatggctgctttcctgctacaacagaagttgagttattgcaacagaggtcgtctgggccacaagatctaaagtatttactctggcccttgatggaagaaacttgtccaccgagccctagagctgcacttccaatatggtagccattggccatatgtggatatttcaatttaaattcattaaaattaaataaaattaatatttcagttcttcaactccaaaaattacattttgagtactcagtagccatgagtcgctggtgactctcctatcagcccagatacagaacactgccatcttcacaggaagttctgttggatggtgctgcactataggcttcagcttctgggtaaaactaaggggatacttaacctgaccacattctgactcaaccccacccacatccctccctcctcaacaggttcctccctcaataaatcacatgtacctgttctcctatctcaggctctatatctagagatcccaacctaagacagcctttttttttttttttttttttttttttttttgagatggagtttgctctgtcgctcaggctgcagtgcagtggcgtgaacgtggttcactgcagccttaatctactgggctcgagcaatccttccacttcagcctcctgagtagctgggactacagggtgtgttaccatggccagctactttttaaaaattgttttgtagagatggggtctcactatgttgtcagggctggtctccaactcctgggctcaagtgacccctcccaccctggcctccaatgtgttgggattacaggtgtgaaccaccatgcccagcctccaatgactaagatagttatgatatgcttgtattgcatccccaggttcatatctttgccattcttgtgatgagagtgtgggctactaagacacaggggaggatgccaggttcacctctaaatctccagtctccactacagtgtctgtcacagagcagcattcagtaaataatacatgaataaataaagtaaataaatggtcccctcatatgctgtacccctggtgtcccgtcaacagcccagagctcctcttaatccattcccactgcacgtttcaggttcaatttctcagacattcactttacccggaagtccagctgtgacagctaatagatgaaaccatccaatttgcaagttcccctgagtctctgctgtaaaatcagcctgatcctcaggaagttccacacctaggtctccactctcagccctatgacctcacctccacagactctgcacttgagcattccaccctcagcgcttgtgaaaggagtcatgggagacacaaggctggaggatgtgtctgcatcttcagaaacccgctaacagggacagcgtctgtgataccggctgacgctcattaaaccaaggctctagtagcctgttcctctcagatttcagaactaaaagaacagtctggttatcctgacttcttcttttatcataagatgctgcaagtcgaatctacagcagtcagggttaagagaaatcattaagtaataacaaagtcaggagtttcttctctgaggtaagctttgctggaaatttctcgtccctactcaagatggcaaccaaggacactttggagatagcagcttagaaatggccctgaagtgggtctttccttagactttaggtgaaaacactttcccctgatcctctggggaaacggctcccctgaggttgtctggggtttttacagagctcttctaaagaccctgggccttggggcatgctgtttaatttactgggttattggctgtcatattgaagacaaatgcatccaaggaaaaaatggctcaagaagaacagactcctccatcacttcaatcaaggggtccttcacgaacatgcttcattaacagcaaaaagggctgttggggtgctttgtccttactctacatccccctctcagctctgcaagactactgctgtcctcccagcaaaccaagcccggcagagagagaagccatcacaggaacacagttggcctcagcagcctgatgctctcaaggaatgtgttgaatcactacacagataatcagaaggcagctgctaaggttcagaagagaaacagcaggttctatcattaagtgagaagctgcccacatgaagagttgccctaggcccccgaatgtgactaaaacacagcccaagaaggccgctacagctgcaattccatgcctgtgctgaggcccctgcgtgtctagcgccactgtactcttcgactccaaggtgtaccattcatgtggaaggctatgtaaatcatgcttcttggagggaggccaggccacagccctgcaggtgggcacatcctgtatcagtccattctcatgttactgataaagacatacctaagagtgggtaatttctaaaggaaaggggatttttttttttggtgtcgttgttttttttttttttttttgacagagtctggctctgtcgcccaggctggagtgcagtggtgtaatctcagctcactgcaagctctgcctcccgggttcatgccattctcctgcctcagcctcccgagtagctgggactacaggcacctgccaccatgcctggctaattttttctattttttagtagagatggggtttcaccgtgttagccaggatggtctcaatctcatgaccttgtgatccgcccacctcggcctcccaaagtgctaggattacaggcctgagccactgtgcccggccaaggaaagaggtttaatggactcacagttccacgtggctggggaggcctcacaattatgtcagaaggcaaggaggagcaagttacatcttacatggatggcgacaggcaaagagggagagcttgtgcaaaggaactcctttttataaaaccatcagatctcgtgaggcttattcactatcatgagaacagcaaaggaaagacctgcccccacgattcaattacctctcactggatccctcccatgacacgtgggaattgtgggagctacaattcaagatgagatttgggtggggacacagccaaaccatatcacatgccttgatggccatgcagaacactcatctctctctttgctcacctataactggggcagtctgatttcagaatcatacactccatgttctcaccacatcctataagccaagttcatggaggcacacatttatgtggtgaaagtccatctctataaacgtatccatagattcctcacagagaaaaagatatgaatgctggttaaagtaataactccctcatctctggggagtatgggaaggtcctgaaagagcccctaagttatgcttgatttactgcaaaaagtgtttgctggttgagagcagacatatccctccctcaacttctctctcatgtttggagagacaacccaggtgcagttaacaagagaacctctttgcatttgcatagcactcaagcatctgcagcacagagccaatcagagccttgccttagctcctggatgcaggcaaggcttacttgcctcaggtctatgttatccaggcaaggggaagacaaggagggcagtaagagcctgctccaactgtggtccccttataaagagctctccaaaaggccccaccctccaccactctgctttacatctcactggctaacacttggtcacatgaccacactcagctgcaagaggggcatagtcttttagcactcacatcattgccagaaaaaaataatcccatctcaggaagtaagaaggtacaaacagatattggttagcagtctcttccacttggctccttttttacaggtgatgaagcacagaatgattaagaaacttgtccaagtaaacagcagaaccaggacttgaaatccaggttttcccaaccaacctccaataccctgtccactacttccttaactgaccttctgcaccactgaggtttctgcacaaatcactgccagatgctattaacaaggcagtatcctccctccctcaagcaatctcacacacatacatatgccctcctccatctccctgggctcatcaggatcacctcattttctaaaataaatctgtcacctccatcaatcatgaaaaacaattgctcaatcagctgcagtagagggggccttttcaaatcagggattggactaaactggaattgaccagcagattcatttcaatcatcaccttgacagttacaggcagacacagtcacagaggccagggttgttgaaagactcagcatgcacaagaaaagtgcttttattctctgctgcttgcatttctgtcttggctctgcagggacaataaagcagaggtcatctcctaagctgctctgagatgcccaagaatacttatgcaaagataaagtagaagagaaaaagcaatttccttcctatatttttaagttctcaggaaaacaaccacagtggagaaaatactcatctctgccagtgtgtcaaagaatgacaacggccaggcaaatgcaattggatcttatgtgttcacagtgagaaaagaacacaattaagaaaccccagcaatacctgaattcttgaggaagtgcatagacctccatttctctggcgaagctctccagagaggcccccaaaataaactaaaggctactttattcactcacttttcaaatgggtgagtgaataaagtagcctttagtttattttacacgtgtaattaaatggctcttatatctgaatggtgtcagattataaagggttctataaacaaaaagcattttgataaaggaaagtgaatttggtatatattattgtgagagaaaaagataaatgcctttacagatggaaagtctaaaaatgatggtattgaatgtgacaacggacatatattaaactagaataaataggaattaacaaacatggccaaacccctattgcttgtcaaagtcagatataagaaaatataggcataccctattgatctcaaatgtcagaatcaatggacatttgtttaacttctacttaccaacaactgtcatggatattttctcaaatgttttccatttagtgactgtttcaaatctatgagctagtcatattttgttcccattttacagatgagaaagctgaggctcaaagagattaagcaacagtcattaagggacagaggcaggggcaggtctggaatccacttgctgtgattacaagcccagtgaggtttctgtgccttgagcagttgccttttctagaacattactaatgatattcaaggcaggttgtattgctgagcagagacactggaagcttcatctaggttcaaagtttgggtgtgccactcattagctctgtgaccatggacaagtgacttccttctccaagcttcaccctcatccttaaaaaagggataatatggccaggcacagtggctcatgcctataatcccagcactttgggaggctgaggtgggtggatcatctgaggtcaggagttcaagatcagcctggccaaaatggtaaaaccccatctttactaaaactaaaaaaaattagctgggcttggtggtgtgtgcctgcaatcccagctactcaggaggctgaggcatgagaattgcttgaacccgggaggtggaggttgcagtgagccgagatggtgccactgcactccagcctgggcaacagagcgagactccacctcaaaaaaacaaaaacaaaaacaaacaaaaaaaacaaaaaaaaaaaggaagatggatgatactatatcttcaattgctattaataagtagagaatgtaggtaaaatgcctgccacatattgtttctattctattcaaatgacaaaaaaaatggtctattaaacattcattatgaaatcaggatacttggagagattcctttaaggggaattatctgctctgaatccacattgccatttgcatgcttagaccacgtagcccttcattcatttaacagaacctccttgagtacttacttgctcaatgctggaccatgctgggcactgaggtaccagagcttagaagacactgtgatcactaccctgaggaatgtgctgagggatggtgcacgaagcagggtgttgtaactttccagcctgcatctggttatgattgctgtggctctctggattctttctgccactggttgctgatttcctgtttccctctcagagcatccccctccccttcactcatgagtcccagagctcctagaaactccaatctgtgctgtcagaaccaatcctactcatcacattcctttctttgctgctgggaggctactgaagacattgatgcctatggtgcctctgatagcaggccaaatcaagggcctgatggttgccaagggtgagtccctgcctttgtgtcacctcccccatctttgtgtcacatcacttagtgcagatttcctgaacagtgtgtccttcagttcatatgaggtgcatgtggtagaataatcagaatggatctggcaacactcagacctaaccctaaggacctcataaaaggcaaatttcccagcattctctttctccatcataactttccaggactgaccagtgctctaccagttaatagcactgacagcctacatcatgtgtgaagtcctgtgctctgtactgggaacccagcagataaataagactaacagactgatatgatttggctatgtccccaaccaaatctcatcttgaactgtagttcccatagtactcacatgtcgtgggagggacccagtgggaggttattgaaccatagaggcggttacccccatgctgctgttctcatggtagtgagttctcatgaaatctgatggttttataaggggcttttcccccacttgccctacacttctccttgctgccaccatgtgaagaaggacatgtttgcttccccttccatgcttgtaagtttcctgaggcctcctaagtcctgcaaaactgtgagtcaattcaacctcttttctttataaattacctagtcttgggtatgtctttattagcagcatgagaacagactaatacacacaccttcagtcttgtatggcttacagcctatcaaggacagcatcaagtatcacagaattgagtgataataaaaagaaaaaggtagatgatcttgcaatcatcaggtgcaaattcatggcagcaggcagctaaggagtggaaggctggaggtcaaggagaagcccacagatgtgtctgatcttcacaggccagtctagttgtggaattctccctgacagcgtattaagatacacctgcattctacctttgagagtaactggaatatttttgtcataaaattattttgaactatttaaaaaatagtttcattttcaacatcacttggtttccaagaacttaataatttatcactgtctgtggtttctctaatcactttgttcctttgggaattcttgatctgcgaggaaaactaacccacagtttatcgttaagtgtaatgaaattttttgaacagtaaatttgacaatatctataaaggcatgtagacacatatgtcatagataacgaattcttgttagcttcaattattcagtattctttttacatttttgagtcaacatattgcttttccaggccgtaaaacatttccataagtcctgaaatctcctgaccacaaagtaaaataaggaaaaagggcgcagaaagggagcaggacaggacaggggaggctggagaagctcttgcagggcttcaaatggcaggaaaggtagtgacaacactcccaggatgttagaggccatggaaactatgtaaactgagggagaaatcaggctaggtttggtgttgggatgctccccattgctgtcccatagagaatgaacagcagcaaggacatgaagttggtaattagcacccaggaggagaaggctggtagaaaggtccaagaatgatgcaagaaggctctccctagcacagtgcattcaaggatgaagaaaacaaaaaacaaaaaacaaaaaacactgtcccagacaggcaggcaggcaggcaacttagggaggacctctcaaaaagctgcagtggaacaaggaagtagcaactggccacaaatgagaacatcccacaccagacatccagggccactctacccccagaacccactcattgagggcacgaaactattcaagcggatggttactacagagaggggtagggacaagcgaaagagttatctctttgcagactgcactacgtccaacacatccagacaataccagctttgctggataactatttttcctgtgtacctatcatgttctgggcaccttgaatgactctctacatatctgttcattaaagcctcacaggagcccactgagatgggtacagttattccaaatgtatagataaggaattagcccagagaagtttagtaagttgctcaggttcacacagctggtaagtagtgagatgagagtttaaatctggaaggtcatactctccttggaatatcctgtggcttcccaaagcccactaacatcagggcaagaatatcactactacccgcattgaagagaaatttatagattatatcttattgcattaatgttatatgcatttaaattcactttcccatttagtcatcacgagaccttcttcagcaatgacaattcaatggatccaatcatatcatggtgtatttgatcctatcagcaatgagacatgtaataccccttccaccctgaaaaggtccatttcaatggaccaaaaatggaaaggtatggaagtagcaaaattaaatcacatttaaaaatacatcatcatctactggaaaagaaaaaatagtaataatctgccttagaaatttgccagatctcagctgggtgcagtggctcacgcctgtaatcccagcacattgggaggccaaggcaggtggatcacttgagttcaggagttggagaccagcctggccaaacatggtgaaaccttgtctctattaaaaatacaaaaactggccgggcatggtagtgcacccctgtaatctcagctacttgggaggctgaggcaggagaatcacttgaaactgggaggcagagattgcagtgagccgagattgcaccactgcactccagcctgggtgacagagcaagactccatctttttaagaaaaaaagaaatttaccagatctcatatttataccttggttatgggtgtaaaataaaacatgagacttcaatgaatagtggcagcaaagactcctcaggccacatctgtgaatgggagagtaaaactggagaaaaaagaaacagatctaaaggataaggagggaacatgcacagtagtatggctgattgggtgtaaaggctaaggatggtgaggggtggattccaaatgactctcaggtttctgatctgggcaaacagtatgatgtttaccaaattggagtagctatttaccaaataggagtagaccattttcagcatcaacctataatgttgaggtaggtagaaaacaggtaggaaaagtagtcaggcataaggacttgaagttcagaagtggggatatattcatgtcttgttgaagtcatggaacaggtaagacatctaggaagagtttgtgtaatgaagagagaattgggcagaggacacagccctaagaaataccatcaagtgcagaaatcagagatgagaaacagtggacatatgatccttgaagcaagttctcaatgcacatgagctggatagagcttttattttaaaaataaagctgacatgcagctcacagggaggtaaaggtggaaaatctccctattgaccctggtagatgggattgttcttaggtatggaggcatggccttttcttccttaagagggagaaaagctgaggcaagataggaaagccctaaggaaaatagagggatggatgtgggagagaaaatgtcaggtgctaaaaattcagagcctgcctaagccaagcctaaaggaaagataagagcctgcaaatatttgacatgtgttaacgccagtaagggagagaatggattccgctccaaatagggggttgagacttacaagtagtgataagaaataaaagccattgattatcagctccaaacaccaaaccacttgtttgcagagttattgtctcaggaaaacagagaagaataaaggcagaatgtcaactcataatagctatagatgggcatgtccaaataaacaaagctgctcatccactgttgaaggcagggtgaaaactgacccaatttttgaagaactgtctcaaagtcttgaaaatgctcactgacccagcaaggacggttccaggaatttattccaggaaaaaatattacatatgtgcacatatattagtatctttcaggatgctgattacagcttttaaaaattaggaaaaacttacatgtctggaaatcaaagttaggatgaaatcaattgtacatctatataacagtatattaagactgtaatcaaaacaatgcctccactctctcacccccttttcacctatcatatgacactggcttttgcctgcttatatttttaatatctgttaatgccaagtcacccatcactccaacactgacaaatccaagtgatatggtttggctgtgtccccacccaaatatcatcttgaattgtagttcccataatccccatgtgtcgagggtgggaccaggtggaggtaattgaatcatgggagtggttgcccccatcctgttcttgtgatggtgagtgatttctcatgagatctgatggttttataagggttttccccctttgctccacacttctacttcctgccaccatgtgaaaaaggatgtatttacttcctgtcccaccattattgtaggtttcctgaggcctcctaagccctgtggaacagggagtcaattaaacctctttcctttacaaattgcccactgtctggtagttctttatagtagtgtgaggacggactaatacaccaaggggaccctttggagcacctcttactcaatccttcagagttggctactttctccatcctcagttttgctgttgacctgagggcatcacaacttccttgttttcctcctgcttttagttgttcgttcatggtcttcttttcaggctctttcttcacaacccaaccttatggtggtggcattccctgggattggcctctcttgtctctccacatgctttatctaggttgatggcatttattagtatggctttgtgggggggaaaaatctgtgcttcaatgaaaaactgcattgtttatagctcatgcttccttgttatcagattctgattctatgggagctgtttcccaactctggaaattgtagataactgataataatgcagaataattcttgtccatagatatgcaaatggttccatgatcaggaagagggacaaccttgctccctcaaggaaaaaaagctagttttgcttccatttgcatattcctgaagtatacagatctcttacctttgaattttcctctgtactggctgtaacacctcaccagtttcttcattaatgaattaaatgcaatcatgttcatttttacatctctgtgaggtttacctttttttttttttttaccttttcttaagaaaagtaccttgattttaccttttcttgaaaattatcttttaacagttttaagttatatctagagccaaagaacccaaatgtatgtctctatcactgacttgtacatatatctaactgattcttcttattggaagtaatgttctctaaagttgcactgaattactgaatattgaacccatggctcctaggagaaatacaaagttcagttcctgtgagcctctgctcacaatgcttttgtcaaatgattaatatagaaccttgtttatgtacataaccttgttctgtgtgtttctgtttaaagacagcttacttaacagattttgtcaattcattaacattgaactgacagccagcagccctgtaactcaggcctgaacaaagctcatttaatatacctattttctctgcaaagcacatcacagccttcttgcgcttaggaacatcagatgacacttcagcactacacttgggggccacttaaagcagcaaaatcaccaacagcacaaaaatgtgaaaaacataacactaaataaaccatgaaaagcacactcgtttacagtaggggagctgaaacaagaaggcagagtgctacctctgaccccagctagtaatatgtgcactgggcaaccaaaagttttcactgttccgtgcaggtctgtgaatgactgggagagaaccaagagtactgatgttggtgttacaaataaattttagtgagtagataaacttgcaaatatgaaatctgcaaataatgaaaactgtatttctgtatctatattaaatgtaatgtatgtctcccccattagtattcaggatccataaaaactaagaccatatctattcaattctattatatattattcaatttaatatttgcatttattgaagtaaaaaggtacttgagtacatagaaaaatattcattatacattgttttaaagtgtgttactcaacaacatttacatattagctcagttttgtccagggagatatatctgtctgtattaagaaaagtaaaccctaatggaaagaaatgtctcaaaattttgtataatctccatgtggtggggttcatggtttctttttacatccttttttagtgtttttctgtatcttccaaaataaaataatgaaaacatatttttttcatcattgctacgaaatgccattaagacgtgaatacctgccttaacttttccactatatacagcagaagtttgaacagctccaggcaccaggaactctctaactctcaaaaaaaacatctgggtcagcacctccagcctgctcatatgacagctttaatagctcatccccatagggcctggtgctctcctaggtaatatctttcatctatctttggaatatgtggccagaattaaatgtcatggtcttgggatattttgtgtgacatattacaggcatcccactgcacactcagtctgaaccctaaactcccataatacagaataccgttaccttgatagccacacctaattaagaatgtacactcatccactcttcaaactaccagatgcgccagccagacacagaggtctgtcctcagggagttagagtctaatctattcaagacagtgggatggtctttcccagcctgtgggaggtctttagatgtctaagctgccatggctttggtcaaatgctttggggtgggtgcggggaaagtcaaatccatgtaccaactataaaaggtaattaagggttatgttattgacttcttccttctaagggatattcctctgggctcaattttattgtgtttagttcatatacagtcctatataaaatagtgtgggtcaagtttaaatggattcgctgcttaaccttcaaataaaaaaaattcaattaatcagagctcttgcctcctccatcccatcgccaccacctttcccccatgctgtctggttaatccaagattcacagcacatagaaaccttctgtagtgaacagacggcaggagtcaggtgagtctggggtcaggagatgctatttcacagctattacgagatttgagatttggggaaaattactttactcctcagagcctcagtgtccctgtgtaaaatgacagtgatcatctgaattaagtcgcagggaaactgtgaggaccaatagaaattgtgcttataaagggctctaggaagattgtactgtaaaggctatgcaagagcaggtggtgctggccacgtggaaggggctggagctttcctcccaaaataaatttccctaacagggtgtctgctccaccattatgtctacaagttcagaagatttgtaaatatggcacccactctgataggttctcttacagctgtgaagcttctttgggtcaggctctaagcttccatcccttctccctcccaagaaactcccatactctccctccccagtccatcactgtttggggtattgtaagcttattccagcaacggtgctggaataataggttaaatactgaaaaacaaagttgaaacttccctttataccaaagaccaaaacaaaccctctattagttaatgagctaaatataagacatgaaaccattaaaaaagccaacttggtaacagttgttatcactgagtgatgctttgttggattcttttcattgttgtgtgtatatttttatgattttccaacttttctccagtgcacacatttgtctccacaacattcattcatgcatgcaacacctatttattgcatccctccaggtgccatccatgattccaggcactggtgaccagaacagacaaggtaacgatccctggggagtatatagtctaatggaaagggcaagtaataaacaaatacacacacagataagtagacaactatgaattagggtaagtttggtaaacagtgttttttgtttgtttgtttgtttttattttttcttgagacagagtctcactttgtcgtccaggctggagggcagtggcatgatgtcggctcactgcaacctctgcctcctgggtttaagtgattctcctgcctcagcctcccaagtagctgggactacagacgcatgccaccacgcccgtctaatttttgcattttagtagagatcgggtttcaccatattggccagcctggtctagaactcctgaccttgtgatccacctgccccagactcccaaagtgctggtattacaggtgtgagccaccgcacccagccgtaaacagtgttttaaatggttaaaatggagagtgaggaggaggaagctagaccaacaaggtcctttgcgaagtgacttttaaagggacatgtaaagggcaatgatgagttaactagttcacacaaaacttttctgtaaaatatttattttatgctgtagagtgaccaatgagactaaagggcatatggagcatgattacatgagaatgaggtcagtgactaaaagggaatagacacaagcaaaaaatatatatttaattggaatatgaaatacatttcctattttcaaaaggttactttcaaatttcaaaaatgtgctacctctttttttcaagtataaagatgaagaagataaagaagtaaaatggcagccaccaccagagtagttatagtggctgcatccattttccgccctaagcccaggtgggaaaagggttggctggaaaagttacaagcttctaatgattaagaagccccatcaaggaaaatctacatggccgtggtggatggacaaccactctctggtggattcccattgaccttcgagaccccctaactcccactctcacctcctgctacacctcatctcaagaatctcaggatgacttgtggctcaagccaatagtgggtgggatttagaaacaactgacactctggttttcctcttttctgtcaggcagagtctttttctctgcaccaagccaggtttgggctcactgctcaggataactctcccattcttctcactgcagggagacctctgcgttccagaatggccagcaatggacagggtgcccttggcttcctctggctcaggcatcattttggctgaggctgcataccaagctcttgatagagtgagctttgtgaacacagcaaagggctagcccctcagactcatggcaatgaggatttttggggtttaatggtgaggaaggcctagggcctaggtaatgagagagaaactgaaaaaagatagcatactgtcctcttaatatgttgtaccagttaactcacctgcagaaatgcctgttaagagcctacttcgttccttgccaaaactggttactaccagtttgaaacatataagtaggtaatatattgataatgagagagaaagtgagcccctaggtgttaaagtaccaaaggctccaatttactaagcacctactaagttctaagcattgtacttagagttctatggtcagctgggtccagagcaggactctaatcggactcagtaggccccaacctcagctacttcctaaactgtgtgacttggagcaaaacactaaatctctctggccttggtagtaatggtcatgataaaacctacctcatggggttataggtttgcaggcaaagtcagtggggtaagccttgcagagcattattagccatcattaatattaatgacctgtatttctatccagtgaggtaagcagcattatactaattaacagagggggaaactgattcacagaggtcaagcaattgcccaaggctgtccagcatcctaaggagtgaatctagcattaaaactctgatgggactgaaagcaaaccccctatttaactgtcccttactctatttgaacactgagcttgaagcttggtttgcatctcagggcttagcaaatttgggactgtttctgtactgtccaaaaatgtcaatgattcactaactaataaaaataccctcatatagagtgttttacaatttataacaatcattcacattcacatttgactccaatgggtacaacaatttctaaattatataaatttttgtgacccacagtctcaatacctgaatatatgtgtgtgtgtgtgtgtgtgtatgtgtgtgtgtatttatatatatacatgaatatatatacataatatacagacatatatatggcatgtctgtctctgtacctatacccaagggcagataggttaaaatacatattttaagaagggttgtttccattcaaagaaacactttgatctcagaatgagccgccctcccccaaccccacttaatgttcagttcagtgcaaaagatgtacaaagaggggcctggaaatagagtctagagaaagttgaactgctctaggaacttgaatgagaagactttgctgcacctgtgggcaatttgggagggaggaaacagaaagaggtgaaaatttcttgcctgttgaaaggacttttaaagtctgagaaaggatgagttctatgctgggcaggacggcaatgcgaccccttgcctgagtcccaccaaacaccaagagaagtttgctgctgcaggaaacagcctttgttatgtggcttcggcagggtggtgtggaagggcccaggtccacatttggttcagttaggggagccagaagaatttgactgatgttctagaatccagggcaggcagtgaacaggggctcatgtgctctttttgaaatctccatgtgcagaatttgaaatggggagttctggtcaatacttcatagatttcactggtaaactggccccagctgatatgcggtctgtgtatttatatttcacaaaactgacacagtaattacttacactcgtggttttgtaggctcttttttttaaaacttcctacagcatgaacattaacccatgccattagatacatataccacaaaaacagtttgtaacaatactagcatagaattccactgtgtgtgtgcaccaaaatttacttaactactctccaatcgttggtgcatttaagtgatttccaagtctttgtccttataaataatgcagtgatgatctctgtctgaaactctcttttgagcagctctgattattttgctagaaaaaaaattagcaaattgtcctcttaacatgctgtaccagttaacttacctgcagaaatgcctgtaagaacctgctttgttattccttaccaatactgcttattaacaatttaaaaaatatataggtaggtaatatgatagataaaatgcatttatttgatcatctgtaacactggacatttttaatacgctttttgctattcatattttgtttagcaattacctctttatgcctttagcctttttttctatcaatgtgattacattttaaagttagagctttttatgtgtaaagatattttatctcccttttctcagttttgtcacatgttttcccacaccagtttactaacctgctttttgattttagttaacatggcatagaagatttttctttttcttgtctttctatgtagtaaaatgtgtaaaccatgacctcaatggtgtatttgcttgcttttaatgaactgagagtctctcccaataaaagaatgatattttctttatttttttctagttttgccttttaagtttttaaactacccataatttaattagcacatggtaatatatgcaataaattctattttttacaaagtatcttaccatgtacaatttattaatcatgtactatttgataagcaattttcaattcatataaattttttatttttgtaaagctggggtcctgctatgttgcccaggctggtcttgaactcctgggctcaagtgatccttctgccctggcctcccaaagtgtcatataaattttaaaagtcaccagtggaacagaacagagccctcagaaataatgccacatatctacaactatctgatctttgacaaacctgacaaaaacaagaaatggggaaatgactccctatttaataaatggttttgggaaaaccgggtagccatatgtagaaagctgaaactggatcccctccttacacgccttacacaaaaattaattcaagatggattaaagacttaaatgttagatctaaaaccacaaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacaatgaactcaaacaaatttacaagaaaaaaacaaccccatcaaaagtgggcaaaggatatgaacagacacttctcaaaagaagacatttatgcagccaaaagatgtgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagacagtgtggcgattcctcagggatctagaactggaaataccatttgacccagccatccaattactgggtatatacccaaaggattataaaacatgctgctataaagacacatgcacatgtatgtttattgcggcactaatcacaatagcacagacttggaaccaacccaaatgtccaacagtgatagactggattaagaaaatgtggcacatatacaccatggaatactatgcagccataaaaaatgatgagttcctgtcctttgtagggacatggatgaagctgaaaatcatcattctcagcaaactctcgcaaggacaaaaaaccaaacaccacatgttctcactcataggtgggaattgaacaatgagaacacatggacacaggagggggaacatcacacaccagggcctgttgtggggtggggggagggggagggatagcattaggagatatacctaatgttaaatgacgagttaatgggtgcagcacaccaacatggcacatgtatacatatgtaacaaacctgcacgttgtgcacatgtaccgtaaaacttaaagtataataaaaaaataaaaataaaaaataaaggctgaaagaaagaagaaaataaaataaaattagttatgtaacatctcatcataagttgtttataagaccaatcacacaggacctgttatgaaaattccatacttgtaaagtgctacccagagcctgacacgtggttggcactctatatgtatgagtttcttttaaatttatttgggatatttgaatgcctatttatttttgtgaaagggtttatgtttcaaaaattaaaaaaatatactttcattcatgcatcaaaaaaaaattttaaagtcagttttgctatgtactgtattcatttctgggctttaattattatagtttttacaaatgttgacatttcacagagaaaccctccaatcactttttctaagtgctcttgacttctttctcctgtattttctttcagatcaacttttaaatcactttaagtttcaaaatgaatcccattaagattttgattagaactgtattaaacccatcaattaatttgggaaggattgctatcctcacaatattaaatttgctaatccaacaacatgacatatggccatttgttcaggtcttgttttctcatcctcaataaaactttgtaggtgtttgtattttcatatacatgctgcacaattcttagcttacacttaagtgtttatactgtaattacatttaagaataggatacattttattatagttttataatggttattactggcatatggctatttatttttgtttatttgctttgtgtctgaccatagcattgaaatcttttagtagttccaatagcttgttttttcagttaagtttattctcttaggcattgaggctataagaacgttttcttctggaaataagaaggtgcctttccatttctagcttactaagaattctgatcagtaatgaaggctgaatcttttcaaattactttttagcctctcttgagaggctcagatgatttttattttttggcctactaatatgaggcattacatccatagtttttctaatattcaacatttttcatcagtgtattcctggaaaacacccaactgggccatggtgcattatgcattgataatgattctggatttcaggagctagagctttgcagctgtgcagttaagggttccattttcatccgggccatttgagcaagtgtgtggccttgggcaagtcacctacctcctagacagtgagtggaggaattatacctccctcacaagcttgctgcaagaattacaagtaaaatattcaaaacaagctcaacactataagccttgcatacagtagatacccctcaaattggcagccactgttttcatcactataatcatacactttctttacattgtcatctcaagtgtgacagagctgtaagagtgattgaactctaattttaatatatttgggatgctattttttaaaaatccagagagcttgataaacactgttagcttttactatctttaatgcttctctgtgactcactttttcttcaaatttcaaccctgaaatttagaagaagttgagggattacttgttgacttactattgtaactgaataaagatttagttgcttgctgcttgcggagttcaattaacaagagcaagatctggtagaaagaaaagtgactttattccagagctagctgaagggcagtagtgcagtctccttcctcagggtgccactttgcttccaggcagaaagcagaggcttttaaaggaaggcttggagtgaagggcacgcaggggagagggcgaggaagtgcagggtctatgtgacttttcagatttcttatctatccggaggtctcactagtgccatcatgggcagagtgaggttgtaaatggtggcaatctcctattgggatagaattctggatgtgcctggtttgcttcaagtttcagtctctggaacttctaagtaacacatagttagacagacttgctgtgttggaagtgtctggtggagagaaggtaaagattatactttcattcctaaacagctaagtaggtggtggggggaaagaaaaaaagttaaacaattgattttttcccttttaaaaacgaggtgctaagttacactattgcacttcatcttctaggaggccctggctccctaaggagcatggagtggcagaaaaatctaaaagtgcaactggatgtctaatagggcttttcctgttgctttggaattttatctaagactacaaaaccaataagcatacaaaataaacactgccaccttctacagagaagacctgagggacttccagctatttcttccagagaacactaagaggttcccaagcggactctcactcttccctcccagcactacagtcagctcatacaataatgagacttcatgggttaggggaagtgagtctctgggattatgaattataggtttaaagagagagagctttatgttttgcctctttcttaagccaagggagagggactccaatggtgccaacagtagacatcgtgcgacagtgggaggggagagagggtctgcaagaagaggagatgaacatcttatgccctcacaggtgcttgtccgtctgcggataattctttttttttttttaaggcggagtctcgctctgtcgtccaggctggagtacagtggcacaatctcggctcactgcaagctccgcctcctgggttcacgccattctcctgcctcagcctcccgagtagctgggactacaggcgcccgccaccacgcccagctaatttttttttttttttttttttttttgtatttttagtagagatggggtttcactgtgttggccaggatggtctcgatctcctgacctcatgatccgcccgcctcggcctcccaaagtgctgggattacaggcgtgagtcaccacgccgtgcccagataattcttatggcgtctcaatcagaggctccataaccgagtatgatcagagcaggttttctcccttctttagctttcatctctcttccgtggtcctacaacccagaggaagcagagagtgcagcagcagcaaaacaagttcggtaggtgatgcaagaactgccagaaccctttctccacatctttttgaggaagtgctggtcataatccatcttctgtgactgccttcaatctaggttcacctgcactgcacaagcaactatgtcccttcgagcatggtgtggcatgcatgaaagtcccctccttccctagatcctcatggtcttgaaaatttctccattggtctttagaatccattaactctatggctttgattctgggtgggatagtgagtccattttcatttctactggctactgtttccatgttccccgaagatttatggatcatctcaccagaattacagtacagcagagatggaggttagatgtctgtgttcatactaccctcctgcccagaaggatgtcccattttacttctaattcagaaccctaagagttaggccaagttatgttcctcccattttatagatggtgccgccaaggcatagagaaatgaagaagaaaaactcacgagactagttaagtgatgctgttctattttctagaccttcaattacctctttttataattctctgcctctactctgtcctagaactgcatgttgccctgaaagacccttgcctgtgggacccacaggcttttcagagaacacagagaccacctgaggctgcttattgcagagagtctggattcacttccaatccctttttgctctgggcttgaaaggcctcattcttacaagccttggcctcctcaaagagagaagcatctgcgtaacatggttctccctcttacctgagactagagacaattataaaaaggacaattcccatcccccttaccccgtgccctatatcatgaaataccctcacagctacacgtcgaggactccacaacatgcacacagccacatgtcttaccttctcagcagtgatcagagcttgttgctaaaccaccactgtctaagaaagtacacagagtagcagctagagaaatccttcttaaaacagggtccatcatgctacagtgaaggaaatcaggttctgacatcctttccccaggcctaagatttatttctaaataatgtttattaaagggcccctaagttcccggttctctgcaaggcatataacttatctcactgaagctttccaacaaaatggtgcattataatatcccttagatggaagaaaataaattgagtcacagagagatggtgtaacacatcccggtcacccagccagcaagtgcccagcttgaaataaaaaccagattatttttggctctaaagcctctatccttttcattcaattctaatgactactctcacttcattgagcccagcaatttgaatttatcttttttatccccctggagaaaagagagaggtagacacatatcactgcaagtagaaatccataaatatgtaaataaaatagaacatgcaatcaaccctcaggtggagggaataggaagagagccctccaaatcaacagcgtatgtggtgtctctggctgtacaaagccacttttcacttggagagctgggactccgcaagactacaatgaagtgggttcccaggcaaggggcctttgattgacacgcaagggggacgggctaagattacgtgacttgctggattgttgatttgtgattctgtaactataatcggagtggcctggggtctgcgtcaagcgaagtttggggggataaaagaaagcaatgtctggggattaagtgagacaactgagtggctgaagacctgtttttgagatgaggaggaaaacctgggagcaaaacttacaagtgggtgtttcaaggaggcctatttgagggtaacaatgaggaagagcttcttctatctaatgctagatgatagtcttaagacaccaacaagctggtacccaagccattgaaagtggtacctgcaggagaggtacagggccaagttggacccatgtggtgtccctatctcttgtcacctcacctgctttctccagttactgacctcggcatccactgcccttggttctcactgtggactcccaatagttaatgctagcagcctgcctactgcccccactcttttaaacctaatggacactctgtgtataatccatccagagctgtacgataaccaagctaacactggatagaggataatagtcaccacccgagatctccagcagtgaaatggtctgccatggaagagtgtaaacttcccatcagaggcagcattcaaggtgaggctgggtgggcaacacacagcaattctaagacccaactcctatcacagaaagtctgctgttggggatgtgctggaggaaaccacacaatgctctagacaagagagtctctgagatcccagaccacagcatgaactctgaaatgggattttccaggagatgatgaacaacaaaagaatatgggtccaccttcaagatgccaattagttctgagaagtggacaaggaagacttcctgttttgatataattattcataatcatagcatccataacaatagcagcaaccaataacactttggttcactataggcagctaaagaacattttgagtttgatatacatgatcgcatttgctctcatacctatatctcatgaaagatggtgaatgattaaactaaggaaaagaaacaaaatgataaataaaaatataagaaatggattatctcaacagaacagcatgaagacacagacttaaattgctttcatcagtactaagaagtccctttgatcctaaagtccaagtgaaatcaggtagtccgcatggaagaggcagttatctgctgatctctcctgagctccagatttatatattcccatcacctgctatacatcttcacctccaacacaacatattcagacctgagctcatttccttttgtgtttttcggctcagaaaattgtttcaccactgtgatggttaataatgagtgtcaacttgattggattgaaggatgcaaagcattgttcctgggtatgtctgtgagggtgttgccaaagaagattaacatttgagtcagtggactgggaaaggcagacccaccctcaatctgggtgaacacaatctaatcagctgccagcatggccagaataaaagcaggcagaacatgtaaagactagactggcttagtctactggcctacatctttctcccatattggatgcttcctgtccttgtacatcagactccaagttcttcagctttgggactcggactggcttcctttctccacagtttgtagacagcctagacctcaccttgtgatcgtgtgagtcaatactccttaataaactttcctttatagatacatctgtcctattagttctgtccctataaagaaccctgactaatacaaccactcatctctcagccatctaaactgaagcatgggagtatcacctttgactccctactcccaaccccacatccctcgattcctatctgatcatctgtacagtttctggtttaactggctgggagtcttgctctgaactccagcctactgggctgggatgctgcgctacaggcaaacacttgacaatctcccccttaagggttaaggaggaggtatcctttgggttaagggaaggatagccttcccttagtaccccagaattttcttaatcagtgacctctcaaaactggcagagccagaatgcatccccacctgccttagctgaattgcctctctagcatcttcttgtgctacgcccaagcttgtagcctactgctgccaagtctctgcctgctactagcatgtccttactaagccaacctctgccaccagtgcctagcacagaatttggcacaaagaaaagactaagtaaatgtttgatagaaaggagtgaaacttttgtgtagtagttattcattctcagctgatctccatagtcaccaacctccttactacccaatgccactctcaagaggacacttgtgggcagaggaggtccccagggctgaagactccatcaagtcctgtggtgaagagtttctctggccaagagacctagcatttaaccgattggtgaccttcatccaactattctgagtctcagttttcctcccatctacatctcagagctgctgcaaagaccaagctatggaatgaacatccttccaaagagccatgttggcttgtcactatacataagttagtgtaaaacttgggtatgaaatgacatcactcagtggaatccttacagcaaatttctaggctcaaccccagaatttctgatttattacgtcgggggacaggtctgagaatgtgcatttctaacaagttcccaggggaatatttgtcttaatccatctaggttgcagtaacagaataccatagactgggtaacttataaacaacagaaatttactttttatagttctgagggctggaaagtccaatatcaaggtgccagcagattaagtgtctagtgagggcccatttcctgggtcctcacatggcagaagacatgaaggagcattttggggcctcttttgtaagggcattgatctcattcatcagtattctgccctgatgacataattagtacccaaatgccccacctcctaatatcatcatttcgagggttagaatttcaacatatgaattttaaaggaacacaagtattcagtctatagcaatactgatgctgctggtcgagggaccacactttgagaaccaccgcccaagatgattctaagaccatttctctttccatgctgacgctgtttttcctccatgaagcatgctatttcaatgcttgcctttatgttttacctttttttgctgttttgttggaatcctaacccagcctgtaaattcctctgggcagaaattataccttccactctacatactctctcactttctgttttgtaaaataatgagtacatttccagcgtgattaataatagaataggaaaaggaggaaaatctcagactaccaacaccaataaacaccacctacaaatagataccagccctggaattctcttaaaaattaattacgaggcaaaaaacattccaccatcagtggcgatgcaggaaggaagattatcttcttgatgacacattttgtaaaatgtgaattattcaagattttagctgtaacttaaacaccaacgttttttaaaaataaaataccacaattgcattccaactcataatttttatattgatagccagattattgtgttttcaacatgtaaaatccattacacagtcatggcaacagtttgcaatagactgtaaatctttattgagatgatcatcttgcgattgaatttcaaaatgtattatatgatcatcagcaaataagtccacgggggctgctaaagtactttgaatatcatttataaagatcaaaaaccctggaaactcttacatttaccctgtggaaagagagaagtctcatcagcaggatcaaatcaattatttttatggatgaatattgcattgcaaagctgagataaggtattacccagtttagtaacatatcattatgtccttttaaagtagtaagtttcataatcaggtttcaatgaggaattttaccaaaggcctgttttgaaaataatcaagaaaatggcatctctgttcagcatagtggttcaataaccttacaaggaatatttccaagcaacaaaaatacctgggttacatactaccacgatacaccactgagatacttaagaatggttacagctaattccactacaactcttgctttgaaaacgcaaatttgttccaacccaattaatatatgaaagggcaatttgagcacaacacgaattctgcatttgcttatgtgtgattttgtatgtgagaaacattagtgaaggagaaacctgcacccagcagaactgagccacctacgaatacatgcaacacacacagttccaacccctacctggcccgtcagctcactgcctgtgttctgagccacacctttttccccaatttcagacagctttccttccaccacttcacagtcactcacaggctgcaagtcactcacaggctgcaacttccctgatgcccacttccacagcaaacttcaggtctttttcaaggtaacataccatctgtgttgagcatcccttatccaaaatgcttgggaccagaagcgtttcagatttcagattttcttgaatttcagaatatttgcctatacctaatacgatatcttggggatgggacccaagtccaaacacaaaattcatttatgttttatatatatcgtaggcaatcttacataatattttaaataatgttgtgcatgaaccaagtttttgtatgtcgaaccatcagaaagcagaggtgtaattatcttagccacttacgtggacaactctgtgcttgtctgtcatcaccataattcctgactccaaatgtatatgctatcgataagcaatcatcttcttaagcttattcacacataagtgcttaacagtaaaaaagaataaatgatatgtcattaatactgtgaaatattaatgtgttcaggttaactgagcagcacagtagactcagcagatacctggatcagctggtgaatgtcagcaacaaacatcctggctttcagtcctctccctgtgatgttgtgctttgatgaagggttcctatacaccacattttattttcttaggtgagaacaaacatcagaagcagttgaggaaccaggaagtggatcctctagggataaagaggcattctgctggatggcttttaaaaatgtttcctccagagtcatctgcctcattaacaatgatttttgtcttagacgtctctgattttataaattgacctggtttcctgttctgctatgaatgcatactgctccagtccttccataagctcatcaccaatgcttgccatgtcatctacaggcactttttctgcagtgttaacaatgtcatcttcattggtggtatcgtgttggcactcagtaagtttcagattctggagcattttggatttccgaggttcaggttaggaatattccacctggatggatgcatttcttagccatttcacgtgcataaaattgtgccaccagttttactagattcccctcttttttgatgtgtcactaaggaagtatgaatatggcccctagccccattttttccataatccctgtggttttcatttcgtaacttgacatagtgtggtgatttttaggcacctatatgtcaagtcatggcagagctgtatgcactttcccttgctgtttgttccatggttcctgtactgatgggtccttcccctccacccagatgccctcagtgactcctctttgttttctgaaacccatgctgcctgctcccctgagccacacccgcctccactagaacatccccagctgtatatacaatgctctctctctctctctctctctctcttttattcatcatgatgtggccaaaagtcaaaagctgagagtcagaaaatctaagtgtaattcctgaccgtaccactggccattctatgactttggacaaaaagtttaaaagtattgagtctctattcctttgtgcatatataaaatgtaagtacttacagcaaaagtttacttggtgtgaaaaaaagatataacataaataaggtaatttgcaacaaataaagagcaagttagtttaatttcttgagttgcatccagagccagatcatctcagaggtacagtgagacacatgttgttagccaatagcccctgattagaaatgcagtagaagccaggaggcctgggacacagttggatccagagaatctctcccctcttagacacaatctcagccagcaaactcttacatggcatccaggaatatcagagagacaggtgtagtcagtaacccatagagatagagtggaatccagaggaccttcagaggaatagtcccaacccagactcttaggtagggataggagcctccaggggatacagaggcaggaagctcttagggactaaggtagttccagaaacaattcagagatactgtcagagccaggaggcatttaagacatggttggcaacagaagcccctcggagacaattctagaaccaggagccatcaagaaaattttcaaaaccaagggtcacaggcccagctcagggagcctcaggaacaatgttagaattagaaactcattaaagatacaaccaaaaccagaagcccccaaggacatagtctaaatgaagcgttcacggggcacagtgagagccaggagccctcagagacacaaccagagccaggagccctcagagaaacagagccaggaaccctcagagaaacacggccagggcccccagagacaaaaccaagagccctcggagaaattattagcattagaaagcctcagacatacaaatggcaccaggagttctggaagacacagagccagtgtgtctcatcagaaacactattagatccaggaacctcccgtgacccagctaaagtcaggaagttcttagaatcacagtcagagctagaaagcccctagaaatgcaaccacagcaagaaggtcctctaaaaaacaaacaaacaaaaaaaaccccaaggccttgatcctgtttatccacaataggaagcacattcacattcaaagaaaattcggaattatctgtcacaggaaggcaagaggaaagccagtcttggcaatagcacagcctctcataatggagcctgggaaaaaaaaaaatcttacctgcacacttggtcctggtggtgaggggaggccctggcggtcccgtacccccctcacctggtcgtgtgaggagcactcggatctcatactcaacatcggggtccagatgccacagcttatagttgggagagtcgactatgtgggtctctgcccacgtgcctgtggtggtgcgatattccacttccttcaggatgatggggccatccccgatgatggagttggcatttggcttgatccacaggtatgtggcccccacagccagcagctctgggggagcaatgggcgtgggaggctctgtaagacaagcaatcaaaaaggactgtcagattcaaatgatttacagagcagactacaagcacatgacgacaagggacagaattcttgatgtagccacaaaaaaaatagtcagaaacccctttttgttttattttattatttttattttatatttttgagatggagtcttgctctgtcattcaggctggagtgcagtggggccatttcggctcactgcaacctctgcctccctggttcaagcaattctcatgcctcagcctcccaagtagctgggattacaggcacctgccaccacggctggttaatttttgtatttgtagtgcagatggggtttcaccatgttggccaggctggtcttgaactccagaccacctgaggtgatccgctggcctcagcctcccaaagtgctgggattacaggcatgagccaacacgcctggcctgaaaacccttttaaatcccattcatgccctactttaagggtttgcatgtaagtacctgaatcagtatttcttcaatagctatattcaatgcctaccttatctccttcatttaaagaaatgaaagaaagaaggccatgtgaggaaatggttttcccagaacacagcaaagctgctgggtgaatactctgttttctagcctcaaaggaaaacctgcttttgctgaagtaaagtttggcacaaaaccaggggagcctgaggtctataaacatttcttacatagaacacacagattgttagtgaagttctttccaaaaagtgatatgagcctaagtagaaaaagaatgatggcacagcaagaattcagcttctgcctcaaccccagcaggtttcttccagcagagaaagtcatgggtcacagcagacccagcaggaatgaggggttaaaggaaaagttgtgctgagttatcgtgcatctactctgtgctgccacctctcttccactgagttccacgcagtcagctaagtagaccagaggttcagcaggcttggattgtagcctcttccttgcaattattagcccatggcaaagctacaaaaattaacacttaccttgtacttcttatgtactttaaaatctcacacgtatcattcatgtaattcttgggacagcattatcaccttaactttaatggggaaaaaaaaaaaaactgacaacctaagaaatcaggtcacctaaccaaggtcatggagaaggtagtgtaggataaaacttatatccgcatgccttcctggaccaacttgcaccaaggaaagctgtctgcctcttaatactcatctttaaaaaaatcaaactgaatatatttgttatttttatttgcagtaaaaatggcagaacaataaagaaaatggaagaaagagaaaatatgagaagaaatggaagaaaatggagaaaaatggaagaaagagaaaatatctctaacatccaacatagccatttttattcttccatgtccattccaatatttatgtactgacacattttttgtgttgttataataacacatagacccaatgtagattcatttttcttccttcacttatattgtaaggattttttttttcatatactgcttgagctttatcatcattgtctttaatatttgcataacaatccatcaggttatcacactaactattctctgattgctggacccatgagttgttcatgttttgctatggtaaataatgctgcaatgaacatctttgtgcaaagacttcagtctgtcttatctcatgttttcttagaaccaactgcgaggaatgggattatatgtcaaagggtatgaacaagaggaaatgaagagtagaacaaggaagaggagaaagggcaggcacagaggaggcatatgagggtagaatacaatgtgcatttgtttgagaatatttcacttatagagggcctctgggttattcacatggatagaaggcaggtatacattttagcttggaactcaggtaagggctttgagatagagacgcactaagcatttcccttccaattaattacctagaagcaaagattctctagaaacagaataattgctatgaaacaggggtggacaatattttctcagtgtgactcgaagcaaatcttaagggacaactccagattgcctctattatagcctgccatttggtcagagaaggaaattaagcagattagtcaagctagatgcttttctttacaaagccatggaggttattactcaagaccttgttatctcaaaggtgtttgcaaattgatttttggataatttgttccaggtagagaagctaggttggcaggcagataatttctaagctcatcctttgtgcatgttaaatatatggaacctttgattgccattatcaactctccagagctcccatcagtctccaatgaggccccaggggtgatattttgcagctctgtgatgactctgcccaattccttaatataattattcacagactagacctctacagaattaagagttgcagacttcaatagtttggaggctgagtgagtggccccatttagttcttttccattgacttttcaccatggttttctgctctcctatttcagacagcagtattcaattgctgaccaccagaaagaaaataaagtattaaatctttccaaatggttagcttcttttcatgtatttctaatggcatgtgcaagtatagtaacaaacatccccttgagtatataaatgtccctatctcaaatgacttgcgacttcacacatttgtgtgcagattagcctcacggttatctctctctccatcccctcaagagtagaccatgtaagtttatcacggtgtttcctctatctggcaccaaggaagccatcagattattgtgtgctttattctttcttttttcagtgatccattgattcataattggcattgtttagaaggcacaggtactggtggttcaaagagagagaagcaaaaatatagcacagaatgtttttggtaagcagcacattattttaaaaatacatagacaaaccctatctatttatagcagttctctatctctaagatgaactcttcaagaagacagtataggaaatgtacagggccatccagtccaatggctagagtcagcagggaggaaaaggaaacccctgtgtatctcatttgccagacagagcactgagcgcatgaaatttaatgcagccaagtaaatcagtgataacaaagtgtagtaaagtcatgatgcgggtggcagaggcagttttgaagcctgtgaaaggacccaatctggtctagaggttagggaagctcttgcagagagcacttaggggagtgttctgctgggaccactcatgttgagtctatgaacaaagaaaaattcctgggggtcccctagttctcagttgcttgggctacactggtcaacaattcaaacgatgtgccctggacactcattcattcactcgttctatgaatgttgagtccctgctgctggtcacacactgtcctaggcacagacacaatcttggctgcatggagctccccttccagccttcactcgaggattgacaaagagaagtcaggagagaaggaagctgactcagaagctgttgagaaggagggcattcgagaatagagaggccctgggagccagacctaggtaagagcttatggatccataaagggatacacatatacacaatggaacgctgctcagcaagaaatgaacaagctgcagacacagacacacacaacaacatgagtaaatctcaaaaaaattcatgcaaaagaaaaataaaagaatgcatgatgaccccacttatgtgaaaagttcaagaacaagaaaaactgctctatggtgataaaagccagaagcatagtgacctgaggggcaggtactgaccgggacagagcctgagggaagtttctgggatgttagaatgttctctatatattgatttgggtaattaaataacagaaatcaaaatagtgttactataagggagatgactgcctgaaagaaggcataagaaaaatttgggaggttataaccatttctgtatcttaactggggttatgtaaaactcattaaactgtgaactttaaacagaagtatttttatgcatataagtgataccttaaaagttaaaaaaaacaaaaatatggatatgtgactcactggatgaagagaatgccactaattacctgaaagggaacctcagaaaattgggagaaaatgagcctttactcctataccattccctcttatcagcaccatcagatgcttgaattcctaacagtttttcaaacaagaggttgttcaggcacacaccagtttcttatccatgaggcttttcacttctaacacaaccaatgccctcttaacagactccacaccatcatctgtgcaaagccaggagtaagtgtttaacatctgacagcaccctctgctcacaaagtttgcaactaaattaaggaggaggaagtcttgccttcatggagctgagggctgagctgggagatgacatcagtgccttccagccaggcatcaaagcgctgcgaggacaaggatgccaggagccatccatgagacctgggcagcagcggccctgagcttccaaggctctccttcaacatgtagatggtgaagtgaccccttcctgtaattctgccacatcctcaggcatcaatctccagaacaattctgtctttcttttccctgctgtgagcacttgtaacagtttgactccctagaaattcctacagagagtaaaagtgtttcaaatagctggagatggagctgtgcgcatgtactgtctgctctagatagaaatcaaacgttttgagaaaaaccaaacgttactaagacgtgaagtgagccttgatatgattaaggtgagtgtaacctagcctccaacactttacaccacacgtctcaccccacctgatcacccttttaactgcattttctattcactgaccctccaggtctgtgggaatgcctccacccacccaaccctagccaccaacacaaacacattcatacacagacagaaacacggttgtgccattctcatttccagacttttgtctgtgccatttttcccaactagaatggctttccttttacttgttttttttgttttgttttgttttgttttgagacagagtctcaccctgtcacccaggctggagtgcagtggtgcaatctcggctcactgaaacctccaactcttgggttcaagcgattttcctgcctcagtctcccaagtagctgggattacaggcacctgtcaccacgtccagctaatttttgtacttttagtagagacgtggtttctccatgtttgccaggcaggtctcaaactccttatctcaggtgatccaccctcctcagcctcccaaagggctgggattacaggcttgagccaccatgcccagccttcaattacttttaactaaaccatgcctatttttcttttcaaaactgcttcatgacgacttactttcgtgtagcacagggctaggcacagagtagatgttcaatgctgattaaactttctacgatttatgcgcaacactgttttcatacaataatggactgaggatcaaaaaggactaccttggggccagggttcaagctttccttgaccttggcttaccactagccagatgtgtgactctactcaatcttcatggtcctcaaatttattttaccttgacaatgaaagattcaagtcataaaagtccctaaattttctctaccaagggccacagggattctatgtgtactgaatgactaccctaacagtgagcaatcggcagtagcccagccttctcattcttccctggcttgggctcacagtccttggacacaacctaagtagatatagcatcaaatcctccagtaggtgccaatcagaattagtctttgttggctgggaacggtgactcattcctgtaatcccagcacattgggaggccaaggcaggaggatcacttgaggtcaggagtttgagaccagcctgaccaacatggtgaaaccctgtctctactaaaaattagctgggcacggtggtaagcacttgtaattccagctactcgggaggctgaggcaggagaatcgcttggacctgggaggcagaggttgcagtgagccaggatcatgccactgcactccaacctgggcaacacagcgagactctgtctcaaaaaaaaaaaaattagtctttgtgccctaaccaaacatacagccagtggtcaataaatatctgatgtcttacttaaatgggtagaaaaaatatttgataagttttcccaaagtgaaaggttgagggtggcaacaaagagatgaaaaagaacaagaagtacgatgttgtagagaatactgaatgcacctctaagcaaaggattggaagtatttagagagaagacatcaaacaactgacagaaagcaacaatcaaagacatatgtaaagaaaacttctctgaaatacccaaaggcctgagtttgcagactctgaagagcacagtgggttccaggcaaaatcaatgatgagacttcagcttaagtacatactggcaatatttttgaaatataaaactaaagaaaaattcccataagccttcagaaaaaataacagatatctatcaaaacaaaataaaaagactaaaaactctggttccagactttatcattacagtttcaaacactgggatgtgatgaggaagaggatgatgagaataatcacaaataacaccatggggcagctcccatgtactgcacactttcagacacctctgactgcccttagtgttctacagtattgattcatttagtcttcacagcaactttatgggtgggtagatacccatccaaagtcaaacagttagtcattcaaaatccaggactgaggccaaggcaacatgcccggggtctgcactcctaaccattatgataaagacaatggtacattatgataaagacaatggtatacacaaaaggtcttaagggggatgtttccagtcccaagagttttataggaggttagttgtggtgcattttcaaagccagcagaaaaaatgctctcagtttctgaagaacgcagagaagaaaatgctatgtgcatgccttcccttagagaaaaactgcttgaagatttaccctagtccgccttgtgatgaatcaaaatcatgacctctagcataggggaattgtgatataagaatgatcagtcctatgagatggttagctaccacaagaccctcctttctcagatgtgagtctagaagaggagcatgatcttgtgccagactgaagtgaacacatagcccaatctgtaagaaggggcagaatggcatgcctttcatccacacagcatttagggaatgcttaaaaacaagcaatttcattatgaacggttaactttagcttcggccatcatcctgaaaagggacatcataaattcctatgaaaaagtctctccttcactttgctgaactaaattcaacaaacaaatctcatctacctaagcttaaaacatctagatttaaatacatgaaaacgctgacgtttttcttagggttatgagaatataggtactattttttctttattctgtttcttatttgatttttttacaaatgcctagtaaacctgcatcagttgcttattataaatataagcatttgaaataggtaaggtttttatatatttcaagcttttacatctggatgtgacctctcttgcagttctctgctctcaatcactaggagtgtttagcagtcaatctcccctcctatctgcccaggtagcaggagtcaagaaccacgattacatccattttcccagcaagttcctcaccaatagttcactaacaaggagacatcctggctacctctgggaccccctcaaagacctccactgtgagttttgacacttgactttcagataatcctctaatcattgcaaccacacagtagtttacctgtttcctcatttttctctccatagtgacaacacaaagcagacagtactacacccttattacagatgaggacaccaaggttacctagaaagcagctgtgtcaataccgcctgctctgtggctacaggcattgcacttcccacctacccgcaagcccaggtgttaccactcccaggagcagcccttacccagtgagggatggaagttggtggataaacatccaggtttccttgacccctagtgggacaatggggtggctttattcagtcttttagatggtcctgggtgggactgagcaccagatatcctctagcacttccagctcatagtgcactcttttttttttttttttttttttttttttttttttttttttttttgagacagagtctcactctgtcacccaggctggagtgcagtggcgcgatctcagctcaccgcagcctccgcctcccgggttcaagtgattctcctgcctcagcctcctgagtagctagaactacaggtgctacaggcatgcgccaccatgcccggctaattttttatatttttggtagagacggggtttcaccatgttggccaggatggtctggatctcctgaccttgtgatccatccgcctcagtgtcccaaagtgctgggattacaggcgtgagccaccctgctcagcccatagtgcactctttaaggggctttctttcttctcagtctcacttcgtctcctgtttaccagtgttccctacaacttagataaactattcgcaaatccatgctaaaggatctgttttttggggaaatccagtctaacatattatgaaaacgagggaaagttacttaacctctttgtgtctaaactgcctcacctgtaaactggggatatagtaacatcttcctcatggtaattgccataaagattatataaattattatagttgatactttagaacagttcctacacgtaacaagtaaactgtctttgctactaatatcatcatcctcccaaccagccaccgatgagccattcagctgtcagtgacagccttaactgatattcttattttgtgcccccccaacagagagacagaaagatcccatcaaacgcattccccttcctgtgtcaggatcaagacagtctacagtcatgtcagtgtgtactcctgccaaaactcctaccagcaaataaatttaagagctcagcctcagtctacttaacaacatcatgttgcaaccagtgaagtcattcagaaatgcataattcaataacaacttagcaccagatgaagttttatgatctgcaacactctgtctgccccggctcccccttatcccccaaaacctcaacattttcaagattactctttgctgggccacttcccaaaattaagagcagagtaaacattctagaagagccttcctttccttgcctgctaatcaggagtcctcagaaagcatgaatcaagagtctgtcacctccaaaggaggggctaggagaagctggattctaaagctttggaatcaaaggccatgcttcaggagcaccttgttccagggcagcatgggttcacaaatgggcacccttcactcccctcccccacctcagccaagcagccctgctatgaagaatggggtgaaagaaactcttgccttatccagtttggatcttaagagttccagagacaaccacgtctgtacacccacaggatggtgagagctgttattattactgtcacgcagcaaggacaaataacattctcataatgttcactgcgtgcctggctctatttcgggatttacatacaaattcatttattcctcatatcacaccggaaagtaagtactattctagtatgcatttatagatgaggagactaaaggagtgtgctagtattcagctctggtctttttgcctcaagcccaccctgttacatcagttatgtaattctggagctgggaccccactaacaacatctctaaactaccttgccagctggctttggtccagtcctagtgatgggagacttcagatggagactgggatgctggaagaaggaagaagatgctctctttctgcttcaaggtccttgtagcatcattccagcaacaggggctgctacgctccaggccttcatcttttctggtctttgtagcacccatggcacagtatctttctgaaggaactaatataacctaggccatgccccttacagctgcagtacaatctgtggggtctccctcctcagaggtctcagaatcagccctgctgtgctcctcctacagacttctaggtaccataacccctcctattccattttgttaccccagccccaggtgtggtcaccacttcctgccatttttggctaccttagcgtcccacttttgcactgacagcctttcatcactgtgtaatggattcccttcaataaaaaccctctgtttgaaatacctggtgtgatttagggtttccctcctggactgtgatttatatcaataggtattataattatctttatttttcacatgaggagaccaaggtacaaattgcccaaggtcatgtggctaattagtgagtgtgctgggatactcaggctgtcttgctctagaggccatgattttaactcacacagtgagctgatgccccactgttctcagcaccctggtcagcgacacagtgaggcaggtacatgaaggctgggagatatcatattctgcctaactaacaagtaatgagggctgactctgctatgtttggggatgtggagtcaaagcaaataactgtctctaccctggaggagactaagagactagggaaggatgcagaaaccaatgagctatagaagaaagtgatacaggctgggaagtggcaggcccagagtcctgtggactcacacagttgtgtggtattgatacagacagaagacagggaagcactgggtagaagagggtggttccccagtaagggccccaccctcaagcctgaagacccacagagctaagtcagcacagacatttctgttttcgcacccaaaaagttgccttttggcccaccatacctccaatcctgtccccatataaacccaagaccttagtgggcacacatacaagtggctgaacgttggaaccagcagaccagtgacaatggaacaatgtggcagagaaagacagaagagaaaggatgtctggacgctgaggggggttcagctggaggcagtcagataagaatctgccactgggcggcccaactccaggggaagaccaccttcccactccatcctccccttctggctccccatccatctcactgagagccacctccacggataaaacctcgcactcatcctttgagcccacatgtgatccaattcttctggtacagtgggcaactgaaggagtgagccacacccgtttcacatcctgcaagggagataagggaaatctctcatttcagtatcatacacagaatagtggtcccaaaagatgctcaattcctaatccccaaaacttacatagactccaaaacttgtatagactctgaagctgtgattaagttaaggatcttgagtagggagcatatcctggatatgtagtatcctggataagtgaagaagggaggcaggagagtcggagagagcgattggaagatgctatgttctggctgtgagggtggagaaagggaccactaggcagggaaagctggtgacgtctagaatctacaaaaggcaagggaatggactcttccctagagtcaaaggaacacagccccactgacccattttagacttctgacctccaatgctataagatcataaatttgtgttgtcttagaccactaactttgtgattggttacagcagcaatcaaaaactaatacaaggagagatatccaaattagatggaggatgttagggaaggcttcctagagcaatcaaatcatgatcttggtcttaaaggaaaaggagagtctaacaggcacaagggtggggttattcacaaagacaagactgggtcatgcacggatggtatatcctgctgaaacacaggtgatggggagcaggggtggggggccagcaaaaaggcaatcagagaggtcaaaagtgacctgatcaggaatggtcttcatcctgaggctgtgtaagcagtggtgtcacgtaggcacaagagttttagggacaactcctctgagtgcacggtgaataatgggtctaagggagagaaacagacagggggaccaataaggaagttgtgtcaattacattgaggaaagaaatgatggaggcataactcaagtaatggccacggggctggagaggcagaggcagaggaactaggccgagggttgggttgggagactgaaaggacaggacttggtcatggattgaatgtaaggagcaaggcatatggaccagtacaaagctagtgttcaacatgctgggtgagtctccccttgacctccacaatgcctgcgcagcccacataagtggaagtctacctcaatttccctgtgcagtaccccagtactctatgctagcttctccaaactatgcccaatacacttcatccctttgcattttcatattcactttcacttacaaagggaagtgaggtgtactggaaagtaaaagatcactgggtcagacagaggttgccttgcaatctctattatttaatggtgtgacattaagcaagtgatataactcccttgtggctgagtttcttcccatgtaaaatcagggtcatggtcatacctcactgggtccttgtgaagatcaagtgtaagtgcctgaaaaatgacaggccctacataaacgtgagttattcctttcttcccatggctattagctttggacccctgcactggtctttctccccattccacagccttctcctgtaatgggccattcagcccagcgcctctagcctcctgagatgccccctctgagcatctgagctctcagggcatcttgggctcatgcatcacatgtatcacgttcgataaaatcaatgtcagctttatgcatgtggtagccactaatctcccaccaggacaggcaactcactttcagaaagcactggaggaaaaacacagtagctgccatagcagaacaaatatgacaagatgacaaagtagagagaaagggggtggtagggagtgagggaagaaacatgcaattcagggcaacctgagtccaggaagcttcgtcagttgctacgctaccagccacagaaagaaaggcttacgcagaaggtgtctgtggctttagagatattgttattttgcaaattcttctccttggcctatccctatgtgcaaggggggagatgcataattagtctgtaagctgctgaaatggctagaaatgactagaagtatcgactgctctgaagtgtcaggaaggggtgtccagatggattaagaggcttatccatagagcctactcagtttgtgggaagagtttaagagatgacaccctcccttatgcaaaggaactgaaaaacgagcttcttccaaatcctccctcattcccctagggctgcctctgcccctgccgtatcttgcctgaagagagacttagcacagcctaactcactgctctttgggaaaggacttcgaaacaacacaattctgcaaggtcccatagacctctgtccctgtctccaaaagccatgattctgactaagccagatggacgctgggctccaagaatagaattagtggcttcatgctgttgtctaccacaggtcactgcctctaggtgcttctgtagaggaagagaacatgaggaaacaggaaggaaaaggtaaatatattgtttatgacattgcaggcactgttctaggtatttctaacatcttattcatgtatttctcaagcataggcccagggaactcaatgacatatacagtgatttccaagggcccatagaaagcaagtctttagctagaacatcttggaacaaaatcctgcttgaaggtgttgggtaggtttgaattttaacacacacaaaaggtttcaatgaaatatcacctttacacaaattatttcagagactccaaagagaagaattacttccaaacttactttacaagcccaggatagctttcattccaagacttcacaaagatatcacatgaaacttttaggccaatctccctcgtaaacacgtaaactaaaatcctacatattgtattaccaagccaatcctgtgatatataaaatgaataacaggttataaccacattaagtttatgctgggactacaagattgatttaatattagaaaatcaatcagtataactcatcatattaacaaactgaaagataaaaatcacatagttgtctcaagagatgctgaggaagcacttgatggaaatcaacagccattcatgataaaacttttagaaaactagaaatagaaggaaagtcctataatctgacaaagggtatctaacacattactctaacatcataatcaatggtaaaatactacacacttttccctgatttccccaattctactggtagttttagccaatgcaatgaggcaagaaaaagaaataaaagaaataaatgttggaaatgaagtaataaagctttcattattcatagactacataattgtgtgtgtagaaaattctttaaaaatctcaaattatgataaaaattaacaagttaatttagaaaagttccatagattaaatataaacaattataaaatgaaatttaaaaagtgccatttacccaatcaatggtaatagacatcataataatggtgacctctaggggaaggagtagtcgactgggaagaaacatgatgaaactaggtaccacaataatttacaccttgatttggaagatggtaatatgggtgtacatgtatatgaaagacattgagctatccacataaggttaacgcactttatgtcctttactgcattctgttctacttcaataacaaacaaattgaataattacttacaaaagcaccagcaaagtattaaaatatctggggatgtatatatacctatatgtgcatttgtgtatatacatgtattcttcttcactgaaaactgccagacattactgggatacatttttaaagatccaaataaatggagagatattccatgctcatgaattagaagaatcaatattgtaaagttgtatattctccttatgttgaagtataagctatcctaataaaatatctgtcaggctttctagacaatttgacaaacttattctgaagtttatataaaaatgcaaaaggccaggaatattcaaagcaatatttaaaaaggaaaagaaagttagagagcttaccttttaggaaattaagatttattattaagctacaataattaagaaaatgaggtattaagctacagtaattaagaaattgaaaaacagttcaagaaacaatggaggcaagaaacaaatccacatattgataatcacttgatctgtgatacagctgacacttcactgtggtaggagaagtgtattctcaacaaaacaattaggattatttaggcatccatatgaaaaaataaccttcaacattgtgccctactttatactataaacaaagtcaattccagggtactatagacctatatgtaaaaggtaaacaataagatttatataaaatagaatgtttctgaccctggggtaggcaaactataatccataaggaaattaaagtggaccacaagggtttctcacgctactcctttagaaccacaaccacctccctccccacttccccacctcatcattcatccctgggaaccaccaatctgttttctacttctaaaattttgttatttccaaaaagacaatatataatctcttgggactgtttttgtcacctgccatcataccctggaaattactccaggttttttttcttttattttattttcttttttttttttttttgagccagagtctcgctctgtcgcccaggctggagtgcagcggcgcgatctcagctcactgcaacctccacctcccaggttcacgccattctcctgcctcagcctctcaagtagctgggactacaggcacccgccaccatgcccggctaattttttgtatttttagtagagacggggtttcactgtgttagccaggatggtctcgatctcctgacctcgtgatccacctgccttggcctcctaaagtgctgggattacaggcatgagccactatgcccggcctagtccaagtttttgtgtgcacggatagttcatttatttttgttgctgtgtagtttacatgtgatatacatatgggtctattgttgtgttgaatgttgtttaaccattctcccgttaagggtcatctaggctattttcaggtttttgctattaaaataaaactgccatgaacagttatgtataggtttttgtgtgaacataagttttcatttttctggggtaaattccttggagttcaatctctgggtcatatggaattcagaactatcaaactgctttccacagcggctacatcattttacattactactatcaatgcatgagtggtccagttcctcacctgtactactattgtcactatttctttttagccattctgataagtatgtagtgatgtttcactgtggttttaatttatactaccttaatggctaatagcatggaacatcttttcaagtgtttatctcatctgtacagcctagtgcagcttgatagctggttctggctggggtcactcagaaggctgcaaacaggatgtctactgtggctacagtcctctcagggcctgactaggataggatctgcttccaagctcacagagctcctggctgtcttcagaagacccactgcaaagatcatgcatggccaggcgggggtggctcatgcctgtaatcccagccctttgggaggccgaggcgggagggtgaaatatctcatcatatcttttgcaaattttctaattgttttgtcattgagttttaagaattcttgatatattctagacattagtcctttgtcatatatatggttggcaaatattttctttcactctgtagcttatcttttcatcctccttgcctgagctttcacagagcaaaaattttaactttaataaggttcaatttatcaatttttcagttagaaatcatgcttttgatgtcaggtctgtattaactttttacttttaattatactcaaatgtatcagagctcacaaatccattcagattcctgatgaaatggtgttcagtcaaatatttggttcacaaacacacaactacgcttgattctatttcctaccatagagtttctgaataacagatatgctgaaaaatatgtctggattgttttgaaagttttagtggtatttattttttagaagtttgatattttaaaaattatgttttcggtcaggatgatgaatagttaatttaaaataagaaaattaaagaatatactcaaaactgtggaaaagatggaagaccatacaatttggaacaacctacaaactgggaagcatgtatccaacacagcactgtccttcagagtctcttcattgaacttaacaaggaagaagatgggatcactaccccaagttcaattaatgattcattagtaagcagctgtcaatctggaaaatgtaagatagacttagatacttaatatgtgacttttactactgtaaatcttcaaagggctaaaacttgatatctctcatgcaagaaaatctggcaacatctgcataagaccatcactgctgtggtgatatttaaagaccaattattggcagcctgcagcctccagcctctacaatgaccctcagtgactccctcctcctgtcattcatggccttcagtaaccctatcacttagagagtgggctggacctagtgactcgcttctagcagagtacagcaaaagcgatgtgataatatttctgagattctgttacactaagtctaccattttacttgcctctctccttctctcttccccttccctttccccttttcctctgctcttccctcccttttcttccctctcccctaaaccctctctttttctatctcccaatcatctctctctttctccttcttctcactttcccctgatctcttttttcctctatttctctcctcctgtcccccttcctcctccctcttctctccctttttatctttctgtttcgcttcctccctccctccctccttccctcctcctctctcccgttctcctttctctgtttcctctctctgccatgtcatgagtggtttcataaagaaacacatatttaagccaacaactaacaaggttctaaagccttccaatagccacatgaattatttttttttttttttgagacagagcctcgctctgtcgcccaggctggagtgcagtggcatgatctcggctcactgcaagctcttccccccgggttcacaccattctcctgcctcagcctcccaagtagctgggactacaggcacctgctaccacacccggctaattttttgtattttttgtagagactgggtttcaccatgttagccaggatggtctgcatctcctgacctcatgatccacctgctttggccttccgaagtgctgggattacaggtgtgagccaccccgcccggccatgaatgatctttgaagtgagtcttctgaagacagccaggagctctgcgagcttgggagcagatcctatcctagtcaggccctgagacaactgtagccccagtagacaccctgcttgcagccttctgagtgactccagccagaaccagctatcaagctgcactaaagctcctaaggcattcttgtgagataataaatgtttcttaaggcactttattttgtaacataggtcatagacaactaagacatcaaacatactccatagatagctaataatgtagcttaatattaccagactttttttgtgtcttaaaaaagtcttagcttgaagttaatataataaaaaggtacaagcggatgcaccagagaaaaaaacaaaacaaataaacaaaaaaagaaacagaaaaacttgacacttcctttaacatcagtttcagaatcaccattgaaggtgaagcttagaaagtaggcaaaagcctggagaagatgtggctgaatctgtttcagataaacataaaaggatacgggttactgttattgaaggacactgtcaaaggaggcattttaatgcacttcaagtgtgtccaaacatttggttaacccagtgttttattttacagtggtaaataaacatgcgcaacttctggccattttatacatttcctctgtatattctatgatcctgatatcaaggaagacattaacttgcaaattactcgaaaggaagataaccggtaaggaaatggtcagtaagatatggatggatgtttgcacacatggaactcaatacaaaacagacacggccatggggcagacactgggtcttcacacacacagcaaggattgttaattcaaatgttccagcacgtgaagcatcacttaataataaagctcgtcctaaaatctacttctttatttcatcaatggggtggtaaaaaagtaggaaaaatggaaaaaactcgcctttgtgggcatgtacacaataaaatgagaagtgaatttgaaagcatgctctgcttcaaagatataccttggcctattcaatggggcacattgatggtctcagtgaaattgccatcattcttcattgaggaagaacacatataagcaataacaaagttctcttaaaattcttgcctaaagcctcatctagatcttaatcagtaaagcaatctgcttaaagccacatataacaaagaacacacaggtttaatgtagcaattttcccgaagtattaactttttttaaaaaaagaattgatctctaatcgtatcattcctatagagctcttcacagcttgcaggcatttatggactcttcaaattgccccatgaacttcctctcctacctttgattcccctaaaggaaaggaaatgtaactttgattgtatgttcctagttggaaacccaacaaggtttcccaacagctagtgtgtactcaagattgaccctgaactatcgatgttctgcccagaaggctgatgtgagcacatttaggggttttaaggtcaattcaaaagctaaagtaaccagttcctttacagacaagaagcataaactgggcctctctaagaaatgaggtgtgtcattatgaaaactgcagggcttaatgcttacaggacccctctgaaaggactaaattgtacccacacctaaatggcaaacgcctgggtccctccaagtccatttccaactaaggtccaagtactgcttttactaaaagtcctttgtattaagctatcccactctaaaaaaaatatcttcatgggttgcaccagtggcctcaaacttggctgcacattagaatcatgcagagaagttttggagttcctaatgcttaggtctcaacccttaccaatgaaatcagaatctatgcgggaagttaaaattgtcaaaaattccctagttgtctccaatatgcagccaagttggagaaacattgggaggcatcatttattcattcatccaaagatttcctgaacactcattatatgcttggcctctaggtgattccccaaccgcccgggtctttgggtggtcatgtcttatgcatctctgtgtgtctaactctagcatcagaggcaacaatgaatgcatacatgaatgaatgaatgaatgaatgaatgaacgaacaaataaatggcccttcttatctgcctctccctgacttgggatacaggaaggatttctaatgcttacagatagctctgcatagattaacccaacaaacaactaacaacgatgtagtaataatgcctgaaaaacttggcaatgaagaggagagacgatggagaagaaatctagtctcatgatgttttctttgcaaacaacctaaaaaggagtaaaaagcacagtctcaagggaccagtgcattacctcttactctatactcccacggaatccttaggcattgagacacctcacatatttacactgatcacatctgaacaatgccacctcacatatttacactgatcacatctgaaatatacatggtcacatacaccaaatcacatctcaagtatatgtgatcattttgcacctgctgaaatagtttcttccttcaaggccctgttaatattgcatctgcttgagaaagccttctaggagaccagcagcctccctgacatgttccaaagtgcagtacatgagattaaataaggtgcacactcatggatatttacttataaattattttaatagtcaaaaatgtacattaacttgtaaaagaagacagacttccttctatcatagtaatatgcactctcatttgaaaaatcaaggaaagcatgtgtcatttttaaaaagcaataatatgaaacacataagagaacagatgggaaaaactcatgaaggggacacaggaaagactttagtgtgggaaactcagctagaagcctttgtagtctacatagtcctgttaccctctgcattgtgtcagtatcatgtctgtgtctttttcccctacaagagagtcatcacagggcagggattatggccaatcatgcttgcactcctcactacgccaagtacagtgccttacaaaggaattctgaatcgacaaaatttttctgtgattgtgttaccagtcccatttaggttaaaagcaattgacaaaaaaagtaagcccacaaactaatttgggtcattgctaaaaatataaaattgatattattctcagaagcagccctaaatagatgacgtgtcatgtgccgctttcctacctacccatctttccaggtcttgatccttctccctgacaacagcagtgagaccctgacccctgatttcttctctaccagcttggccactgggcagtgaatccaggaaagcacttaagtcacaagagatttgaaagatttcttgacatagcactcgaccatctctaacctagcgtttggggatttttcagaaaattatctctgacaaaacgaaacacaaacctcatttcgatgtgaccaccagcttgagaagcccacggaagtcaccttgcccttctcgcctgagctctgtgtgatgcagctcctggggtctctccacagcaggcagtcctctcctgtccctcccactgagcctcagcccccatcaagaagcctggaggctggcaggcccccctcacacaagctgtgtggtataaaaggatctgacatggcttaggaaacagacgcagagcgcctcgactacaccgcggatattttctcagtttaaaaaaatgtgttctcacttaagaatgctaatggcccatgcacagaaataaaatccctgacctactttgaagctgaacttattaaacaagccgaccttattactcagaagagactgtaaaacagtagaataaagcccaaatagaattcctcgcatccctcgttaacaggagcagccaagaaaagcacaaaaggatgtcagagccctgggctgggagtcagaaaccagggcctggtccagctttttgatgactttctgtgtggcctgggataagtcaccatccctctctggctctcagaaccctcatctaggggctggacaaggaggtctctgaggccatttccacctactataactggagatcttattttttaggagcgtaatgttaaagtaaaataaaaatcaattatcaagggcatattatcagacacactaagacaggtgagggagtaagatggacattctgcctcctaggagcctatagccaggcagagccagtgggggcggtccacactgattaatggatttatttcccaacagcaatttgaaagccgccacaaggctacatacagcagacataacacaacttgtgtctgcaacaagaattccctctggctctccacctgacaactcagtttagtcgaatgaatctttcggtgtattttaaaccaccgcagagtcatgagtggccatccgtaagttataatcaaatttatcacactgggaaggaagagagtggggatacatttccacgggattttagggcagtaatgtgagtcattcctgctcattctggagaaaatcctggaactgcaaggtaagttatccaaaccagaatcagagaaaggcagggaaggtcactgatgtaacagtaggcattagtaacccacacaacagtagattagtcagtaatgataggtgctaccgtgggatgcttaaatgatgttactgagaaaatgtcatggtgcaatgtaattagagggcccccttttcaaatttcaggctcagagactcttctcttcattgactctttagcatatgctcaacctcacagagctcagaaaagaaagccagcggagagaagaaattccccaaaaagggacaagtggacctggggtttacattgagaattgcaaatcccatagtctctcccaggcatggccagggtgaactcaggacttgaaatggtgtgcacaaattccaaggcagagcaagatgtgggcaatcctatagagactggatgtccgcaattggagaatgtggtgtcccagggaaagatttagaagggtcccaccaagaagacacttggatcacgagctctgctgtcatcgttttcatagtcctcacactaagtagcctgctacagtgctccataccttggaggtatttgagtccccaaaggtactgtggaacagctagatctagagttcttgtttctgcccattttacagatacgagcactgagattcagagagatatacgcaaggccatagaggtatcaagtggcaaaacaggtaagagtgtgtgcagccccgcgtcaccgaggttaacccttaccctaacccgactctaatcccagcccctccctctctgtttacccacttcccacttgtcacacttgcttaacctcaaatttcccacagctgctaatcacagtctgcacccaccaatcacatcctgttccaccctcatgagtatcctcccacctcctgtgggagtgttgctgaactttgaacagagtgttctttgtcctccactattggtgcttgtatcatgatgggcctattctgacagctattctttgagctgtttggggtgtctccatgttgttgggcccagaaggtattctcttcatcttctcaatgtgcaatgctcattaacatctccagggatcaacacggataataaagaggaagcagagagcccaaggttgcaaggaaggcaaaccacaaccttgctgcagaggctttaaaaggctggggtgaaaagtcatttgaatgtttccagtcctgaatgcattctctgtactgcatctgacaaagctcccttgacacactgaacccccatggatccttttccccctagcaaagggagcaaaactcttaacaatctacttcagtgcatctccataaacagtggccgtccagcacccctgggagggctgccctgtgtcctgtaatgaatgcaggcccatggaaagtattgtaaagatccacagccctacagaactttgagaacactgttctatcaccattaacctacagtgggaaacagaggccaagaggtagcaaggtggtgtttatcaagttcccttagaaagtcagtggcagagctagaaccagatcttcttgattcaaaggctctacctaacacagtttatacttccctgagcatccctgaggagaacatctcttagttttgtttttgcctctcaaattcaattcacaattcttctggttaagcaccttcgcaaatttctcttaaagacccctatcccatagccagcccatatggtttgggatttatcctgccagcagcagggtatgatcagagtaggttcagattagcttaagtcaatcagcatatctactttcccactcccatagtttagggatggacacacgacccaattctgcccaactgcaatcataaatagtttattcatccataagggagaatgctgggattagtactgctgcagacttcatctgaccatgtggggccagagaataagaatgtggagaaagggaaagagagacacagagagagagagagagacagagacagacacaccagaattctatggaagtgctgtttgaacctttaattagctcacactggaagccagtaaaacctattcattgactatttccataaaaaaaattcctctgttgagtaacaaaaacaaagatagtagaaaagaaaggaggaaagaaaagaaaaaagagacagaaaaggaaataagagaaaagtaaagaaagagcattgttaccaggagtggggtgaatggaagttgaaccccaacctaaaagtggtcttggctatggtaggcagagctatgtgcagtgggcccagcaacatagagttctcatgatccaactgatgctcctctttctgctccttttactgcaacccaggttttatttattaaacctcagctcttggaagacgaagcttagagaccatctagcctcactccttccatttactacacagaaaagcttatctcaaagagggaaggaacttatccaaggccatacaagaatccaaggaacagtcacttatagaaacatcacgtgtgccttagagagctttgtaaaaccagatgccacctctacttgcccctgcacacgagctctctgcggcttcctactgtgctctaagaaatagaaaagcagctcctgtcatccggggtttggtcctatcagctaaaacttgatgttgttggaagctggcccaactttctcacccaggccattttgttcccctattggacctaaacaatcttacacaacaccaagatcaggtcaggtcattctgtagccacagtgaagtgataaggaacaagatgacttcatatttttttttctaagcaagacaaaaccaaggtcactgtgcaaatcgcaaaataccatgtatctttcttgtccagctcaaatgagtggctgccgcaactctaccaattatagctttaatcttgctctactattatccccttctagattaggtttcctcagatattcaatcatagaattgtccccacttcctaacagctcaatctagaaaaaactccacccccttgatgtctcccaaaatcatccatccaaagcccaaatcccttaacactgtcttgccgagacaccccatggttctctgtggtgtacattctccctcactacaataagtcataaacccaacttgttcaactatgggtgtgttcctaatggtctttagctggaaggcgttgatatccaaaaaaaaaaaaaaagttccacttcctttcctgatacagaattctttccataatcaagctttcctattgagtccacctccatgtcatgcatgccatcttgtgccatggcaaactaaataccattctgggcctttctaccttccacattcagatcctgttaactggaaaacccctcttctctgatcctctgacagaactaatttgggaagccttctctgaccccaggtagacaaaacaaaccctcatgcctctctgctacttccctatgctgcacacacactgttatgcacccatcacaccgaactgtaattatgcataaccccagactgcaaagctctctgaaggaaagggtcatgtaggggctgatacagaatagaggctccaggtattggctgtttactttcttcctacactgaaatgaatacctttcctattcgattgttgtcatacttcaaatcatattccaaataagcatcaaaaataataacatgcggccgggcgtggtggctcatacctgtaatcccagcactttgggagattgaggcaggcagatcacctgaggtcggaagttcgagaccagcctgaccaacatggagaaaccccatctctactaaaaatacaaaatcagctgggcatggtggtgcatgcctgtaatcccagctactcaggaggctgaggcaggagaatcactttaacccgggaggcagaggttgccctgagccaagattgcactactgcaccccagcatgggcaaaaagagtgaaattgtatctcgaaataataataataataattgttacacacgtccatataaaaggctacttgagcaggcttagagtgagcaacaaggctgtttattcacttgggtgcaagtgggctgagtccgagaaaggagtcagcgaagggtggtgggattatcgttggttcttataggtttgggataggtggtggagttaggagcaatttttgcaggcagcattcacaagggcggggtggggggaggtgcgggggtgtattgtcactagggtggggaggaatgttacaaagtacattcacaaggaaagggaatatcacaaagtacattatcacaaggacagggaatgtcacgatggcttgaccatggtgtggctagctcagaggaccttacaataataataatgataatgtgcaaatcaagactcctgtgaaagtgcagctttggtctgttgtaatcatgtcacttgtcacctgcacaatgctctcagacttgcaaagcacttcctcattaccttgtctcatttaatgcagtcctcatggcaaccttggcttctattgtggcttctcatttctgttatgtctactcttccaagatgcttagacacatgggggactcaaggctgggatgaaatcagggaataactgtagttgtctgtcacataataataagcatttagtacatgttagctattgatatgattatgttatgaacattactcttactattatggactaggatggtcctaggcctgttcaccattagatagattccttgcccttgatctgttctgctctgtataatggggagaggttggagtggagattagggggtggggaacaggtttcccaagctcctcagctggcttctgatttgatcagctagatgcactcttaggagattaggaggagggagactccaggtcatgtatgtctgtctgtctgtgtctgtctgtctctctttgtctctctttatctctctctctctctctgtttgtgtgtgtgtgtgtgtgtgtgtgtgtgtgtgtgtgtgtatgtgtgtgtgtgtctatctgtctctctccccactaaccctctcttctttaggcagatgttcttgtagcatctcaggccaatgctggacttcccaccatagcttctgtttgttgttaatctctgaattggctcatctttgcaaccaattccctacattaaattccttctgtttgaaacatctggagtttgtatttttttttgctgggccttgattagtggatgtactaggtacgtacatttgagcaagttacttgctgcattaaagtatttttatcctgtgaaaagttgctaatatctcaacattttgtattgagcatagaaagtaaaacatatgggcacataggcatctcagcacctggcacatagcagtcattttaaaaatttagtttcttctttcttcattagaaagaattgttatgtgcaaagatctcattctagggactccctagataaagaaataactgaaactattacagaatcaacaatgattattacaaaattatgtgccatacagaatcttgaaatacctaaaaatacaattacagcatattgtcatataattgtgtccacccaaaagaatatgttgaagtcctaaccctcagtacctcagaatgttaccttatttggaaatagggttgttgcagatgtaatctgttcaagatgaaacactatactggaatagggttggccttaatccaatttggctggtgtctttataggagaagatgcacagacagggaaacagggagaatgcagtgtgaagacagaggactggagtaatgaatctacaagacgaggatgccaaagattgccaggcaacctccaaaagccaggaagaggcaaggaagaattacccttcagattccaaaaggagtctggccctgctaacaccttgctgtcagactcttagcctccagaactgtgagtgaataaatttctgtgtgttgtttttttgtttgttgttttttttgccacacacagtttgtggtgctttgttgtagcagccctaggaaattaatagaatggtaagaaaagataatgagttggtagaattctgttggctcttaacattttcatcctgttatacgggccctgtataatccttgggagcatgcatatgccgagatagcattcccatgagtaggttatgttacatggcacccttgactctaagaaagggagattattctgagtagatctgacatagtaaggtgaactcttaaaaaagatggaaattccttctggcgaaagagatgtgtggtgtcagaacatttttatttgagagacaggctccatttttggctttgaagatgaaggaagcacatgacaaagaatgtgtgtggcctctaggagctgagagtggccaccggctaatagccagcaaagaaatggggccttcagtcccaccatcacaaggatcagaattcaaccagcaacaaggatgagcctagagctaggcatggtgatgtatgcctttagtctcagctactgggggaggctgaggcaagaggatcagctgagctcaggagtttcagaccagcctgagcaacacagcaataccccatctcgaaaatcaaaacacaatgagcttgaagcagatttttatccagtgtctccagatgaaaattcagctcagctaacaccttgactccagctttgtgttatattgaagagattccaaccatgctatgcccaggtttctaacctacagaactctgagatcataaattattttaagctgccaagtttgtggtaatttcttatgcaaaaatagaaaaccaatacaggtaggtacattcactccttaaaattgtatgcaattattaaattataaaaatgctaaaggtcataaagaaatatgcaaaatatgtgtaatatagcattaactttaaaataactgaaataaaatggtactctcttctgatggtatctatgccaaatacatatttatgtggataaaacaaaaaatcaaagagactttggatgtactagggtgacaggattattagttcaaagttgtcattagtcttcttttatcattttaagaatataaaatattataaaattcaagatttttcttgcccccagcccacattgaacagacaggatagactctaataggaagcatggtgtcctatgagccaagctacttgaaaaagagaaccacatgagaactgacatcctataaaattccactggagagagagatttctcagttagattaatatatcaccacatcacaatgactcatttctctagaaattccacacaggccctccttgtggccattctcctccctgcccaagagaaagaaacatagacaccgtatacttggggctaaaattgcagcttgtgttaagggcccaagatagcaggcatgctctacacgttccactttgcatttcccgtaggtctctgtcttggtctttctctttccatagctacctcctaagtggcttgaacaagttgcttaacattctgtggcctcagtgccctatcataataaagacattatgaatgtattacttaataaattgtacttccctctttttccatatatttgctgtgtgatcttagggaatacagtctctagcagtttcagttttacaacacctgaaatgggtgatgactacccatgcctacctccataggaatgttgctagcattggcattaacgagcagaattacactgttaaaggtcaagccagagagaggacaccaaatcccatccatagcagagagaatgggcagcaagtgctgcaaatggaggctgccaggtggaggtgtacagagaggtttctgcctcagagaactgaaaatccaaatactacatggtgtaatgtaaactcagaggcatgccaagcttgtagcttgctttggttattaaaatgtgagtacaaaggacctaaggtccttcgggacagaaagggccagtgctcagttccccacatcctcttttcctctttgtcatagtcaccagcaaagttacagatggcggctgctctatcatcttgcagtgtgttacggatgtttgtcccctccacagaatctcatgttgaaatgtaatctccagtgttggaggtgggacctggtggaaggtgtttcggtcataggggtggatccatcacgaatggcttgatggcctccttgcagtaataagttcacatagatctggttatttaaaagagcctaggacttttcttctctctcccttgctccctttcttgccatgtgacaagcaggctcccttttgccttccaccattattggaagcttcctggggcccttgctagaaatagatgctaccagtatgctttgtgtacagcctgtagaaccattagccaaatagaccttttttctttataaattacccaacctcagatattcctttatagcaatgtaaaatggactaacacagaaaattggtaccaggaatggagtgttgctataaaagtacctgaagatgttgaactggtttttgaactggtaatgggcagaggctggaagagtttggagatttcagaaaaagagagggagatgagggaaagtttggaacgtcttagagacttgttaagtggttgtgaccaaaatgctgatagaaatacggacagtgaaggccaggctgatgaggtcttagatggaaatgaaggatttattagggactagaataaaggtcactcatgttacaccctagcaaaaaacttggctgcattatgctcatgccctaagaatctgtggaaggttgaacttaagagtgatgacttagggtaactggcagaataaatttctaagcagcaaagtgttcaagatatggcctggctgcttctaatagcctatgatcagatgtgggaacaaaggagtgaccaagttcagaacttataattaaaagaaaagcagaaagtataacattggaaaatctgcagcctggccatatgggagagaaagaaagaactttttcagaagaggaattcaagtgggctatagagaaaccatttgctagagagattagcatgactaaaagggagacaagggctaatagccaagacaatgggggaaaggccttaaatccatttcagagatcctcagtacagcccctcccatcacaggcccagaggcataggaggaaagaatggttttaggggccaggcatgggacccttctgccctgcccagcctcaggacactgctccctatatcctggctgctccagctcccactgtggctcaaagggccccagatacagctcaggttgccagcccagagggcacaatccataagccttggaagcttccacatggtgttatgtttgcaagtgcacagaatgcaggctttctgatacatcctctgaaatctaggtggaagctggtaagcatccttcactcttgcactctggcctgccacaagggcagagccctgcaaagagactctactagagcagtgccatggagaaatgtggggctggagcccccacaaagattccccaccagggtactgcacagtggaattgtgggaatgagggccactgccctccagatcccagaatggtagagccaccagcagcttgtactctgagcctgaaaaaacagaaggtactcaactccaacccatgagagcagccacatgggctgtgtccaagaaagccacagggacaggaatgcccaaggccttgggagcccaccccttgcaccaatgtgccttagatatgggacatagagtcaaaggaggttgttttagagctttaagatttaatgcctgccctgctgggttccagacttgcatggggcctgttgcccttttcttcgggccaatttctcccttctggaatggcagtgtttacctaatcctgtactactattgcatctttgaaataaataacttgtttttggtattgtaggctcatggatggaaggaacttgttttgagtctcagataagactatgaacttttgacttctgagtggatgctctaataagttaagactttggggaactactgggaagaaatgaatgtgttttgcatgtgagaaggacatgatatttggggtccaggggtggaatgatatagtttgaatgtttgccccctctacaaatctcttgttgaaaagtaatccccagtgtgggaggtgggacctggtgggaggtgtttgggtcatggggggcagatccctcatgaatgtcttaaggctctccctgtggtaatccattcacatgagatctggttgtttaaaagagcccagcacctccacctctctcttgctccatctcttgccatgtgacataatggtttccctttgccttccaccatgattggaagcctcctgaggccctcaccagaagcaaatgctggcactatgcttcatatacagcttacacaaccatgcagagccaaataaacctcttttctttataaatttttcattctcaggtatttctttatagtgattcaaaatgaactagcacatcttggatcccatgtatagagtagagccctatccaaatgccaaggaatatgaacaaattgaacttttttttttctagcctcggacttatggggctgtttgttactgcagcattacctcctgcatcctatctagtatagctttaagctactctccccctctaacaagtggagaaaatgaggctgacagatgaaatcattggctcaaaagcacatggctaccactgatagaaccaagactcaagttcaggtggcctgactccacagcccatgactctcattcactgtggaaacttccctctgccccttgatgcctggataacccaacattgtgttcaagtggaagcagggatgtcacaagaatcccactttaaaatgagcagtatactgtgccattcattacctggactaatgagacaaaggtgatgcaggagatgccaagcatgagggcattctgacagcaagaggtatctcattaggaaaataatcctgaatgacattgttcttctctcaacaggctcccgaagaggtccaggtgccaagatagtccctttccccaagtcccacaggatctaattgtgggttctgccctgcctggatgtcagcttagattttctcaggccacaactggcttggcagtgggtatgttagccctgattttaagagaagcaaacattatgtagcagcccaaaaaagaagcccctactgagaactttgggtactaagagacaggttctatgtactcctcccagttgatgatactcagtgagatgacatgtttgccagggacagtacacatctgtgcaccctgaggttatgcaagatcactcaggctaaacagttaggatacccagattcacgaccacctcaaaaacagactatcagcgtgaccttggttctatctctgagccctggactccctattcatagcacaagagaaatggaaaagtgatatgtaaggtgatttccagcttaaaatataataataaaaactgatgtcaactctcacacatagctgataggcctataaattggtacatcccctatggagaataatttggccatatctatcaaagttaaaaatgtttagcaatctcagacctaggaattatgctaaagatatgcttgcacagtgaaataatgtttgctcaaagtaattcattgcaatattgtttgtaacaggaaaaaactgaaagcaatccaaatgcccacctatagaacccaagtaaataaatgatggtgcgtgcatacaatggaatatcccagagctatgagaaaggaggaagctctttatgtctgaatgcagaaatacatccaagatacattaagtggaaaaaaataaagccaaaagagtttttgaaatacgctacaatttatgtaagaaaaagaagataatatgatggggatttaattttgattaatctacacatgaaatacctttggaaagatatacatacacatacacacgtacacgcacacatacacacacacacacacacacacacacagagtaacattggtaatctccagggaagagaaatgtgtggctaggataaggaataaaaagagtaattttcagtgtacctttttctttcttttgattttttgaaccacataaatatattaccacaaaaaaatgagtaacattgcaatatttttaactgctgccagccaggggttgaataagaatcaagaaaattcccaaaagcacattctgaagatgctgacgaatctcaagtatcttcctcctggagcccactacccaaaggtttctcatgggcaaaatttttctcttctctattcccagtatacattgtattatctgccttcctatcatccattgctcttcagaaatttcaccatataccttaaatgaaactgtaagacttttaacattttcttttcaattttgaaaaaaatgaacttagggataagtgaaggaagacatgtgatacagtttggatgtgtgtccctgccagactgcactaaaatgtaaccccgattgttggaggtgggatgtagtgggaggtgactggatcatgggagcggatttctcacaaatagtttagcaccatccctcttggtactgtccttactatagtgagtgagttctcttaaaagctggtcatttaaaagtgcatagcacctccccctctctcttcctccagttcgggccatgtgacatgcctgcttcccctttgccttctgccatgactataagtttcctgagacctccccagaagcctagcaggtgatagcattacgtttcctgtataacctgcagaaccatgagccaattaaatctctttctttataaattatccagtctcaggtatttctttatagcaacgcaagaatggactaagacaacacggaaagaagtaagcagaaccaagctctaggtagggctctcatttcccatgcagctgttgggtgagcaccttgccctctcagagcctcagtttccccactggttcaaaaagagctatgggatagctgaggtctcaggtctacttccttccagctttatgtttctggggttctaagaatcatgtggaatagagaaaaggcaagaccacattttggaggaaactttggaccagctgcctgatgagcattttctcactttactgtcatctggcaacatcctaaatgaaccaatgagtgtccagatgggggccaaactatgagtcaaatcaacacacactcacttattatttatgtacaaattctgtgacaggtgcagtattagaagccagaaatacaactataaacaggatacaattctgcctggacagagatcatagtataaagtacactatgtagcagacaaaaaggtgatttcagtctccagcatctcatgacaaacacgtccacatctggccacaactgactaactggcacttaacttggtatcctgccaaaacaatcaaaacactacaaaaatatatgagtgattttttccagcacagtattttgatcattgatagcgaagaaatacagaagtgagactcatgtttgtcttggctttctgcctggtggttattttctagacccgacacagagaggtggaggccaaacagcatcgcagtcttgttgaactgaggaacccgaattagagttctgggctgctgactcatctggaatttgtgaggaagggtaccagagagttcatatggggagtacctgttagaatttggatattggctggcctgcatatttgcaaggtaaaactctgtaaggtctagaaaagagtggttgatgcagggctgagagctgaacagaaatgtgagaggttgaccagtgctgggaacctctggaatcctggcccacctgcagtggagttgcagttgaggcttcagaaagagcaggttatagtagtgaatattacatcaaaatcaaagtaaggcacacacatgaagataactgataagccaaaatagatccctcctaacaaagtataagacaataatgacagtttcagaaggacacgccggtaatttaactgcttaccaggataaaattcaataccatttaagtccaatcaatataatccagaccacctacagcaaactatctaccattcttaggtaacaaacaggacataaataagtaattagataggcaaacaaataaggagtaaaatgaacagatcccaagataattcagatgttagaatttgcagatgagaactttaaaatagatactataaatatttttgaaagatttaaagaaaattggatataatgggaggatagctaggaaatcacagcagagacatcagaagtaagaaaataaaaataaaaatctgatgactaaaaactaccatatctaaaataaaaagcttactctggggttagtagcagtgcaggcactgcagaagaaagagtccttgaatataaaagcagatcaacagaactaatccagtctgaacaatggatacatatacacaaatattaaaaaataaagagactttgcaacccgtgacagtgcagaaaaatatctttaacacatttctgagaattttaaaaaaacataaggaaccaagagagataccatattcatggattggaaggttccaattaagtggtagattctcccaaaattgctctacagacttagcgtaaattttgatcaaaatcccaaaagtattttttctttttaaataaatcaacatattggtgctaaagcttgtatggaagtataaagaaccaaaaatagttaaaacaatcttgattaaaagagtccatgtgcaaatccagagatatatgggaactttatactttttactcacatttgctgtgaacctaacactgctctaaaaaataaaatacattgtttaaaaagtacttgtgcagtgggacttgctctattgcacttctgttgtaagaatcttccactcttggtggctgctcccacggttctgggtctcagaatgaaaaaagagcatagatctgagctggccagacccacagcttgaatagagatgctctgctaaatagctcggatcagctgactcctaactaaaccacagacatgtgagcaaaaaaataattgctatttaaaaaaaaattgcagagggtatatacccagtaatgggatggctgggtcaaatggtatttctagttctagatctctgaggaattgccatactgtcttccacatggttgaactagtttacagtcccaccaacagtataaaagtgttcctatttctccacatcctctccagcacctgttgtttcctgactttttaatgatcgccattccaactggtgtgagatggtatctcattgtggctttgattttcatttctctgatgaccagtgatgatgagcattttttcatgtgtcttttggttgcataaatgtcttcttttgagaagtgcctgttcatatccttcacccactttttgatggggttgtttgtttttttcttgtaaatttgtttgagttcgttgtagattctggatattagccctttgtcagatgagtacattgcaaaaattttctcccattcccaaaggattataaatcatgctgctataaagacacacgcacatgtatgtttattgtggcactactcacaatagcaaagacttggaaccaacccaaatgtccaacaatgatggactggattaagaaaatgtagcacatatacaccatggaatactatgcagccataaaaaatgatgagttcatgtcctttgtagggacatggatgaagcaggaaaccatcattctcagcaaactatcataaggacaaaaaaccaaacaccgcatgttctcactcataggtgggaattgaacaataagaacacatggacacaggaaggggaacatcacacaccagggcctgttgtggggtggggggaggcgggagggatagcattaggagatatacctaatgttaaatgatgagttaatgggtacagcacaccaacatggcacatgtatacatatgtaactaacctgcacgttgtgcacatgtaccctaaaacttaaagtataataataataataataataataataataataaaagcagaggtgtaggtcttacatggatttcaagacttgtcataaagctataacaattaagacaacaagacatcaaaataatgataaaaaatagatctacagaaaaaaaagaacaacagcagaagatccaaaataaacccttacatatgcagacacctgatatattataaaggttcaactgaaatcagctggggaaagatgatatttttaacaagagtcctgggtcaactgatatccatacagacagaatcaaagtgacagtttttatagtatctatataacactttatgtgaaaatcaattttagatggattacatagacctatatttgaaatgtagagtaatagaaattctaaagataatgtgagacaggattttttttttattgtggggaacacaagtatttcttaaatatggcaaaaataaataaaagactgataatgggacatctttaaaatcaaaactgttattcatcaacagatgccattaattaagtgaaaaggcaagctacagaaagaaaaaggatatttatgatatgtatacaaggactcagatctagtaaatataaagaactacaaatcaataagacacaactcaatataaaaaaacaaaagacctgaatatccaattcaaacacatgacatcaagatcacctgtgtgtgtgtgtgtgtgtgcatgcgcgtgcacacgcgcatatgtaaaggttgctcaatttcactagtcatcagaaaaataccacaatgagctatcaccacatacctaccagaatggctaatattaaaacacagacaacaccaatatgcaatctgtcatattagaaagctatttggcagtatctgcttaagccaaagaacaactctactcctagttacatatccaagagaaatggagtccaatactaccaaaaacacgtacagaatatttacagtcacgtggttcattatgtctaaataatagaaacaactcagatgtctgtaagcagtagaatggatacattttggtatattcattccatgacatactatttaagagtaacaacgtgggccaggcacggtggctcacgcctgtaatcccagcactttgggaggccgaggcgggtggatcacgaggtcaggggatcaagaccatactggctaacacggtgaaaccccatctccactaaaaatacaaaaaatcagccgggcttggtggcgggcgccagtagttccagctactcgggaggctgaggcaggggaatggcgtgaacccagggggcggagcttgcagtgggccgagattgcgccactgcactccagcctgggagacagagcaagactctgccttaaaaaaaataaattaaaaataaattaaaaagtgaatacaacatggatgagactcaaatataatttcaagtggaagaaactagccaaaaaatatataatttatgctcttatttatataaaattcaaaaacagggaaaataattctagtagtcacaatacctttgcaaaggagaatcaatgacttggagtgagaccgaggagggcttctgaggtgctggttatattctgtatctcgatcaggatgttgtttacattattatattcagttataatgtgtcttttcctgcatttttattattcttcaaaataaaggtttatccacacacacaccaaaaaataaggaactgcaagagtccagttgagagctgacgagagccaatgcagtgatactagtgatggtaggaaagatacatagtcaagaaatattcaggagctaagttggtgggtctgttttaattgaacatatgcagggatggagtagggcgaggactgaggaaaaggcaggaatctgaaatgaatcttaggtttctttttagcttcgctgaagaaatgaatggttgagccaatgatggagatgaaaacttcgagaagaacatgttgagttgaagtgcctgtggcaatccacaggaataactccaacagctagttaatcgtaagttcagcagaactgtccgcgcaagagatatgggtgtgggagtcatcagcctccctggtcataattaaaataatgagattggatagactcactcacaaagagaaatatgaaggggtatggtagccagcactctggggaacattatatttaagggaaaggcccagaaacagaaagctgtgaccaagacagaaaaggttcagctgtagaaattgttaagaaaccaagagatatagttatggaagcccagtcctgagggaaagtcctgaaaaactgtggccaataaagtgacttctctccaacagcttggcaggaaggcaagaagttagctctatagccgtggtccttgggcaagttatttctcccctctgagcctcatttttttcagctccaatgtgggaatgttacagctaaagagtattgttaaaggctattgtgagaagtaaataagacaatgcatatgaagtgtttagcaaatagtgaaaggtctatggtcatggtgacctatagaaactatgagcaaatcaagcagggtgttctttctcaggatgagagagatagggatatgtttagagaccaaacagaagagccagtgtataaacgtcactggatacccagagaagaagcagaaagggcagccccacgtccccaggtagatggaaacacctgccactctgacacagggtaagaacggatgtggagaaagacacatctgacaaagaagtggtagatgaagcaacgaaaggggtcattcctaccaaaggcctccgccatgaactcacatgcatttgggcaagacccctaggtgtgggacaatcggtgcagatactagagatattgtaagaaataacaagtttcatttaactcacttactcatcatttagccactcacctttgacacatactaaatgcctactgggtgatttacagggaaaaaagaaatccttcatacccttgaggagataacagttccactgggatgctgaacaaggaagaaaagtgcagtgaatatatattgaacattgcctttgtaccgaaccgtgggcttacatgcatgataaatgatatcatgtgtatcccttagcagaatgggaggtaaaaatcactattcccattttacatatgtgaatactgaggcatgaaaatttaactgattagcccaaggtcacatggttgtgtctgactggtagtgcaataagagaatgcatataagcaagtgattgcaaggaagtaaggtgagatgtgtgttgcagaggtgggaattatggaggggtcaatgaagaaactgacgtataagttagattccgaaataagagttaaagaaaaagggtcaaaggcaagaaaaaactgacgaatgttccattgtcaccagaatatatgtgtccacagctcactccttgtatagagagaagttgtctataagtcgtgcttgcctccccattatcaaaatgtggctccttcttgaataagtacaattcattatcatgactgaagttatactggattttctccaagctttcctgagtatgcagaattgtccttctgcactgtcaaatccccagatcacatacttagcagctgttttcaagatattttgtcagaattgcttgtcatagaggcatagaataatgtgtcgcaggcatttttgaatataactgtctctcactagagagttggggtccagtaaccttgatgagcttaggaagctcgagagacctcctggcatgcagccctgtgcttaccctgtctgcctgcacactgtcccagatgctctgagctcacagcctgtcaatgtgaaaagacaaacacacaactgacaaagtgtaacaagtgtcaaacaagaggaatgtgggacagaacgaagtgttagctctacacagacagcactcctccaaggaggtcagaccacggttcaagcagcatgaacaaaaagcagggagtttgcatgttcaagggtaacttcatgaacaaaagttacttgggcctgaaagaaggcaaacccagggacaggatgcctggaaatgaggagatgaagggtacttgaagtcagactcaaaagttaaaatgtatcttaaaggcagcagggagcccctgaaagacaaggaacaaggggatgtcaagggaagtgcatgatggtgaactggagatgagatggatccacaggaggcagggttgtggaggcctcatgtgatgggaggatgtgggtgtcactcaggtcttggcggtgtgggtggatggaagcgtggtgggtgggcagcgaatatgtgtaatgctgttgtaatcaggcgaccaatcagacaagggctggggagggagcagtcgggctggccctcaggcttctggttggacaagtggatacacagccatgctgagaaacggacacaaacaaagaagcaggttaggggaagagggtcagtcagtgcagtttggggtgtgaatggactgtgggacctgcaggctctgcagcatcctggggctgacatcagagcagcaagtttcccttgtcattcctatcatgagccagtttcatagtcaggtttctggccttttccaaggaaatccctgctgccatgtgcatccatgcacgcacacacaggtgcatccctcacctccatctcctaattgcacagacacctccctccacttatcaacaggccaacccatttcagaccatcagtaaaatgccatttagtgataacctcccagtgatgtctgatcctttggtggctgctgccacatcccccagggactcatgaaattgtgtctgtcttgatactctgctggggccactttgtggaaggatgccaatgcccccatgttgccagaggtatctgcacctgttccctttcccttccttgcagcatctagcactgtgctcagctgcattgggaaatcctgcttgctggcctctttgcttcctcccaagtgtcctcccttcctctctgcacattcttctcaccatatcgggtctatgagtcacctgatgaacttgttaaaacacagattctgattcagtcggtggggtggggggtgtccagaattctgcatttcaaactccaaggtgatgccaatcctgctggtctccagcaagatttacccatgcccactgtctccactgcctcacacccacctccaatgcccacctccttaccagaacatctctggcttaattcactaatggcctctatgtgactaaatcccctggacattagcaactgaccctcctgctcctggaaatagtctcttctctgatctgacattggatggaagctccatgagacatctgcttctactgtaaatgggctggctagaaacttcccaaaagaaatgcctgtcgattccactttctgcaccctcgctgggagctgactccccgtctctgtcctttctgagagtctcagagtgctctgggtcactctgtctgctctctgtccaaaagtaggagaatgtcttcatctacagcagcagcatccagcagaaccctccacaatgccagagatattctatatccacactatcccacatggttgccactaggcacatgcagctcacgtggccaagaaactgaaatttttatttttacttaagcttaattaacttaaaaggccacgcatggccaacagctgacatacaggacagcacagatctatgtgcacaacaccccagaaatgagctcatcgcataccacatgttcctcaggactatggcaaactttaacaagtctgcagttatcctggaaggtggtaaacattagtggatggaaagcatgcctgccagactcagatgacttgagtacaaatcctgcttctgatactgaatgagtgactttaacaagtcacaacttcagttgtcttcattggtaataatatgaatataacctcagaatgtcttcctaggggtaagagtagtacttatctcattgactttctgggagtgttaaataagtaaatgtatatagagtgcttaggtcaatgcctaacatataaatgctcaatcagtgctgtcttgtcacgattttgattaagtctccaacctggttttgcaaagaagggattattgtcttaccatcttcattttgccaatattaaagaaaaaggggccacaccaagaacacacagaaaacgagggcttgaatatggtcctgcccagctcggaagcagctggcaggtcaaccaggggccggatgtcccattcgaagctgcagtgactgcctcccagggcggccttcccggtgagctgggctgtggggcagctcccacagagctcactatctccatatccccagaagtggctggtgggccagatgtagcaatgcgggcacctgccatgttcagtgcagttgtggcctgtggtctatcctcaggggcctgaaaaggacttgtagctccccttcccagatcctcagggcctgcataatacccctcttccactctaccctacagggacaggacacacctccctttctacccaatgtagccaactgtgtgtttctaaattcagaggagatcccagcaagatgccacgtgcttttgagatatcctcattgtcattccttgcagaaggtaccctaccccaggaagcagtcatggggagctagccacccaaggagcccacatgggatgggcagatcagaaggctgtgatttgaaagccaaaggcagaatccttgctctcctatctggacagggtaggcaactggactggagtgggattatcactgggcttggatccagaagactgggactcaaatccttgctttgatacttcctgtttgatcttagtgagttcatattacctctccgaggctgtctcaatgagtgaaaataagcttgtatgtagcaatgcatgacttttaaagtattttcacaagtgtgaattgaatcatttgttcattcagcaaatattcattgaacacccactgtgtgttctgtccctggagagacaatggtaggcaaagcaataaaatccttgccttcagaaagctcactttttaatctaatcagctaagtgtaatattaaccactgagatcaatcttatgaagaaatattacataacaatgaaaatgcatcaacaccagctgtgtggttgtttcaattattctgtttgctcccctaattcagtctctgtcctccctcatgcacctggaggcccaaatctattcactgcatctctcagccctcttaccctctggtggtcagtggggctcagccagtgagaggctacagcaggaggtagaaggtaaatttaaaacaaaaacaaagctcagggcatttctttcttgtttccctccaccatcccctaccccaaagttcttagttttcatacttagtttctaccactccctcccctgccccttgagacctgggaagtaacagctccctgctattgtttgtccctggctgcctcctcattcctcatttgtttcctcaattctgctcatatccctgtaaataatctcttcatgcctagacatggtaactcatgcttgtaatcccaacactttgggaggccaagacaggaggatcacttgaggccaggagctcaaggctgcagtgagctatcatcctgccattacgctccagcctagcatagcatcttccaatctcttcttctttctctctctctccattgccacctctcctcctttgactctgaccatccctgcctccctcttttataccccttgtgattacagtgggcccagataaatcagtataatttgcccacctcaaaatccttaactccatcataccagcaaaatcccttctgctatgtgagagaatacattcatagattcttgacagcaggatgtggacatcttttgtgtgtgtgtgtgtgtgtgtgtgtgtgtgtgtttgagactgagttttgctcttttcgcccaggctggagttcaatggaatgatctcggctcactgtagcctccacctccctggttcaagcaattctcctgcctcagcctcctgagtagcagggatcacaggcacacaccaccacgcccggctaattttgtatttttagtagagacggggtttcaccatgttggccaggctggtcttgaactcctaggtgacagagtgagactgtctcaaaaaaagaaagaaaaaaaaaccttcctcaataaactctaactagaaacaaacatgctgtaaaggaaagagcaggtgccttgagaatgtttaatgacaggctcatttcatctaggcagggagatttatcatctcaggtgggattggaagaatgtatatgaggtagacaaacacttgtacaatagtattaaaatcctccactttacaaatgagaaaagtgaggttcagagaagggaagggtggccaaggttatgcaaatccagtcttgtttgtgcatgcaaagcagctcactgtgacatttgccttccaagtcctagggacttttattactttcctattgctgcagtagcaaagttccacaaacttggtgatttaaaaagtcaagaaacaacagatgctggcgaggttgcgcagaaatagaaacacttttacactgttggtgggaatgtaaattagttcaaccattgtgggagacagtgttgcaattcctcaaagatttagaaccagaaataccatttgacccagcaatcccattactgggtatatacccaaattaatatacatcattctattacaaagatacatgcacgtgtgtgttcacaaactctgactctgaccatccctccctccctcttttatgccccttttgattacggtgggcccagataaattggtataatttgcccacctcaaaatccttaactccatcataccagcaaaatcccttctgctatgtgagagaatacattcatagattctggacagtagaatgtgggcatctttattattattattattattattattattattattattatagactgagttttgctgtttttgcccaggctggagtgtaatggcatgatcttggctcactgcaacctctgcgtcccaggttcaagcaatcctcgtgcctcagcctcctgagtagctgggatctcaggcacacatcagcacacttggctaattttgtatttttagtagagatggggtttcaccatgttggccagactggtcttaaactcctgacctcaggtgatctgcctgccttggcctcccaaagtgctgggattacaggtgtgagctaccacacccagcctggatgtgggcatctttaaggggtccattattctgctactacaggggcctacggccatggagtggatggtaacttgcccatcataaagactaggtcctattgctgaggtgttacctgcagcaatgttgcctacgggcagccacaaacaaaaccaggattctgaggccagatggcctttggcaaaaggggctggtccagcctactgtcagctttgtgaccctgagtgagacacataacctttgtaagcttcactttaccatttgcaaaatgggaacactatctggtccccatgctgagaagacacgagctggtgtgtcaagaactcaccacacagtagggcctcgggctcttccatctctcttgtcctcctcctgccttccattctctagatgcacacacacgtgcagctcacgttcagtccctcagcagatgctatcactatactttggagactgatgagctgttactaatgggatttttgtgtgtgagcagggagaggcagtgggagaatagaagagcttcagtacctcattcatcctgctgagattttgacacagacacagatcttaagagaattaggcaaagaagcagacatgctatgaataaatgtcagtgcccctcacaaaaggttacctcccaaggcctcactttttgcctgccaatactctgaggtaccagagtatctctgatcacgacgcccatctttttaacatcttttgaagactgccctgctgctgacaggacagagagaggcctccattgtggggaacctcagatggccttgtgcctgtctcctgactgctcttctcatttgggcctccatcccccccgttccaatgcaagcaaaaaaagagggtatgtcccaaatttgatatcctcttagatatctaatcctatgtaagacctgttacttgacatctttcggtgaagcttcttcagttgtaaaatgggtcactgtgaggccaaataagatcacagttggaacacaccaagaacactgccaagatacaatagctagcagagatttcattaacataacacttacagtgtgccaggtgttcgataaggtttggatgccctcctttatcacactgtctaataactgacatctttctcaggagactgtggaccatgggagggtacagaggtgtcacttatgtgtatgtgtgtgtgtccgtgagtgcctagagcattgcaggtatccagtgaatgcttgcaggaaagcaaatggaagaacaagtaagaaaaggacaactggtatgcccaccaatgttcaattcagtagaaagttttcttctggagactccagggactgttattttccctggtctactaggtgttcctgctaccatactgcagcctcaatgactgatcttactaatgacacatttgaccttgttacttttgtgtttaaaaccttttaatggtctccaggtacaagtccaacgttcttagcttggtcaaatcagaccctcctgatctggctctactggattgtatctctcttgctgcatctccaaccacccttcttcttgaattttgtgcatgagcagcaccaaacttggcaccatcctccaaataccactgtatctttcctcacattgtgcctccatccagaggctctcttccttctcaaaacccacaattatctctctagagctggctccagacgaccttccagggcaacttgcagcacccttgaaaagaattattgcccattatgtttgctctcacttcactaacagctgtaaatacctttaccatgcatcagtatttgggcagattctgtgccacacaactgtcataccttatctctaagccagtgcctctcaaatttttcccaggcattctaatgccccgaaggactttaaagacagattcctaaaccccaccctcagattctgcttcaataggtctggggtggggccggagaatttacatttctgataagtttctatcactgctgctgctgctccatgatcacactttgagtagcagtgcctcacttgtgagcaaaattacattatcatcttgcaaggggggagaggtaaggacttgccataggctaaatgatccagtggtgaggctagattttgaaacccagtctctgaagccacagcctggctcctttactcagcaacagcactaagagcatccaacattgactagcagttacctctagttcattccaccaagcacacatatacagtatctcatttaatcctcagaatcttctaaggtaaagccattgttcctacacgacagctgatgaggaaacaggggcagaaaaggtatcgcagccaaagtcacacggaactgagcgaagggacaatgaccacgggcccatgcgctaacaatgaccattttctaaatgtgacgttgctcacccttcattgcaattcttggtttacacaccaagtctttctggccaggccacgagcacctttgaagttaggggaaatcatctcatttaacttcacatcctagccactggcaaaatgcaagcaattagcaggtacctacatatgtttaatgaatgaatatgtaagactgaaagagtgaacaaagaacaggaaaataaccacattcttagccacttgacaagtagattgaccttctctctataaatgatgtgactcaactcacagaacaatccatagaggggcttcgaggaggtgagtttgtcttcaaattaaaaaaaaaggagcaaaacaacaataacaacaacaaaaaacacttcatctccagaagctgtaggttgacactgaaagaaggctctggaaccaggcaaaagacctcaggtttggcaaaatgaggctcccaccctgaactaaaaatgcttctcttgtttcccttttagctaatttctctcctttctgagtctacccaggggggtcggtctagcggatgctattaaaacccacagctgcaaaaggggagaaaaaaacagaggaaattttctgttgcttgtaatcaagggtaaaaataaaagaagcacaatgaaaattaaggaaaataaacagtgatcaaggcttttcttttccacttgcccgtggagtcctgctgtgtgtccaacaataggggaagaacaggactgagatgtgggattccgtcagctctcgctgcatgcaaggacagaaagatgcctacaacaagccagagttacgggactggggtgacatgactctcacaatctccttctcccacgtgaaaggtgaggccatggctatataacgagaaagctgggaagacagtacaggcagaggaaaggagtgatccaggaatgaatgcagcttggtccctggctgtgagacacaggattgcactcagatgtacccttcaaggtatccatccattcagatctcttggggagtgggcttggacttgactggaggctctcccatgaaatcatagataacctgatttccccatggctacctcttctcttctcaagattttgtgctacactcaggattccagcatctgggttctaagctgagatttggcctggacttcccttggccaggctgaattgaccacagcttccaatgaagccaacaaggatgataacctctgccatatgccacgcactgtgctatgagcccagcatacaattcctagtcctcccaaaagctctctgatgcaggtagatttgccctaattttacaaatgagaaaggctcaaaatgaaagtatgacaccaaacacatgaatccatgtctgtgtccttaatgttgacaaagagaaaacctgacttactacccaacgtcattcttctagaaagtggcagaacatagaaccttattctggtctgactgacctggagcccacacattccatatttctccaggagggtgctctgatagatggtagaagttgggcttccagactcactgctagaaataagaccaccaaaagggaagaatcatggcatgagtaggaagtgaattgaatagctgacttcagacatagctgatcagccatgggacacaaaagcagaaagcaataagagagaggcactggaggcctgggaaagtgttagaagcaagaaggataaagaatagagggaaaattggactcgaggtagccaagagactttctcattttcacccataacagatagaggatagagcaaagggaattggaagagaggaacagagcagttcagggtgtgtggttaccttgcagtcaatgtctgaggaagatcagaaattctcagggaaccaaatgctgtcagttctggttcactttgtggtaaacactgtgtagttctgctgctggaagcacccctaccctatcaatgctgaatgctcacagcttcatccttccctgggaactctctcagccaagatcatgtttgctttcttggaggtgagaggacatggctgatgactgattggtttgagaataaaaaagtctggtcctctaacctcagtttgggggcaattctaaaggagcatcccagctcctgggttctcccacagggttgactgatccctcggttgtaactacatcatgagtcagcttctccctctgcccagcccagcctcccccacttctttacaggtgggtgtccatacagctttcccaaataaatcttctgcacccaatctctgtctcagattttgtttctagggaacccaacctaagatactccctgtacctctgtgccccccaccacccttcaagtaatcttgagagaagacctacagaatggaagggaggggtgcaggtaaaaggtgaagcaagaacatcttcacctagcctgcaaacacagcctccccttgtgcaaccagattcctctatggttccacgagccagctgcaagatttccaccctggttctggcaccagacgttcagcgcagtctaattgcaccaaattttatttgagtcttcgctggggctgtcacttcatccaattaagtggaggttacagaaggatccacttgtcattacagcaattcctccttgtgctaaatgcttccagaatcttaattaccgagcaggcaagatcagaaaagatggctccagtggagatggtagtatttctctttcacaaacacaggcaggcccccgagcctgacatgcactacccatgtacagccgctacataaattagacaggcctaaataagtcaggctagagacaggaatggaaacagaatgcagatgaggctcaccaccaggcccagcactgtgtgaaggttgtgcgtccacattgcttgggcagcatggtacagcagaaaaactatggagctaacagctaggagacatgcaccctgtgctctgctctttgactggtgctgggatgtccagcaagcccctttccctcccctgtggcctctaaggtcttaagtgatttgattcctgattatccagcctccactcccactactcacccatctatcccagccacatcaaccaccctcagtcctttcaacatgccacactcattcctacctctagagtttcccactcactgatccctttccccataaaggtcatcttcctactctttaaatggctgacatcttctcattctccaggttttaaaccaaatgtctcttcctccaagaagcttctcttgtccacttaccgaagggagccccctacttactttctgtcgtgatgctctatttgatcccaacaaagtctcaatcacaatttgtaattctatattgttccattaactctttcaaagtccatctctccctgtagaatagtgatgcccaatatggtagccaccagctatgtccatgtgcggctatttaaacttttctaaaaaaaataaataaaatttaaaattccattcctcagccatgataaccacatttcaagtgtttgatagccataagtggctactgagccagagatgccagacagcacagatacagaacattccaatcacagcagaaagctctattaggcagctctggtctatagtatatgcttgatcagtttcattgacccttgaatcgaatctctggatacctatccatagtgcctgggtatatactactcacgcaataaatatgtgagtaaatgaattaacaagtgaacaatgcatattttaaatagagatatgtttggcagagccaagaaggaatgttcatttctgcttggggaagctgtagaagtcttcacagagaggatgacatctaacatgagctttgaaggatgactgcgagaagaaggtgaaggggcaggcatagaacaaagaaaaccacagaggtaaaagcatcaaatgatgaaagatcgtgctgtttcatgcttagaggtttggcaagtttcttgttgcaagtttcttgctgcaaagttgattagaactcaggtttcctttcattgaaagtccgatgcttgggggctcaacagctgaaatatttgcctcagggcccagaacttaaacgtggtggtaaagtattatctctgaaaagaaggaaaaatgtactgatttttaaaattcaaggtgaaaagggaatgcagatgttcatattttaatacactacaaaagatccctggatacttatctcctggcctacatcttccttgtttttgtattgcagacatactttagcatacacaggttgtatagaagacaaagtaccagttttaggatgaataaatgggaacactgatatctcgagaggccttctcagcatggaaacacaatgatgcaacctcatgtggaaataaaggtgctttacttccaccctcacttacttcaatacgctggcacatgcttgctttcaagcaactccctctctagacatggggtttaaccacctgccctgcagatgacgtgtacattctgacatctgcatggaaacaaggtaactcagtcttagaaagccaggagggtggccaagatcacagcgggaggatggagcaaatccttgggtttatgtccctttagacgaggggggttcactctcttctgaaacacgggctcatttatacaagcaaacagatcagaacacattacaggaaggaattcccacggcatgcgctgctctttgctttgccttgtgaagataaaaggaggaagaaacaaaagacttagagagcagagctggtatgaaccatgaagctgctctacattaatcatctccatcgcccccacttcctgctgcccttctcgacataggccctgggtcttttgctgggaaaaggcaggtcgaactggagctggctggggagctcattagcacctcgccagagccgagggctgcctgccttccaggaggcattttgaactctcccttcagttacttccttgcaatcaatatgctgcttttgcagttgctccatccactgcccttgcagccatcggaggctacaggcttctaagaagaactgttggggtttatcaacatacacatcttcacttcacaggaagcagcattccatggtttgcacattggtcctctgggctcataacacagcagggtccagatctggggagaagcaggcacgagggatgtactgggagtagggaggaaggccttggccaggtgctctggcaatgtgggcaggaaaaggccttggtggcaatgggtgttgcatgaggaggtcctatggtcagctcaggcaaaggcccaggagtctcaactgggaagcagaccctgaagccatgtctcccaattcagacctaggggccctgaaacgctgtgtctgagatgcttttcccttactgattcctgtaatgcctgagccagcttgtagctgtcatgcatatggccactagggaccaggagaatttgagttctacatgtggcctggttggccccatccctctgggaggtcatcactacagctgagccacaagatcctgggactgggatcctcatagacctctgggacagtaggttctggggagtgacattgactccaaccctgcaggtgtagccttccagaagccagttcctctctgtaaaataaaggcatataaaggaccactcttagcccttccaatcaccagcaggaacccaagagagagtccctctagccctgagagtctccaatagcatcatccttcttatccaaatccaataaagcaatgctgttcttcaaggcccactgaccacaacctaatggagagctgaggctgccagataccaagacttagcattatagaagggcagagcatggcaggatcccaggggaaaagaattagcacaacctcatacaaaatggagtaataatacacctacctcagaaaatctgctatgagaattacctagatcatctctttaaagcactgtattacttagctttttcttagtgacaaacaaccccgaatcttgatgtacgcagatacttgtttcttgttctcagttagctccaggctgtgtttgaatctattccctatgcctctcattccaggaactagtctgaaggagctgttgctgccaggggcaggttcttccagtgacggatggcagcaggcaacagagcaagcagggacacatgatacctcctgaaatctctcctgggaactggcacaccatcccttctgcccacattctacggttcaaaccaagccacatggccaagctcaaggtcaatggggctttgtcaaagccaatcaggaagtgtactctgcccatggggagggatcatgaagagtgaatctttgcagaaaaaccacacagtgttccagaagtgctcaataaggaattgggatatagtcatctctcagaaaatgttagttattatcaacatgtgtattactatcactattagtaacaggctttgctgatgattcattgaagctcagataaggttgggttggatgagacacagtttggagggctgctacttgggaatggccctgggaaagcttaacctctattgcttggtcaaggtcaagactgactgtaagaactgtgatggagccaaatgtgactagaggagagggaaacggcttcagccaggtcaggcttgacccctgagctgtccttaggaccaggaggaattggaggaaaaggcatcccacggaaaactgagttcatggcagaaccatgacttaaacccagattgccttactctaattctagattaaatccctactccaccctcactaggagaaagaacattttgagatggaattgattcctttctacatatttttctttaaaaaaaaaaactcagtgtttatttttatttcttttaggctgaagcttaactccaaaaatagtctttttcagtagccctgtcattagcagttgctacaaacactatgtcccccacacattgaactgcacgcacgacacttgaaaagagcaattagaacagaagtctcccaagaatcgcaaggaaggcagtggctgcagctcctgatgcctacagtctcccaaggacatggctgggagccagccctgctctggggcttctcgtgcctctctgtgggtcgcccataccctagcatttgctccgttgtgtgcctgactctgtgctaaccccaggagaacttgcagccactcggccctcaacttcactctagttgtctgtccttaaccttaggtcttaatgtagagaggtcactaagcctctctaagtctctgattcctcacctagaaaataagaatcataataattttgggatatttgaggcatcctcatcattttgtacacatcaaagaactatttgatttcatgggagtgccaccaactgagctcctcctatacacagggatactgagaataaacagatagttggacacagcccttaccttcgaacaattatagtctagcagaggttcctgctgttgatttgggggcatgtaatatagtttacaatggtggggaaagtttcaggtaagacttccctgcagggaaaatacatgggctgaattataaaatggttgatgaagtagggaaaggtattccaaaggaaaggagcagcatgtgcaaaggctctgaggctaactagaactatctgggctggtctccagcctcgtgtgcagtgaaaaggtctgaaggaaaagatatcgtgaagggctttgtccacctttgcaaagaagcagcaagtaatagagaagtatccaagccctgcagttgcttcatttatgcaacaaatgtccactgagggcccacaatgtgccaagcaccagggacacaggccgagcaagcacagacccagtgcctgtcctcgtggaacccataacctaatgaacttggcatgtttgctatacatgtgtagtttcaagaagtcaccttggataacaagggtggtggcattggggaattagaatttgtgtggtcaagaaagggggttcatggaaggggttcctgagaactatggctggagagagactatggctggagagagacacggggtacaatttatgcccttctgtgggcaatagggccttggcaggggaagggggcaggctctggcctgacagtaagacaaaggaagaaactaaaagatgaggagagatggaaggagggaaggaaaggaccagcccccagcctctcagccagacctcatcacactcttgtctgctgtgaatctgtggtcacttctcacacctgggaaggtgcagacctctgtatgggcataaaaggaggcgtctgaattcttcagaagcaaaaacatacaagaataacccaaaaggagttgggagggggatttcaaattcatgaaagccaatacacatgggtgctgcggattcaattgtgtcaaccagaaagatatgttcaacacctagcccctggtacctgagaatgtggccttatttggaaatagggtctttgtagatgtaatcaagccaagatgaagtcctactggaagaaggtgggccccaaatcaatgactggcatccttctaaaatgaggaacatttggatgcagaaacacacagagagaagaaggccatgtgacgacagaggcagagacaggaatgatgcatttataagccaaggaacacccaaagatcactggcaaccagcagaagttagaagaggcatgggctgggcatggtggctcacgcctgtaatcccagcattttgggaggccaaggtgggcggatcacctgacgtcaggagtccaagaccagcctggtcaacatggctaaaccccgtctctactaaaaatgcaaaaattagccgggcatggtggtgggagtctgtaatcccagctactcgggaggctgaggcagggagaatggcttgaacccgggagacggaggttgcagtgagccaagatcacaccattgcactccagcctgtgtgatagagcaagattctgcctccaaaaaaaaaaaggcatgaaacagattctccctcagagctatcagaaggaaccaaccctactgacacttggaccttggacttcaggactccagaactgtaagagaatatactgttgtctaaagccacccagtgtatagtagttcattatggcagccctggcaaactaatacaatagtaaattatacctcacaattgtacagattaaatttggatgggtcaacagccttaggggtggcaagttgaagtaacccaataattgcattcagatatacttagccccaccttgcaggacagggccaggaagtagctggtgttagcccgaggggtagggagctgctgactcctgttctggccacatcatctcactcatacctcacaacaaacctgaagggtccacctcactgtgctcactttgtagagggtatgacaggcttacagaagtgtaggtgcatgccccgggtccatgtggcaagtgccagagctgggatctgaatacaagtcatcctgtgacttgcttttgagccgtaaaattataaacaagcagttagttcccgtccacaaagcattcactattcacagaattaagaatgacattcttggctgggcatggtagctcatgcctgtaatcctagcacttgggaggccgaggtgagtggatcacttaagggcaggagtttgagactagcctggccaacatggagaaactgagtctctactaaaaatacaaaaattagccaggcatggtggcaggtgcctgtaatcccagctactcgggaggctgaggtagaattgcttgaacctgggaggtggaggttgcagtgagccaagattgtaccactgcacttcagcctgggcaacagagtgagactctgtcttagaaaaaaaaaaagaatgacattcttaccactctctaaatggtctcacttatgagctcatttttcttctcccctccattagaatatctgcttcaaaatagtcgaagccctgatccatatggctgtttgctgtatccctgtgtctagaagattactggggcataacaggtatttaataaatatttgtcacattaatcagtcaactaatagggggcatttggagactaagatggcactgtccaggtgtatatttctatactaatttaacaaagtggcaaatggggctgggcacagtggctcacgcctgtaatcccagcattttgggaagatgaggtgggcacattgcttgagctcaggagtttgagactagcctgggcaacatgatgaaaccttgtctctccaaagaatataaaaattagctggctgtggtggcacctgtagtcccagctactcaaagaggctgaggtgggaggatcgctgagcctgggaggttgaagctgcagtgagccatgattgtgccacagcctaggcgacagagtgagaccctgtctcaaaacaacaacaacaacaaaaacaaaatggcaaatggtactaattgcttgctgtcctcaatcaaagaatactcaaaggaaaatgttaatgccacacatttgtgcaggctcgacccctgcacctgagagtctgcagaagccatggccaacagctccatggcagtggacaagacaggtgtcacccaaaacattggtgtgtaacaaggcattaataagaaatgaaagggagagataaaaaaaaagcaggatttacagggaatgagaaggaagggagaacaggggaagagaggaggatgtggtagggggaagagaggaggaagaggtaggaggaagaggaactgtttttcaggagggactatcagtagcagcagacactgacaagcatggcagtggtgagccaagttacctgtttgtgaccttttgaatgcataggaatggttgcaagagagagggaaggggcagaggctggcggacactgaggagaggagaaagaaagatggggaagtgttagacaggaagtcagggaagcacagggacaggcagaaagagaagctgagagggactgagactctgaaatagacatagataacacaacttagttctgaacatatttagttctaaaatgggtttccatcagtgtgaaattcattacaacaaaaatttaaggtattaatagatcattctcattgttatttaagcctgaaagcaggagacacaaactacacaccacaacctaccaatcagccctaacacttcatgcggccaactcccttcctgctctattacagaaagtggggaggtgcatgccagtgggagccccacctatgcatgtcctattttggtatgcccagcattcctattgaggggaagggctcttgtctcactttgcatcctcctggagggcctgggttcacacactctggctaaagaattgggcacatgacttagactgggtccttccatctgccactgggcagatggtgggtctagaatcggacgctcaaccctgtcagggataggcagaatccttccctgggactggccttcagacatggggagacataatccttttgcccttgaggttgttaaactacaaggtgtggatctggagatgccagcccccaaatggcccccaacttatcccatcagcatgtaggataatagtgccaatgaggaacaaacaaaacagaaaatgacaaaggagacaaagccctgggtcctcatttgagccctaggatgtgatctgcacagagacagctccatgccagagcattccagggacgtgggccaacaaccttcctctggggttttatccagttagagttgggtggctgccacttaccactgccagggtccaggctgagaatggctcctcatctccatcctcctgctctgtgcagcccctgccgagtcctcctgcccttaactatgtcaatgaccgcacagttttggcaggacaagagcaggactatacgcagtgatgtcccagcccaggtaggtgtcaaggactgaggcaatggcaaaatccatcctggcagtgaaatggagccctgcttccgagatgcaaaagaaaggcagggaaaagtcatgcatctgccagagggaattaatccagagccagtgggggaagaactggcaagtggggctggcagaaatgagctgtgcaaacaggtcctgaggcaactgtctgctgtcagactgctctaagagcctccgaggaaggagagagaggggaggagccagggcaacatggtaggagaccagagctgccaccaagaacttcttcctgggatggcaagggcacttgtaagggcagaaattcatcagatcccattgaggacatttgtatttctatgctataaaccccttccagtaccctaaatcctcagaggtctattataccccaaagaacttgagagagagagtgtgcatgtgcatgtgcatgctggagaaaggataaagaatattaaggggagctgagttccaaatttggaaggtttagagaggacagaaggtgtaaggagtgagagggaattgaggatgaaagtcagaaggaatggtaaacagatatgtcagaagtgaccatagaagaaacccctaggaataggcacaaaggtaagagagagctaatgatactgcaatctcaaaggtcatggtaacttctgttggcatcatggttgataaatttgggactgggtgaactcttctcagatgtagccccaggaatgcctggcatgagcccttttgtgcaaaagcaatcactacgggtatatccatgagctgtcttttctgttcttttttttgagatggagtcttgctcttgtcgcccagactggagtgcagtggcgcgatcttggctcactgcaacctctggctcttaggttcaagcgattctcctgcctcagtatcccgagtagttgggattacaggcaaccaccaccacacccggctaatttcttgtatttttagtagagatagggtttcaccatgttggccaggctggtctcgaactcctcacctcaggtgatccacctgactcggcttcccaaagtgctgggattacaggcatgagccaccacacccggccttttctgtgatttctgaagacagtagggcaattccttgatgacatcatggactagtagtcaaccaagagtcttatggtcatggttggataagagagggtgagaaaggtggtagcttggagttggggtggtaaaggtaagggccataggcacaggcaatacctagacgtactagatacgggtcaataactgctagatatgggttaagacctgggaggagggtaccctgtagtttccttcatctctgcttatctcagaagtcaagaaataaaggcaacagagcctggaattcagcagatgcatgcaaatatatctgaaaaagttggttggtcacttaattaactatattaccctaacttgggacaaacattgaagaataaaaggtggcggtcagctcacagaggtgagtcatagaagaaaagccacagagatgagtgcagatgtgctcagggagaaggagcgcctttcagacaattgaatcccaatagcactgtgggtagatacaatcagctaactccgcctactatgagaccagacgcagcaaacctgcttctgatcactgttcagctcccacaaaatgctgactggaaactatggcattgtctgcatgctgtgggtatctgtccactgcatagatggccagaatgaggtttctaagccatcaaggcgagaagggccacggtaacagacagagcctccctgcagtagcaccacctgccccgccctcacgggttggacaagtcacagttggttcagctttttctcattcccatcacagcccagtgaagttactggatgaggagaggtggtgctgtactccacatagtcattcagggacccaggctccgatctggagctgctgcctgacttaatatgtggtctcaaatgtcacagcaggaggggaaaaagagagggggcttgcataggggagttttttaataggtctggcccaaaaggagtgtatatcacttctgcacacactcctctggccccatctgaatggaggaagcttgtgtgcccagaaggaaaaataaatggtacagagaacgtaacattgtcacacgagtctttgaactttcttgctggtatgaagcaggtcccacactctgcgatttccacactttatttcactgatcctcagaaaacatgaggcaagaaacatccttctgtccctttctacagatggagaaactgaggctcagtcacgtgcagagttgcattcagcaacataaaatgaacagagccaagaatgaaccccaggtttgcctgcttctaaagtgcagcctcctcacctccccttacgaagggcctttccaattgcttgctcaggcacagcaaattgcagccctgtcttgctggggtcccagcagttcctcactcacgtgcagaagagattaaaagaacaaaccacagagcacattttgccgctgattaactcaaagaggaggctttccctcactgagaacagatgatcagctgctctgccaataactgcctgctccgtaccaccaggccgcattccatcaaaaaggcacagtttccatttactgggttgaaagtgagtcacatctgcccctggatagacatataaagcaacaggcatgctactctgattaataatgaaaagctggtgcaagcacatttcattttaaaagagaagaggccaaatcctagcctccttttctaccaggtttaggaaagcatgaaaaaggagaaggatcatatgggttaggggggaaaaaagaaactttaaagaagcaaagaaatctacctgcccaagaggtgggaaagcagagattttattctattctaggaaccttgtgattctgcagagctgcatcgtttgttttttatactattttagaaaggaattccattgttttaaggcgggaataagcgtgaagcctggccttagaatacaacccattattttgacaaatagtcaagtcaaggccctgagcaatggtcacttaagtctaattagcaggagaatgaaggccacatctcttcttaggtaaatgtccgctaagcacggcttctgagctccctggatcaaaatgagcacatgttgtgcaaggggcatgggtgaagtttaaaaacaatacaacgtgagcatactgaacctcatcgattacattgggaacccacagccaccccaactgttgagatacggctgttttcggcatctgcttcctgagaattgctactgttttgttttttcaatgtttgaatgtgttgcgacgatttcttcatgagaatcctttctaaatgattggcggtgcttgtttttgaactgcaaaatcttttactctacctccttttctccacccacccacctgcggttggagtcactgggttgccggtaggtggaccaactggcttgggctggaagctgggtgaggccaggtacaaggacagttcccatgaccagctgggctggctgggactgttcacctggacaccctacctcatgtaccaggccctgcctgacaggaggatcaccagtcctccgactcctagtgcaagacctacccttcaggatcagacttccaagctgccacatctggccagactctacctgagttcatgtagttcttgggcttcgtggccatagccaagtctgtctctaaccccttcccataacacagaacacacaatttttgccctcatgtattctggaatttgtaaagtctacatcaagaaagaacatttgggaggagactttaaaaaaaaatcttcaaaaacaatcaatacgtgacaagaaaaagataattgctcagctttcagatcgtacagaatttggacgtttaagcccaatatcagtgggaaaggaagaaacatcttcccatctgttttcaggtaggctagaaagttttcattcaagacattaagcctgtgggggtttctaatggctttttttgatccaaattgtattaattaggaaaatactaattgctgtaacaaataaaccccaaggcttagtagcttaacacaataatagtttattatcacttcaatattaataacaggcctgcttagcagacaattttcctccacaaggtgattcagggacccaggcgtgttcaatcttttgactctcccctcaccttgaaattgtctgcatccagctaaccaaagaggggggtgagcagatgaggaatgactacatgctttttaactctttgactctgaaaggacatgcagcagttctgctcacattccttaaactggaactattatcacagggccctagtgattgcagagcaggctgggaatgaggtccgtggttaggcagctgcttcaccactttatcctatggaagggaggcacatgtgcttggtgggcacttggccagctttattggcctgaaaggtagcagaaaatttctctcagatctcggaaatggggagtcagtctgcatttaccttttgctgtatttccctggatagttagtggggaaatggcagagggaaggccaagcatcactagtcagagtaaaccagaagacatatgtcaattttccagaaagggattctggggctcaaataagtggaaccacttcttcacagccacgtcaccagctctgccttcccatccatacagctccattggccagaggcccacagaggaagtatcttcccatccagtttctgcacctggcgtcctagatgaatagtagggcactaagtacaaaagccttcccatggggcaggatctgggccagtacgactggcctttggagctgggtcattctttgttgtcagggggccatgctgtgtatcgtagggtgtttaacagcatctctgggctccacccactagatgtcagtaccccccctctcccatcgtgacaatccaaaatgtctccagacattgccaaatgtcccctggaaggaaaatcaccctcaattaagaatcactggtccaggcagaggctgcagtgtttcagagataaattaggctccagtgactggacaaaggcaatgatctagagcattcttactaaactggagcccatgggtttaactgagtttagcctagcctggaacttgggttctcagaaaaaatattccatatatatctgtcacggaataatacattatggaaaattagcataaggagggtcagaaaatagtctcatttatgggctcattataggaagagggcaggccttggactgtgtgactctgatgagactgggtaatcagacttcagcatcctcagtggtaacaggggaccatggtgaagattaaatacaacctcatgagaagacagtcagtgaagtgtctggcatgcaataaatggtccacaaatggtagctaactacagactttgcagcttgttccatacctcagatcattcttccatttgaacacaggagggtaatgttccaagtgaatgagaatttaatgcagttgccatttgatttaatttccaaatgcgttaaaagtgttaatgcaacacatcagcatgcagctgataaagtagtcaaaataattcaaggaaaccaatacttatcaggttttatttatccacatttacacttttttaaaaataagctggtctttgtgcccatatagattacaatatacataatatctcccggttagcctcccctccacacatatgttcaagtgaagtttcccacttttctcccatctgtcatttttctctttccataaaaagctaatggtgacgttatcaaagagtgaaggagtcagaggctaagggtggggaaccgggcacccatgaggaggatggggaatgatgaggagaagcacaaacataggcacgcactttgtttaggaacaattttcatagccatggcctctgacccaaatctaggggagccggcattattattccaattaggcagtcatgaaatgatggtcctaatccacttagctaacacaaggcagaatcaggatttgaacccgagacctctgatttgctatctatgtgttcttgacaatagcagtcatgggaaaaaaaatgatgcaagtattattaataaaagttaagaccaaagaaagattaaaaaataagaaccaaagcaccagcatattttcctacaaagaatgaaactcacgcagaagatgagcatgttgaggtttctctgctttgaaatagggttccaggaaagtcaagatcaggcatgagatgagaggaggaggtaagctaagtctaccacaaaaaaacttccagacctaagttggagcatatatgatccatatgcagggctcttgggggaatgggtagaactcacactgaggcaagccttccttgaaaaggcattgaagaaggcccaggagtttttaaaatgaccactctaaggggcacatggtggggtgggtaagtagcatggctctggcagggcaactgagccccctaaatttgtagccaaatcagagcaaagaaagaccataagaggagcacagggaattacaaagctcacagctcccataagaaggaagaaaagaattaaggaaacgtaatacttaaaggaaaaggtaaagaaacagatacctataaaggagacagaactttctcagaggtagaaggaaaaccaggagctcaatcaataacgagaaccttaaaaaagaagggatggtgaggggtctcgtcacatgcttgtaaagtaaggacctgagcactcttccctggatacagcaaatgtttaagccccttctatatgccaggtactgactcaggtactgctggtctagcaggaaataaggcttacaaagcttcttcctccaggagctcatgttctagtaggaaagatgggtaatccacaaatagatgtaaattacaatgtcagatagtgacaagatctaggaggaaaaccaaagcaccctgcaaaggaacagagttacaaagggaaggggtgggaggtgggggagagtgttatttcagataaggtaatcagagggggcctctctgagaagctgaagtctgagcagagaccagatcgataaaacaagtgagctacataattatctggaagaaatgcatgtcaggcaaagcaaggacagcaagtgcaaaggtcagaactagtttggtgtggttcaaggaagaggaaatggatcagcatggctagaaaagagaataagagggcaaatatgggggtggggcattacaaatcaaggactagatatggagaccatgttaagaagtttggattttattctgagtgtgacaggaaattctggaggcttttcaacaggaaaaaagccattatctaactttttcaaatgatcactcaggctgctgcattgagaatagacatcaatggggcaagagtggagcagggaggaagctggaatagtcatgcagttgagaacagaatagagttttgactcatgcactgatcagcaaactgtggccaaatccagccctctgcctgtttctgtaaataaagttttattggcacataacccatgctcattcatttgcatattttttatggctgtttttgctacaacagcagagttgagtctttgctacacagatcatatgacctggaaagctgaaactattgactctaatgccctggagagaaagtctgccaaccttgtcgaggatgttgacaatagaggtggtggaaggtggcaggctctagataaacttaggaggtagagcagaggccagatgttagcccaggctctctgataccatgcctgctctctgatcactgggtgatatagccctccagctcctctttacttctgaggacttgtggagaacgtgaatggaaactctggagtccagtctgaggccagcctttgctttgttccactccctatacaagcacagagctcaaggtggctttgcctctcctcctagcatgagcttgtcctccatggctgctgccaccaaggaggcaggagccagcagccttggtcaccttagaaggccacagaggctgtaggatccctgtagcagaagctgttgcgtcccaccgccacctcaggacttattattgcaccgagtgcagtccaacctccaactgcctctgccaactgtcaaatagctaatagacatgggcttctgccaaagccctggggagcggggggttacatcctgtatgacaagacagtaaagccagaaaattaagacccccaagagcagctctcaaccaatgactggagggggttaaggtacaaataaccccctcctccacaccccaggggttctacactgaatcccagaattacctagtaggatagagctccagacggtcacagcagttactcacttgagaatgtaccctttattcgctgcccttgattctctgtctcatgtccctaaaaccaaataagcaccttgcactcggaactcctgccctgagtctgcttctaggggtctcaacgccatgtgccttttatcttcactcttcttttccaacgcagtctgtgccagtgaccatagccagctgtctgacaatggtttttccctgcaggaccagagaaaggaagaacagctggatgcagagatcccaccttatgagtgtgcacactactatccatggccatggatagggtccgtcacagcccctagactactacaggatgaagcccaggctcctattctggtacaaagactctgcaaatgtccccttgcctacttatccagccccaaacatgtcacccactcagtgtctcaaaactaacccaggctgtcctgcttatgagcttgccaagccacaggacccatctcagatggggccagtcggagaggctatcccagactcttccagactgcgctcattgttccaacctctgtacacctttagctcacacctgaatgcagggtctaccatactggattttgcaagaaatgtggtataaaagagacagcatggccaaggcaaggcaagcctagctctgccacttatgagcagtatgatcttagaaaggtccagaacctctctgggtttccatgctctcactggtaaaaggtggttgctaacagcacctacgtcatagggccattgttaggattagggaggtagtgtggcaggtggctaacattaactgaccatgcagcacagatttgcatgattcttcctgctagaccatgagcttattacagaacctgacacagttgggctccataaacctttattaagcaaatgaatacaggaatgagtcagctactccaggcattccatctttaaactagaggctataaatgcaaatcactgctggcaccagactagtgagagagcaaaacgggaccagccaggacagcagtcaacggtggaacgtgtgcttccaaaacagggacgctgaggagcccactgttgccatcctaaaatgtaggctccaggtagctatgcctgatacagtctcaagaaacttgtaaatgctgaaaaaaaacttaaaaaggaaagagaagacagtacaatgtaagtaaagcactttcgcaactgacttcaaacaatggattggattggatgacctcaatcccatttcagaagagggagaccttaagatgatctaaatttaaattttcatagtatgtacagaatatcattcctttaatccaggaaaacaaacaatggacaatgtctttgggaaacattccttaatagtaatgtaaaaaatatgattactactaaagacataattttatactttctagtactaggatgtatctgtttatatatgttacatatatattatgctatatatatgtgttttatatattatatgtatgttatattttctccctctcataggacctatttatatatattcacctccattattcagataaggaaaatgacgcccagagtaaatacatgatttgctgaatcacacaggtaccagggagcaggactaagatggaaactcaagtgtatttagaacaataatccctactcttgatcctaacaacctcccttggtaggaagtcacatcagtgtttaaatcggaacctctaacagcactagtatcacatttcttctgagcactaattctcatactgatgagtgttctgagtgcataataggttgttaaatggagttgaaagattggtttaaaaatcaccaccgacaagaaactttttatgaattagaaaattttcatcaagatacatctgcataactttggttgcagacactcaagtccttgaggccagctaagacaccttgaaattgaagacactcagaaaaccagaagcaaagcaaatgaataagcatttgctgagcactggtctggaccaggtaggttgaggggccgaattgtcaattgagcgaaacctcaattacagagtaatctaatgtatacccaggtacattatcacaactcaataaacagctccccagaattaagtaattccaatttgctttcatttcggtctgtgtgtcgccctgagaatttgatattacctaccctcacattaggcagcatcttctgaagtgctaatctttaccatctcaggatcacacgtgagctgtgagccagtcagccatgaatacgcctgtttggggagaaagagagaccagcctgggcctctgctgttcctctcagcctgagtacctgctgtggaagccagcacaggggtttacagctcccagaaccctcgggtgctgaagggcccagtgacctcccaactgtggagtggttagggttttgaatgaacaataccaggagaggggtggtccatgtaactagatggctgagcacaaacaaaactagctacttttcctttgtccccagacccgggaatcagctttcccgatccagtaggggtgaacacaggaaaggaccagagaattctgacctacagggacttgtgatggttaatattaagtgttaacttggttgaaatgaaggatgcaaagtattgtttctgggtgtatctgggtgtttctaggtgttgccagaagagattcatatttgagtcagcggactgggagaggcagacccaaccacaatgtgggtggacaccatcccatcagctgccagcgtaactagaaaaagccggcagaagaaggtgaaagaagcggacttgctgagttttcctgccttcgtcttcctcctatgctgccctcgaacatcaggcctcaacttctttggcttttggagtcttggacttacaccagtggtttcccaggggctctcgggcctttggccacagactaaaggctacactgccgagctttcctacttttcaggttttggaactctaactgagccactactgtcttccttgctcctcaacttacagacggcccatctgggtcttcaccctgtgatcatgtgagtcagttctccttaataaactccccttcatatatacatatatcctattacttctgtccctctagagaaccctaataaaagaccccatgacccaaatgtcccccagtccacactttcatatttcctccctccctcttcttatactcggcacatcaccgtgtaccaacagagaactgggccacactttacagaacaggcctgacatgatttccccaaagccacagagacagtcatcaaatcggcacctgggtccaatgtcctgtccccacccatggagtccttcatctctcttacttctttgtctgataaatcccacccctatgggcaatttatttattttatttaacaaataccttagagtgcctatgcagggcactgttctaagaactcctacatccattatcacatgtcatcctcatgacgccttctgagggaggtaatcctacattcctgttcccagatgagccagctgaggccccaagaggttagatcatgttcaaggtcacagagttgggacaaggtggggccagaattcagacccaagcatcttggctgcagagttatctcctgccctgaactggaaccaaagggtgggaacctgtgaggaggaagaccttgaagacatggttttctttctgtgatatcccagggttgtgggtgacgtcagtccaagaaggaatccagatcccatcccataacacagcacttggcccttgagaatcctttttcttttttggtctgtttttcagattttctcccttctctgaaagaaggaggattaatgcttttcccttgtatttttttaaacaagtacaaatacttcagtattaaagtacttaagcatcctggctccgcaaaggcaaagggctcttgagaggtaagtgagtcattcttcatcacacagtttcttccaaacgcttgggtttgctgccttcaaatgggtccctgggcacccactccagggtgacaggtttcctctggttgcttctgctcctgagggggtccctgccttttattttcttgttttgcttggatgccactaactctttagcagtgtgtttggggtcggggcagggggtgagggtaggttaaatgtatttctccagcaatctggaagttagctgacagtcaggaagggaatatcacgtgtcaaaatggcaagttagctagacggacccagggaatcctgcttgcctggtacctgggccccttcagcactgctcatgacattgtggcaccaggtaacagcaagaccacaacccaccagccctccaggtgtgaccaaacagcatgagccagatgcaggtcggactccagttgtaccccttgggatggtcctgtttctcaacctggctgtgctaattctcccactcatgaaatgagttaaaataaaaccaatgtacagagctgcaattaggaaaaaatcaggtaacatatgttgaagggacttctttacatgcaagggaccaggctcctagcttaccaccatcataatatttaaatggaggaaaaatgggcactaaaaaactgataacctatgccaaaaatatggatgaatttcatcgatgtgtaataaaattacaccttgattgaccagattacaggaagtgccaaccccccactgttcaatgtgaaggagactgggtgccacccaccaccccaccctccctaagctggagtggcaggggctgcaggtgagtggcttcagagcagtggtagctgcggagtcatattgccaggcctggctactgcacccaggctagcaccagcccctcctcttgacttgggcccaggatgcacaaccagcagaggacaaatcagtgtccccgtaaaccctggccacctctccgaataaagcaaggatgctccaccacatcctctgtcccagtagcctcttggtttctcttcccatagctcccatcctgcccctgaatgggggcatataagcaaataataaaccaagcgttttctggttccatttgtctgctcatgggaatttcagagtgctaaactaactcccatagccactggtcacattcttttgccaccaactttgccccatgtacatgcaaggtgctagcaagaccatgaggagcgggaatgaacacagcacaccctctcctgggactctcaatctggtgtgggagaccagccacggaaggtataagacacattccagcaggacatctgaaaatacacattcactgagaacctgaatggcctgcaataacccctgtgtcacataatacaaatataataataataaatcttcaaaaaaaattttttttttgagatggagtctcgctcagccgcccaggctggattgcagtggcatgatctcagctcaccacaacctccgtctcctgggtttaagcgattctcctgcctcaacctcccgagcagctgggactagaggcacgagccaccacacccagctattttttgtatttttagtagagacggggtttcaccatgttggccaggctggtctcaaactcctggcctcaggcgcatgccaccacacccagctattttttgtatttttagtagagacggggtttcaccatgttggccaggctggtctcgaactcctggcctcaggtgatcgatctgtctgctttggcctcccaaactgttgggatgacaggcgtgagccaccataccgggccacacaaattaatcttatggcatcaacaaagcaaagataggagcttaatgccatcaaagtggtggcttcttttctatgttaataacatttaatgtaaacaaatttaaagatttttaaagttttttttcataagtgcctaacttgttgatctttggcttaagtgttcatggcattgtggtgaggaaataataaactcctgctgaggccaataattcattcactcttctatcagtccacacattttttcaagttgagccttgtgaaatgactgattgtgcaagtcaaaacaggcgaacactaacacttcatatggtttagcaaactgagaaccagtgccaggcactgcgctgagtgcagggacttccaacccagcagacagccctcctctcacagagcttagatcctaaaaggggagacaaaaagtcaccaagtaaacaaataaaggcaaaccagcattttaaagtgtgataaaaactatgtggaagaggagaccaggtaatgagaaggaactgtgaccaccaggaagggaggtgtgggcggggggtcagggaagttctctgggagaagacgacatactgccatttcagctgagacctgaatgatggcacatgatcagccatgtgaatgtctgtatgaagtcaagacagccagcatagagaatcccagcctgcaacccccagtccagttggcccaaggatcccagtcacactgggtcagcaaaatgaggtcaaagtttccacacccacccatactttgacaaaggaaactaacttaggaggcctcaaaggctcgatcagtggggttttttttgtttgctttttgttttttcccttcaaacacaccaggtctcattctacagctagcataataagaaaagcttcattatttcattcactaaattatgctatattaaaattttaatcggcaaacataacattggtaaaatgagtacatccatacactgcagttaccagtgtaaactgtcaaaccatttttttttttttgcaaaagcaatattgcaacacaaagaaaaatccataaagatgctcatattcttggcctcccaactctacccccagggaatttatcctaaggaaataatctggttcaatagaataaaatgttctctccagaagaactccatggaggtgctaattgttacatacacaaaggaaagaaaaaaacaagacacgtggaattatcgaaatgactgcaaatgggggggtttaacaaaataggataactcattggatgagatagcatacgatcactaagcatcataacaaagatgacaaagttgcagaaagaaatgggatatctggctttttgagagaagcagaaaacaatctgcatattttaatggaaagcatgtaaacagtatctcaaggtgaacaagaacaagaaaattgaaaagaattgaatcaaggccagtggggtgaggaattattcatttcaaaagtccttccaaaatattgtcattgtattgagttttcaatttttaaaaaaaaatccctcagaaacaatagtacgagaacactgccacagcatgccacccaaatacaaggacatttgttcattctaactttaaatacaaaataaagccaaatttgaagatgtcttctgtgttatatattccacagtctttcacgtatggctcttgtatgtgagactcaagttggaatagcaatgcaatgttgcatgattttaccatagtttctcccgtttggggagtttgtgttggggagggaggccagagtgactagaaattaatctcctcttttactgaatgtgggggaggatcagcagatgagaaaaggggctttaaggcccattaatgccaaccttccatggcagtagaggcgcaggctggaggcactcacctttcacgatcagctccgcgtagttggacacaccagacccaccatcagagcggatcacacagcggtacttgctgacgctccgctgggcagtgtctgccacactgactgtggctgagaagcgcctgtggttgaccacacgggtgaccatcagggccgtgtccctgccattccattgctgcagaacagaggaagagagggagaggaggaatcatagcatcataggcttctaggtgactcccaacacggatatccacccatcctcacacccctggggctcaagactttccactataataagggatttccagccaggcacagtggctcatgcctgtaatcccagtgctttgcaagggctgaggcaggaggatcatttgaggccaggagtttgagaccagcctaggtagcaagcaagaccttgcctctacaagaaattttaaaaaatagccaggcatggtggcactcatcttcagtcccagatactctggagggtgaggaaggaggatcgcctgagcccaaaaaccaaggttgcagtgagccatgatcaagccactgcactctaccctgggtgacagaggaaggccctgcctctttaaaaaaaaaaaaaaaaaaaaaaaagggcaggagttttcatggctggtttgtgctaatgagctgattcaagaataaactttgctagtgagctgatttgaggacacaggcctggtggtaagaagagaggaaaaaggctccttctaaacactttggctcagcctgcatttggggctggcatgtagccccttaactttcctccctattttcctttttcccttaagcagaactcatagcattctttcagacaaacttcagcagacttagtgaaaacccagcccatggagaataaacaccgcctggctcacaggccctgtggctggtgccctgctaccccaccccacaggctctgagccccacctgccctaagctatcaccacaggtagggaggggatgggagccttccaacacctctcttccttggcacatgctcttttctctgcctggagggtctggtctccctggggacactccgtcttccgtaaaaagccacgttcagctcacagccatctctagtcagttctcacaactgtcacaccatctctggaatcttatctatgtatgatacaaactttccacacacatttgcccacaagtgttgcccattttacactgaaggactttcctctgttcatctttagaagcttgtctgaaagcttcccaagttggtagacatctctagaatcaaggtgaatacacgtgggcttttgtcttcagcatcctgaatctcaggagggatatcctgagtttgaacaaacctctttcacagttgcaggttatgagaactggtaaggcacatgcatgttggtgcagtttgagtggatgtttattaatgttattaactggatatttatctactatgtgccagcccctgagctgggtatttttgtataaatcttcattgtgtcttcacagccttgtttggggagtgtacaactgctgctcttctcagaagaaaaatccaaatgtctaacagtttaactaaatgtgtagagtacacaagccccttatccaggttttccaacttcaagtcaagcactgtttttactaagaccatattctcagtgcctgctttaatttgaaaacgtttttccccaaaaagtgaaattgactcctttaattatctggacttagggaaaccttatgacttatgattctcatgccctgagtctcccagtctcgcaacgcgatcttcattgtttcctgcaccaagtaaacagtttccccatgtgcataacctactttcatctatgtcatctttcctcaccctctacagtgacctgtcaggagaggggcacaggtacaggtagagccacactgctcagctctatggcagcaaatgaggggagaccaataccaggggaaggcagtgatcatgaaggccagaaacccagggtatcccaggcccccatcaaagggcagctaagagagacttgctccaggctacaggctacaggctccaggctacagggagattgtaggtaatattttgctgctgctttttactttttcacattcttcaaactttctgtctcaaacacgtatttgctttatacttgaacataaaaaaaaatggtattgttcaaaagccatggcagaatgagaggcagccataactccctctcatgccagaaactaaccaacatgtggaatagttagtacacatcagagcaacatgcatggggctgtaagaggagaatctgaagccaaatgccagctctgcagcttccaagctatgcagacttgagcaggcaatttcactgttctgagctggaaagtttccattcgcttgcccgaataaaaaccagtacaaggtaatggaaggggagaaaggtcacttgggcggaaactgccatccagcttcctcatgccttgaggcatctttgcaggagatggcacaacttggaccccactatgagaacctaggagacaccacatgcaatgccccggaaattcccaaagtagtgcagggagaaaggcgggaaaattccggcaaacaccaggaatgtatcctgatttggagaagagatcacttaatgaataggagggccttggaagcagggggtcatcaaaaggagcccatcttccccactgctgagcaaggcatttcagggccaccatgggggataagaatgagttagtggtgaggctttggctcaatattttctaatatgagttatttataacatcataaacacttttattttttctttattaagctaataacagctaaacactactatgtgctaaatgttttatatgctttctcatttattccccatgaaaaataaggtaggcacacttcttatcgctgtcatatataagaggaaactgggctgggcgtggtggctcacgcctgtaatcccagcactttgggaggctgaggcgggcagatcacgaggtcaggagattgagatcatcctggctaatacggtgaaacccagaaatcaggtagcataaaaatgcacagagatacaaatgttaggatgtcaggaagatggagcaagacattgaaggaaagcccaaagtcctgggaaatgccacaaagaagcatagcaaggatgtgtgcacacagaagtccaggaaaaattccgtcagataaggcccttatctaccacttggcttctcggaaattttcttctggttcctgcagtagtttttcagatttaagtatatccttcctctgaacttttagggcatgcttcttttccttctgtggcaagattttcaagtcaatatgtgtgttgttctaaagtgaaatcatcgtctggccctctgattccacgagtcaactcaacaaatgtcccagtgggccccaacaggtggtgtctctggttgggctcactggaagcagactttgacacatggagatttatcaagtgctttcaggagaaaggatataaaggacagagtgagaaaaggggctaagaaaggatgagatcacaactggagtcaagctccagcctggtcccacaaggagtcatggagcatgaagtgtaccccagagtggatggtaccttgtggttgaactactgtgtccatcagtcattggtcagggctcacgaggcagagagaggaggaaacttcttacttgacggagggcagctctctgggaaaaggaagctgtgaggctttagcagccgacatgcccagtgctctagggttgagggcacttgcctgcaaaggggatctgtccaggacactaaaagcatgcattccacttggcactttcctgtctctgccttctcctacagtaaattatacgttgggtttcctgaaatccaatgagctactgccttgagattttctggcagtctgtttctaaatctgctttttttttttttttttttttttttttacacatggggctgggaactgacctcagtagcacactggcaataccaggtgtgagcatagctgtaattaagcactgcttcctatgaaatgtcactccatctcacataaataaatcactccgtagctgagcttgataaacattttgttcaacttaacaagatttatctgagcgtttatcaagtaaaagtcacatcaactaacagttttgaaggctgactttgtgccagccactgtgttaatggcttacataatagactgttcacttgatcctcttaaagtccctgtcaaagttcttctcaaagagtggtccctgaatctacagcatcggcctcatctgggaacttgttagaaatgtaaatttgtaagataattctagggctgatatccacttggagatgttgtttactggggttgatagtctgaggtttttcccctttctccattctattattaatcatgctgaagatgtactcattattttacaaaacagaaaatgaaagagtgtggaaggtataatttctgcccagaggaatttataggctggattaagattgtaaaaacagtagaaagagtaaaacataaacactaagtcgagcattgaaatagtatacttcatggaggaaaacaggtctggcatggagacagaaatgctcttagaaaaatctagagctatggttctcgaaccatggtccccagacaggctgcactaacatcccctgggaaattgttaaaaatgtgaattctcaggccaggcacggtggctgacgcctgtaatcccagcactttgggaggcccaggcaggtggaccacctgaggtagggagttcaagaccagcctgaccaacatggagaaaccccatctctactaaaaatacaaaattagccgggcatggtggcgcatgcctgtaatcccagctgctcgggaggccgaggaaggagaatcgcttcaacccgggaggcggaggttgaggtgagccaagatcgtgccactgcactccagcctgggcaataagagagaaattccatctcaaaaaaaaaaaaataaaacaaataaaaaagtgaaatatctagcgccatctaataaattcccagacctaatgaatcaggaactttgggaatggggccaggccatttttgttttaacaaaccttcctggggattccaatgtctgataaagtgtgagataagtcctactagtaattcctatttaatgaataaggaaactgaggcagagagcggtcaagcaatatggcttttagtagtacttctcagactacagcatacaaaccacctggggatcttgttaaaaatgcacatcttgattcagaaggcctgtgatggggattggaattcttcaggtcttgctgatgctgctggtccatgaaccttactaggaggaacaaaacctgatatcactttgctgaggggctgagttaggattggacccaggtgatctgataccagacactgagacattaatcacatcacccatctgccacctagtactaaacagtacacagctacacttagcaactctgtgaaaggagggtagagagtgcagtgttccagaaacttactttgtttgttcaaagaatatctaatgataacttgcagaaaatgactgcttcacagaaaacagttttggaaatgctgtgatagaagcccagatgcctagcattctggaaatcttggaagaccttaggtcagaaatatatatgtaagaaggaacagagtatcttcctatattcttggccatcagattcttttaatatattattaagttatggcatacctggtatactattaggttggggtgaggtttccttatccccactctttcagactagaacagtagttcctaaattttaatgtgcatcagaatcacctagagggtaatttaggaggtctggggtgaggctggataattagcatttctaattggttccctggtgatgctaaattctgctgactttaccctgggtctcaaggacttaaaagctgatgtcctcttaagtcccttaatggaaagcaaggggccaaataataccacagaacacatgaatggaaaaattccttaaatctaagaccatgtcctgaggatgagcaactggtcactgcaccaacagtgcccagctaagaggcgggagttgtggcccccaaacccaacccatactctattggcagagccaggagttctgactacagccatgagtccttactgagcccccttggagggaggtcacttttgtgctttgcccaagggctctatctgcatatcaagctacatatctatggagctgcatctgcccagaaggtgaaccccttttcttccaattcatccgtacaggagggatacatgttctaaattgaagaaaggcattttacagcctaatcggtggttctgcttaatcccattttatgtttatgtttctctgattatgttgcctttgaaatctctctttttctttcccctttttcaactgcttgccttgctctttaaaaacaactcaaattccaacttcccttggcttactttgttttatgtggataagtcggcttggtttgagagcacacactcattggaagaacaggagctgtaatagctacactttaatgttctgtccccagcacaagtgcatccttccacccccaggcaagacccctctattttcaggaaccacctaaagaggaaggcaagagttgcacctgatgccacagagagtgctgttttcctaccgtctgattatctatcaaggtttctgtaatggccttgccattttgcaattccccatccactctcctttagtgtcatgacattatttccttcacaaagaggtaagacaagactacaaaaatggctgtcattatttcagaaagagcaggaagccttgaaattgacttgtaattggcagaagtggaaacagtactgtctttaataaaaggaaaccatttctggttttgcacaacagatactatgcctggtttacagaagatattctaatgcaggatcctggaagccttcagtgtgttggtttgaacttcttggcatcaaaataataaaaaaaaatgataaagataaaaatataaaaataaaacaaaataaaattaggcccagcatttccagctgtcatttgttccaactgctccaggaatttcctggccagaaaatatttaggtgaaattcccacaattcacttgtaatgcgtattcttttcacttctagtcaccctgctgccacggcatgacatttagaaacttgctaaaatctagcccattgattctcttaagatcacatttgtacctttttggcagtctctaaagaatagcttttgattattctttattaaaagtcagaagaaatagaagtagacataaatcatttttgattagctgtgctgaaacccttccaagagccctctatgtacgtggctgactgctcattttgggttgatttctgggtttagaactcctgcaaagagtcaggagggacctggcataagtcccacagggcttggtgggggacaaaggaaactaatgagaacatgaaacttaatgctgcttgctgtgtggtgaataacaaagttctttgtctctgacccagaagtttcatgtcttctgccagcatctatgaaactgtggcagtctaccttgtgagcctccaaataaggtaaaatcttaggcctttcatagttattgatagacagtttcaagtgggcagtaagatttttgtggagggagcagtcagtatcatcaaatctgaaaagagaagtataaggcctgcgatgcaccctttggctatagcaatgaggaaagcactggggacatttacaagggccactccttggaagaggtggcactgaagaaagcctcattccaagtgtagacgtcccatttaaagaatgtggctaggaaggggataagagaattaagaaggcaactagggggtggggaggcaattcaaaaataattccaagggcattttatttcattgatctcatgtagatttgagaaattaaaatatacttaagtatctggttcagcggccaataaatttagaagtgtataaatatatgctaaataaagaaatctgtttttaaatagaaagcctcctgtatagaaggaaaggctggagtgtaacccaaggtgacagggccatgaggtaggcatggaagaatgagcccaggactgagagacaggacctatgtttcttcacaccatgcttctgctgctcactgcctgtgtaattccgaggatgtcatctacccatctaaggctcagtctcctcacctataaacagggctacaatcacatctaactgaaagactggttatgagaattaaatacatcctatgtgtaagcacttagtaaacatcagctgttaaacatagtatcattacattatcatcattgcttagttgcagcgtgaccactagattgtcaacagaaatgccacacagaagggatgcctggttcagatgcaggcaggtaggtaggaggaggagctggtccccagaacactcacagcctcagaggccagcagcagccctgcaggagcaaggaaacaggtttactgggcgaaccggctgcagtaaagactgatatgcctcctcagctcatcaaccctgttgcagctgctggagtgcaggcaggaaccttttcctatgagattcagatctgctcccagtccagtgaatgcaatttgtctgaaaacatacactgtccctacagagatctgcacagggcgtttggacacatggcttcatttctgagactcttcaaatgttatttgtcataaaaacccctcgtggattgaatcctttgtagggaggcctgagagtcagctccatggtggggctgacagactctgctctggagtccctgagtaattcaaggaaagagccccatccaccatgctccttgataaagacaggaggacacacataaaatatttctaaacatgcttctggatgagtagtgtctgatggtgatgatgggggtgtgggaaaaacctgtgtcctcactgttggaattagctatgccaaacccagcaaaggcttcttcgtatactaggagtattctgtaactgggaaaaagtgaccatttttctttttttaatagcattttgtttatgttagtttcctgtattcatcttagaatatttggataaaacagaaaagaatagcgatgaaaataaaaagcttcataatctattattacaatcaagtgtcttaatatgtatttcatggagttataggagtgtctatgtatatacatatgtatatacagattatatatatttatatattatgtacatgagcatgtatatgtgtatatattttttcataaagcttaatattatatgactctataactcatccttttcacttacatgttatgaaaatgttaaatatacttctaaaatctgatatttaatgataccattccctcatttacttaatcagtctcttttgctgaaaatttaggttctttccagccttttgtcctactgaacacaattgcagatacatttttgtccccatctctagatatttccttaggtaaatttccataagtaaatttactcattggaaaaatatgcatatttaaggctttggatatcaactgcctaattatcttgcagaaaagatgtacacatttatatttgctctgtgctacacttataattatgttggtatagccccacctagttgtatcctgaatgtcattttttaaatggactccacaaaactgtagaccactttgtttagtggctattccccttggaatgcacaccatctccttgcttgaaaaattgcttgcaaagttacatgtctggattcctcaggccaaagtatcacataaggaataagcaagttatgactgagccccttccaccacagaccacggcatcatacacttcacctcaaggagaaatgatcccaggacaagaagaacctgcttataattttttactagccttctatcatccttttccctgattcactacaattgttctaggctcatgtgtttgcatttctgcatcggtcctgtccattgactctcatgtagaacttgtactgtaattccacaaaagccagcaccggcagatgggatcttctaaagacatataaagtttccagaggggtgcaaaacaggggcattggctggtcctccttttaacttattaatttatgatccaaaaccacttaaggaaaagcaagctataaagtcccactctacagaaaagagggccagcatttcaccacacaggcaacagggatttatctcaaactatgaatccactggctcctttctaaccactgccagaaagaagggccaccgacatacctgctatgctggaaacaacatctttatttccctgaattacaactggccgagttgagaagttaccactttcagtgacttagtgaaattcctcagcatatctcagaagctacagcaggaagtagcactgctacacagtagacctgctgtagctgtcttatagagactcttttggccatgatgggcctgtttcatttgctttggaaattctcaggctaagtcaccccaaccttattatatgaggcagaacaacagcgagagtgccagccactcctctactgcttggacacatctgaagaaacatctcaggagaaactggccactgccttggcctgtcttggatggtggctgcgatcctctctggggtggcaggtgtgttgataggtgccttctttttgtagaaagatgttaacctatgtgatggttaattttatgagtcaacttgactgtaacagagtacccaaattaaacagtatgtctgggtgtgtctgtgagggtgtctggatgagatgagcatttgaatcagtggactcagtaaagtgcatggccctccccagcgtgaatgggcaccatccaatctttggaagaatagaacagaaaagcaggggaagaagagtttgcccctttgcctcctccctgactgcttgagttggaacagtggtcttctcctgaacttggactagaattacaccactgccattcctggatctccagctcgcagatggcagatcatgagacttctcagtttccacagtcacatgagccaattcctgtactaagtcctttccttccatataggaaggacatattatatatggaaggaaaagacttactatggatggaagtgtttacatctataaggaaacacttattaaaaaaactatatatacacaaatatatattaatatatacttacatataaatattttccttaatatatttaataaatttttataatatatattttataaaatatatattttctttaatgagtgctatataaagattatatatttatatatacatatattttaaacataaatatattacatataattatatatttttatatattatatatgttatataacatataataacataatttgttatatgtataacatataattatacataacttaggataacatataattacatataattatgttacatgatatatattataacatactatatattatatatgaaaatatataaaattatacacacacacacacacacacacacacacacacacacacacacacacactgcttctctggagaaccctgactaatacagcctacttccaattacctgattgcacataagcctggatttaactagccacacaggcatttgtcagatggcacgatataaactgtgtacctcccaatattttctgaaatgcagatgagacagacaatatttagggaagtttccttgaaaaaatagttactgaatctattcacttaccagatacgtttcaagtgccccaggatggagacagattggcagagagcaggggactctgccatagcctcttgcccacttcacccctctctcccccttctcctccccagactgctttctcacagccatcatgatgtgaaacaggcctgtgaaactcacttgtgtgccctcagtaagactgtggtggggaacattgttcattgcatcatacagtgttttcttcacagggactcctgggaacaattcctgtctggcttctgtgtgaacaacaggtagaattttcctgagcaattggtttttgtttatctcacagacattgtgaactgtgtatctgacaagtttcctttattccactagtggctacaaagctgcgggctctgtgtgtgacccaccagttagtaacgtgtgcagaaatgcggttttcgcattattaccagctctgtgtattttctccttctatctggtgttgtcccacttttaatttatgatatcttgtcatgttttatgtcccattgaaagccacctggaagacgttttgtgaaataagatttggtttacattgaaaaggagataagatgtggaagagctccatgtcatgtgtttccatctgttttcttcaaatattcagttatgatctctttaacatcctcccactgacaaacccaaggttcagggcatgcaactaagaactgccacaataacgatcataaaataattggaaaacccaaacaaagttgctgaaaatattgtgatggtcctgcctcattctcatgacccagctgaggcaatgccattgaaatcacacagcttcttggcagcctaatacacttgaacactaatcgtaatgaaaagagtaaataactctaccgaatactgaggtgacgtggaggtttcttatgctctcctgtggtctgtaagcaaccctgggaagcagaaagaacaggtatttcacgctgctgtgctgctatttgcactctgcttgctgctaagtggcaaggaagaactgttggtccctagatgggctctttatgcccaaggatttttctaaccacaggaaatggcttaaattcaagaaaagaagtgacaacatgaacttccaagaaagtgtgtggagagacagctaggcaaaggaacacatgaaaatatgttcagtatcatcagtcctctaagaaatgtaaattaaaactataacgtgctcccattacacacctattgaaatgctaaaattaaaaagactgaccatactgagtgctggtgaggatatggagcaactagaactttcatagactgctggtaggaatgtaaaatggtacaaccattttttcaaacagctcgttgttctttaaagttaaacatatatctaccagatgaccctgccattccacttctaattcactttcatacccaagagaaatgaaagaatacgtctctacgaagactcacacatgcaggctcccagcaacttctttgtaatagccagaaactgccaacaacccaacaggtatccatcaacaggtagatggataaacaaatagtagtatatccattctatgaaatatttcttagcaaaagtaagaaatactgttacacacaacaacataagtaatccttagaataattctgtaggaaagaagggtacataccgcatgcttccatttatataaaattctagaacatataagctaatacatactgtcagaaagcagattggcggttgcttgtgacaaacgggagtggggaagtcagaaggaagtgattacacatggggacggaactttggacgccatgcaaatattcaatatcttgattgtggtaatagtttcacatgtaaacatacaaaacttatcaaattatatactttaaacatcacatctcaattatacctcaataaagctagttagaaataattttttgagaaggagtttcaatctggttgcccaggctggagggcagtggtgcgatctcagttcactgcaacctccgcctcctgggttcaagtgattctcctgcctcagcctcccaagtagctgggattacaggcactcgccaccacgcccagctaatttttctatagaaataattattttcatgtcaaatcaccacagccacatgtagttagtggttcctgcactgaacagcatggctccaacttctgtgctgccccaaaaacttgctatttgtgctagtattaatggaagtatgctaatgttataacaagttacgttttagttctatgtgtcgccctctgtcctaacccccactcaaagagatcctttctcatctttcttggaaagtgggatgaacaagcagaaataacaggaaggcaaattcaagcttcaaacacttccctgatggactttactaacggacttatttaaccaaagaatagacagattgctcattttagtgaaaaattcccataaaaagcgactctctaattttacccagaagtaccagtgaatcactggatatccaagaaccttccagttaagattacatgacaaccacgtaccaagaacctaagctattccatttgcctcagccctagtaatctgcaattaaaagacaaagtttgttagagggtagttggaaaaggtcatagttacaaattctagttctggaacttttaggttttggtctgggtttctgcatgtataaaatggttataccaatgcctgactagcagaatcgtagttaagatttaacaagatcatagatgcagggcaccatcagaggaacagaagtactttaaaaatctcccttccctgtacacaccaaaccattcatcatagcacacactttcttcccttatcaagggataagacagcatcgttagcccaagctgccccatttcgtaaactcacaccattttgcaaatgctggttagagcagaaaattccgcaggggtttgggccatgagacacatcccgccagacaagtcccaggcctaaccatctgaccccaggaaactcctcacttaccagcgactgaccacaccacccaccccatctcacaagcccagacctctcccgcctggacctataattaccccagtttgtaagcaagggtgggctccggtgctagctgttgtccccctctgcatgtctttgttcaatacacttgtgttgccatagagctgcttccttccagtccttcttttccctttctcatcctaacgagtctgagcagaggcttctctcatgcttacctggagccaaagcttgtcatgctgagaccacttcccaccagcaatgcactgaaatgtggcattctgccccacattcacctccacgttttggagtcgcagaaaatgaggtgcttttcctaagagagaaaccaaagaacacaagagaatgagattcgacagcctgcaccacttccctattggtggatggcagctcaggatgggcactgggcagggtggaactggcacttaagaagtagcccggctcagtcaagatttcattgatcacttattataagtctggcactgttcgaactttacacgcagaatctcactgaaacctcacagaaatccatgaagtgggcagtatccccatttcacagatcagaaaattaaggctctgagggtttacgtcatcatttggcacagacacatatccagagggggagggaaccaggacgtgaatttagatctgtgctctgtgaaattggcacaaacatgcctagaatacacccaaactgatcattgcttctggggttggcattgcacaaaaggtgaaactacgacactgaaagttaaaagaaaaattggggggcaggaggggtgtattcaccataggtgatgcttccctgtagcctgaagaagcaaaataagaaagctgaagtgaagcacctttgggcctgatacctgcacacttggcctgggtgacgatgttgatgaggaagatgatgaggaagacaaagagcggaagagggaggaaaagggaaggaaagcactagtagctgtcattcttagcgcttgccatttgataagtaccacatgcagtgtctctctgcagtaactcacttaacccaatgcagtcagtagtgttattttctctattacacagtgaatgaactgaggcacagagaactctagaaacgtgcccaatatcacaagaccccagagtcttactctgtgatggtgctttctgagcatgagggggagcgttgattctagggactggacataacagggaaagggtctttcaaatgaaaatcagggtgtgtatgagcagacaatcttcggattaagtctatgttttatattgggtaacctggtttcatctctttccttttttgtggagaagggtcctcacctacctgcactctacaaataataacaacagtaacagctctccattggctgataaattgtatctagaagaattggtttcttcattgaggcacaatgaaggatctctatgccatcaatcaaatcagtgatgaactgggatcacccccagaatggaaacaaatggagggttaggagaggatcaaggaggtttaacaggaggctttggccatctttctacaaggagtcaaatacacagagagacaaatagtaacaataatgtcatttactgagagctcctacaatgccaggtactatgataaatgctttgcatgctctatctaatttaacttcatgacattcctataaagcagacactattatgatttccctgttaggcagaaatcaaggctcagcaagtttaatgtgctgaaagctacacagcgctagtgaaagacagaaacaaaattcaatccaggtccactttagccccaaactcagcatgtaacaagcagctatgctcccttgcctcctgggcactgggaatgaggatggtgtctccagatagactccagggtctgcagaaggggctcccagtcagggctgtgctgatggttcaggtttctgtccatgctcccaaatattttattaaaagtgacccctttccatgctatttttccttgatttgaactattttgtctaccaatctgtgtcagcacctataaagctcagcaaaagccaagaatcttggaacaattaggcagacttgttgggagagcactgggcagcgtggaattggtgcttgagaagtggcctggcacagtgaagagttcattgatcgcttatgatgagtctgacactgtttgtaggactttacacgtcatatctcactgaaacccccaaaaaatccaggaagtgggcagtatccccatttccccaatgtacttttactcaggtttttaaactaatgacagcagctcagagacccctcaggctacctttgagccaccatggctggtgtggtgtcaaggacccaaggcccggggaaaaccacctctatgggcttttcagagttgaaaattcctgcatctagtcaacttgacaaatgccatgctgctctgattgtctgaaattgtttccttttggctctcctgtataattttatgaagttatttttggaactatcagttcaaatcaattcttaaaatgggaatagagtgaaccttggaagcctgttcatgccacaggcttaaagggggagtgaacacatccaccccaggtggggagggagtgcagagtcttagctccaatgctgggaaactctgtgtttagttttacaaagaaatgctcttcccttacccttcgagaaaatggtttaacctctgggatatgcacaattagcaatgaatcttttctggatcaatgtccccagcatgcctctgactcctctccacttcttccttctcagcaacagaccttttgccttgattctttcatcttcaattcctcttcttcccttccttctaggttcagtggtagagagtttagatgtttaatggctcctagtgtgaatattctggggaaatactggcaatttacagcagagataatgaacgcatgcacctacaagagccagttatgtaaattaataaagtcgttcagctgtaaaacaaaacaaaaataccacctccttgccccatcttttactttcccacttttgatagagacttgagaaaaataaagatttctttatataagaaaagcaatgttgtaagcacaataactggtatccaccagtagcctcagcactgaggagacaataaggagtggtgaggactggagggaactggagagagactctgaaaggggacactgaaagggggcagctcctacttaaattcagcagaggaaggccaggcatgcatgctttgtataggggtgtcaaacgtctgatttctccaggccagtaagaaatccagactttatatgaaatctctcactctaaactcaacatgttattaaaacacagtacaggcttaacaaaacatgtgtacatgcaggctctatcaatctgcggtccctgatatgtagctcttatgaaagtcctctgcaacaatttccactagccagtctcacccgatccagccccatacattcagggatgcccccaccactccatgcggtacgcggtgggcatcacatgaaggccaaccccgagtacagttcccagcacaggagctgatctaggctaccctcttcttgctcaagacccttgtctctgctccttggggctctgggtcatccttggctcatgacaggcagtgctctctggtgattgtgcttatgtggggggcctgtatggtcctcttccctgcgttcctggcctctctgaccctcctttttccatgcccccaaacggcctgctcatcagccgcaagctctctcaactgtcaccttcccccagcatctgctgctctgggagagaacttatattccacgagcttcaaatcactcatcttcagccaaacatggttgaccttggtacccaggtcagccatcggctcgtggttctaagcatttcctactcactccacactgagacccaattccccccagatgggatgccactgaatgggcttaacagaagactggctgtgcatttggggcaaaaatgccttgacgttagtgacatttagacgcctacagatgtcagtgcagcatctgaagacatattattgtgccctttatcttgctctttaaacctgacagtgctcagtaggaagccacacaattgtggagaaagcccagtacgcacattagaaacatgttgcagatgctctgtgggctcggggacacggccccacaagattgtgagggagaaagaaaagtcaacttagaagctagaaactttgaaacggagtggaaaaatcatactgacatttatcttacacagttataactgccttggccctgctaatggctaacactgagaaacagcaacagagggtaactaaggatagaatacttttagaataacacaaaaatgttaaatgggctataaaatatagatgagaggcttccgtttgtaagagaaaataatttctttgagtattatgcctgtcttttggttactgttttgggagcttggaggcaattatctacagttctaatttcagtgccaatcaattgaagatacaattgcaaatcagtcactcgctccctggaacttttggaatacttagtggaatcacttattgataaactctgaccatatgttaatagaaaatatgttttagaggacagaaagggataattaaaaagactttatgtccacaggcttttttgaattgaacgcatatatttcaatatagttcaatttttaaccatctatgagtgaagtcataaattctaagactggaggctggggaaaagcacctttagtctaaaggagagttcagaagctactatccacttgcatgacaggtaatccctgtaagcagtccctggggcccacagggcccctcaccaggcagcctgctcagttcttcccaggctctcaccaccttgcttaagctacaaatctgtgagtgcactatctccgatgcctgactcttaatccaatttatcaaatgagaccagttggctctgcctcctaaatggatcgctaatctctgcacctctatccacctctatgctctaagtttcttcattgtcctgctcataatttgtcatggtctgaactgtgtctcccccagatttatcttttgatatatgaccccaacccccagtatctcaaatgttcctatttttagcagcagggcctttaaagacatgattaaattaaaatgaggcctttagggaaagccctaatccaatccaatctgaccagtattctcaacagaggaggacatttgaatgcaccgggagacaccaaaggattgtaagtacagaggaatgaccatgtgaagcctcagcaagaaggcagccacctgcaagcaaagaaagagcctcaggagaaactacggtggccaacaccttgaccttgaactgccagcctccagaactgtgagaaaataaaatacatttaagttgcttaagccatccagtctgaggggttttgttatagcagctttagcaaactaacgcactgtctgtgcatataattatataatcatatcatataattatataagcatatcatataattatatatgatatgcttatataattataaatgtatatatgatatataaatgtaaattatatgattatataattatttatatactataactcacatttatataatatatacttctatataatgcttgtacaattatataatatatagattataataatataatcatataattactttatttgttttgcttcagcctccttcacttcaatagaagtccatgaagacagacagtcaatctgtctttctcactcccacaaacccagaatggtgcctgacatggagctcacgctcagtaaatacttgttggatgatgaatggatgtctctcagtcaccctggtgcgggccaccaccacctcttgcatggctccagaactttcttcctcctaggtctcccgacatcttctctatggtcctccaacacagagcagcccaagtgacccttctccagcagcactccctgcagcagagcctccctgcccttagacaaacatttaaactactcacgatgctgcccaaagtccaggctttcctgcccaacatttgccctgaccaccttctcctgtgccctgtatgctcaggacatgctggcagcatcaagccaactccgtgtgcagggcctctgcaaccactatctcctctgtctgaagcacccctccaccaaatcactagactgtgaactccctcctgtgatttgagtcccagcccaggtcacattttcaaagatatctcctctgaccactatatccaagcagccctcccgtatcccagacaccgacacttactatatccactattattttcactatctgaaatttctggttacttaatattagttactgatttagtgcctttctttccactggctcttctgctaatcaaacaccatgagtacaaggaccgaacctttcttagtcacttaagtatcactgtgcctaggaaagttcttaacacatagctgatgtacaataatttacttgctgaaagaaagaataaaaacctgggctaggtatggactgagcactggtccttaggaaagggactttgctaggccctactcaactccacatgattcgtgagctgtggatatacctcaggcattatatacattgccagtatttgtccatatagttaagtgaaattttttccaattccagccactcctatggggtcttcacatcatgctttctgggaagtttatgcttaagctgcctcaacactgaggttgaacccaacaggagcacattatgcagacataaagccaggatcacgccttcctgagttatatcccatggtccatttgctgggtaactggctttcagcaatttcatgaccatgccacccacacccctctgcaggaggaggatgaggttgtcaggagaatcctgacttcaggagcaaccccagtgaaacgagaatttcaaaaggattcatgagactttggggggtggaaagtcattccagtgccctccaaagagccctctcccatggagatttatcaaagaaaaaggatgcatttgcttgtgacagcaaaccatggtcagtgcttggaggtaaggcagagcttttaccactctggccttgaaggtagttacggctagggtaagagacaggtgtcaaggttgggcatcaggacggagatgaaaattcccattagagcacaaagttctgggatccaggtagagagactcatgctattttcccttgggaaaagccagctgtcacctactagaaagctaaagtccaagcatccagcacaaagtaagaagcaggaacacaggtagatgtggcagaggcaagcacgctctgagtggatgggatgtaggcagggaatgaggaagacagaaggcatgtttcagagagactacctcgaaactggaggtagtgcaagattgagcgcatgcaattaaatggaccacaggtagcacagacatctcccaacacagttgcccagtcttaggctcattctcaaatgagcagctgatggtgactcccacgagtccagggtggggaatatttcaccctagtgaaggagattcatatgcatatctactacataaaccctgcatagctggggggatttctgggatcctcttcacatgaagtctgggtcaatagaaacatttccccaggcatgactgaatgacagacccatctgagaaattctaaaagcctcaggaagtaacccagagggtagggactttcagccagtgcaaagaagagcccagtagcatctcagcattcccaagataccagttgcttcttgggaaagagggtctctcctgcacaggatccaaacacaatttctcaaaataatgttcggaacttgtaatgtgttccaaattcctccagagaaggggctctaagacaatgagtcagacaacggcattctagtgccaggcagagggagggaagttacatttgagggtctgacaaattcattgcagcagaagtggaaagagttatttcaattaaagcaacatggatgaggctgaaatgagaatagtccctaaatgcgaggattgagaagcacataaggagaggaggacccatgatgtctcttgaggcagcagcaaactgcaccatagcccaaagcatgactcatgcccatatgggaggagtggagagagcccacagggggttacctagaactggatggctgccaagaaactactgggaatctccaatctgcagaacactaacaaactcatggggctggcattccaggtatccctcccagggtctgccataatctccatgcaaatcagtttgatttcagtccccccaaccaaatgtcactgggtatgatgtcatctcaactacctgtacccaggacttatggcctctgagatttagtaaatccagaaaccacatctccctgctgaaacacattccaatatctgagactaaatatggcaaagaagtagatgggtatggaggagtgccacgcctttgaggactcttgacgctgtaccataagtactaaccactatgagaaatctctatgcctacatggagctgatgagtatatttaaaattattttaaaagaattaataacttcagggtacttttccctgtgagggaacagtgtgctaatttgctcagtgttttggtggtggtgtgtttttttttttttaagacaattgcacaagattctatccaaagccctctaattctaccacttcagtggtctgaatcccactaataaacaatcaggactttagactcccttaataatggagagagattcaaacaaagatgttttgccactctctgcaaattcctggaggtgctgcctgttgaacaggccggcaaaattatggatttattcaggactgattgcattgagtatgtaagcatttctgaaggattcaaagagaaagagagagtgagagatgtttgtaagctgaatgaatggaagggattgcaggctctatgctacccagtctggcatggatcaaggctgtgttgggaggaagggaaagacttactgcatggatgagcaaggacccggacctcgtccacggcgatgtagccaggatgacccttcaatgagacggattcaaatatcacctgcaacacacagggcgggagtcaatttcacagaaacagttgcaggcattcatcacaagaagctgcccggcccccagccctttatgtttcaacttcccatcagaagcaacccaagaaaccttctgttaagacagcacgctaccctggcaattgactgggattttcaacacaaggtaaaaaggccacactttggtggctagcaaaagaagaatatttttaacaaatttcagaaataacacttagatgcaggaaaaacaacccaaacaccgaggtctcggaaaccccagtctgcatctttctcattgcagcttcaagggtcaagccacaacttgaccattcttctacagagaactactttctaatattccaactttcttatgaaggataagatagatgcctaccttggaagctaccataagccaaggagggtttaccatgagttgattctacattgccaaggaacatattacatttgaatctataataacactcttaaaaataagtggcaatctacctgttggtatccaggagtagaaggcaactgacttccacctaaactgctatttccataaaaattttgtaatgcatttagcttccctcatcactcaacctctatcttcaccaaggagatatgaatgtctgtgtggatagcatggccaacatccttgaactctctggttccaatggccttcttcaatccactttagccccactttcacctcatttttcaccttctggaaattggaaattccattttcccatactccggcacagtctctaccgacagtctcatcccagttgactcctcttgacctgctcctcaggctcacgtggtagcctggacctctgcttttcttatctaatccttggattattaatgcagaaggtccaggctaccatgtgagctcctcagactccatacgagtctctcctaaagcccccattcctttgcacctttatttcaactttgcccagcctataacacatttgccttctccaatcctgtaccttacacaactgccgccctttcaacatgcacccatgtaatcccagcagacacccacatcttcaagaggcaagagggaaagaggggctgacttctaactttttacccactgacttgatatccatccacaccatcccctgcctcttctttgcaaggaacatcagcgctcttgacccggactcttgctatattttccatcttttggattctttttggttttctctgtctaccctatatctccaaaccctcccttttatccctaattttgacatgtcaacagcttctcctattctttaaaaactacccttcagcagcaggttttctctaataccatccagttgtgtttcagtaacacttaaaattctcagcagttttatcttcattgactcccaacacttcctgactttccactgcaaaactttaacctaatatgatctggaacttcccctaaaactgcttacacggaagatactaataatcttctaattgcttaatcaagtagatattttcaatctttatcttactttaagaaggaagatagtacagtgcttaaactcttgttccaagtgcctaggttcaagtcctggctgtgccacttgctagttagtagtcctggaaaagttatgttactgctctgtgcctcattttctgcatctttaattatagtgtctacctcattgagtgattttttagattaagggagttaagaccccacttagaacaatgtatggcacatggtacattctcaagaaatatttactagaattattatcacaacttgaccattcttctacaactgtcagtgttcatagactctccatttctgggtcttttttctatttaggctcagataacactttattcttgttatttttctcataaatctggcactgttcaatgcctgggaggtctgtaggcattcctccttctccatcttcccttctaacgtgggcccctgttagtcatcttttcactgcatacactctcccttcaacagctgccaatgcactgataactccaaagcccagctctgcaccctagacctttcacccacacatccgtcttaggtgtccaggtcacagatctgtatttctacctaggtaccacatcaatgacgtgaatccaacagatctgcacagattcctcctcaaaccttttccctcattgaccaatagtctattctttctgaaatacggaatatggttaagtggcactatgacccattcagtcacccaagctggagaccagggtgtctattgggcctcaacttctgcctcagccctcatcttcattttcctttttattctaccttattagcatttctcaaatcttcccatgtcatacatctctgaattgtatgctataagataaacacctaaaacagaatgactgcacaacattaaaaagaacaagttgaagaaagacataataaagaaatgcaaataaacagaaagcagttgttgcaaaaatagtgtgaaaaccttgaagtagaattttaactgaaaagaacaatgaaaaaattaggtggactaaaatggtcatttagaaaaaacacatgagtcaagggacttaagtgaagaaaatgatgaaaaagacatgggttgaagactttaatctatgtcttagactttgactactaatcgtataggaaaaagcaagtatatataatgtaaataataatgtatttcctagatacatgttaataaatgtaaagacagaatgaaacttccattcaaaggcttatggctcagttgcaaaaaaatcatatactaggctacaatataacttcaataaatccctcgaagaagaaattgtttagctttgggcctatacattttctaaccaaattcactacaactagaaattagtgacaatgtcttaaaaaccaatttatttaaagttacacaatgctttcttaataactatggtgtcaagtgtgctttgtatgttagcaaaaatctaaaacaaaattaaaagtcaaatgacaggttgagaataatatttgtaatacctatgtcagctaatatgaaaatatccttttttatgtgtaaaggactcttgagaatcaacaaaaaaaaaaacccaaatcattcaaattaaaaagtggcaaatgacttcaacaggtaattcacaaaaagaggaagtaaaaatggtaataatctatgaatgtaattgtgtaaaatgacactgagtatgatcaaaaggtgccccagaagacacctacaaccttggagggagatgatcactccatcaatatgcttctgacgtgagactcctagccataggaagccccacccaatagatagccagctccagtttttagggacagacaccacaaggggacaaggtgatgcctggaccctcagagatggaaagacctgccaaggtgttctgaggagagggagaatggttatctctgacccaagcacactctcaagaaaattcaaccacggcccttgaggaatcaaagtcaggaaatgggagagccaggggagtgagtagagaagtctagaggtgactctggtgcagtgttttcctcctgtcttcaggaggcaggggagtagggatgggatgtcttcaggaggcaggccatgcatacccagtggcactccaagtcagtaaatggaggccgagaccctgagtacagggagtggagcagagggcccaggctgagaattccaacgtctctgtagatgctcttcagctccaaggctgccatgtggacctaccatctattgcacatgctccagcccataggcttcattagagacctcctggtgcgggtgttgaagagatgaggcttgcatggaaaggtgaaaacctctccctgtgcatgactacttgtgcaaagccaggaagcaattccccacaagaggctctgagatgagtcttgctcatccttccaaaaaatggtttttgttcatacttggaggagggtgtggatatgtcaggccatggtttaacagacctggtgttttaacctaatcttttatagttcttgagcagaaaatctgcatggcaaaaatttcaaggggctgcaaacattttcaggagaagagaaaaatgttggcacatcagaactcctcttagaacataaatatacatgttttcatggggagagattgtttagggtaaaattaagagagactttttttaccctatcagcccaaggagacctgtataagacaaggaggaggatttgatgcttagtggagagaagtgggatgggtaaggaagcagatggaatagaattccaagagtggtagagtgggcccctcattgtgataaactccacttcattgtgagtgaatttactaaatctacagagtgccacatagcaccgttttccagggaaagggactgagtttaaagtccagttgaaccaaagctgggtgagtccttaatttcaggggcctatatagcgataataactaccaaataaaagataatttttcctaggcaggtgatggagactagggcaagcagatggctgcaaaattaacagaagttcttttatttttttaaatcttgaaacagaaaattcagaatcattagaaaatatgaaatcaaattaacatcacctagaaaggagctgtgatctgaagtacacgtgacttaacagtcattcagcactgagtggtgaccacatttaataataatatattgtgcatttcaaaattgctgaaagaatagatttttttaatgttctcactatacaaaaaaagttaagttggtgaggtgatggatatgttcattagtttgactaagtctttctataacacatgcatagatcaaaatatcacactacaccctctaaatacacacaattaatatttgtcaattaaaagtaaataaacaaacaagcccctgctttcccaagaaaaggcacatgtcgggagatggctggcagaggcaggttctcacccccggccttgccaaaagtctggtgccagaaagctcactaatgagaaagaggaaatttcagtgtttattacagagctaaaagtcaattttagaactataaaatacgactttaataaattaatacataaaccatcagctccgaagcccagtaatttgtatttagcccatagaatcatatgtacaggaccagagctccaggtctggtgaattttaaaacccattttgctagtgtcattggattttctgataggcctccttttcttgccactgtacttatgtgtatatgtgcaagtatgttttgaatctgagagtcttgtgggtgcttgtccctatgtgggcactctgcagtgtttgtggccaagtgagtaaccattagtgacggtgtgtgtataacatctctctccaaactgctgctctcagccaaggaaatgcaatgaggctgtagtagccaataaggtgcaaatcagaaaattctcccagatgaggctacttatccaagggagggcatggaggttactgagtacaggcttaacaacactggctatttcttttaaaaaggcttccttcctccttcccctttgtctctttttccctcttttcctttttccctccctcccttcctcccttccttccactgaggcccactacaagcctgatggcatggtttggctctgtgtccccacccaaatcacatcttgaattgtaatccccataatccctacatgttgagagacgaacgtggtgggaggtgattggatcatgggggtggttttccccatactgttcttgtgatactgaatgagttatcacaagatctgatggttttataagtgtttgacagttcctccttcacaggctctctcttgccttccaccatgtaagatgtgcctgcttccctttctgccatgattgtaagtttcctgaggcctccccagccatgtggaagtgtgagtcaattaaacctcttttctttataaattacccagtcttgggaagttctttatagcagtatgagaacagactaatatacctgacatgatgatacatatatgttctctaatttcatctgcagaaggtcctatcatacctaatatcctctccattctacagatgagggaactgtgattctgaatgatgacaggatacagctaacattacacaactaggaagaagattctcagaaagtgcaagctattttccctaaaggcaaagcagagcttagagccagaggacctgggatggatcatggggacttgaatttaccagtagtgcttcctacgctggaagataggacatgttgccacctaatagagggagctactgcacagatctcatgcctctcatagggtgtgaacatagggggtactccagaaatgtcctttccccccatgcctcatccaaaagcatggcaaatggtatgactgtccctgtactcagtcaattttcttgttcattgtacttcaacctgtggccccatcctgtacccatttgtgtctggtcctatatatggggtttctaattgaaaccttaaaggctcactgaccgtgcccatgagcttttagagatactttatgtctacagtcaatgatacagtggtgacagtctagggagtagggtatctgggatctgctctcagctttgccaataatttgttacgtgttcttggacttcactatgcaactctggacatcatcagctttatcatgtacatcagggttcagctatggcctggaagccaaatccagcccaccacctgtttttgcacataaagttttgttggaacacagctgggtccattcatttacatattatctatgactgctttcatggtacaatggcagaattgagtaattgcaatagaaattgtatggcttgtaaagacaaaaatgttttctttctgcccttaacagaaaatgtttgccttatctacaaaatgaggataaacctaagccacatgtgccagtatgcattctgtaaatgtctatggataggaagactatataatttatcactgaaactggggcacactatgaaatggatgctcttaatttcaccaggataatgggagtaaaccagggttgtcccagcaaactgagatgtagggccacctgtctgcagaatactatctctatagtcaggtggtcatccaacaaaaagagggccaagatcaaacttagaggcaagacaggaggttaaacaccaataaatggatttctttctgactcctcagaactcccacgtgggtaactgtgagtctcctagaaccgaatacatcacacagctttttcaaaatgctgtgacctccaccacatcagccttcactacagagaatctcggggaacacatgttccacagagcacactctacaaatcatacactgggtattcttcccagaatgtacaagcaagatctgatccccttgttcacgcaactgtgcaggtagagaatataaggctatatgcttaatgcaattctgaaaccccaaaagctctgaaaacaacgttcttcaccttagtattataaaaagtaatttggtggtaaaacctgaacacagccgaatggcctgatactacttacagtctttatttatcccatttcttgtgagtgtgtgtaagttttgctgtagaaatattacatttgattacagggtactgcctcagagcctaccagggttgttataaaatacagaagatatgccaatatattactaatatattactaaattccaaacattgtgaattctgacacatatctgacaccatcagtttcagataaaggtttgtactaaaacatattacacaaaaggaaaagacaccgaagtaaagaggccaaagatatataatttgtctcaaaacatctaggatacaacacgtcacgttgttagtgacacgtgttaaaaacaaaggactctgcttttagccactttcattcataggttcctgctgttgtaaagaagggaacaggggcttaacctcacaccaaatgacaacagtccaccctgaccaccccaaggccagctctgtcccactcacctctgcgttaccaatgcctgaactggcctggctcacgcaggatgcaaaatgactgacaagcagatgagaatagggagcgagtggctgaatgatggtgtgatgagttcttccaagaatttactctctctttttctcttttcttctctttctcacttcctcttttatttctgctctcttcctaactttccttacttcctgcctctggctcttggtcacccatgggcaggccaaggagatgaggctgggggaaaagcaaaggaaacgtggtcccaaacaaggctacttaggtccatctcccaggctgcttgcagatctccaggattgcgggagtcacctgtgctgttcgacagtcattgccattatatctcattatttactcctttaagtctcctgacaaagaaccccaaaataaaaaccttaagaaaaccctcaacacagaccaaggcattacaagagatagctgcgggattctccagcaatggaggatgagaatgagcagaaccagcacctcataaaggccaggtcccttctgagagcccagccttggagttaccccgcttcatctccccatccacaagttccaggcgtggctaagcctttcaagaactctactaggggaaattgtggagccaagtggttaagaattatgatctgtactaatttgacaaccacgagctactgaagcgtggctaatgagactaggaaactgaacttctcattttacttaacttcagttaccttacattttaatttaaaaactgatacccaattcacttaagaatgtttggaacaacttgtgtatatgtatccacttcttcagctatacattttatgagtccaaatacagatcattattactaatgaaaataaaacatttaaattgagacttactgtaagtgtaaaatatagactgaattataaagattgacagggagagaacagaaaacatctcactaataattgtttagattgattacatgtccaagtgatagtattttggatacgttggtttaagtaaaatgtattactaaaattaatttcactgatttccttttactttttaatgtggctactaaacgtttataaatgacatgtgtggttcccattatatttatactggattatactagcttagacagtgaaatcaaacaaaacgggtaaaaaacaaggcactacctccgttcaagcttgggttatcacttaccatttctgagccttcgtttcatcacctataaaatgggtacgtagtacctgcctcaaaggattgttgtgaagattaaacaaggtaatgtatgtgaaacattttgtactgtgcctggaacatgataaacacccaatgaacggtaggtatcaccatcaccaccattaccatcatcatcactacctctcccctatttctgaaaggagtttcaggaaatgcatcatgaagaaaaataacattattctaaaaggaaatcacaagccattgaggataaaattgaaatatgtatggcaaaaatccagtctaaatattgagggtaattgagtattaaattctgatttctcgttaccaaggcaaaagggaaataaagcttgaattgcctcattaaggtaaacccaacaagcaatctcaatagatacatgtattcctaacactaaaatctggaagaactgtaccatggatattaacttggagaatgtctaagaagcccccagccaccggttcatcttctgcttcagatgctagagaaatttctccaaaatgcagatctgactgcctcaccctctaacctaaaacctttcaacagtgcaagtggagattaactgcaaatgagcacagtgtatcttactaggatgatgaacatgttctggactgctttataatgatggttgcacaattcaataggttttcttaagtcatgggattgcacacttaaaataggtggattctgtgatatgtacattttaccttaataacattgttaaaaaaaaaaaaaacaaaactttcaatggccccaggccaagacaatgtggagaaatgttcctctaagcatgctttatggattggtgccaatctgtgcgctgtgtgcatcagttcgcaaggagataaggaaggaaagagagagaggtttaggaactgttgcaacaatctgtcattgccatgattttttttttttaccatggtttataagagtattgctccacaatgagttgagaggaagtgtcccttcaccatggacagtatgagcagcactgctttaaactaagttccatccattagcctgacattcaaagccccccatgatctgcttgtccctgcaggctgatctccctgtctgtcctctttgcaatgtaccttaaacaacttagactttccaaactctgccatagtctatcatccacccctgcagctcactgtacacactgtctgtgacaactcaaatgcctttccctccctcccttttaaaataaatttgtattcattcttcaagattcatcttagatgtcatctcctcttacaaaccatcctaattgccttccccagcaaacaccccattccccagagggtgatcttttacgagttatttcatctctccgaacctcaatcttttcatccataaaataggctagtactagtacctccctcatcatgtcataagcactgactttataaaaaggaatcaatgcctatgttcctctagcatcttcaggagccacatgcatcctggtacattgttattttatctacatatcagtcttttcctacaaatgatgaattcaagtgggacagcggctgtgttaggtcacctctgcagagcttggctaggaggagaagcacagtaaacacgagtgaataaatgaagtcctttctagacctagcacctgtagggagagcaaaggtgtatagatttattacaaattttcaaaaataaaaccatggtaaaatgccatacctgatagaaatgtggccagaaagtgctgatggcgagctctgccttcacccagccctcagtgacgaccccggacacattccacacagggttcccttgggggccaccattcaccttcacgtagacgttcaaggcccctgggctggacctgtcacggctggagaagtagtaatggaagtcgatgcagtgggtgtcattctccttcagggttggcaggagaaggtgggccttctggccagaggctctcccagagctgttcaccatcatgaaagatcctggagacccacaaagcaggtgggaagtagagacaaagagaaagtaagaaaatccttctgaaaatcagtcacacccataaacatggtggccagaggagtggccagagatcaagtcactctagaagggtctgggtgaccctgcaaaagccacatctctctgagcctgagtatcctcttctgtaattgggtataaaaaatctattcaataaggtggttttaagaattaagagatggtaacatgtatgaagtatttctacaacgtgctactattgctatttgcagaaaacatagctactattactgtttgcagaaaacatctccaagcattcaaaaagtttccttgtaggacgaagtgagcctcttttgagttgctttgacaaattaaatggttgtttccaattctttatccctccctggatccatgtcccttgccactggctttgcagttccttccagcagaaacagagggtatgtccccatcccttgactttgggctccaccatatgacttgttttggtcaataggatgctaacagaatgattcaagcaaaggttaaaatgtgcttgccttgctgggcttgccgtcttgcactactgctacctttcatgaaaaggatgtgcccccagtagctgctgcccctttcagcttgggatcaagaatacacacatggaggacacctgacttgaactgatcttaaagaaccaagccatgccacccctgcagctggaatcacagccacatggcccaaaagcccaacctagatcagccaatctacaatcaatgcacagttccatgagagctagaataaacgcttattgttgtttgccagtgagtttcttttcagtgtgtcatgcagctttattgtgacaatagcttattgataaagctgcctgggagggcagactcatgaaagaaaccatgagggggtaaatttcagttcagtgtacaaataactttctaacaagtaaagttggtgcaaaatagaatggactggccagagacaaagtgagtccccaccaaagcaggtggcaaaacagagcctagacaaattaaagagatgattaaggaaatttcacaagcaactgggagggctgaacttagagtcttatgattctatgaaataaactgcatcatggaacactgcagataaactcagttgattctagaaggacagtttccacctagaaaaccactaaaatcttcaattcaaaaataaaccttaagaccacttatcctcagccaagttgagctacttcaatagctaaaagtcacctcattctttcaccctaataccaaaaagactaacagctcccagttaataagtgctgggaaacccataacttcttgggattctagaaggtaccaatcaaaccctgtctccttcaggttctgagtgaatttaaaaacagacatgagagagatagaaagggagagacagagagagaggagttcaaaacctccacgttattattcacaaagtaacttggacttacggccaaattagactttctgcatgtttcccctgaaccaccatgcagagcaggcggatggccatggacccaccctccaactgtgcccagatccctagggccacagttgtcttactgggatgaccacttaggatagttgggtgggtttgtaccaaaaggtagccaggtgaaaagcacagagaaacctgaaccagtggctatcaggttttcgccatcctaccaatgagaaaaacttgtgtgtaaatataagggatacaagtgcagctgtgtttcatggatatgttgcatagtggcagagtccgggcttttagtttgactagcaaccaaatgatgtatattgtatccattaagtaatttctcatctctcacccccatcccaccctccaactcttccaagcctccagtgaatatcatttcacactctgcgtccatgtgtacgcattatttagctaccacttataagtgagaacatgccgtattgattttctgttttggagttacttcacttaagattattgtctctagttccatccatattgccgcaaaagtcatgatttcggaaaatgtagcacctcctggggaaggagccactggaagtggaacaaaggtgcgggtgtctttgcctggtgtttctgagtaaggcgtcccagttttatggccgtgcagtaacacaaggtaagtggagcaatgtctctatgtcagagaagttattgaattatcataaactcgcaagggggcagctaaaaaggagcaattataggggcagaaattgaggcttagagatgagaccgagcctgcatccatgcccatatctgtccactggcctacatgccacagggttccaaaaggtttccttggacaggtaagtagcaactcacaagccccacaaagggtttgtgactgcctctgccactgaggagtagcacatctcccagcagaggcagcagcctgagaagcaaagtgtctctctcctctctgaatcccatgatacccgcatgcacatttcagctcctgtcctcctgccaattcacgccacgggctcatgtacccttggctccttacaatccactgtagagagagttgggaaggttttccttccaccagttcatgatcccacttctttccatcctagcttcggtagcagggcaggctcgctgaggaggtagagattgccctgttccatgtagcttcatgcacaaccctgtaacattgttctgggcacacagctagactatgtcttccagcctccctttagcatttggtagggacatgcaactgagttctagataatggggcatgagtatgatgtgtgccactttccaggcctggttggtaaaagctgcctccctctcacccccacacctccatactaaatgatcttgcctctcaaagactggtccttggaccagccaccccagcatcacctgggagcttgtgagaaacaagaatctcacatccacccccaggcctattgagtttggatctgcagtttatcaggatccccaggtgatcggcatgtacataaagcagtgagaatcattggcccattctattttcccatctaccagctgaatgtcccagagctcaagagcctaggagagggcagtgcaccataaaagaagccaggttccctgaatgagcacaaccacacagaaggctactcacctattaggagcactcatcttggattttaagtaaaaagggaataaactattattcagctacaagtccctttatttaaggcaataagatgtgaaacagtagctactaagcaaagttgcaagacaggctacctaaggatatcattaagagcagcaagccttggtggtaacttgggaggcatttgaaatagaatagcctaggcaaaggcacagaagcatccagcaatgctagtgtaaggtcttgggggtggggggtgggatccagcggccatctctagccccttccacatgtagcccaccttatataggtctgaccacaccctccagaaaggaagggagcctatctgcgagttgagctcaagcgcgccactagagattgctcaggagtgaaaacccttgtatatcatcagctctgtggggcccgctttgatcaacaggttggcataattaatatcatcccagggctgtcagtttcctggagatcaaaaatgagccggtcattacgccaagatcagtcagaaacaagaaagagaaagactgtaaatacattcttttcccttctcccttaaaaaaaaaaaatctactaacgtgataaggaacataaaacagcattagtttcctcatagttattatacatagcactgaaaattgtggaattaaaccaggaagtactctctggctggccataaattttgcatttttccccttcgtgcataataatgccttgataagcgcctcgttattgatgtgtctgcaacacagatctcctttttggaggcaaaatgcttctccatagcagatggtggctattgtgtttacacatgagcacctcaggattgcatttcctcacgtcggcagtaaaaagaaagtcctaattgagtttttaatggctttgcacattgttcattaagattacatgagtgtgctcgggcgactggcagctgagggccttgggcaccaagagctcagcatggtccctgcagacaggtggccccgccagctcccagtgccagcacctacttgaagggaatggatgctggtggggcctcaaatgctgccaaaagccaagcagctgtggtgacatgaaacaagttctggatcttcagttaagtaagctgggtttcactccagcttctggcatttcttagttgtgtgactttgagcaagtcagtaaaattccctgggcctcaatgccctcatctataaaatgggataatgaaacctacagatcaaagttgtttgttttcagtgaatattaagtaaaaacggtacttaataaatgctaattttataacagatagccaacagcaggtaacagtgagcccaatgccgtttataaaaccttatgtttattgagaacttattatgtgccaggcattgatctaagcattgtttagcaccctaatgaggtggtgccatgcaatctctgttttaaagcaaggaatacgaaggaacagagaggtaaagtcattttcttaaagccacatagccagaaagtgataaatactcaaaccaattattccttcttagaaagcagagactacagggtctaggaatgcactttcctaaccagtagctaataacgccatatgcctatttaaaataattaaaattaagtagaaaaaaatcatttacttagagatactagccacatttcaagtgcccagtagacatacatgactggtggataccatattgaacagtgctggtgtagaatacatccattgtcacagaaatttctgttggatagcactggtcttgaagttgtggattacttaccaaagcataacaaattacatccaagtgagtcacaggaacttaactaacccaacctactcattttataaactccagtagggaacaagtaacttggccaaggtcaaccaacacaatgaagatttagactcagattttccgactccgatttcagtttctaccgcagacaactctgccgttccttgcccgagctgtacagccacagaagtggtttcccagatagctatttaagagggaaaagagcatatgttgccttcaggaagcagaagcatagaagtcctaggcattctacatgtcacatgacttaggagaagtatgtgcacacacgttgggcattcccagcctcagctttgacaggcagttcaacaactgtttgttgaggcccaagccctggtgagcaaggacaatgtaggatgcttctaacaaggggtccctgggataaactggaacccaagatacatctcttctctctgatgatcttaaacaagtcacttaactctttgactctcaagtaccatcttctataaaatggttataaaacacatctcatattgtggcctcatgtaatccatgaggattaatacaactactatttataaagtgcgtagataagtatcgctgcatgtaggtcctcaaaaacagcttcttttctatctttcccatacccctaaagttttgtttcagtgtagcagggagaccttaatagactgaagaagaaaatagtaagaaatccactgagaggcagagtaaaatctgctgccccgtctccacctcccacaattgataaggcatcaaggtccagggatgcctcctccttttgtttctctgaccatcttcttcctttccactcccttggcactggcctaattcaggtccatggcatttgtgtcagaaactgtttattttgcaacgacttcctaagcagtctagtccttgattctctcaccatccaataaaacagtactcagcaccatctttctgagatacaaagccaaccgtgacatgttctcgacttccattgaggtcttcctttataggaaattccccacttcctataaagcccaaggtctttcatgagaatatgtggagccttacacatcctgacccccacccctcctgcctcttatatgaagactatctctcccaccctcccccgcaaacacagtcctcggccactttgtggtagacagaataagggcctcccaaagatgtccatatcctaatatttgaaacctgtaatatgttacctttcatggcaagagaattaaggttcagatggaattaaggttattaaccagataagcttgagatggggagattattctggattttccagctgagcacaatgtaatcacaagggtcctttaggtagacaagggggccaggagagtcagaatcacagttgaggagctatctgaggaggctatgctgcttactttgagatgaaagaaggagccatgaaccaaaaactgcaggtggccagaaaaaaactagaaaaggtgagaaaacaaactctaccctagagcctccagaaaagaatgcagccctgataccttgaatgtaccccagtgtgacccacttaggacttctgatgtccagattagaatgtgtggggtttcggccactaaatttgtggtaatttgttacagcagcaataggaaactaatacacacttcaaacatcctacgcatgtccctgctgctaggcttttgcccaggtgatacccttcctgaaatccacgccacccagctcagccatggtccttcattaaactacttaaatatcactttccctacatggctttcactaatgtccaggaaacaggcacttctgaattgttgttcctatacttcagagtgcatacttccattataggtattttaaacaggatctaatttaaaagtccataatgatgaaatttagctatctagtcataataaaagtgaaagtggcacaaagacatcaaaaggcacaatgcactttcaagtaagaaaatgtaggtgcaagagaagcagatagtgctaccagtattaccatgaaaactagtaatcatcaagccaattgcaaacataacaatagaccaatagccataccaataaacatatcattcaacattattcttattatctatgaaagcaatctaattatcaagtgtcaaaaaaaagaaatctgctgcttttctaatataccagaaaatggggaggtggtgttaattggaacttaatggatatataatacctatttaaaacaaaaaaaagatacatcctgaaacttcaaaggaattgaatattgtgaacattttgtcactttgcgtgaacaagtaataagcatttctgtaaccattcattcagaccggtaagttggggtttcagcatttcatatgcaaatttgttaaggcaatttttgaagaaacaactatctaataatccatgtagctgtggataatgtcgtttaaatatggtattaacccccagtgattggatttgaaggcgcactggtggagaggctctgctaaccggtgctggataccctaatgcaagcagagtcaggcagggagtttgtgtgcacgtgggtcttttcctcaaagaccaaatccctagccgcctgcattcttttacactttctgagaaaaaaaggaaggcagagaggaagagggagagacacaagacaaagaaggaatggagaaggggaagaagaaagaaaagaaggagaaaacaaaagagtaatgaaaactaagatgaagaaaggagggaaaaggggaagaggatggatggaagggaagaagggaggaaggggaacaagggaaagaggcagaaggagaagcaggagacatgaactgcaggcgagggaaggggtactgagcagggggagagaagaggcaaaagattatggagacaaagcagaataacatgtaaactacacgcaacccctacataagcttgcatccctcctgacctcccaaacaaaagcaaaagtgaaaataaagactttttacccagcatacttcttctggtccttccaatgatgatgtgatgaaaacagaccccgggacaatgttgcagggcatactgggacctgcgtctccctttattacttcataacttgccttccccaacaattcaattcaatctcccaggagcaaaactaaatgttattgtaggaaaaacaatggaacccaaaacacaacagaatgacaactcagcaacataaactgtaaaacataaggtcttgaccgatttgctctttgatgttggaaatagacaattcatttggcaaagtccagatgaaactgaaggtcagataatgctactctcccttcagactcttcacctcttcctatgcacccattttaaccacacactgccccgtaagcaagaattctgtctgtttcttcacgtgcaaaacaggtatatatacaggtagaggttttaaagttccttccagctacagaagtctgtttccaagactttacagcgactttacctgactagttagtggtaagtcaggagcccaggctggcttggattttctacctagactctctctgaagaaggggtgggaaggaaagatctttctccttgggtcttgttcccaaagaaatgcagtactttttgtgttctcatgagaatttatttatcttctcagtcactcctcttcttaacaataacaacagccaacacataccatcatgttttacttaagattcatttgtttaattcttatatcaaccctatgaggtagtgactactatcattcttcttttacagttgggaaaactgagaaacagagagcttaagtgactttttcaaggccacacagctggtagcagagccaggattcaaacctaggaagttataattctcatttagctgctaggctgcacaccacatgtgggcacgttgtgtttgatggcaaggagtgatcatcaactccctggagttagctggccttgcgctggggagctggttcatgcaggaagaggggtaaagaatggaaagaacgaacaaaaattaagtcagttgtcaagctgctgccatattaagagtaaagagaacaacagggctgctgggaacattgtcagaccccaaattgttcttgacattcattgggctgagtcccttgcttctgcagctctaaatggaaatgacatggaactaaaatatatatatttttaaatctccaaactcttcacacatccgttggcatgataatattttgattagttacatttatgctccaattacactcacagaatgttcaactgtgtcttatatatagcatgtttgccatgctccatagaaaatactggattattacctcgtatatttgcaatgggaaaagacacaaatggaaagggggagaaaagacagcaaaaagaagagatgactaatcctgttaaaatggtgccgtcttgccttcacattactaaattgggtcatcgctattattgccaagctttaaaatgccagggctgggagagacatcaagtatttaagtctacccttcccctcacctgaggcttttatctcccttaccacgactgggtctgaaagcaacctcctcacatacccagtgagtggcaaggtcgacagtggggaatgtttgtgtctttgtgctctttttttcttcctggggagagcatccatctatttctcaaagagctccataaccctgtccaagataaatatataaataaataataaacagaagctaagagttactctgagctttgcaaaatgcctgccctggggatactaggagtgacttattaccgtgtgtgctgcccagatgccatcacattattttgctcttcactagtagcccatgctgcaagcactgaaggtgcgtgtatcacaccatctaacgcggataccaggtggaaggggtcccatggaggtctgctaaagatcgcccccagttccacagcacccgcccctcaaatcctcaactactggagctggctttctcccctggcttctctctgccactgcatccctaactccactggtacctctatgcctcagtttccccaaggtggttccattcatgaaggctaacccctccaccagtctccttatgaaatccaccaaagccaagcatttcatcaagttaataaaatttgttctaaccacaagtattatttgtgcacctactatgtgtctgacactaggggaacagcagtcagcatggaagagtttttatcctcttagagattacagacttctaaagagccattacaggaatgtggaaagttctatgacaaggcaagaacccagacttgatttgggggaagaagtataaaaagaaaacacctacaactttctggagcaaataaactgtaggctgaggtctaagttatgtaggtgtcagacaggggaaaagggaacagaaagaatgttccatgcagatgaaatagcctgtttcaaagccaaggaacaagacagtttctgccttgtgggggggctaaaagaaattgcagacagaatgcaagtgccttagagaccacctctctaacctctcacccttcagtttatatataaggaacttgatattcagagaggtgccctgatttgcccagagtctcacagccaaagggtgatagagccagcattcaaattgaggtgtatctgactccaagatcagtatcatttccctctgaaacagcggttcccaaatcgcagtgtgcatcagaattacttggaaagcttgttaaactgtgccgggtcccatacccagtagatttggggtggagtccaagaatctgcacttctaacaagtttctaagtgatgctgatgggactgatctgtggaccacactttgataaccactggactagctggtctctaattccccagccctgatagggcaggggcccaaaaatttgggcgaatcaacaaatggtgctaccacaggggtgctaacttgttaaactacctcctaccctgggccacgccctgcctacctctctcaggggcaggaggtcttggccactggccattaaacatgaagactctccctctgcccaactccaacagcctgagccattttctttccatcactgctaattaccaagaatataattagacacttattgactcccccaaatgtactaaggtctgcaaagaaaatagcacaataattattcctcctattttaccatcctctaaggagctacaagactttgacagctgttatccaattaatcctgacagcttatttttttaacgtaaaggtatttttttcttctaagattggaaaagctatttccttttttgaagtaagaatgagggcaaagagaggccagataacttgtccaacattacaagggtcatttcttgcctcccttctcctgcatgatcagtggaacaatgaaagataagggcatggactgttgactcaaactgccagatcaaatcccagctctgtcagctctcagctgtgtggccttgggcaacatacttaacatctataagcctcagtttctccatctgaaaaatggaggtgatgatggcaaaagttgtacatgcttcctaggcttgttacgtgaattaaatgtgtctgtatgttacacgcttagaatagtacctgacatgttgagaattagctaccatgatcatcagtggcagaagcggcatttctgagccctcatgcagatcttcgactacaacagtgagataactgaccctggaattcagcagggtaaggcaggtcccagtctcactgtccacagaggcagcgggcctagaaggcaccaggaagccatggaacatctccatgctgttgacaacaaggaacatctctctttgccagtggttctccaagtgtggccctgagccagatacatcaacgtcatggggaacccctcaaaaagtaaatccttgggccccaagctagactgactagaccagaaactctgagtggggtcagtcatctgggtcccccaggggatgctgacacccactcaagtttgagaaccactttttttccccagacaggttgcctgagcctcagcctatcagggtagaccacaataacctggcgatcatgccagttcctgtccactggatgttccctgcttttcccaagaagggacaggacaggttaccagattccacagcactgtagcatgggtccagagcctgtgcttttttaattatttattatttatttattttttgagaaggagtctcgctctgttgcccaggatggagtacagtggcatgatctcggctcactgcaaccttcgcctccagggttcaaacaattctcctgcctaagcctcccaagtaactggaattacaggcatgtgccatcatacccagctaatttttgtatttttagtagagacagcatttcaccatgttggccaggttggtctagaactcctgacctcaggcaatctgcccgcctcagcctcccaaagtgctgggattacaggcgtgaaccaccgcgcctggcctagcctgtgttcttgaccactgccctacattgtctctcttgaaactgccttcccacatgcacttctggaaaggactccaatccctaccccagtgagggccagctgggagtgcggtccttattgctgaggcaccatagttgccctggtgtgccaggaggtaggaaatggacaccaggagataatgacgactcacagaaatgacacagaaggcatctcccagaccctctgagtccttgaagccactaggatatgtccatcaactgaggcctcttgaaatcaagcacctgaacccctagattttctacggttttcatcctgaacccactcttcccctttcatccctcactcctccacctgcccccatcctctcagctgcaaagctagtttcctatttcagtcttacctttctcccattccccatccctagccctcctcccctgtcccactttttgtaccaaaatgcactttggactatcccccttgaccacaatgcagaccccaaccatctcttgggttccccttcctcttgctgctgtccacctcatccagtcaagtggtctctgcactctagaccaccaaagatactgtctctgtcagttccaccaagccctgcagtagaacctagacccagatggaaagagaacaagacaaaatcaggaagtagaggcagctctagtgctgacaactgccagggaagcaatgagctgaatgggttccctgaagccgccataacaaagaccacaaagtgagtggctgaaacaacagaagttgatcgtctcacagtcctggaggctgaaagcctgagatcaaggtgtcagcagggttggttctttctgaggccagtgagggagaatctgttccatgccctcccctagcttctggtggtttgctggcgatctttggcattccttgggttgtagatgtacccctcctccttatctctgccttcagattcacatggtttatccctgtgtgcatctgtctccatttgttaaggaaaaaacaccagtcacatcgaattcagagcacaccctactccaatatggctttatcttagctaattacatctagaatgactacttccaaataaggtcacattttgagatactgggagtgaagacatcaacatatgaatttggtgggaacagaatttaactcctaataagctttctagagccctactgtgttcatcacccaaagagttatctaaggcagtcctaggagggtttctgtagagatgacggaatatcatatttagagggagcatgggaaaatattctttttaactataaaacaatacatggggaaacaaacagaaaagtagaaaggaggagtgacaagtcctcacggaaagacagccacacatgtcttgaggtatttccttacagtctcatttgctggcataggttagtgctttccaaggagttatggcatttacttgggtttgtgactgtggttagtaaatttttcctgaagaagaggcttaatgggggataacagtttatagtggccttgtctgcattgaagctatatccaaattccaatgggaaaggagcaagcaccccttcaacagggctgcctgttcactgatgttgcaggttagtttcacaacaaatgtatattgagtgcctgctccacaccaggcactgttgtaggccccgggagtacagctgtgaacaaaacagtgaagatacttcatcagagacagtttgcggagatgaaaatgctcctcaagagctttgaaacaagttgaatagggctcctgtagacgccccccagggaatgcatgccagtttttcatgccatgattaccccttttaaaattcttgatttttagctcatctttcgaggctctgaagtacctttgcaacgattatttccccaggaaggatctatgaatggtgtattttctgagcctgtgcatttctgatgctgcatcacttttatagtatagatcacgtgcccatatgcaatttattgagtctcgacctattcccttctaaatactgtggaccggtgcttctcatcttttgccaaaagaacaaggatagcatgtttgtccctcatctgtcaaatcctctttttgaatatacacttggaaggcaggtagataggtatatctcacaccctaattcctaatatagggaagatttttttttttttttttaatcttacagccttgttcttaggagcacagcacagcaatgaagatgcaggctctggagccacacccctgcagtcaaaacccagccctctcatttcctaaagtgcatccctgggcaaattacatagatttttctctgtctttgtttcccaatctgtaaaatggagataataaaaagacaaacctggccaggtgcggtagctcacccctgtaatcccagcactttgggagtccaaggcaggtggatcatgaggtcaggagatcaagactatcctggccaacgtggtgaaaccccatctctactaaaaatataaaaattagctgtgcatggtggcgcacgattgtaatctcagctgcctgggaggctgaggcaggagaatcacttgaacccaggaggcggaggttgcagtgagccaagattgagccactgtactccagcctggcgacagagcaagactctgtctcaaaaaaaaaaaaaaaaaaaacccaaaccttacaggatcctcagttaagcttgaggattaactgaattaatacaggtaatagtagaaaggctgacaaactttttccataaagggccagagagtcaatattttaggcttagcaggccgaaaagtttttgttaacaactactcaattctactgttggggtgtgacaactgcagagacaatggataaatggatggatggatgaggctgtgttccaacaaagctttacaaaaacaggcagctgaggggtccatgcataggctgtagtttgctgacctctgacttagtaccaggcaaatactaaattctcaatcaatgttagccattattattaactatgatgagattcagaaggacaggggttggatcctctctgtcactcactgcctggttctctgacactatgaacagatggtgtacatgaaaaaccaccatccacagaagtattccttccagcccacctatagcactgcacttgtgaaaacgacaccttccaagatgcaatgcgctgccacaatgtctctgataatttttgccctgttgtatttgtgagtttcagccttgagcaggatgtgaaaagaaaggtgggaggaaaacaatagaacattaagtgcttcagaaagtcctcttcatgctgtaaagggatgtctgtcccatttagattggtacagacctttatcttctactagagggacagagaaggatggatgcacatcttccttttgttagtggcacggcataggtggctgagctctgtttttccgaccattcctattagccttggagttgagggaaaactctcccagattctgtcaaaagttcacctgtctcactttccagtgttgctatgatctgatgcttttgtgctgttctcatgggaatttttaagggaaactgcaagaggttgggattcccaaagtctcttaaggttatttccaccatggactctgtgtatggtggaaagagttcccgagccctgtgctctctgtggcactgtctcatttcaaacacataaatccaatgctttatctacttcttgggattttctggttattttttttaccacctacaccaagggttaagccatgccccacttttcccttgtcctgaccaaaattgatatactacgacccagggccaaaagcatagacaacaggtgtgggcgaaaattctctacttgtatagaaattatttgaagaaattcctgcttaatcgggcttcaatctcttccactcccttatatccattcatttgttcactcattcattcattcttttactaattatgtgcccgctaaacattcactgagcaagctttatgtacttggtaccaagcatgcagagacacagaataaatattttattcttgaagacatcttgctctaaatgggtatggtgcatctggtgatgccctgcccaggtctctctttaaagaaacttgtctccccagctgccagggcacttaggcacacagtctttagcagtagcccctccagggactgtgtcagctgcagagtgtactcccaaggtctgcctttctgagagctgcacatccagcaactgatggaggctagggttgaaagcctcagccagtcctgcccgttgcagactcggacgggccattttagctccccgtggagttggctaatgatgtcctgaggtctgcgtcaactcacttcctcccgcagcctgctgctcatcccttccttcccttccatagctgctagtccagggggcaatttccaataaacatcctaataaacactcatctccatctctgattctgaatcccagagaatccaacagtgacaatgggtctggggaagcaagttgctctgtctgggcatttttgaggggacatttgcgttggttctttaaaaacacacaggaatattccaggtagagaaggaacgatcatttcaggcagagggaacaggacgagaaagtccaggactatgacagcacagaggcatttggtgtcctggcctgactggtgagaggggatgtggaggcccaggaagaggaccaaagcaagtccttgatagtcaagctaaggagctgaccatgcaccaggagcccatgggtgtttatcagaagaaatgggacgtaataaaatattcatttcaccgagatgagttgtctttgtcaaggttccctctaaaaaacaggagctaatctggatgcgtcaagtagatagttttcatacaaagactcagacctttatccactactgggaggctggggaatgtcagtggggaaggtagtcctcaggaaatccctaagtataaggaccacaggaaaagtcgagtctgtagttttggctacttgggtgactgttgggtagatgctcaacaaacatgggcacacctcaaagtctgctgactgcccgcacccctgcaggggctctcagctgccggagggaggctcactgttctctggttctttgacctttcagatctctcatcagtgggatctcactgggaccctgcaggtgaaggaatctgggaaacgtggcttctgggcttcatgaccctttggtataggagagcacttagggagctgtgcatcaacaagcaatatgtgacttgggtcacagaggatgtggctgcagcaaggagattagttagggggttgaatcaaaagcccaagcacgagatgttggtgccatcatcacgtcactgcccaattctccttcctctccaaggcctccaaacctgctctgaggcttggcagggaaagtgagccagactgaggacaggagaaagggctgccggaaacaaacgcaagggacacacagccctgtcccgccaggtgtgactccaggtgccaggtgtgactcctgccaggtgtggctcccggatcaggatggctgctcttcactcactggcatttgggtgagaagggcactgagatggagcagggataaccaatccagaagacagaaaccctggcttggagccctttccagccatttcctaattggatgtatgacttttctagggctgccggaacaaattaccacaaacttggcggtttaggataacagagattcattctctcacagttctggaggccagaagtctgaaatcaaggtgggtcggcagggccgtgggggaagtctctaggggataattcctctttgcctcttgcagcccgtggtggtgtctggtgctccctgaggtcgtctctgcctctgttttcacatggtcttctcctcatgcctcgcatttcaaatctccctctgctttgctctcacttttgcagctatcattggatttaggatccaccctaaatccaggataacctcctcttgagatccttaactcaactgcatctgcaaagatcttttttctacataaggtcacagtcacaagttccaggaattacaccttgcacaatgctggggggccgtgattcaaccccactacaactacactgggtgactctgtaaatgtcacttaccctcatgcttagacttaaatttgtactaataaaatagagtaggggccgggcgcggtggctcaggcctgtaatcctagcactttgggaggccgaagtgggtggattgcctgagctctggagttcaaaaccagcctgggcaacacagtgaaaccccatcgctactaaaatacaaaaaaattaactgggcgtggcagcgtgcacctgtagtcccagctactctggaggctgaggcagaagaatcgcttgaacccaggaggcagaggttgcagtgagcagagatcatgccactgcactccacactccagtctggctgacagagtgaggctccatcaaccaaaaaataaaataaaataaaataagagagtgcgaggagaagatgacctacctggatgttggggtgattacataagacagaacaagtcaaagccccggcccacttatacacacaagggaagcctgaattaaatatctattgaatctgaatcagctctcaccccacggctatgggactggtctggtcaggacctggagactcctagttcatgcagcgtaacacaaagctcagtttgcatttaggattgcactagattgccttaaaagcagtacgcagttctgaagcttaccattgtataaaataatacctggtgtctatagtccttcatctgttcaagtacaggttggatggaaggatttccagattcctgtggatttaggattcctacaatactgtgggcatcagattcactgcaagtaactttcccagcaactgaaacactgttcccacccaaaaggggaaaatcagatcacttccacatggtggaaaaactagattacttccaccatagaagtctttcgacgctgcctctcccctttgcccgtccaacccgccccaggtcttaattcctgtccttctatttaggtttaaatcattgcacaatcactttctgactatataacttagaacaagcccctttgtacttcatttgttttccttttatgctctttaaattttaataaattaaaagtggcagaaaattgagaaagctacaaagaataaaattataaatacccataactctgccatctagcttcaaccactgtgaacatcttaacatatttgctttccctttttatttttaaagaagaaagattactttattgttattgggaaatgatacatattcattttgaggaattcaagaaatgcaaaatacaaagattgaagtttaaaaaaaatcttaagtttcactacccagaaataactgtcattaacatatggcaaacatcattttaaatatcttatgatatacacagagacaaaaggacagacggatggatggatgaggatgggcggatggacggaagaataggtggaaataaatactatgaaatgtgggataaaatatatgtcactttaagtttttttttaacactgtatttgtctttacttgtatgtagcagaagaaaaagaaattaaaacaaaattgaaagaaaactagcctttcaaatacttctttaccaagagatacttacccaaagatctctttaagaacacagattgtgaagaaagcattaagagcttgaagtaattatactatattttaactatttattttgatgttaagcttatctaatgactccatgctgtcaaatatggtattagaactatcacacttcccctcaacttctcctccctctctcaatttctcagttttaattgttggtggccgctgttgttacactgcccaggttttaaccttcataccctgatctataactgtaattgtctaagttgcttactgtgagtcctatatttatatggtttcattacttatcatcaatccttatgttatgaggtctgcattcatgaatcttttatttttgtttgcttttaattagttgtattttgtaattaagtatttttgtcaagatcttatggatattacactgcctgagtacatttactcttgacaaccatgacttgtgagctttatattctattatattcttgaactatgctttctttccctcaaatcttttagataaccattctttcatctttgacattgaatcctgctgtagagaagtctgaggacaacttgactttttttttctccttgtggaggatattcttgtgtctagaatactgggtaattctgtatttatcctaagttttaatagtttaactagggtatgtcttggtatctagcattctgtaccaaattttcctggaatacattgtctctttattattattttactacaatatgtaacataaaatttagcattttaattattttaagtgtacaattcggcagcattaattactctcacaatattttggaaccatcaccattatttatttctaaaactttttcatcaccccaaagagaaattttgtaaccattaagtaataactcttcattctctcctgccccagtctggtaacctctaatctactttctatctctatgaatttgcgtactctagatattacttataaatggaatcctgtagtccaaaaatgaacagtaacaatttttgggaggatatggagcaactggaatccttatacactgctggtgagtaggtaaaatggttcagctgcttgtaacacattctcttttgatttgcacattcagttatttattcgcttcaggattttttttttatccagaggcaaaatagcatcattctactcttttgaatcccaattctgttatatatactagacatgttgccttgggcaagttacgtaactatatcttaatttcctcatctataaattgggaatactaattgtattaacctcaaattgttgtgaaaaattaattcatgtaaacctctaaataaatgtttcatgcataatcaacgccaaaataatttgttattgttgttatactaagctatattttgttatatttgaataaataaaaggttatatgtttatacctttagagtatatatctttatgtctgtatctattgtagaataaattgctttctcctttagctttctttatgttcatattcagttgactactttcaccactctatttcatctgtattcatgtgcttgttaagacttccctctacactgttttttccagcaatgtatattctattttgtttttgtattgtttcactttttgctgtcattatttatgggctctttaatcctattaatgctattttgggcctcaatttgtttccttttgtccctattaatctcatgctgtccatttattccattatcctgaaccctcgctttattgacctggtgttcatatcaaattgttctatagaatgaagcaattgtgaataatttacctctgtttctgaaatgttatttttttaggttagaatccttgcccttgtatattacagccccctgcttgcttgcatcccttccttcctttttcttccttccttccttgccccctcccttcctctcttcctccctccctcttttccttctttccttccttgtttcttttctcttcctccctttatttttttcaaaattagtatttgtggtatgctttaatgttgccatgacatttcttaccttcttgttctgcctaggtgactccactcgggtggctccatcctgacatgccatttgctatgatatatagcatatgtgacacctgactttcttcctaccatatcagggaagtttgttttccccttgaagtttgaagattgagtattctttattctgtctgatttctgagcctaatgaaacagtgagaaggaaggagagagctcatctaaggtgatatttggtcattcttagattactgggcatctgtttcttctttttagattttgtgaatatcccatactcagattcactacatctacttgcaggtatttacttttctgatgagaaggtagtccctattttcatttatcttactcaatttagaagacagtcctgaagattttgctaccattagagaaagttaacctcctccataacccccttcctttgctttgtttatacccccatcccggccccaagccattttttcttattacttaatcatatgagagaaaggataatgatacccagtaaacttgattttctctagatgtttggtattgaggaatccccaaactatgttactaatatgctttttggtgggtggggaaaaagatttagaagcctagctatacctctccacatcactctgtgtctcctgtttctttccatacttaccagtgtttaaaacttgcatttgatagttttctttcccttgttttggtgttgtggtgaattttatttatttttcttttcttgtattcttgtttgctcaatctattacgtatttgtcaagaggaattctgtaattcagtttctgtcagtgatcttaacgcaaatatctgagtcacactttccataagtaagttgggataataattataatactgaactcatgaatttttttagaagtactaagttagataatatatgtaaattgctttgcaagctctcaaattttatatgaagaatatgttttcaataaatgtagttatgaatgaatgagctgttattactctgcagtaatgaacttagttatctaatttataggattataaaatgttagcacttaaatcagtcctaggaatcacgtagcacattccatttattttataaaggaagcaaatgtcatgactgccatctttagtgccatgtttcatcaggaggtgggtgacacaagaattctgtggttataattgatggcaagcatgtcattcataagaattctccttgcaaataaacttcatgtgttagaagaaatatttttattcacttctcagaaggaaggttttttcaatcagaaggcccctattttgctgaacaccaacattagtttaaacacgcaagcttgtgggaagaacccagaagcaaaacctaattgccttccataacagaggggaaaaaagtacaacagaagagagaaaagagatagaacaagctagaccaaatgctgagtaagaaaaatgaagagttaagtaaaagcaatgggggtacaggtgagaatgaacattgaaaaaaagatggtctgatattaattttcagttgtttcctctgaaaggtatactttctccatctcacacaaggaatatttattaaagtttatactattcactgatgtttttgtagtaggtttttgaaaggcttagtcctgaattcatttagatcttagtaaagaccaagcagacatagcacgttcatttgcagaagctaaagagtatgggatctactgaattatttatgttggtcaattgtgtcctcttatgttcaaacacagcactggggtaggggggatagagtgtggtagagggctgagctgaaggagcttagcgtttgtcagatgactgactgaagagatgagtttaaagctaaagggattgccaacaccaaggatggaggcaaagctcaaaccatggtgaaaatcagaggttctgatacatggcaaaggaaaccagtagcaaagtaagtttacaacatttgcttcagcacaacaaggaaacattttttctgccaggtcaaacttagaagttgtcatctgcttcctaacgcaccttaggaggttcatccaagcctgatattaagataaaattaaaaaggtacaaaaataaatattttcagtcaaaaaaagcaaaatgatcactgatatttgtcttctagggcctctctgaaatgatcataagtggatttttaaaagtgtttaggctcacaaaaacaatcagggcaagagagaggctgagttgacagggcttctcatcaaccactttggatcctggggagaaatgtcaccataacttcaaatttttaagagtgatctttagtcaaaaattgtatacccagcaaaactatcaaataaattagacccagacattttgagccacacaagactacttactctttcttgggaaattatatgagaatgtagtcctgtttgaacagaaaactttttttttctctttttttcatttcattttaatatcagggttatgaacatctacaaaaatgagtctggaggaaactttcaggctgggagctggcacacacacaaaagtcttctttcttgggctgaagccagtaatactaactgtgaaaagccacctcatctcagacgacagccatgattaatattcagtgaagattggaacagtaggacaggtggctctggaagtgagtaagatctctcatgaaataagagaagttgatagctcagatgctatgataaaagtaagtagtggggtgtaagtaaaagagagaatcccttcaaccttaaaggtaggagcattctcctttgagaggtagagaagatatgctcgagtccagcagaaaaggaaatataatcctagcacacggtttggttttgcaatgaaacaatttacacagtaagaataatggaagagctatgtatccactttcaacttttagaatcattaaactgactgatatggtttggctctgtatccccacccaaatctcatcttgaattgcaatccctacatgtagaaggagggacctgtaatccccacatgtcgaggaagggaggtgactggatcagagggaggtttcccccatgctgttctcatgatagtgagtgaattctcatgagatgtgatggttttaaaagtggcagttttttcttgcacagtcacactccctcatgctgccctggtaagaaggtgcctgcttccccctcgccttctgccatgattgtaagtttcctgaggcctccaagccatgcttcctgttaagcctgtggaacttgagtcaattaaacctctttcctttgtaactacctagcctcagggaagttctttacagcagtgtgaaaatgagctaatacactaaccaatcatgaaaggcaagaatcgttatggagaaaagcctaaaaattaccaaccttggccatgaaagcgtaaaaacaaggatgacaatgtcaaagacagaggtgattgggagaaggggagatcaacaatgtcttcctcaccttacccagaagaccctgatggttcctagaacaagaagcagaggctgaagtaaactatagcatctgaatttgcaaagattaccagtggtagacataaaaagtaaacatttactataacagaagctagaaagtgatttaaaagggcaattcctcatttttcttagcagaaagccagtagacaacatattaagttaataagtcaagaaaagcactttaagtaaactacttacacatgtagaaataaccaccaaagaagcaaaaatagaaatggatgacctgtgagggcgggatctgaaaggcagagaagccaaacagcatatggtggtttttaaacatgaacccttctgagttatttgacatcttaatcatgtttggttttttttttttttttggtttaacagatctttgaaaatgaaattaaacataaaactatagaacaatctcacctatcaatgtgtacacaataatactccctgaattaaattaaattgtgatatgaaaaagaaatatatgtatattcagggacagtatgcttattctaggaaaggaaagactgtttgaaaatataaaatgccttttgttatgatttcagcaggatgaggtgagaaaaacaatctctaatccattgttgcggaagaggcttttggtaaaatcttttcaatatttttggctttaagaaagtcagtattttatgctggagccagggaggctggagggcttgatcccaagatttgtccccacagcccaacacactggctgtggcagtctgaggccagcgtgcctcttcaggcctaaccctgacctatccttcctcattgggcagggcttccctgcagaaactccaataactccagctagaggctcaaggacagaattcggatccccctggacctgagccccggcgggaggggcagccacagtttctagggaccagcagacttagtctctcttcctggtagctctgaggaatccaggcagcccagacaagtaggtttccccccagcaaagcacaccctctccaccaagtgacaaagtgtttcattaaatgggtcctgatccccgtgccacccaactgggtgagcccctccaacaggggttgtcagataccctatacaggagcaaccctactggcatcagtctggtgcccctcgaggtcagaggccccagaagaacgagcaggcacccatctttgctgctccccagcctccttgagtgacatctccaggcacaggagcaaatcagatgactaggtcctaaagtgaacccccagcaaactgcagaagccctaatgaagagggacctgactattgaaataaaaataaagaagcagaaagtgacaacaacagcatcaacaacaacaacaacaaaaagacccaaaaaaaaaacccattcaagggtcagcagcctcaaaaacgaaaactaaacaaactcacgaatatgagaaagaatcaacaaaaaaatgctgaaaacacaaaaggccagagtgcctttcctcctccaaacgactgcaacgtcgttccatcacaagcataaaactggatggaggatcagacagatgaattgacagaagtaggcctcagaagatgggtaatgaaaaactaagttctaacccaatgcaaataagctaagaaccttgataaaaggttacaggaattgctaactagaataaccagtttagagaggaacataaattacctgatggagctgaggaacataaattacctgatggagctgaaaaacacagcacgagaactttgtgaagcatacacaagcatcaacagccaaactgaccacgcggaagaaaggatatcagagtttgaagatcaccttactaaaataagatatgcagacaagaatagaggagaaaagaaggaaaaggaatgaacaaagcctccaagaaatacagggcttcataaaaagactgaacctacaattgactgaagtagcagaaagagatggggagagtggaaacaagctggaaaacacacttcaggatattatccaggagaactgccccaacctagcaaggcaggccaacatacaaattcaggaaatgcaaagaaaccattaagatactctccaacaagatcaactccaagacacacagtcatcagattctccaaggtcaaaatgaaggaaaaactattaagggcagacagagagaaaggccaggtcacctacaaagggaagcccatcagactaacagtggacctctgggcagaaactccagaggccagaagagattgggggccaatattcaatattcttaaagaaaagaattttcaactcagaatttcatatgcagccaaactaatcgtgataagtaaaggagatataaaatccttcccagacaagcaaatgctgagggattttgttaccaccaggcctgccatccaagagatcctgaaagaagcactgaatgtggaatggaaaaacaggtactagccactgcaaaaacatactaaaatataaagaccaatgaaactatggaggaactgcatcaactagtgtgcaaaataaccaaatagcatcatgatgacaggatcaaattcacatataacaatactaaccttaaatgtaaatgagctgaatgccccaattaaaagacacagactggcaaaatggataaggagtcaagaggcattggtgtgctgtattcaggagacccaacttacatgcaaagacatacatgggctcaaaataatgagacggaggaaaatctaggcaaatggaaagcaaaataaaaataaaaataaaaaaaaataaaaaagcaggggttgcaatcctaatctctgataaaaaagactttaaacaaagatcaaaaaagacaaagaaaggcattacataatggtaaagggaacaattcaacaagaagagctaactattctaaatatatatgcacccaatacaggagcacccagattcataagacaatcttagagacctacaaagagactcagattcccacacaataatattgggagactttaatacctcactctcaatattagacagatcaatgagacagaaaattaacaaggatattcaggagttgaactcagctctggatcaagtggacctagtagacgtctatagaattctctacaccaaaatcaacagaatatgcattcttctcagtgccacatggcacttatgctaaatcaaccaaataattggaagtaaaacactccctaggaaatgcaaaagaactaaaatgataacaaacagtctctcagaccacagggcaatcaaattagaactcaggattaagaaactcactgaaaaccacacaattacatggaaattgaacaacctgctcctgaatgactcctgggtaaataatgaaattaaggcagaaatcaagaagttctttgaaaccaatgagaacaaggagacagcatgccagaatctctgggacacagctaaagcagtgttaagagggaaatttatagcactaaatgcccacatcagaatgctaggaagatatcaaattgatatcctaacatcacaattaaaatacctagagaggcaagagcaaactaatccaaaagctagcagaagacaacaaataactaagatcagagaagaattgaaggagatagagacataaaaaaatctccaaataatcaacaatgcagaagatggtttttcgaaaaaattaacaaaatatatcactagttagactaataaagaagaggagaaagaagaatcaaataaacacaataaaaaatgataaaggggatattaccactgatcccacagaaatacaaactgccatcagagaatactataaaaacctcacgtaaataaactagaaaatctagaagaaattgataaattcctggacgcatacactcaaccaagactaaaccaggaaaaagtcaaaaccctgaatggaccaataacaagttctgaaattgaggcagtaattaatgggctaccaaccaaaaaaggctcaggagtagacagattcacagctgaactctacctgaaatgcaaacaggagctggtaccattccttctgaaactattccaaacaattgaaaaggagggactcctccctaactcattttatgaagccaacatcatcctgataccaaaaccaggaagacacaacaaaaaaggaaaacttcaggccaatatccctgataaacatcaatgtgaaaatcctcagtaaaatactgacaaaccaaatccagcagcacatcaaaaaacatatccaccatgatcaagttggcttcatccctgagatgcaaggctggttcaacatacacaaatcaataaatgtaatccatcacataaacagaaccaaagacaaaaaccacatgattatctcaataggtacagaaaaggcctttgataaaattcaacatcccttcttgttaaaaactctcaataaccttggtagtgatggaacatatctcaaaatgataagagctatttatgacaaacccacagccaatatcttattgaacgggcaaaagctggaagcattccctttgaaaactggtacagacaaggatgcctcctctcaccactcctattcaacacagtattggaagttctggccagggttaccaggcaagaggaagaaataaagggtattaaaataggaagacaggaagtcaagttgtctctgtttgcagacaacatgattttatgtatagaaaaccccaccatctcagccacaaaactccttgaactgataagcaacttcagcaaagtctcgggatacaaaagcaatgtgcaaatatcacaagcattcctttacactgacaataggcaagcagagagccaaatcatgaatgaactcccattcacaattgctacaaagataataaaacacctaggaatacagctaacaagggatgtgaaagatctcttcaaggagaactacaaaccacttctcaatgaaataagaggacacaaacaaatggaaaaacattccatcctcatggataggaagaatcaatactgtgaaaatggccataatgcccaaagtaatttacagattcaacactgctcccatcaaactaccattgacattactcacagaattagaaaaaatagttttaaatttcatatggaatcaaagaagaccccaagacaatcctaagcaaacaaaacaaagctggaggcatcaaactacttgactttaaactatactacaaggatacagcaaccaaaacagcatggtacctgtaccaaaacagatatacagaccaatggaacagaatagagacctcagaaataacaccacacatctacaaccatctgatcttcaacaaacctgacaaaaacaagcaatggggaaaggacatcctattaagtaaatggtgctgggataactgcctagccaaatgcaaaaacagaaagtggaccacttccttataccttatagaaaaattatctcaagatagattaaagacttaaatgtaaaacccaaaaccataaaaatctcagaagaaaacctaggcaataccattcaggacataggcatgggcaaagacttcatgacaaaaatgccaaaagcaattgcaacaaaggccaaaattgaccaatgagatctaactaaactaaagagctcctgcacagcaaaagaaactagcatcagagtgaacaggcaacctacagaatgggagaaaatttttgcaatctacccatctgacaaaaatctaatatccacaagttacaaggaacttaaacatatttacaagaaaaaaacaacccatcaaaaagtggcaaaggatatgaacagacacttctcaaacgaagacatttacgcagccaacaaacatgaaaaaaagctcaacatcactgatcatcaaagaaatgcaaatcaaaaccataatgagataccatctcatgccagtcagaatggtgattattaaaaagtcagaaaacaatagatgctagtgagactgtggagaaatgtaaatgattttacactgttggtaggaatgtaacaaccattgttgaaaacagtatggcaattcctcaaggatctagagccagaaataccatttgacccagcaatcccattactgggtatatacccagaggaacgcaaatcattctactataaagacacatgcacatgtatgtttagtgcagcactatttacaatagcaaagacatggagccaacccaaatccccatcaatgatagaccggataaagaaaatgtggtaaatatataccatggaatactatgcagccataaaaaggaatgagatcatgtgctttgcagggacatggatgaagctggaagccagcatcctcagcaaactaacagaggaacagaaaaccaaacaccgcatgttctcacttataagtgggagttgaacactgagaatacatggacacacagaggggaataacacacaccagggcctgttgaggggtggcagggtgaggggagggaacttagaggatgggtcaataggcacagcaaaccaccatggcacacatatactcatgtaacaaacctgcatattgtgcacatgtatcccatttcttcctttttttagaataaacaaaatgtaaaaatgaaattaaaaaaaaagtttattactcacatcctcctcaaaaaaagtcagtattttagatgtagaagaatactctattagaataacagcgcccatctgaagccaaagacaacatcatatataagagtcaaacactgaagccacttctattaaattcaggaatgaaacaaggttatacttacattattcaatattgatttgcaaactctaagcaataaaattaaaagggaagaaagagaaggaagaagttagaaagaaagaaattttttataataatagaaaagcaagagataaaattaccattattttcctgatgatatgattgaatacctaaaaaaaacacaagcatcaactcaaaaacttgcagtactgattaaaaaaaaaagttcagtaagatgagtggttaaaaaacaaatagataaaacacaacagctttcttatatagcatcaataaccacttggaagctctgacaagaaataaattaaatcccatggtagcaaataactaggaatcaacttaaacagagatatgagaggtccagatgaagaaacccacaaaactttactgagggaaataaaagaatccttgaaaatgtgaagatacaggtaacgattctgagtctgaagactcaataaagtcaagatggaaattatcacaaaaataatttgagcaatattttcaattcgaataaaacccaagaggagttttctggaacttggcaaaataattctaaagatcatttgaaaggagacacaaagagtctctctctcttttgttttgttttgttttttttcataaagtgtaactagaagagaatgtcctattaagaattaaatacctagtaaagccacaataattaaaagagtgttgtactgacataaaaacagacaggctaatgacaagaagaagaaagaacatcaatagaccatatatgagaatgcatttgatgagaacagccccacttttaatgaggggagaaaggctaaactattaattcatggttctggaatactgattaactatagtatttgaaaaaacaatggacttagattctattcacatggtgaatgaaaaattaattaactagctaattaattaattcataactataaagagttgaacatgaagaagaataaaaaatcaaatcattaaaatctagaaaaatacaagagaatatttatctcatttgggaatagggaaataacttttgaagttcaaaagcaaaagaagatataaagttttctataatggacaacataaaaattaaaactattcatcagagacatcaaaaattctgaaagcaaataaaaactgaaaaaatgtaagtaccaggtaaagaataatatcctttctccataaaaaagcttataatatacatatatggaaaatataaaaatgtttatgaacagataattcacagaggacaaaacataaaatatatttggctatataataaggaaaaaccaggtcaataggatgcagtgtcatttcttatcaaataagctaagattttgaaacagtgataattcctaatattagcaaatagtaaatgagtaattacctgatgcttggactaccagttgtctcaatgattttctgaggagcaatttgataatacgtatcacattatcaagttgtgaatcatataacacaatatgaatcacatatcacattaaaatgcccacaccaccaattgaataatcccaatctagaagacataatgagaaatcataacaaatatttaggtgaaaaatctcacgacagtattactgtactgaaagactgaaagcaatttcaacacccaagtgtaaggacgtaattaaataagtaataatacggcaatatgatataatttaattgatgtaaaagtccaagcattcaagaatatttaatgacataaaaatgttaatgatagaattctaaatgagaaaaaaaagccatgtaacaggacttatagcttgcacctaattttgtaaaatatatatatacatttagcaaacgtatgagcatatgcatacacatgtgtgtatataaatagtaatctacatatagaaaaacgacttgagaagagttcaactttcaattaaacatcacaaagtaaacacatgcattaacctccattttcttccaaatgcaccaaaatgacagtgtaggaattaaaaagacataaacaaacccatatataccaagagaatggggaaaaaagtgacagcaattgagagatgcaaacattttggaggaagaaaaatggttggacaaatggtaactgattaagcagagcagtgaaaactgaagcccgtatgtccatcaggtaagaaagcagaatacaaccaatttaacccatggagtaccaaaaggacccagaaatggggcaaccagattattctaacggcaggaacacctagggctgaaaacaaaattacctgaaaatctgtataagaaatgttaagacaaccacccacaaaaccccctttgacatctgccatgcgaccagatgccagtcccttctcaatacctacataagactgaaaatgtagttactacaacatatcaagcagagaggatatagcttcaaggattctgtggccagctgagagggggtaagtcaccaggcaaaaccacgggtgatccactgaaaccaacatactgagtgaagacagcatcccccaattagctctgagtacccacagccaggttacacatacttcccatgccttcatgagtgcagaaggcttatctttggaaaaatttaccagatggagaggaaaaggccttagccgtgaacattccaatgttcatccataaaaatccagtttactgtcttatttccatatagtcaaacctgtcagtgaacaaagcccctcccatgcaatacatagactcaaaattttagtgccaatctcttaaatatgaatggatagccaatgatgatgactatttgagttaaatctctaacatgaacagaagagaccaaaacaaacagggaggggaaaagtgcaggtagaaaacaaaagataagtgcttctcagccttttggctaagatcaaatgtagtatctcttcttatcagtttcatatgcagagcagtgacacgataaagcaaccacacaaacaagctggcatgataaccaactaacaacaaaatggcaagatcaaattcacacatatcagtattaactttgaatgtaaatgggctaaatgttccacttaaaaggcacagggtagcaagctggataaaaaagcaagaccaaatggtatgcaatcttcaagagacccatctcacatgcaatgaatggcacacaaaagctcaaaataaagggatgaggaaaatctaccaagcaaatagaaattagaaaaagcaggggttgcaaccctcatttcagacaacacagactttatccagccaaagatcaaaaaagacaaggaaggccattacataattgtaaaggattcaattcaaaaagaagacctaacctaaccctaaatatatacacacccaacacaggagcacctagattcatgaactaagttcttagagacctacaaggagatttcaagttccacacaataatagtgggagactccccactgagagtatcagacagatcattgaggtagaaaattaacaaaattatctaggactttaactcaacattggaccagatggatctgatagacctctacagaactctctaccccaaaacaacagaatatacattcttctcatcaccacatggcacatactttaaaagtgaacacaatatgacataaaacaatcctcagaaaatgcaaaagaaccacaatcattccaaacacactcttagatcacagtgcaataaaaatagaagtcaacactaaaaacattgctcaaaaccatgcaattttatgaaaattaaacaatatgcccctgaataagttttggataaaaaaaagaaattaaggcagacatcaagaagttgtttgaaactaatgagaacaaagatacaacataccagaatctctgggatacagctaaggcagtgttaagagggaaatctatagcactataaatgcccttatgtggtttggctgtgtccccacccaaatctcattgtgaattgtagttctcataatccccacatgtcatgggagggacctggtgggaggtaattaaatcatggtggtggttacctatatgctgccattctcataatagtgtgtgagttctcaagagatctgatggttttaaaggagatggccccctttttcttggcacttctccttaatgtcaccatttgaaaaaggacatgtttgcttccccttccgccattattataagtttcctgaggcatccccagccatgctgaacggtgagtcaactaaacatctttgctttataaattacccagtctcttgtatgtccttatcagcagtgtgagaatggactaatacagtaatttgataccagtagagtagggtgctgctataaggatgtccaaaaatgtggaagctactttggaactgggtaacaggcagagattggaacagtttggaggatttagaagatgacaggaaaatctgggaaagtgcagaatatcctagagacttgttgaattactttgaccagaatgctgatagtcatgtgaacaatgaagtccaggttgagatggtctcagatggagatgaggaacttgttgggaagtggagcaaacgtgacttttgttatgctttagcaaagagactggtggcattttgcccctgccctagagatgtatggaactttgaaactgagagagataatttagggtatccggtagaaaaaatttctaagtggcaaagcattcaagaggaagcagaaaataaaaatttctaaaatttgcagctgacaatgcaatagaaaagaaaaacccattttctggggagaaatccaagcctgctgcagaaatttgcattagtaatgaggagccgaatgttaatcaccaagacaagggggaaaatgtctccagggcacgtgaaagaccttcacagtagcccctcccccagaggactaggaagaaaaatggctttgtgggccaggcccagggacccctgctgtgggcagcctaggaacttcgtgtcctgaatcccagccactccagtcatggctaaaatgggccaaggtacagctcaggctatggcttaagagggtgcaagtcctgtgccctagcagcttccatgtggtgttgagcctgagggtgcacataagttaagaattgaggcttggaaacctccacctagatttcaaaggatatatggaaacacctggatgtccaggtagaagtttgctgcagtagtggagccctcatagagaacctctgctaggacagtgcagaagggaaatgtggggttagagtctccatacagaatctccactggggcactacctagtggagctgtgagaagagggccacagtcctccagaccccagaatgttagatccactgacagcttgcaccatgtgcctggaaaaatcacaggcactccacacaagcccatgaaagcatccagaaggggggctataccatgcaaagccatagggaccaagctgcccaaggccatgggcacccatctcttccatcagcatgacctgtatgtgagacacggagtcaaagtagattattttggagctttaagatttaattactgcctgattctagatttgcatggggcctgtagcccctttgttttggccaacatctcccatttggaatgggtgtatttacccaatgcccgtacctccactgtatctgggaagtaactaatttacttttgattttacaggctcataggtggaagggactcacctcatctcagacaaaactctggacttggactattgagttaatgctggaatgagataagactttgggggactgttagaaggccatgattggccaggcgcagtggctcacaccagcaatcccagcactttgagaggccaaggtgggtggatcacctgaggtcaggagttcaaaaccagcctgaccaacatggtgaaaccccatctctactaaaaatacaaaattagctggttgtgggtggcacatgcctgtaatcagagctgaactgaaggaaatggaggcatgaaaaacattcaaaagatcaatgaatccaggagttggttttttgaaaaagttaataaaatagactaataaataaacaagaagagagagtagatccaaataaatccaattagaaatgacagaggggatattaccattgactccacagaaataaaaattatccttagaaactaccatgaacacctctatgcccacaaactagaaaacctagaagagctgaacacatttgtggacatatacaccttccaaagactgaaccaggaagaagtttattcccgaacagaccaataatgagctctgaaattgaattggtaataaatagtctaccaatcaaaacaagcccaggaccagaaggattcacagctgaatactaccagatgtacaatgaagatctggtacccttcctaccgaaactattccaaaaaattgaggaggatagactcctccccaactcattccatgaggccaacatcatcctgatacaaaaacctggcagagacacaacaaaaaaagaaacttcaggccaatatccttgaagaacattaatgcaaaaattctcagcaaaatacttgcaaaccaaatccagcaaaacatcacaaactaatctaccatgatcaagttggcttcattgcaaggatgcaagtggttggttcaacatgtgcaaatcaataaacgtgattcatcacacaaacagaactaaagacaaaagccacatgattatctctatagatgcagacgaggctttcaataaaattcaatatcgcttcatgttaaaaactttcaatacactacgtattcaaagaacatatctcaaaatagtaagagccatctatgacaaacacacagccaacatcatatggaatggggaaaagctggaagcattcccattaaaaccagtacacaacagggatgctctctctcaccactcctattcaacatagcattggaagccctggccaaagcaataagccaagaggaagaaataaagggcatccaaatagtaagataggaagtcaaactccccctgtttgcatacaacatgattttatatctatataaatcaggatacaaaatcagtgtatgaaaatcactagcatttctatacaccaacaacagccaagctgagtgccaaatcagaagcacaataccattcacaattgccacaaaaagaataaaatacctaggaatacagctaaccagggaggtgaaagatctctacaatgagaattatgaaacactgctcgaataaatcagagatgaaacaaacaaatggaaaaacactccatgctcatgataggaagaattaaatcattaaaatggccacactgcccaaagcaacctacagaatctaccaaactaccagtgatgttcttcacagaactagaaaaatctattttaatattcatatggaaccaaaagggcctgaatagcgaaggcaattctaagcaaaaacaacaaagctggaggtatcatattagctgccttcaaaccatactacagggctacagtaaataaaacagcacggtataggtaccaaaacagatctatagaccaatgaaacgtaatagaaagcccagaagtaaggccccacacctacaaccatctgattttgacaaggctgataaaaacaagcaatggggaaaggactccctgttcaataaatggtactgggataactggctagccatatatagaagattgaaactggaccatttccttataccctatacaaaaatcaactcaagatgaattaaagacttaaatgtaaagccccaaactataaaaaccctagaagacaacctaggcatagggacattctgtacataggaacagcaaagatttcatgacaaagataccaaaagtgattgcaataaaagcaaaaatggagaaatgggatctaattaaacttaacagcttctgcacagcaaaataaactatcaacagagtaaacagacaacctacataatgcgagaaaatgttggcaaactatgcatctgacaacagtataatatccagcatctataaggaacttaaacacatttatgagagaaaaacaatcccattagaaagtgggcaaaggacatgaacagacacttcaaaagaagacatacatgcatccaacaagcacatgaagaaaaactcattatcactgatcattagagaaatgatgcaaataaaaaccacaatgagataccatctcacaccagtaagaatggctattattaaaagtcaaaaaaataacagatgctggcaaggttgcagagaaaagggaatgcttgcacaccgtcggtgagagtgtaaattagttcagccattttggaaaacaatgtggtgattcctcaaagagctaaaaagagaactatcattcgacccagcagtcccattactgggtatacacccaaaggaatataaatcattctaccataaagacacatgcacatgaatgttcatggcagcactattcacaatagcaaagacatgaaatcaacctaagtgccctagattggatgaagaaaatgtggtacatatacaccatggaatacaatgtagccataaaaatgaatgagatcatgtcttgcaggaatatggatggagctgtattctaagcaaactaatgcagaaacagaaaaccaaacaccacatgttctcacttataagtgggagctaaatgatgagaacacatggacacaaagaggggaacaacaggccctgtggcttacttgagggtggagagggagaggagggaggggatcagaaaaaattaactattgggtactgagcttaggacctgggtaacaaaataatcaaaccccacaacacgaatcttcctatataacaaacctgcacacatactcctgaaactaaaagctaaaaaaaaagacattttgaagagcattttttaatgtagagagaagagattttatccaagaaaaagatgctgtaaaaaaggatcattccaagaaccaagataactatcagatgttaaaactatacaagtataaataaaaattgcaatagatggcttagaagatgaagttgaggatattgtccagaatacagaaagaaaaaaaaaaaaagaagaagaagaaggaaaagcaaagaaaaaaaaacaagaaaattgagttttggcttatgtaatccaaaagccaactaataggatttgttaaaaaaaaaaaaaaaaaaaaggccaggcttggtgcctcacacatgtaatctcagtacttcgggagacagaggtgggaggattgtttgagccgaggagtttgagatcagcctgggcaataaaaaactgtgtctctacaaaaatattaaaaatgtagccatgtgtatgtagtcccagctactcaggaggctgaggtgggaggattgcttgaacacaggaggcagaggttgcagtcagccttggctgcaccactacactccaacctggacaacacagtgagaccccgtgccaaagaaagaaaaaaatatacgagagaaaactgagaatatgttatcaaagaaatgatttaagaataatttctagaactgatgataacaaagttgtaaattgaaatagtaaccaaatagtcatgcagtataacttaaaaaaaaacctaaagtcattatgaaacctcaaaacactgaaattaaaagaaaaaaaaaaaaacttggccaagcatgaaggttcatgcttgtaaatgccaacactatgagaggctgagacaagaggatcgcctgagcccaagaatttgagagcagcctggataacatagcgagaccccccatctctgaaaaaataaataaataaataaaataaataaagtggggcatgtgcctatagtctcagctactcagaaggctgaggcaggaggatggattgattgagcccaggagctcaaggatgcagtgagctatgatcacatctctgcactccacactagatgacaaagcgaggccccatctcatttaaggaaaaaaagactaaacatttacaagataaaagcagacatatgtctcatataaaagataaggaatcagaatggcactggacttctcaatattgtgaagggaaatcagaagacaacacagccaacatctgtgaaattctgagggattgacaaagttagaaagataattcagtggagaaaggacaggcttttcaacaaatagtaccagaacaattagacattcacacggagcggggggaagaaaggaggacccttgacctatacctctcactatatgtaaaagtttactcaaaatggaacataaacctaaatgtaaaatataaaatcaaaaacaggaaaaaatctttgtggccttggactaggctaaaaattgttaaataagacacgtcttagtgtcatcatccataaaagtaaaaaactgatgttagacttcatcgaaattaaaatattttgctctgtaaaagatactggtaagagaataaaaagacaagccataggctgggaaaaaaaaattaaaaatcccagatctgacaaaatgcttatatttggatatataaagaactctcaaagcttaataacagctcaattttttaaacgggcaaaaaatttgagcaaacacattactaaagaagatgtacagaaagcaaataagaatatgaaaagatgttcaacatcattactcattaggggaatccaaattaaaatcacaataagacacaactgcacattttgttaggggagctaaaatttaaaacaaaggggaaaaaggaaaaaaaatgctaactgcaggtgaggacgtggaacaaattgaatcctcacctattgctcatgagtatgcaaaatggtacaaccattttgaaaaacagattgacagttccttatgaagtcaaatatacatttatcgtacagctcagaaatcttagtatttactgaaaagaaataaaaacttgcattgagacaaaaaccggtatgctgacatttacagtggatttattcataatcaccaaaaatccgaaacaatgcaaatgttattcaggttgtgggatatgatggggtttctcttccaataatctgatcaatcttttattctttaattcaccgtaccccaccaccctttttccttttcccagatgttaatttctttggagggctgaatctcttctgtatgtactagagtaatggatatatgattctacacatttgtctaaacccataaaactatatatgtgtaccaaaaggagggaaagttactccatgtcaattaaaaaaataattctgagaaaaaattatagcctaccagaactttatatccagccaaactgtcaatcaaatgtaaggataacataaaatgattatctgctaggcaagatatttaaattattttttaccttcaaatataacttttctcaggaagctcctatataccatgctctaatagaatgagaaagtaaaccccacacaaaaaaagaactcatgggacctagaaaaaggagagaggtagcaggaaattccaaaacaagtgatgtgtctgggatctaaagagaacacaggcgatattaaactaggaagctggaggcttctaggcatgtaaattcaaggagagaaaacaatgaaaccaatagatattctgaagaattcagacacaaggagatgagattaacacttttgagggggagttggaaacactttaaggaaaacaaaataataaagcaaggcaggtattatctctatgactggggaaatgaggaaagagatgtaatcacaatatgaggggacttcaaaaggaaacttgggaaggtttgtaagtgaggacgtacaaggaagcttccagagaactcagtagatagatgatatccaaatgaaatagaaaaggactagcagaatgcctattttatttggaaatgtagtattaaacgcagggggaaacagcagcaaaaggagctgagtctggttgcctcaggggggcagagaatgagaggggaagggctactgctgttcactcaaggctttgtagcatacattacttttaaaactgttctagacaagaactttttttcatcaaaaaataagaaaaaagagaatgaatgataccaaattattaacaacgattatttttggttattactgggtttatagataattttcattttattctttacaatttcctatatttcctcaattttctatcttaataatcaacagggagcagaatgagagagatacagacacagagagttattaagagcagaaaatacttctcccttctctttaatcaggcaaagcataatagatatccatgtcttattatgaagacagtctgcatttagaaagtggggatttcagggcacagagtaaaggtttctacgagatagcacgttgggaaggagactagctcagtgcctggcatgaaggaggagtttggatgatgcaaacccctctgtttgcccctggtctaatttttccattggtaagatgagggcttggggtcagccacctctccctagctctagaatttgactccaagaatctgtatccacctcagatgcctgtaatcaaggaacctgccaggaacaggttaccctagcctcctgctgcccaggcctaggtgccaggagcccctcctctccccgcctcccacatagggccaggcatgttcccaccccagaccctccatccactgcaatacattcctgggagtttctttgttctctcaactgcccacctcccaagagacaagtccctgaaaccaggtataaatggctgctgagacttcagtgccaccacctggtctgtgtacttccagctgttgaataaatggcaacccttggacatttctatttcctgcaaagccctcccagattagaagctgatcctcatgactccttacaagcttggcaatgcggaaccaagcagagtatttgaatatgaaaagaaaggccaggtctgtcttgaaattcaagtctctgaactctaagacctggacgcaggccaacacctggtttctagagctgcaagtcagaaatggcaacaaaacacaaggggatgagccgagctttggaaccaaacagccctgggtttgaatccttaatcggccactgaattcctggcactggctgagacacgttttggcagatttctcatccataaaactggaacaacaaggcctactttctatctaaaataattagcaaataattagatgacaataagtcgtgtttactgggcacttgctatgtaacggcactgtgctaagtattttatgttcactgttcatttaatcctcagaaattaactattacgtgctaccatccccatatcaaaaataaggaaattgaggtacagaaagattaatgtgtccagtgtggctcagcaaggaagcaccagagttgggatttgaaccccagcagtctgaggccagacttaactgccgcaccgcatggtttccctaatgacaggcacttcttgagggtggacagtaaccagccctgtctccttcttcctgcccatattatagatgggagaacaaggcccaaagcagggacgtgggcgtcccacagtcatacaggagctgggggtgggccctggattcagctccagttctttcctcatgccagcagccactggagcccacagaggcccatccggaggacccttggatccccactgtgagtgggcccagcaccttgctgcctcagacaacccacaacccctgacactcacaggtcccctcaccttgttctgatgtgggcatggtcttctgctgggaaagcaggtatctggcctccgccacccctcagcacacttaccaggctatcatcctattgtgacacctgccctagtccacacctcttgagagctcatcttttcctccaccatggtgaccaagagcaccacccatgccctgccatcaaagtggagggaaggaccaatctcgggcccctggatccagccaggtctgctgcagtccagtctgctcaaacagctcatgcctaccaaggcaagtgatttgtttccttggtagcatttaacactcactacattaacagtatgtatttattcagggaccatatctgagttatccattgctgggtcctcagagcctattccagtgcttagcaacgaagagtccagttgctacacgcagaacagagtacagaggccaaagggaaacaaaagtccagtgaagagtgactgccaggaaagagatgatggtatcctggtggcaaaggagaaaatagaataatttcagcagacatttaggaggaaaacgggataggattggggactgagggaaagaggggtcaaaggtggctcttggtgttcacatttgcaccctagacagatatccatctgtcctttcggagaagtaagagggaaaaaggaacactttttccaaactgggtggcagctttggagtaccaggccctcacgtaaactgttttgtttgtttgtttgttgagacggagtttcgctcttgttgaacaggttggagtgcagtagcatgatcttggctcactgcaacttctgcctcctgggttcaagcgattctcctgcctcagcctcccgagtagctgggattacaagtgcccaccaccacgccctgctgtttttgtatttttagtagagacagggtttcgccatgttggccaggcttgtcttgaactcatgtgatccatccgcctcagcctcccaaagtgttgggattacagatgtgagtcactgcgctcagcccaaaaactgttgataaaatgaaaccacagataaaaagccagtctgttgcctaaggacaaaccatattatgagcccttgcccctctgggtacccttttaatcagaggctccagactgagctagccaggctggaacggggatctgggaagctggagatttctttcctgagatcaatgaaacactggacattggaggaccagttggggatccctgtattgtatgggcttctgaccaaagggtctacaccatgaccttgctctgtgatcccaccattatcttgggatatctgggctgtaaccaatgggccgctggacagaggagaggatcagaagggttgggatataaaaacaaatcacatcccttccctgattttaaacctgatatgggtgcccacttctctgtggagggtatctccctcatggcagggaatccaaattccaatacaaattggtgacaatctccctttcccattttttcaccaatgtctagtgtagtggccatcattggctgcccgcccagccgtgtcccccgctcatccttcctaggggaacctctggggagtccttgccccctttatataggaacctgtgcttgggcttgggatgatgagacttgaggctcctacacctttggtccccagggttggtccaggaaacaggactcatgtatctcctatcactgcttgccattggctactttaagtatctatctcccctgctggactatgacctcctagaggccagggctcaatatgatccctttctgggctctgcaggagggatctgttgggcagaagaagggcacaggtgctggaggtaggctcttcttgcatacctcgtagggacttccatctcacacggcctccctggttgcccatcagcctttcccaccttgggcaggattctgatccatggctttctttagtctcagagcaaaaagctctctcaatgtcactctgaagctcgggcacacttactctgtgttcactctgttttttttttttttttaaagcgcccttcacatgatctagctctcaggcaaattggaaaaaaagaaaagaaaaagccttaattaaaggaaagtaaggcacagttttcatgcataataagaaatggctttttgagccagcatgataaaatcctaccactctggggttgccctccagaaagtgaggattaagaaagccagggttttatttaagggcagttggagaaataatggcagcaaactcttagaaagcactcactgtgtgccagatattcctacatgctttacaaataagggaaagcagcgattcccttgaatcctgctggccaaaagctgagaagagtgaagagaaaaacatgggtggagaaaaatgaccaaggacatcccaaggtatggcatagtctggagggtcgtgaaagccaactggtgctgttactactgggaactggatcccttgtttaagatctttaataagtggtactctaggttgtggtttgcaaatttgtttttaaatcacctgaagagctttaaaaattctaatagctggggtttacccgctgagatcctaatgaagttagactggggtgtagccaggacaatgagactttttagacaaaccccaggagatcccaacgccagtggaggttgtataccctggcctaatgttgtttactagtatattggtttcctcagctgccgtaacacagtaccacaaactgggtgacttaatgcagaaatttattgtttcatactattgggggccagaaacctgaaagcatggtgttggcaggaccatgttccctctgaaacctatagggaagaatctttccttgcctcctcctaacttctcgtggtttgctggtaatccctggcattacttggtttacagctgcgtgacccccatctctgcctgcgttgtcacgtttttctccatgtgtgtctgtgtcatctcagggtcaccttcttgcaaagatactgattggggccaacctactccagtatgacttaactaattacatctgcaatgacggtatttccaaataaggtcacaatctgaggtattggtatttaaggcttcaacacatcttttttgtttttttatttttattttcatttttttggtgtgtgacactgagtctcactctgttgtccaggctggagtgcaatggtgcgatcttggctcactgcaacctccgcctcctgggttcaagcaattctcctgcgtcagcctccctagtagctgggattacaggcatgcaccaccaagctcagctaatttttgtaattttagtagagacggggtttcaccatgttggccaggctggtctcaaactcttgacctcaagtgatctgcccatcttggcctcccaaagtgctgggattacaggcacgagccaccatgtccagccatcacatcttttttagagagacacaattcaactcacaacaatgggtataaatgcctgttcctgcaacccctcagctttgacctgtggactctgcctgcccattgcctgaatgccatactcacagcatgagttgctacttggagcccagcatccccacatatttgggagatccctagtggccttcctgctcaagaagcctctacctttctccttattgttcatggagtccttcgtgctacttgactcaaagccttttgccttggctcacttggcctttggcttctgagtcttcaacaccaggctccttggcaaggctactgacagcctgctaaatttcccaagcacccttgccatgagaggtatgctacaccctgtcccctcaaaaccccactgctagctggggctcagccacaaagcagatatcccaccccatccagctgcaggtttggtacttgcctcctcttaggtagcatcagagctccgacattccactcaccaggaacaaggcccactaatgagtcaaagctcctttaaaatctgcatttgtctggaccttgctgtgctattacacagctgaacatccttgggcaaatcacttaacctctctgaagctctgtttccccacctttaaaacacagatgataatccatgccctcatttctgatcacaacactcaggacaaacacagctcagaattcagaacagtttgggtttttagacaagtaatatgggcccataaaacagtcctagtgagatctggggcaacattctgggctcagacacacaaatatttccacagtgaggcatatcaaaattcataccatgggagacaaaggctacagatagcttcataacagtttgcgtcaggtttgacagccaaatgaatttagtgttaaatacacacacacacacacacacacacacacacacacacacacacacacacataatctctctctccattttcataacttcttgaatttctggactatatgtacgagaatgtcaacctaagtctagttcacaagtttgtggtaactattacaagagatatatcacacatgtgggtatcttgcagaatagctagtttgaagtaattaagtatttgtgaatctggaaaaggaaaaaagcttcaatctagctgaagccaaagtttgccactctccttaaaacactgcaatttggccagaaggcctgtgacttgtgcattataagtggtaaaatgtccccagctttgccctgctccccacttcatcatcagtcccaaactgaggtctcagcatgtgacaggaaccacgttcattctaatcatcacagtaatttttaaaaaaaattccagctccattccacatctcttaagttttggcataaatcattgttacaagaagaccttctcttagaaagatctttagaatcagaaaactcctgtattctccaacagcagcctggtttcatggaatgcagccagactcaggttcacaggtcttcctcctcaggttggaagtggtttttatggtggctgcactgcgaacatccccaaagctccaggagacatgcaaaacgaagaagagtgcagtgtctacaaatcagcagccagtgctacaagggagctgagtagctacactctgtcaggccagggttggaaaatccattgtcttcttcacttcagactgctataacaaaatgccttagactgtttatttatttttatttttattatgttttttgagacagtcttgctctgtcactcaggctatagagcattggcacaatctcagctcactgcaacctctgccccccagattcaagcaattctcctgcctccgccccccgagtagctgggattacagaagtgcaccaccatgcccaacaaatttttgtatttttagtagagatggggtttcaccatgttggctagtatggtcttgaactcctgacctcaagtaatctgcccactttcgcctctaaaagtgctggtattacaggcatgagccactgagcctggcctaaatttattgatcatagttcttgaggctgaaaagtcaaagatcaaggtggtggcaggttccatgtctgatgaaggcctcttcttcatgcatggcagcttctatgtgccctcacgtagcagcaggaacagagggggtccctcaagcctcttttataaggacacaaatcccattcacaagggctccaccctcatgacttaatcacctcctaaaagccccgcttcttaaaattatcacattggggattcggtggcaacatacgaatttggaagagggagatacgaacacctagaccacagaacccatctagtcaggcctagtatgaccttggataagctaattcacttccgggatccctaaatcttcacctgctaaataagcatgtggattatattcccttccaaggaacttctggcttaaaaactccacaattaagatttctgcctgtctgagataaatgttggttccctaaagagatttggaaaataaactatagctattaatagcttccgatagacaatttcaggcaggaggtaaagaagcaattacacagtgcacatctcatgccacacccggccttcgtatgctgatggattcaggtacagtgtggttctgcagttcccttggggaattttgtttctcaaagccagggactgactgctcccaccacggcctctgctgggcagctgctactaggcaggaacctgtcagaaatcaacccaagcaatgacttcttttgggaaacagagtctccagaatttgaggtaattcaggtaaatgtggcagatggtagcatctcaaattgtcatttctccaaagaaacctggcaagggtgataacctctggtggcctgaatttagagttgagcaatagtaagaatatggcaggtgtaataggttgctattgaggggagcagaaagatttggggcagagcactccctcaggtatacaaagaacaggggccatgcccatggttgtagctttggctccaaggaggaaagtaagcatggagggcttccaaattggactaaagccatctctggctgaattctgggtgccacattctaatgagagggaattaaggggtaagacttgacctcatgtcatctctttacagtgaccttaaaaagcacatcaccttccttaggagtaaaattctattagtagaaccagccaggaaaaaataatgcatgcgagtgtgttgcatggaaaatctcagaaacttggccaagaaaactgaaagatcaagaacctgagtaaaattcatcgtaacaatagaagataatgagaaaaaacacaaaacttcaaaataaagtagttaagtgtatgtattgaggacatgggaacaacatttacgcaggtgagcatcagagaaggaaaggcctgttttttgaatgccaactatgtgccaggcactgtgctaggcactttccattcattatttcacttcactcccataaaatacatatgaagtagcattggcggtcattgcagtcacagtaataataggaaagcaccagtaattagaaatcatagtgtttttcaaatctttttgtgatgaaaacataccccgggttcagggaggcaagcctaccaaattcaaaaggcatgaagagaaaaatgagaactcctataaactcatctttagatatgagcctgatgccaaagctcccaccgccatagcatccacattaccatcagaattaaggggtcctttctatgagagtcatagtccttgctcaggtgatttcattggtttccaggaccaggatttcagaaatgacaatggatttttttttcttcatggtccagaaagtcttggtcaaaaaaacaatttggttactcacagtgacagaaggcccctggctggggctctcagagggaatccatgctgaccactccccatgacttcccccacatgacaatgggctaagtggggctctcatgcttcccttctgacccctctcccctctcctgactcaccaaaaatacaaagtccttgggtaccttcaacatatctagaatcagcttcacactgctctggcgtttgttcattcatcagttcgagcccctgttttgggtcagaccccatgctaggagatgggcgtacggggatttggcaagctgcctagtctggaggaaacccatggtccctgcctgccattccatgactctctatcccacccacctgttcaggttcattctcccagcaccttctgccaatgtgacaatagagtttgcggtctccaagaaccagccctctgggagtggctagtgctttgcttgacggggaccatcagattcagctctcatcccttgttactatgaaggtaaggatgaagatgcccctgtgggagaagggggctgcctaagaccaaagtgtctagacattggtaagcaagcagcccacccctcccttgcctgagtgtgtgaatgtactcaggatcctcggagcagtcagaccagtgccttgctcgatgtccactgttgtttctgtttcgggtgttcttgcccctcagaggtccagactggggaaagctaaagggctgtcttgtgtggtaatggccaagtcacttctcctggatctcaactgccttctctgtaaaatgggagtgttatattggttggtgatccaaggtcatcttttccatatatgcaggtttatgattttatataaacctgtttctcatcctaaatcataattataatcataaattgaagggcgtgcatgtgtttctgtgtgtgcacatgtgtgtgacagagtgtgtggtctgagaaaaatctgactctgagttttctacgaatgctccagagagtacttaaaaaagtctggaatcctggactctccttgttgagagggcacacacctgctatacccacgtgggtcacacagcccacctgctgcacaagcaatggaggaagggcatggcagagaactccctgggtatgagctggatgcaggagtccaagacaggcatgaacagagctctgtgatctggtctggagaaatgggacatgtatggagcacttggttaagggcaagcgagattatcccagaacacctcaggaaatcagagatagcacaagcttctgagaaatgatggcagagaagaactgggcaggtaaagaatcagacctccagctggtccagggctcagggttaaacccaggggtgccctcaaagaacagacaaaatccttgttctcagtcatgagacagccacacctacttggcccagcataggtctattaaagacagaacttgcaggggtctgcaagggaagctgagcatcctgcagcccccagggacgctacaaggcagctgagggcctcaaaaccttaccaccatcacgcccaccacccaccagcctccgtgtgtcacccagaaccatggatgccctcacttgctgcctgctcacttctcctactttgataaggtcactcgccatgctttataacgcaaaaataatattcctgctgccattgcaaattatgtctgaactatccacccttcccatcctcatgcagaaagcagctctgcaggggagaggcatgccgggctgcagttacaaggcttattaagacacctaatggaacaccttgtggtgaccgccccctctgaggagagctcagcaaaatgcatcacagaagcagatgtcaggcttaaggcaaaagcttccaaagcactaaagccatacatggaaggactgagactggccccatctgtaccagatgttcgccatggctgtggtgctggggctcctcacccttcataagcaaactaccacagtaatgatctcacattcttggcttctaggggctgcaagaagaggcactcttgcttaatacaaagcttgggacaatggctacaggcatttggtgagcctcaaacaccataggggataaagttttaatttaagtgaatgagttgcaagcccagctgtctggggaatgacctctttagggttctcttcgctgcccctcaggagctctggtttcccatgtggctagttggctcctaccttctgaagtggggagctctggaaagttgagataaggactgggcctggggacagaggttccaagaaggctacagagcctgattttttcctttgttttcctgtgtcttaggtctccctcgaaaagaatcaatggaagtaggtaccctagtgctgtggtagaaaatgtgcaggaacaagccagatgcaaactctgtctctactccttacaaacaatgagactctggagaaaacaatggggccattctatgcctgtgttttctcattttaaaaatgagggtggtgataataacagtctccttgtcctccagtttttatgaagatcaaattagttaatgcctagagaatcaatcagggtcaccctgggcatgttcgaatgaggagaatccaaggcaagttaacaaagggaatatttacaaaggtacaaagcgggcaaggacaagggtaagtgtagcagagcacccacggggatggaagggattaggggaggaagtcgttaacagaagccagcaggagagaacaggggcgagaagatccccttgagaggaacagcaaccttcagtcaagacacacggctggcccatagcaaccacacagggaaggcccagggaataagtacacagaacactcttactccccgcccccctctgatttctggccatacagaagaccaagggcattggcagagcctatacaggccagcctttcagggcagtgagcagggtggaggtgggtaaagatggattgaaagggtcgcgtgaacaccactagcacagctctcaatctgcccaggaagtaagcactcaaggcacgagatgttgctccatccatgggcatcaacttggatatacatgttcagccctcatcactgggacactaaatggggctttagagtcacatgccacagccatcaatgtctctcacagacctgtagctgccacagttgagtgatctgctggctgaagggaaggccacccacaggtgacactcccaggacttccctgggcctaccatgttcaccttgagactgtttagactttgcatcaatgacagggcaagaggcagtgatgtttccatcctgttagaaaacagaggtctttaaaaaattttttccataggtttttggaaaacaggtggtatttgggtacatgactaagttatatagtggtgatttctgagagtttggtgtacccatcaccctagcagtatacaccgtacccaatttgtagtattttatccctcacccccctcccaccctttccccgagtccccaaagtcattgtgtcattcttatgcctttgcatcctcagagcttagctcccacttatgagggagaatatatgatgtttggttttccactcctgagttccttcacttaggataatggtctccaattccatctaggtcactgcaaatgccattattttgttcctttttatggctgggtaatattccatggcatatacatgccataatttcttcatccacttgttgattgatggagtttagggctggtttcctatttttggaattacaaattgtgctgcatgtgtgtgcaagtatcttttttgtataatcacttcttttcctttgggtagatacccagtagtgggattgctggatcaaatggttgttcttttagctctttaaggaacctccacactgttttgtatagtggttgtactagtttacattcccaccagcagtgtaaagtgttcccttttcaccacatccccaccaacatctattattttttgattttctgattatggccattcttgcaggaggagtaaagtggtaacacactgtggttttgatttgcatttcccttatcattagtgatgttgagcattttttcatatgtttgttggccatttgtatatcttcttttgagaattgtctattcatgttcttagcccactttttgttgggatttttttttctaatttgagttcctcgtagattctggatattggtcctttgttggatgtatagatggcaaaatttctctcccattttgtggactgtctgtttattctgctgattgtttctttggctgttcggaagcttttcagtttaattaagtcccatctatttatctttgtttttgtcgaatttgcttttgggttcttggtcatgaagtctttgcttaagccaatgtctagaagggttttttccgatgttatcttctagaatttttatggtttctgatgttagatttaagtccttgttccattgtgagttgatttttgtataaggtgagagatgaggatccagtttcattctcctacatgtggcttgccagttatcccagcaccatttgttgaatagggtgtcctttccccactttatgtttttgtttgctttgttgaagatcaggctgtaagtatttgggcttatttctgagttctctattctgttccactggtctatgtgcctgtttttataccagtacccatgctgaggaaacaggggtctttctgacagccaaggggtaagtggaatttgctaagtgaaagaggtccattttaggaagtcccactttctcttaaatgacaaccagcctcctcctaagtctttcccacttgctctaggcctgaattcagagttccattgttctttcacagaactccttggagtgacaatcaactaaattaaatcaattaatccaacatttacagaaagtcaggcatgtactgcttctggggaaagtggaaacagatcagatgcaggcactgtccagtggtttctttttcccaagaggacaattttgaaactccctcctcacatgcccctagggtagccaaaacccatagaggttcattctccaagatagggtggtacagtgggcagagcatcagccctgggggccacaacacactctgttagaacccagctccattattattacatcatcttggggaaaagtcacttagactccatgaaccttgttttcctcctctgaatctttcagagaataatctctaactcacacgatcactctagggattacatgagacgatgtgtgtgaattttctagaacagcacccaacacacagtaagtcctcaataaatgttagctcttcacccctacaagaactccaggtctccagatgcctatgtctacccctttaaatctcagacttagaggaagttaatcctgctgtttctgtttcctacaacttgggctgtgctaccttgtcccatttccttctgggtccaggtttcatcacctattaaatggaaggacacagattacacaatggataagccaaggggttctcaactttccctatgactacatttctccctgggctgcatgttatgaaaggcttgtccactgcataaactgaatttgtgaaggactacctcttcctccattttctcctaatcaaagcaagttccccccttcaggtttctgagcagcatgagatcacagctttgttcaccgggttgaatttgaaacctaacccaaagaacttgagatttctttgaacctgtatagtgtaggcacaggcatcttgaaatactaaaagcgcttcaagcactaccacttctccttcccagattcccaggtcctcaagttgaaaagcactggactaattgattcttctgaagccctccaattactaactctgtcattttaacgtccgaaccggaataactaaggaaaatcaggcccaacctgaaaaggcatttgttaacatgagatggactgtggctcattatggcaagggctggatatgtaaggatggaggcattttatttatgttaggagactgggccattaaccagtgttgtgaatgtgccttctacaggcgagtcttttggcatcccccagtggtaggcagtcagtcctttttgttcagttgctatacacccactgcactgcagtgtcaaccccaaaggcagtggcacttacacattcctttgtgaggccagctgctggtttaacccatggccaggcctggtcctttttctccaagcaacagggaaggtgcttagaggcccatgggcttatctgcaaagctattttcctggagctcactttggagcatcccctcctgaccatggtagtgatttgagatcaggtgtcttcaaagagcagcccttggaccagtctacctcctgacgccctttcttctcatcagatggaaaactcacagatgggaaaaaacaagctgattacccgggtctcactccccacagacatcttccatctttggtcctcattagggctcttggtagctggctcgttgctaagtcaaacttgcaaggcacagtttttctgccacttctttagatctgcacttaattacagctgttccttcctgttggccattctccactgtttcaaacatccaagatactagtcttctaatgttcttatcctctcattagagttgaacattttgttcttgtcttacatctattctgttccctgcacagctcaagaagtacttgagtttttgcctctgcttttatgttgcataataaatagcattctgcctggtgtgacactgagaataactgagttactactttctatcaaaagtatctaaagatccatgaagactcacaaggctcctttctgctgttaaaagactgtgcttttaacaacgctgatttctattattcttaactttattaactctaatcttactcaactctaatcatcactgtcttgcatttctccctttccaatccaattcttgatccattataggcatctataattataatacctccctgcctacctggggtattccttttactctcaaaaatgtccctattgaaacaaaaataaatatgtcaccccaaccatagagaataagatgtttcctgtttatttgctattgcttcagctcaagttcctgctctccatgtgtcaaagcaggggtcagcaaatatttttcgtaaagagctagatagtaaatacttttggctttgcaaccatatcgtctcttttgcaactactcagttctgccatggtggtgcaacagcagccgcaagcaatacgtaaatgaatgggtgtggctatgtttcaatacatttaatttacaaaacaagcagcaaaccagatttggcctgtacaccatagtttgcaatctatgcttatgtacggactgagataatgatctgcctttccctctaaaaagctgattttcctaacagcattaattatataatctattatttcccaaaacgatttaagtctaccattatcacatagtaagtatttacatagacacaaatcattttcattatcttattttgtattctgtttcaattacattttatttcactagccactaaattgcttatagtattaagttattttataactctctgtaactttttgctgtgcaaatctcccttctattaagggacaaaatgtcccttttgccattcttatgcatttcatcttctatccaaactttacaatcatttttgtcaagttttaaaaacataaatatgtaatcactttgggggagaattgacatatttatatgaatacacgtttccattcagaaacatgatatttttccaagtattcaagtcttcttttatgtgcctctgtgttaaagttttcatgttgttcctgcattttttttatcttcatcccaagctttaaaagatattctgtcctgttatgattgggtttttctttgctctatatattacaatttaaaaactgcacatagaaaaaacctgctaatttttttttagaaatttatttcgtatctggtccctaaaacctcttgctaatgccaatgggttcttctttgatgcctccttcatatatttttttagaatactaatcacacttgttcagagggctatgtcctttgattttcagagccagagtattttttcttttccatcagtttgaggatttttctccactggctcatcctagagatacagccttcattcatggattctgttccccaccaagcccagcctagatacctcctctatttcacaaaccctctcatctgacctatcaacatgccttctagttagtgaggcttgtactaattttacagtgcttgggtgcagaagagaacagactgagaggtaggtggggctgcagaaacccactgggaaacctagacctccctagagagtgaacacaagttcactcagagtggccaagagaatatgacaaatgcaggttccacccaggttgctagcatacttgaggagtcaaagatggtggtggagctgcccagcaaagatgttcaagtgaaggcatcaggagatggggatgctgagagtcagaagctagatgatgaagcaacagctttgctgcatttcaggataagagcaaagaagctaaatctcaggcaccctttggtctgatatatctacattaactcagcattgtcagtgccttttagctcatgtggcttggccctgagtattttggtctcattcaggaatcaccatcttaatcaagaaaactaagcagaagcctcatatgaagaactttgtattagttaaggttctccagagaaatagaaccgacagaatatataaagatatataagaggagacttatggaaattggctcatgcaattatggaggccaggaagtcccccagtatgctgtctgcaagctggagaatcaggaaagccagtggtataatttagttcaagtcctaaagcctgagaactagaagaggtgatggctgatggtataactctcagtctgaggccaaagtcctgagaacccaggatgagaaggtgtaagtctggaagtctgatagcccaacaaccagaagctccaatgcccatgcataggagaagagtcctagctcaagaaaagagagaaaaaatgaactcctctgcccttttgttctattctggtgctcgaacgattggattaagcttgcccacattggtagacttctttactaagtcttctgattcaaatgctaatctcatctagaaacaccctcacaggcacacccaaaattaatgttttaccagatatctgagcatcccttagaccaatcaatttaacactcagaattaaccatcacaaccttgtatacgttttcctcagaatgactgcatgccaggattgcgccagcaggctgactttaatcactactatcttgagagatgggctcctaaaatacagcaaagttgagctggatctgaatagactaaccccgtggctgagcaaatctgggcaggaccagatggaaaatgggctaattctgtaccacccattatcaaatcacatatatgtctagatctgtgtcaacaaatcctttccaacccaccaaatcaaatcattggagtagaactggggagacctgcagtaccattacggctcacaatacctcgtcacaacatgactctggatctccttatacccagagtgtttctgtctggagagtaggatgtaatggtgacattccatcttcctttccatacgtacccatttgtttccttttatttgttcattcattcgttcatttggcaaatacttaccaagcctactgtctggcaggcaccttactaggtactgaaaatagagacaggaataaggaactctatccttgaagcacacatcctattcacgcatggtttaaggaggccaagacatagcaagtttgaacaccttgacaaaggaaagaaactagggaggtacaaccagagtttaatcaaggactgtttaacttaccacacctgctatcactcagaattctcacaggaagcttccctaggcacactgtgacagaatgggtgggggaaactcttcctaacaccacctgacatgtgccttgcacccaccacaggcatggtaccttgaagcagagtaacagaccagtcagatgatcacatctccctcacctatagagactcatgatgatgtcttactgcctaggaaacagtacagtagctaaagcaatcactgggggaaaaaattctgaaatctctaagcattgctcattagcataaagcttggagaggtctgataaagttcatggcttatctccaagcctgcttgcttcctctctgcccagagcagcagctgggcaagggattgccttctttgcaaagaagcaaattaaattaaattagatcagttataccagcaccaccaacagcagaagcatcttcaataaaattaagatctcgaaatgaaaacaaggaaatcatcttctaaaaacctaatcccattgcccagtttgaaggcgctcactactgagacctcctgtggcaactttacatgaacatttgggagcagggaactaggggagacctggcagcatcgttgggtaacccaggatctgggccttttgtttgttgttgttttagtcttagggaagcacatatccaatcacacacttgatatataaataggccatttcagtgaatacagtcattggaaaccttttccaataagagcatgtcatactggctatgaaagagtgtatttataatcacacagcatggtatagtggaaagaatgccaggtattccagaaaatatggtggtttgcacaccatttcacagaacctccatcttcaaagttgactgaaatgaacaaaatgaattaaaatgaacaacaaaaatattattaattctgaaactcagaaactgccccaacctcatgctataggttttaagtgccacctgggccaaaatgaaagaagagtaatctatgttcatgcttttttttttttttttttttttggagacagagtctcactccacccaggctggagtgctgtggtacaatctcggctcactgcaacctccacctcctgggttcaagggattctcatgcctcagcctcccaagtagctgggatcacaggagtgcgccaccacacccagctgatttttgtatttttagtagagacatggtttcgccatgttggccaggcttgtctagaactcttgacctcaagcaatctgaccacctcagcctcccaaagtgctggtattacaggcatgagccatcgaacccagcccatcctccctttcaagatggaaaagtactgttggcaaggaaaaaaaaaatgtgtaatggacagaaaagctgaatgatatagctcctaatttgaagagaacaaattggaaaggtgtgaatattccacttggagctcgtttttcccattttggattgactccttccctaaatcccttcccagagccattctgggaattatcaggcagaaaccagttatctcatatgaggactcaaatgggcaaagacaagaaaatgaatgggtttagaaaaacaaacgacaaaagtccatgaaacagaaggacctctcattaaagcagctgactcattttgaaacaggtgagcaaactgaagctttaggggaccacccaccccaggaagaggatcaactgacaattcaatagacctaaatctagtgtcagaatttcaataaatttagagacagattagagacaaagcccccagaggctttttgcaagtcctcagcaatttcctctcccataagagagcagtcaaactgtaaccaagtaaattgggaaaatagcaaaggcaaattcagcattaccaatttggatcaaataacaccatcaggtaactgcccccactgatatagtggtcaagtagagggggaaaagtacaagacttaaaggaagattgtgtgtcccccacagtaggtttcacacgcaaagatttttttttaaaactcaccctggaagaagagatgctccaggaaacataaatagatcactgctttgtaatcccaggaaaattaaagagaatttaagctctacgaaacaagcaattaaagggtgagaaaacatgacagttgttcaagaccgggagtgtatcagcttctcgacaacacccccaggttcccccagggttgtcttctgggcaacctcccaggtactgtcctctcatcaatactagatccgctgcagttcctgaacatgtgacggcacagtatgtaaaaatgcatatactattagggctggaggaccctcatctagtcatcgtcaatgacaggacaataaaaaccaagttcacgtatttattaagtggcaaagctatagcttagaccccaacctgaccctacatgtataaagaggaaagaagagggatgaagataggatgttgggagggaaaaaggaggagaaaaaagggagagaaaatggaagatggaagcaacagctggggtgcagtaaaaaggggcactggactagccagaaaacctaccatgaatcaaatctgagtacatgccttcaatttctggggctacatgcccaacaaacagaattgttgggtcacatagtcacttgatgtttaaattttgagaaattgccaactgttttccacattagctgcaccatttggcattcccatcggcaatgtacaaggttctaatctcttagctctagcactcactatgttgcatgactctgaaaaagtcattttatttatctgaacctcactttctttttctctaaagagtaggggttagaactagctatcctgtttctgcctattcacacattctttctttccatccaaatcctgaccttccactgcccacatctgtttccaagagtttcctgacagtgtgaagtactgtaatgagtaagtcctagctctgctccttagagctagaattatcttaatccatatccccaagttatattaatgcacttccatttccatccatatctctcagcgtacattttttctctcttgtctattcttttaacctttttgcaagcatcatcttgttctgtctgtcggctgtcagcttttctctccgagcttctgcggagttgccagattcttgactatttccccaccctcagctcataactgtttttccctggagctcagcgactgctaagtggtctttgtgaaatcctattaggataatctccctgtctgtgtctcctctcagctgggctgcctctagaaacctcagctgtcttcctactcacaatcggcaaatcataggctggctcctgagtcatccaacatcgtacttattcacaaacatgcttagatgagctctgaacctgtcgaatcttgtagcccacaagcaagagttaaattcactggagattcaactcatatgtcttctcctgcagaaggtgtctcctgtttatgcgggacccctattccctctacaatcccaggaatgacacctgccccctttttactttttctgtttctgtttatgtttatcatctatctctctcatcagactgtgagattcatgagagcaaggagctggagtatcttgtccaaagctgtatcctcagtgcctggcatattacaggccctcagtacatgtttgttgaattcatgaatacgtgttcctcttccatagagtcaatcatggatctgcctacctgtctacctattagacccaaagctactttggggcagactgagatttacctgccatggtaacacttgttaaaaataaaattactctgacacttgttaaaatggtaaggaagacattattcaagattattgcaatggaggagagaaattaggcaaatataacaaagacagctggggatttagagccaaggaacagagtgagtggatgaaaaattaccaagaggagacaagggtagggagattcttgctaaaacaacttaccagggttcttaccgaaggcaggccaggatgatcagatagtgctatcatccgaatgtttgtggaggccaaaactcgtatgttgaaacgctaaccgccaaggtgatggtattaagcgatgaggactttggggagatgaattaggtcatgaaggaatgggattagtgtccttataaaagggaccccagagagctgccttgcctcttccatcacatgaggacacaactagaaggtgtcattttttaatgaagagagatctcacgagatatggaatcttctagcaccttgatcttcaacttcccagcctctacaactgtgagcaataaatttctgttgctaagaattagtttatggtacttttttatagaagcccaactggactgacagatgtcaaggggttgggggatcctcagtaggctaacctagcagagttcttgctaaaactgggctagacaggccacagacaagatagccaaaatcaaagcctagttgagaagggaattcagaggagcatgactaaaatttggtcaaggggagagtctttgtcaccccagcacctagcacaagtggttggtactaaatacttactgagcccagctgagcacccaccctcagtgcagccctgcttaccctgacaaaggtttagggctcttactctctcctttgtgcctcaatgagctgcagcgtcaggagaagggactccagtagatagcgttcaagtggctgggggtggggaagagaagcaaaatgtgacaaccccacattaatcaagaaggtacaccattttctcagggtttcataactccaatgatttcctgggccaatcatcccaaatgaccctcacagccactttgtgaagcaagttgatttatcttctcatgttatgaacggaataactgacactctgggaggtcaagcaccatgtcataggtcacacacccagaatttcatgaagtcatgaagacataaagtgtacatttatctgctcagaaactttttaagttgttgtccctaaatattgtaccaacttgtacttataccaacagtgtatggccacctggttgccagaggtctcaccaacactgatgtgtgtctgccggattatttttccttttactgatttttaaaacctctttacatgttaattatatcaatcattttttgcacatataatgcacatatctgagctcagtttgtttatttttttttttaatttttttttttttttgagatggagtctcgctctgtcacccaggctggagtgcagtggcacgatcttggctcactgcaagctccgcctcccaggttcacaccattctcctgcctcagcctcccgagcagctgggactacaggcacctggcaccatggccggctaatttttttttttttgtatttttttagtagagacggggtttcactgtgttagccagaatcgtctctatctcctgacctcgtgatccacccgcctgggcctcctaaagtgctgggattacaggcatgagccaccgtgcccagccagtttgatatggatattttcatgatgtttaggttcttagggacaaagatataatatttttctttatggctgtaccttcaatggtatcatcagaaaactgtcctgctccccaaaattaaatatttatttattctttaaatgtcatctatgttttccaaattttacatttaactgaaatgcactgcatttatccagaatatattttggtacatagtatgaagaacccacatcctcccctggtggattatcatttcatcttgacctgtctcattaattagaaatgtgaagtttgtctataacatgtacacatgcatgcattcacacacacacaaacacacacacacccctctgttttaaggacatactttattctgttaatctatctgtctcttctaagattggtataagctatttgaactattttagtttcaggatatatttctaaaacttggaagtagaagtctttctccatcattctcttttcaacatttgcttgatgatctgtgcccatttatttttccagataaaccttaaaatcattttataacattgcttatacatttctattgcaatatgcattcaatattttaaattgacagctttaaaataccaagccttcccatccagaaatgaaatacctccgtttacttatttgttttcccagttttgctttatagattccttctacagttcctgcaaattgtctcttaagccaattcctcaggcttttatatttgttgcttttacagaatgaatccttttatattatgtttcctaactggtgattggtatttagaaaatttttcatttttgtatatttattccctaactagtcaccttattagactcttttattgggctctaatagtttttcattatttctcttggggttttggtagataataaaatcctctgcaaataataactttatgccataattatatttcccattctgttactagaaatccctgaataaatgttaaataattttagtggtcctgagcatccttatatttttaggatatcagttgttagtttggaatagacaggctccgtcacattaaggaaatagctttctaggtcttttaaggatgacgattattctctgttcctccatcaccactttcacccaccaacctagacatagtggtctgtagtctgtatctcccaggcttccttactctctgcttctagctgagtttaaccaatggcagagtttggccatggacagaagaccagggggtggctgtgttcctctatagcctgtcaagcaatcccttaacactttagcaccatttctatttcctaccattgcccttcagacccagggtggtaatggcttcccaaagttgccagtccctgggtgcttcactatcccttgttaattcccttgattctgatccaatctctatttcattaaaccccatttaaatcattcatctctcacatgcttcttgcctagacattccctaactgattgataaattaagacccagtgggaagtattttcaaatgtatttttcaacatctcaaaataatcaaaatatttttttcttttgtgaaattaacgtgacacttattcattcattcatttaagaaaaaaaattctgagtacctactatgtgttgcttgttgtgctagacactgagatcagaacacattaaaaaaaactaaataaaacaaaacagataagccttctgcccttatgttctcttagggaaaacagttacacaaacatgtagatgaataaaatgccaaatattatgataaggactagaaagagtgtctggataaaacaaaacaaaacaaaacaaaacaaaaaacagggagtacatattcaaaaaggctagtcagagaatactgctcacagaaggtgacatttgagttgagttgacatgcaagctcttgctgagaagagccttcggcaagtgaaaagccttgagacaggagagagcctggtgtggttaaaaaaaaacaaaaaaccaaaaaaaaacagaccagggtatcaccagcaagggggaatgtggcagaggatgtgaataaagagataggcagctgctagatcagcactgtccaacagaaatacaatgcaggccacatttatacttttaaattttctacctgccatattgcaaaaggttatacacacgcacacacacacacacaagacactatcttttcaacatataaacaatataaaaattaacacaacattttacccttttttttggtacaaagacttgaagatctggtgtattttgcatttagagtacatctcagtttgaactggccacatttcaagtgctggaggccactgtattgaaccactcaaggctacatggtgcacatcaggcctggctcacaaggcctcccttggttgagaggggcaagatatctgagactcatctctatagctcccagcatcatgcctggcacatggtaggtgttcagcaaatgtttgccacacaggatggcagaagaactgcaaaatagatggcaagttcctgaagcagagaggctgcaccaggatcactctggtgcctgctccaggaaattgggtctattgtgtgtcctcaagcaagagaggaagttggggtccacctgctgagtctcccactgtgggggctgttcatgaccacctctcccatagccagggtgcttggcaaagctgctttcttaattcagaaagatcacatcacaccatatgccagagagtgggagggagggagcccattagcattcattgtacacagcttttcgtttggaaaagcacctcgaatgtgccgatctgcattgctttgcttcatttttcaacattcatgagtgtaattgcatttatttttctcgtcaagactgcaaaacaagtgataatttactacattacagcccatatcggctgggtttacagccacaacagttataatccaccctcttagggactgggtgggtaagcagggggtggtctttttagctgagagcactgtatttctttataacaggaagcttgggcccagctgttcttcaaggttacaataatagtggcaaaaactaacccatacagagacactgagctgtcaaagcatatgcacttctactatcttgatggcttcttacactaatggggtaaggcagacttgtactcccattcacacttgccagagaaagagactgagattcagagaagtcctctgtagtagatggtaacaggttggtgaacagcagagccagggttcaaacctagattcatgtgataggaaatcccgtgctctcctcatgatgacacctggcagtgcctgagctctagcaaagcgtgaggtcttgtagttatattggtagaaaagaagaggacatgatcttaaaattttgtaaatgtgaatgaagtgcctacagcagctgtgaccacgaaggacacctattttcttgcatctacaccacagaatgctaacttccagcagagaatcaggacaggagactacatccctgcctgaggtccatccaggtgctactctgtttgtgactatctagaaatgagagcagggaaggatggtctagccttgtatttggagatcattcaatgcagatgttttcttcctctttagaacaagagtcaagccatagtgatgttcagactttagatcacaaatgctcacgaattcatgagtagtaactgatgaacaagatccaaccctaaaaacttatggattcattaaaatcatttcctaagtaagattaaagtagtggacatgtcagtggtcgtgagctcctcatttcttcttcctgggttttagagggatgtaaactccatcccctaacctgactccctgccccctaattacaacacacggatcttgaaaagggtggacttgaaagctggtcttgctgtaaaggatctgaggaaagtgggcagaccatgaaaagccccagatctcagtcagaggatattgctaccatatgatgtgacatctctttcaagaggagatgaccctggggtccagccccacctctgcagctttctccaaggcaggaaagagataccaggggtccctgtaaagtctgaagagtcaggagctgacaggtgttcaggaagtcgctccagctacctggccaggatgctgtagtctgcaaaggacccttcagccctgttcctgtcccttttctgcaaactgaggtcccctctctcaatcaagtgatggctctcctctatccactcctgacattggcaagtgagaccctgtgtgggcgtttctgccccaggccaggactaaaatgacaaggtctggccactccagggccttctgctgagtctcagtaagcacacactggacaaagaacctccagcagccactcaatataaggggcctcaggtcttcaaagaaggccagtaggcgatgatgaacattacagcccacctagtgttaaacacatgtaatcacacacacagagagaggaggggagaggggagagaggagagggatggcaggcctaacaagtcctcagggttttccatcagtacacaggttaccaaggcacctccatgctgagtcccagctctgagacaggacaagaagaagctgcttgatggtgatggaggagacccaacatgggtccacgcaccaaacattttgttctgtgtgttctcaaatgtttgtcattcaatccctatgtgtcccaattgcatgaccttcattttataagtaagagaaaaccttgagccatagagaaactttgctcaatagctttgctcaaggtcccccacactagtccctctggctatagtgtccctgaaccttgaacgtgtatatgcctctggaatctcttttctgaaattcaactgtacagagaatcaaagaccaaggttatcaaagttttatttcaaacacaggaaagtagtctttcaattcaggcaataacctttctgttattattttccatattgcaaagtctaaaaacttagcacaaatctaaaaatcaggcttgtaaaggtgacattttgtttgaaatggtcaaaatcagataattttttcaatcagcatggagtgttaaattcaggctttcttctacttgttgccatcacccagaaaagaaaaataagatttattttccagaggttggaactatactccaggtggctctctggcctgccaggccccatctgctccatgctgctaccacctccacgtgcagtcaagactctcttcattcctgtattgtgaagtcttttcatgtggtccctggttgcagtaatgaacaaagtatgccacagcagaactgctttatagaacctgtgtggtattagagttagaaaactgggagtattacctaatcagggctcttccttgtataggttaaggccactggagcccagagagactaagcaacttgcttcaggccacacagcaggtcagcagcacagcagacccggatctcctgagacccactgagcaccatgctctgaaccacaagtgtatgtttcagccacctcagattttctgtttcctttaaatctgtttccaaatagctgaacacttcactcatcccctaactcacttattcaatattcattgagggcattctggtgccagttttaggagctgaggacacatagctgtgaatggaaaagttgcttcctgctctgatggagcttatagttcattgaggaagatgggtgttaaatgcaaaattacacagagctcctctgtattgagctcccgcactgcctgacctgggacaggggctggaagaacaatgggattctgagacccagtggtctccaaggcaaaggaaagaacatggcagtgatgacaaggggatggcaaagtacagcaggtagaggaagaaactacagggatgcaagcaacagctccaacaaagaggtgtcccagggtgccaattctccgcaggggaaagaagaagggaaggagctgggtgctcctggtggaatgccggcttattcctgtcttcctctaggaatgcactccctccgtctccttctcaggctcccattcctctacccacaccctagattgtggcaatgtgcagagttctgctctctcccctctgctcttccctttctcctgtgaaatcttgaccctggccttgacccctttcctagcttcccaaacacccagtggttctcaagatcaatgtactaaaattgcctgctgtttcctgggccccatcccagtgccacatgttgggataggacccaggaatctgctttttaaaaataccctcggtgattctgatgcagatgttcagtctacctgctcactgagacccaaggtctggtaagcatcaaacactgggccaacactttcacttgctaagaacccagtattgtgggcacagaggtagggtctctgcatgagcatcctggccatttttagcacacctctataggtatgtgtgtaatatacagatgaggaaatggaacccacgtggcttggctagagtcacagaacttcaaagaataggcacctgactccacacccaaatccagtatctttgttcatctctttcaccaagttttcttgagctcaccgatacctccaacccccttttcctcctccccatttttacagctaacatccccattcatgcctgatcagttccctcctggtccactgccttccttcccaccacaggctccctgctgctccaagttgcctttcacactggccaacaagtggttatcctaaaagataaatctgatcaaacattccctgacttaatctctgatgaatcctcactcttatcatgcaacatccttcaagttgtggccccaacctcccttctcatcacatctcatcctatgccacatgaccatggtatcccttcctagaatactacattattcaagagtattggtttgagtatttgcctctgccacttacgtgtgattttagataaaatcacactgccacttctgtgtgattttaaataaattacttaatctttgtgtgcctcatttttctgaactgtaaaatgggctgttaccactagctccttcaaaaggctgttgtaaagacttaataaaagaaagatgacaagtataaagtgctcagcacagtgccatgaaaacagatgctccaaaatgctacctgatactaatgtcatcactgtcatcctaccatgtaaggactacttgttattctctgaacataccacatactttgaggtatctcactggaagtagacacctcttggtgctggaaactcctcatcaaaattctaaagtgactgcaaggtagggtggccataaaatatccattgttgtacaaggtgctttgtatgtgaaattttagttaattccccacataagtcttatgaggctcttgtcccttatcctcattttagagacgagcatgaggctcagacaggttaccaaaccagctccatatcagaatgctagtcactagtagaattggcattccaactaatatcagcctgatttcaatgttcacacttctgttcatttcttctatgtgaaaagaacacagatttttttttttttttttttttttttttactcacttagagtacactgtactgagaattgtgtcatggtatcttgtatcattcctaccctcctaagctcacccacatatcactggggctggaagcctagaaactacatcttactttctggcagggttccagctcagtcttcaccaatgacagaggcaaagactgggccctcaccagacactgagcctgctggcaccttgatcttaaacttggaattcccagcatccagaactatgagacataaatttaaaaatttacatatggccttttttttttttttttttgtgacagagtcactctgtcacccaggctggagtccagaggcactatgtcggctcaccacaacctccacctcccaggtttaagcgattctcctgcatcagcctcccaagaagctgggattacaggtgcctgccaccatatctggctaatttttgtattttcagtagagacgagttttcaccatgttgaccaggctggtctcaaactcctgacctcaggtgatctgcccgccttggcctcccaaagtgctgagattacaggcatgagccactgcacccagcctatgtatcacacattttgtggcattttgttacagcaatatgaatggacaagacggaaattaataccgagaagtagagtgttgtaacaaatacataaaatgtggaagtggctttagaaatgggtaatgagtagaagctggaagactttagagattcatgctgcaaagagtctagattattgtgaacagagtattaagggtgtttctggcaaaggttcaaaagaagaaagctggagagaaaggctcaatcttcttagatattataagtatagtcacaaacagaatgatggtagaaatatggatggtaaaggcaattctgatgaggtctctgacagaaacaagaaataagatattggaaactggaggaaaactcatagtcttcaagatagccaagaacttggctgaatcatgcccatgtctcaatgctttctgaaagggagaacttgcaggtgataaactaggatatctggtgaaagaagtatctaagcaaagtgttgagggtgctacatggcttctcttgactgtttatagtaaaagtgagataagaaatcaattaaagatgaatttataagtaaaagggaagcagagcttaaagattttgaaaattcccagcctggccaggacataaaggtatattatggagagaataccaacagtgtggctgagtcaatgtttgataaaaatattaagatgcctgatagggttattagtatgggtgtaaggaagccagatgctatttatcaagacaatgaaagaatgactccgaaggcatttcaaagatctctaaagttgtcactctcatcacaggcccagaatgccatggcctgggggacaaaactgtatgaaaaaagggatcttgggcacccatgagacctcagcactcgctgctctgtgccacctcaagtctctgcttactgaattctggtgtagtgctccttagatgccccagatgtgactcaagtgagcccaagtgtggctcaggcttcccctccagagggcataaacagtcaaccttggtggcatccacatggtgttgaccctgcaggtgtgcagagtgcataagctgtgggggcatggctacctccacccagatttcaaaagatgccctggagagcctcagtgcccaggcagagaactgccagggtgggtggggctgctctgagaaccctcactagtgcaattccctggagacatgggaattcagccactgcagagaacccctattagggcaatgttccatggagccatggagatgggcaacccttgagacctcagacctgtagagccaccatcacgcaacacaagcctgggagagagacaggcacccaaccccaaccactgagagctgctttgtggggcacgcccagcaaagccatgaagaatggggctgcctgggtctttggcccacccttgctgcacggtgtccaaaaggcaggacgtagagtcaaagaagatcattctcaagcctcgagatttaatgctgtttgtcttcttgtgttttatacttacttgggacctattaccttttcttcttccctatttatctcttttaaaataggaatgtctatcctgtgtttgtcccaacattgtattttggaagtatacaatttgatttcacaggcacacagctggagagcaatttgcctcaagatgaatcatatctaatttagatgacactttggacttacactttaaagctgatacaggagtaagacttctggggctattgagatggaatgaatgtattttgtatatgagaaggacatggattttggggcatctggaggagaacgctgtggcttaagtgcaggtgtacctgcaaaattcacatgttggaacttaaactctaaagtgacagtattacgagttggggcctttagaagatgattaagtaatgcggtcagagccctcatgaatgggaatagcaacattataaaagagctggagggaactaggtaggccctttttgtccttccatgtgacagcatagcattcaagccaccatctttgaaatagaaatggggtcctcatcagacaccaaacataatggtgccttaatcttggacttgtcaacctccagaactgtgagaaacagatttctattattcataaattacccattttgtggtaccttttatagtagcatgaatggtctaagacaccactgaacaattccctatctccctcctctccccagcccctggcaaccatcattctatttttttatttctgtaagtttgactgctctagatacatcacataagtacaatcatacagtacatgttattgatgactgatttatctgtcataacataaggtcttcaaggttcatccatgttgtagcatgtgccaggatttccttccttgttaaggctgagtaatattccattgtatgcgtataccacattttctttatccgtccatctgttgatgaacatttgggttgcttccatctcttggctactgtgaataatgctacaattaacgagtgtgtaaatatattttcaagattctgctttcaattattttagatatactgtcacgtgcagcataatggtgtttccgtcaatgacggactgcacatatgaaggtggtcctaggtggatagttggctatagcttctaggtttacaaaaatacagtctatgatgttcacacaatgatgaaattgcataatgactcatttctcagaatgtattcccatcattaaatgatacatgattctatttcaagaactgggattgctagatcatatggtggttctattttttatttttggttttccatatagactataccatttttacactctcacaaacaatgtacaaaggttccaatttttccagatgcttgacgtttatttctttttgtttgtctttttatagtggccaccctaatgggtgtaaggtgatatctcattgtggttttgatttgtatttctctaatgattagtgatgctaaacatattttcttttcttttttttttttttgagatagaggcttgctctgttacccaggctagagtgcagtggcacaatcttggctcactgcaacctccacctcccgggttcaagtaattctcctgcctcagcctcgtgagtagctgggattacagacacacgccaccatgcctgactaatttttgtattttttgtagagatggggttctcaccatgttggccaggttggtcttgaactcctgacctcaggtgatctgcccacctcggcctcccaaaatgctgggattacaggcatgaaccaccgtgcctggccgtattttcatgtttctcaccatttgtttatcttctttggacaaatgtctatttcagccctttttaaaaaaaaaaaaaaaatcaggttatttgttttgttattgttgagtggtaggcattctttatgtattccagatagtaaccctacaagagaggtttgtaaatattttctcccattccacaggttgtcttttaattctgttccctttgaaacacattagttttaagttagatatagtctcatttgtctatatttgctcttgtcgcctgtacttttggtgttatatccaagaaatcgctgccaaatccaacatcataaaactttctacctacattttcttctaggggttttacagttttcactctcatgtttaggtctttaatccattttgaattaatttttgtgtatggtgtaagttaaggatctgctacatgtggatattcaatttactaaatgccatttgttgaagaaattattctctctccattgtgtagtcttggtacccttagtgaagattatttgaccatgtatgtgagagcttcaaaggttttataaacctctaataccctgtattaaaccccttcctgattgaaatacctagaatggtttccgttttcctacctgaatccaaactgatggacacatcatgcttatatatgtttgcagctatgatttagaaggatcttggaagctataggtcttattttaaccttagacactctcagagttcttaaaagacataacatattcttgcttgttcatagctttcacaagttgtttcattgactacaaggctttgaatcctgagaaagtgcaatttgggtttcttaataaggaaacacaacacctaggaaaggaagcaattttaaaagatattggcagatttgaggaaagttttaaaaacagtttgctcaaatatctgttgctttccaaacataaagtatgatcgtgtcagcacagagcacagtgtcaaaactaggtagatgaagagggaaaacaggaggtctttttagaaaagggtaatttctctcaattaccaaatgtctcactgattagtagttgtggggaaataaattctggagttgtacctgtgaaattaatggggcatgtgatagatcactgcagctctgcaaggatgcgtgagaacagagtacgtgccttaagctcaactgggagatttatctttctgtgaaggtctgggctctcagggatagattgtacgtcaggtgccctacctccatatactcatgaagacaaattcctctgcaaagaagcagaagcagttgccctgcttgacagacagacgaatggaggggttaggaccacaggagtcttcaccaatgttttgttttataaatgtatcactaaattcctatgtttagaaatgccttcttcttgattcataaattacaagtcaaagaatgctagagtcagaagaaactgacttctgatattacaatggtcaataaggtccagggagggatgatgtgtggcccaaggtcacagagcaagttaatggcagagctaggacagaatccaggactccttatttttagatccatttcacagaagtgggtgtaggaagcccagagaaaggcagctcaaagtctgaggttagtgacagatctgggatgagttcccagggatgcttccttagccactaggcagaaggccatgctaaccaaaggcctggcagtagagataatgcctacccaattccaccatgtgcctgcagcccacacagaaccacaataataaccacaggaagaacagagctagaggggcctgaggtagctctgttgttaatatgttctacatatttaaaatcacatgtttccacccaatcctgggtaggaaaactgaggtccagaggttcaagtcaacagagcaaggcagagacagaagtgttatgtccatgtgctaaaaggtggatgcctgggagtcatcagtgggtgccactgacttgagctgctttggttcaaatccccttcccagcacttccaacctctatgatgaagggcaagttgcttaatctcttcgtgcctcaattttccatctataaagtgggaacacatgttacctacactgcatagggttttgtgaaccataaaggaaacaaggctttaaagcacctggcacagaatgagtgctttataaatgctagctattactattctcaaagagagatatccctgttggtgggaatacaagtgacgtcataaaaatctaataatctaggagagtattgaccaatagaaacacaatgtgagccacgtatgcaattctaaattttctaataggcacatttaaaaaggtaaaaaagaaatgggttacttttaataatttatctaacccaatacatctaaaatataatcatttcaacatgtaatcaacataaacattattaataagatgtttttacatgattttttcatactaagtttttgaaatctggtgtgtagtttacacttacaggactagccacatttccagtactccgtagccatgtgcggctaatgaccaccagattagatatggcaaatgggacctcaatggattactggattttccagattgttggactttattttttagagacatctcagccatcttgtttttactaaactggggaaaaaagactatatttatactaaactatttccttttcttaccaaatatcttagaatgcatatttgtaattcaaattactataatagccaaagcataatgaaaacctgtttctttactaaggaaaagacagatcacacatttaaaaatgaaaggttcacttgcaggagctctagcccctgcagcagcccaatcggttgaatggtccacgaagacatcgcctagcatcagcatccagccagcatcaccatgatcaggatgattctcagcaacgtcttcctctccggctgccctgggagtggctaaagttgaagcagcaggaaacagaggaatcttgaagaacgtcatctctgtggtcctgttaaatgtgtcgctgacacacgactgtttttgtgatgcttccttttcaaagaatttactccgaacaacatgcaggttcactgtatctgcatttacagagacactgacagacttagacaattcaacaaactgacaggatcaaccctccattaaaagtaaagcatttcttccatttttccagtgagaagacatcctctcctcaaaaaaaaagttttcgggcaactttaataaatacaattttaagtgtacagatgattgaattaggcaaaagtccacttatggtatctaatatacaatttaattacacatacattttaaaatcacgtttcataaaatattaattgaaaaatagagagtggttcagggcacagattctggatccagacggcctgaattcaaatctcagctcctccatttactgtaactcacttttgagagagttgacattctgggcctcagtttcctcctctttaaaataagggtgataataacatccagctcacagtgttgttgaagtattaaacgatgtaaaaacatgtaaagcccttagaacactgtccaggaagtggtatacacatgttaggttaaaagacatagtggtttattatccattcacatagactttagaacctctttattctttctttctttcttcctttcttttttgagatgaagttttgctttcgttgctcaggctggagggcaatggcgcagtctcagctcactgcaacctctgcctcccagacaacccctttattctaactcgtcaaatgcagcagtgtttgtcatcagaagaagcacttttttagttgaacgatgccagtctccatcactttcacttcccattacaccatttggaatataatactttttgaatctaggtatgatgtcacagaaaactgagtgtcaaggcaagcatctatgtggatattagcacagacaggttttcccatttatctggcagctgtatattctgatcaccaaaaggacatcatgttgcttttcaaagccattgttaggacattgttaggaaacttgttcataaccatcaccaacactcgtcattacttgctcatatcctccggaataattactaaacctgcgttcaatttccttgccttttctatcaattctgtgatccctgtaaacatcccaaactagcactgattggggtcactgcaggctaatgtagtttctacaattaattttgtagctccaagtacacgaaaaaccatcttataatatgagatgttttgtaagaacttttctcagagctgtttggagacaaagatcttgtcttttatttgggcacacagaaggcattctggcatttctttcttctcccacctctatctcttaggtgttagttgaataaaccatggttcattcacccaggagaatatcatgtagccttggaaggtgaaaactaactctgaatacagtggcataaaaagagatggatgacagaagagtttgggagctatgattctattcactgtctacactcctaagtggccacagtgcagctgtccagagcacagcctggaccctttccaagggcacgtcctgcctccaccatatgctaacgatgacctgggcaagtcattcaagttttctgtgcctaggtttcctgatctgtaaaatgcagataacagcatctacatcagaggactgttgcaaagattaaataagttactatatttcaagtacttaggatagtacctgacacatagtaagcactacataggtagtacgtctctattactattaccacatacagatactctctgtcttcctccttccctctctccatcctccttcactctctccctttctctctcaaaacacatcaatatgttaatggtgatatttaggctaactgtaatcagggtggagagaggtaacttatatgttcaaactcagcattttttaagaataaatatataatattttgtcattaaagaggaaagaaaaaaatgtactgactcaacaattgctaaatgggaacataagaacttacaactttaaaccaatcaataataatatcaggtgtgattaaggacacttaaaggcccatacttccatatgattttattgtaagcctcacattaaaggaagagtaggtcaatctgagaatagattacatctttccaagaggagccagttacatgtgtcacaagcagtgccacacattcatgagagtgtgccaggccccagagcgaaggaagggatcatccccagtgtctctttatttgcccgaaggatcctgggaccaacttcagagcagaagaacccagaccaatcaggacctgggaccaagtggcccatcctgaccaaagcctcgtcaagctcagagtcgggctcaagacatgaaagctacagatgccccaggtgccacgaaaatgccaaagcaagtggcagcccctttagggtcctcctgaaaccactttctcccaactttcccaacacgaataactttaacaataattcagttatttttaaataaccgccttccttattccaggccccatgcaggatacaaggaattcagcaacgagaggcagtccataccctgcagccactcacaggcctagtagggaatcagagacaacatgtgataaactcagctacagaagcatagtagagaggtaagcgctgtgaggggagtcagggagggcctcctggaggaggtgacatttgtgccggggtttgatttaggaggaaggaaaagtggagctgtgctcttagccttagggatcagcaagtacaaaggcacgacagtgtgacctgtagggtttgtggttgaaacaagagatatcaactatgactatcttttaaaaaatacgaagtttctggaatattgagaagctcataatgaacagaaagctgaaggatcaggcctgaaaaataagcagaaaaaaaagggagttctgggagatcaacaagcaagaagtccagcaactttgtagcacaaacaccatggccagacaccacccctactactgcacaccccaattctccagcctctggctgctggcccatccttcctagatgaaaagtcctgggcagcagggtccacctgctgcatccaggttacctattcagccacacccaggctgccaggaaatgatgagcagctggcatcttcacctctcagcgagctacacaatccactgagactcaacacaatgagagataccccaaatcaagaaacagggttggagactggactcccaaaacaataacacaaaggctgctctcgtgtgattacacagaaggggaaatgaaagagaaaagggcaggagggggcactgaggctcaagatacatgctggggtcgcatcatgagaaagttcaattattaataagagcaaatcatctaacaaacatttgccgctacctactaagccccagcattgcggttacaaatataaatacaatgttgttcctgcctacaagaaccgaagctagctctgtttatggcccgtgaacaagcttgcagttcatccaataaacatgagggagcccacacagctttttacagctagcatccacctggattgactagtgcttggaccattctattcgacaatatttccaacactattcttgctaaagcccagggagtacctaagctaagagctagaacaaggtgcaatcaggggaccatcgacagtgcctggcttgtgtttagtgcttcagaatttgcaaagcattttcccaaccatcaagtcatgggcaaatgtccaggactacatgtttgccatgtggatgatattccttctccagatgtcaaagataatacacaaccattctgttttgggtatataagggaatacagaaatatatacatatgaaaacaaattcgataacttctattggagatgagcacagagatgtatgtacaagaatactcaccgcaacatgattcaggagtaactggaaaggacttaaatatgcaacaatatggggtgatgaaataaatcgtggaacagtcattgcaatgggaaactatgaaacctttagaaaacatggttttatggaacatttaatgacatgggaaaatgctaaagaaaaaagtattaaatagcaaaatacatatttatgcaagtttgtgtgaacatatgactttcatttcattctttatagctatctctattgagcattttctcaacaatgaatacacattatttttgccatcataaatcatgactgcaagtagaaacaatttttaaagatgcttagttgacaacagtaccatgtctgcaatatatatttctctagcctggacatcaagcctgactcctcagccacataaaactcacatgaccttggaccagttgcttcacttctctgggactctgttttctcaaaaacaagtgacaatatctcgaactcatgggatggtgggacattagacaaaatgttgtacaggatgatgcctaacccacttcttagttagagtggacaagtagtaaatgccagctcccttagaagaaagcaacgctggccgggcgtggtggctgacacctgtaatcccagcactttgggaggccgaggtgggcggatcatgaggtcaggagattgagaccatcctggctaacatggtgaaaccccgtctctactaaaaatacagaaaaattagctgggcctggtggtggatgcctgtagtcccagctactcgagaggctgaggcaggagaatggcgtgaatctgggaggcggagcttgcagtgagccgagatcgtgctacagcactccagccctggcgaccgagcgagactccatctcaaaaaaacaaaacaaaacaaaaaaacagaagaaagcaaagcttccaatacttacagagctcgtgtggaaaaggtaacctgggtaggtgatggggtcagggtactgatgtgtaattgacctggttttagtttcctagaactgctattaaaaattaccatgagctgggtggcttaagacaacagaaacctattgtctcacagttctggaagctagaagtccaaaatcagggtattggcagggccacgttgtctccaaaagctctagagaagaacccgtcaacttgccttgcctgacttctggtttctgttgacaatcctcagcattccttgccttatggctgcattgccccaatctccactgccatctgcatgtggcctccttccctatgtgtgtatgtatctttgcctccacgagtcgtattgggttagaacccaatatgaccagcctgacctcatcctaatttgatcatttctataaatacttattttcaattaagtgtgacatttacagatatcaggggttaggacttcaacttatctttttaggagacaccattcaacccaaacagacctcaaccctccctttagacacatgagcagttagagcaaggcaggaacccacagggaaaggccccatggtgtgaaggaacaggccaggaccaccctggagacggtgctgcttccatgacatgctagttgggtgaaatgtgtgtgtgtgtgtgtgtgtgtgcgcgtgtgtgtgtgtgcatgtgcatgtgtgtcacctgtgtgtgtgttctcccaactcctcctccttccaatctggaaactcactaagctttttgtatttttctgctctagaaatgtgtgtaggaaaaatagaagaagctgcttgaaatcaaggcttccttccttcctcctttgttttttctaactctaaacttacttaagagagaatgctggggtctggaaggactgggccaagaagggtgtgcttttgaaggctaagatggtgaggagagaggttctcccattttacgaaggtgggaggtatggatctgctggtgccacactcctccgtggcagtacctgaggaggggcaggcccgggggggtttgtgggtggtgcacctgggctggctgggctgtgacaatggctcctagcctgagaaagcagcagcagaatcactagacctaaagggaatgcagcagtgggattcccagagaaaatcacaacagtctgctgaaaccccaggaaactcatagaaccctagggaagagggagctccaacagtgcctaaaatatagtctcagctccctggggactgagggtcagattcaggtttatgtaaagaagagaaataagtgagtatttcttatgtacctgattttgcaacctgatattcaaccctaatccataccttatgtttaaaagaatgtcctacaagtattcaaaggatatagaagcaagccacccaagccccactacctctggcttcagccctttccgaaggatacctccagcactcacatcttccttcagcccccaggatgccctcctgctgggccctgggctgtaattcagggctgtacctcagggatgacttgtggaaacccatgccaaagatggggaaggcagggctaggaactggtggtagctgtagttagttccataggcaggatagacagctagagagagggtttgtgagtgagtgtactaacccctgctcctctgtgacagcctcaataacgataaggtagtgaaaccaggtctgaagcctggaatgctagtgcaagagcttctcccatggacagagatgaggaaaagtctgtatttaggttgacacaaaagtagttgtggtttttgccattactttcaatggcaaataacagtaggtgtgtgtaacattcaattcacagaggtggggtggaggaaatgtctaagccctcgatgcagcaatgcatcctggacttgaaaagcctctctggcctgtcaggacccacagtagaacacctgctgagcagctcgcctttgtaaagcagcatcagtgagctagaagtgggggcaaggtctcaggtggacttggacttccagccccagagattgcaagaaccagaaaacatttagaaaaaccagcattgactaacccctactccaggcagacagttcacactcatgcagacatcctccatttaactctcacactggtccccaagataaagatgtggaaactgggagttgagaccctagggtcactcagctgttgtgtaagattggaatacactgacttgcaaacatgtctatgataacgattttgaaagcaaagaacaggatgttatgagtgagaataaggaggaagtccatctttagacagacggataagggaagattgccttgaggagtcctgtgagctgagacatgaagaaatcagcaaagcgccagatgcagtggctcatgcctgtaatcccagcactttgggaggccgaggcggaaggatcaactgaggtcaggaggtcgagaccagcctggtcaacgtggcaaaactccatctctactaaaaatacaaaagttagccaggcatggcgatgtgcgcctgtagtctcagctacttgggagtctgaggcatgagaatcacttgaacctgggaggtggaggctgcagtgagctgagataacgccacagcactccagcctgggcaacagagcgacactctgtctcaaaaaaaaaaaaaaaaaaaaaaaaagagagagagagacaaccaaagaacgaaagagaaatcaacaaagtgaagaattgagaaaacaaattctggtgagaaggaacaaggaacaatatgtgcaaaggacccgtgccaagaaagaatctgacacatctcaggaactaaaacacaccaggtatgagagaggagaagaaaaggggcccaaagaagacattggatcatgcaggatcttataggccatgacaaggatttcagatttcatcctatgtgccaggggaggccatcagcaggattaagtcccaaaatgacatggaatgagttacccagaccaagtatagcagggagctcgtcatacaaaggggatgggcaaaaagctgtggaacatctgaataaacagactcaaacttgacttccaagatgaggagaactgctggctttacagaaagaaaagcaagatttcagcctatgcccataagaagaacaaacagttttgcctaatccaaattcgctttcatgcctctctgcctaagaggcacacagagctgctgaaatccacaggcgcatcatgacagaataatttcagtgatcattatcaaatgcctctatttagaaaagcccagaagattgtattagcatgatccaatatttatgaaatgacaccctgccataatgaggggctgagaaaattaatattagaagcaaaagccatgtctttggggagagagagtagcatgagtaaaaagacacacttttactcagcttcttagaacttggttttctgatccgtaaaatgggaaggatagtagcaaagaggaaaatacatgatcagttagtaaagcacccaaaggcctttaatcttttttcattcattcctgtattaataaaaacacttaataaagactatttgcccatccacacatccatccaacaaattgctaatttagtacataggatgtctgatgtactgcattaggcactgaagataaagttatgaacaagattctcatggtccccattcacatagaacttctcatctgggagtaaaccatgcactggatgaataacacctgctgtgatgcgtgctactaaggacaagtgcaaggtgcaacgggaaccattacaaagaatgctgacccagactgagatatgaagaggacgcacaagacagtaggtaggggaaaggctccgtggaggatgccaatctcatgtgagttcccgaggcaggagagagtcagaacattctggcaattggcagaagccagtgtaaagtgagcagagtgggatgtggagcatgatgatgatttggaggtttagggaggatcagcactcagagctttggagaccacaacagggctttggtctttcctggagcaatgagaagcctcagaaagccttaagacagaagctgggtagagacaaggaagaaaagaagtaacatgaacatgcttatattctagaataatctcttcgacatctgtttggagaatggattaaagtccaaagagttaagtcaaggagtctgttagaaagttttccacttacccaggaaacagacaatggttgtgttcaccagggcagtggtggcagagatggagaggcttgggcagacccaaactatacttaggaagtaaaatggcagaacaaagtgattgattggaaaagtgggtaagagagagaaaaaagagaaacatggccccccggtttctgaatcagtaccagtagggtgaagtgagctttctggagacgaggaacagtggaaagtgagtagacagggaaggggaaatgggtaaatcaagagttcagttttggagatgttgagcttggagagcctacaacatgctacagggctttaagtggactaaagatgagcagaaagagcatatgtgaatacacacacacccatacacatgcatatgcacacaccgccatatacacacacccatacaaacacacggacacacacacacacctcccatacacccccatacacacacacccatacacccccatacactctcacacatacccatacacatgcacacacaccctccataaacgcacacccatacacacacaacccttacacccccatatgcacacacacacacccccatacacatagacacacacccccatagacatgcatacacacatacaccaatacacccccatacacacacacacacacacataccagtacacaggcatgcacacacaccacacccatacacccccatacacacacacacacgcatacacacacgtatacacactataagatccagatttattgggccactatcaaggagggccatgaagagtagagcagatgtgctatgtttaagcagaggtgtcttggattcttggggtccctaatgggatgggtgattctatcatgtaaaccaggcagtactttttaaagtcagcatgattgggcaacagacagaggttgttccacactgccttgctaataggcatgcacacctgttgatgactttgctcattcaaagtaaggtcccaccagatctgaaatgctcaattttgtaccacagcctaactttattacacctaaggcttgtatcaacacttttgagaaatttatacaattaatgcccttaataggagctatccataaccatccagtgcctcctgttttggagccagactcaaagtgaatgaggccacaccctcacctgggcatctctgagcatcttctttgctcccactttagtagcatcctggaaaaccccgttctccagaggtagccaagatgacatggcagctgggcagtgggttgtgtaggtgtaaaattcctgagacatctaggctggaggcataaatgtcagaatcaccagcacagaggcagtatctgaggccatgggagtggttgaggccaaccacagaaagaacacccagtaagcctgaagaactcttaatactccatggccagagtgcactgacaggggagactgagaaagagcacctgggggattggtgaaaaccaagacaggtgtgggttaaagtgagggagcctttggtcaagcagaaactgtagaaaatggcctcccttctccaacaagcagttgtctttacaactgcagcagggacatgtgattattcagaaaagtgagcttcactttctcagagtcacaactcttcctggcttctatcaccaggtaagcctcttcaagatgcaccttacgcaggtataccccacatttagagtctaagtgttctctctgagaagacctcctttgggtacttcccctgaaacatatcaggtgtacctcacaggcctgccccatgcaggtatccatcaagaattcacactaggccttcagcgctgctggttaaggacaaaaggttggtatttagaatgtcaggatgtttaccttataatacaatatataataataatataataatatataataataatatattatataataatatgaccttataaaaatctgtggaagtatccctaaatatatatataaattatataatatatatactatgtaacatatataatgtataatataatatataaccttataataatctgactgtagaagtctccctaagtatataaaatatatgtaaataatataacacacaataatagataataatatgataatatataacaataatataataatataattaatataaccttataatagtctgtactgttgaagtttccctaaatatatacaacctatgtccatgtggcctggaagaaaagcagcgaccgtaaattcttcagaagctctttccctgacacgccactgtcatcaggctcccaagcaaaacccagtgatacctacttgtagctaaagcttagaatctcgacgctaaaagaaatgctgaatccaggtgacatgtgactagtatcaaatcctgaagaattcattcagccttggtttgaccacctctgagtgtggggaactcactacctacagagctatcgattgccatctcagagagctcaatgtgtaagtaagttcttccccccatgattcacggtaaaaactagccatccccattacagccccaaacatgatggatcacatacctgtgggcactgcctggtccagcattggtttctcccatgtgttaatctgctcccaggtgaacccattggtccctagagccacactataaccacagttgctgtagtgctcatcaaaggaacagccacctgtagacaaaagagatatgggtaaatacattcccgtgtctgaggcttggttcgttacctctgtctcgtcggctcttcatttacagctttgaattttaaactctggagaagattttccatatatatatatatatatataaaagatgagcaaattggatttttatatttgctttggtgctctcaggaaaggcactggcatctgcaggcctccgtatttaaaaaagttaataaggctagttacattgatttcaatcttccttcctgagaaagtaaacagcagcgtctcattctaagtaggaaaaatgaatgcaggggcatgcctctgtaattgctttgtgcagcacggagagatgctgtgaggcagcggaaggagcactcacttcccagtctggcaaaactagacagccatcaccttcacaaggctgtgtgagctcaggccagatgcttcatacctgagcatctccgtttcctcacctatgatacggagggaaatgtccaacctcacagaaataccatgaggaataaatggaataacatgtgaaaagtaactgccacagaatactttctcagtgcccacctgtttctctgtaaaaagcagtctgaaaaatcatttttcatggagtgagaatcgaattggtaagaaattagacaatcatgcacctggaagataataaagtcaatgttgatcatgtttaaagcttctccctttaactttaaaggtcaagccatccaccatttgacaataagttatattcatttgctgttgacaaggattcactgagcatacgctctgagctgtaagtcccatcaaggtgacattgagagagatgtggggtgtacaatggaggctccaactaggaaacactggtctgtccagagaaatgagcccattatattctggaggagaaagcagaagtggaggagaagtgaacagggctttgaaggatgggagcatctccatgggcggagggcaggaggaatggcattctgagttgagcctgcagggtgcacaaatgcagggaggcagaactgggactgagttctacagcagcctcctggctggtctcccagacctgtttcacactccagtccatcttttccaatgtccctttcttgtctctttaatgttcacagggtgcatcacatcaccatcctcctcctttaaacgctcacaggtttcccaccccacagagaaccaatgtctgctatagattaaatgtgtgaatgcctgcaaaattcatgctgaagtttcaaaccccaaagtgatagtattaggacacatggcctttgggaggtgattaggacatgaaggcagactccacatgattgggactgggattgggaccagtgcccttataaagagaccccagagagctatctcgccccttccaccatgtgaggacacaaggagaaggtgccatcaaagaagcaggagctgggccctcaccagatgctgaatctgccaatgtctcgatcttatacttcctagtccccaggactgtgagaaatcaatttctgttgtttataagccactcagtcatggtattttgttatggcagcctaaattgactaagaaaataaacaaacatggctttattcagttcatcccacactagcccggccatgtgctcattaacatcacactattgtctccatcagctgcaaagaaccaaattctttctctgcaccccagacctgagatttcctctggatagtggtggtggacatcctgttgacagatctgacatagaatacagtccaaacaccatggaagaaaacctgtgatagaaaagctttctccactttcctttcttgttggatatggacacccagaagagctggccttcagcaactactatggtccaaatgtgcgtgttccccttaaattcatatgttgaagcctaatccccaatgtaatagtattaggtggagcctttgggagatgcttccaaaggactgtgagggctctgttctcagaaatgagatcgcacccttataaaagatgccctaggcaaatcgttcaccccttctgccatgtgcggactcatagaaggtgccatctataaggaagggacctttaccaagtaccaaatctgctatcaccttgatcttgaacttgccaacccccagaactatgagcaataactttctattttttaaataacccagtttaaggcattttgttataacagccgaaatggattaagacagcaccccactgagtatctctactctgtagaggaaagccacccagagactcgcctgaccaggaatatcagcattcaacttttcaggagcaaaatataaacttttcttgtcatatgccactgagatcttagggtttaactgttagcaccgtagagctttgtacaacctgactaatatataaagtgtgtcatacctcaacacagtgatccaaagaaagaaagaagaagcatattctcccaagcatttgctctgtgttgggcaacatattcgacaccgattacatatactatctcattagctgtcatgtaatcctcacaaaccacatgaggtacattttatctcaactttaaatctaagagaattgatgcactgaggggataaatgacctgctcaggcaacatggaaggaaagtgttggagccaatattaaatccatggcagcatagctgtagagcccatgcccatcctaatagaccagagagagaattattcccccaaaccaaggataaggtctttcacttataaggtaataagaggggccaggcagataaagaacttccaaggtggttgggcctctccattcaaatccattccttcacttattctagaaacattcaacaagtttttttaatgggctctggacatggcacagaattgacagatatgatccttaccctcacaaagtttgcagaatagagtgaaaggtaagcatgcaaatatacactgaagatgcaatggaaaatatgctttcttatgtatgtgttgatgctaaaaaaaacaagttattattttagttgatggtttaattaaccaaattctcttccttcttctagataagatttaagaaggctcacagctatacctctaggcatcccaggttacagatcccaggcaaggtcacattaacacttgcccctagtccgttggatccattgcccacccctcacctccctgcctctgcttaactgtaggtagacactcagctgatactgagctgactgctgacaggtcctggccctctgaggactagggatgtacctcctcttcacaggcactcactgaaccaccttgcttctcccctctgctgagctctgttggtcacttcaatctgcagcaggtaagcaaatgcttttcccttcttacagtctgctctttgaaactagggttccacagcagcaggccttggacctcagtgacccaatttttattttcaaaccacagtcctctctttgcctctgcagaagaactcacttagagtgaatttaaaagcagctttccactctatcttgagccactatttcttcagaatattcaggccccactgtcaattctattccactctgccaggatttgtcatcacttatgggatgacttatgcattcaggacagaaaatggggaccgtaaggtcactctggggaccttaatgtccctcctacagaagagtttctagaaatgggctcctgttctgcacttttatcactcatacatgtctgaatcccagcaatacacacagttcatgattcttccatggagcccttgggctcccagcaaagcagggaatttcaaggaatgctgcctaactggtcactggtccaaccaaagcagcaggttaaacatagaaggaggaaatactgcatgatgacaaaaatcaaattgaggacaggaaaagaaagaaaagcaggacagaaggagggagccacaaatctatgctgcgattttccacgtgttcctttactaaaagggggttacatatatagctctgagcttctgacacccaatagaaaaaaagcaaaacctggtaaggtactggacactctgtgtttttataataaaagccaaattgctcagggaaatgacaaccatttcaggtgctttgatcagacaagaatttctctgcaggaatactcataacagaaaccccatatcccataatgaaacaacatctgcacaaggggctgaatggccaatttcatgagactgtttctcatcatcattctcaatataaattgatagcatcacctaaacacacaattcagtaaaagctcattggggcccaacgcaatgcagtctggatacccactccctattggtctgacttgactcaaaggtaagttttaagaactattcaggggagatttttaggcaacttttatgagttttctgtctcccacattgagaaacagagtggctatgaactcaagactacataacccaatagcaactgacactgacatctgggtacaacctgttgggctcatatcccttccctgtttctgagccttcattttctgctgtgcaaggcaaagggctgaacaagatgattgcaatgaaccttccacttgtaacatttaagaaatccagagattcagaaagaactggaactctcagaaaccacagagatacagacccatgcagtcagcacaagtacaggctagggtgtcctgccactgagagccaccaagaggaggaggagaaattaaagccaagcttcccctggaccgagaacagaaaacatttaaacccagtaacatctatctgtcttggagcaattcctagtggccataaccaaaacaggccccagacgttgctgcaggtgtttatggcagcttaggggagatttatggttccagagagtccctgatacagtttggctgtgtccccactcaaatctcatcctgaattgtagctcccataattcccatgtgttgtgggagggacctggtgggagataattgaatcataggggtggtttcccccatactgttctcctggtagtaagtctcgcaagatctgatgatttttaaggggtttcccctttcgcttggctctcattctttcttgtctgccaccatgtaagatgtgcctttcaccttccaccatgattgtgccgcctccccagccacatggaactgtgaatccactaaacctgtttctttataaattacccagtcttggctatgtctttatcagcagtgtgaaaacggactaatacagtccccaaagacactcatctggatgctaacctcattcaggtttgaagagcagatgacatcatttaagtgatctcgacctcaccacaatcatttttgggaggaaggaaacccaaaaaatctacccccatcccaggagctgggctcagctgaggtttggtgaagatccacataattgggggaggacagggaagtgcagccactggccaaggacccagcacctccccagaggagctatttccctgggcaggctgaggtcaaaatgtggcaatggccccagatgctctgatgtgaatcagacataaaaagtcaacagagaaatggaaaactgtagcaaggaaattggattttgaaaatccatttgggtttggtagtgtatagcatatcagcatctgtaagggaagtaaaaatagtgcaggatacatactttaggatacattaaagcataaataaagtttatagtgtcaatcagaatttttttaaaaaacatgagctcttcttttgaaaatgagagaggaatagaattcaataaaaatataaatgtgtcttcctctgcatttcttagatatgatcctgtgtattcttgagctgaattaagttttgtagaggaactaaaagattcgttgggctcccactgtgtgccaggcactgtatttgaactatgtaggtgtatgtgtatatctgtatatatattaacgtagatgtaggtgactcaaacaccaccactctctaagacaggagtcatcaaacattttccataaaagactagacagtaaatattttcagctctgtagtcacacagcctctgtcacaactactcagttctaccactgcagtgcaaaaatatgtaaataaatgagtgtggctgtgttccaataaaactttatttgcaagaggtgacagcctagatttgcccaggggctatagtttgccaacccttgctctaagaaagaagtattgctttcttctttgtataaatgaaaacttgtcatcagagctcctaaggaacttacccagcgagggaaaaacaatgacatcatgtacagcagtactaatagcaacacctccttttattcacagttgaatgtaatggaggctttacctacagtatctaaccctcaccacaagccctgccattttgattgtaccattttatagatgatgtatcaaactcacccacatgaaggaatggagccaagatgtgagccctagactggatggtaccaaagcctgggtactttccattgctccaacccagcattcttttgaacactctgtgtgttcacagaatctggtctcaccatgatgcttccagaatagaaagatgttcttttaatatccagcagtggagctaagtaaaaaaaaaaaaaagaaaactgggctaaacctaaaaaaggtggaaaattgcctttacttgccctccgtggtaggcactacttttggtagagctcatcattttgatgaacgtggctggagattaaggtgatctgccatggatgaggatacgcagaaacacctgctccctgatccatagctggtgctgaaagtcctagtagctcactccacatacattctcatgattcttgggggagacgtcagcactggggaccctggggtgggggaagggactgagaccacaggactgcgtccctccaactaaagctccatagcaacagggacatgccacaagggtctctttcctcagagtctgtcccatagtatatgcttgcactttattgttcagtgaatgcctgaatatattaaaaaggacctccattcacgtagaggagccaggctggggcccacagagaaagctctcatccactgtcattgggcttctcctgggggccacggtgaacccaggggaggccttgcaggggagtaagagcgaagaactcagaaatcaggctgggacctttaagaaactaccatcagagtgaacaggcaacctacaaaatgggagaaaattttcgcaacctactcatctgacaaagggctaatatccagaatctacaatgaactcaaacaaatttacaagaaaaaaacaaccccatcacaaagtggccaaaggatatgaacagacacttctcaaaagaagacgtttatgcagccaaaagacacatgaaaaaatgctcatcatcactggccatcagagaaatgcaaatcaaaaccacaatgagataccatctcataccagttagaatggctatcattaaaaagtcaggaaataacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcagcactattcacaatagcaaagacttggaaccaacccaaatgtccaacaacgatagactggattaaggaaatgtggcacatatacaccatggaatactatgcagccataaaaaatgatgagttcatgtcctttgtagggacatggatgaaattggaaatcatcattctcagtaaactatcgcaaggacaaaaaaccaaacaccacatgttctcactcatagatgggaattgaacaatgagaacacatggacacaggaaggggaacatcacactctggggactgttgtggggtggggggagtggggagggatagcattaggagatatacctaatgctaaatgacgagttaatgggtgccacacacctgcatggcatatgtatacatatgtaacaaacctgcacattgtgcacatgtaccctaaaacttaaggtataataataataaaaaattaaaaattaaaaaattaaaaaaaaaagaacatttgctctgatcacatgaagggccaaaacagatggagattctgaatccgagaaagaagggaagtccaaggttgatctaaggaagcgccataaggccaccaggaaatggagaagagtaagttgagaccacggacaggtggagaagtcattcaaggagaaatgagagtatttgcgagaggaccagaatgacagctgagactgctaaggagtaaactgtgagctgagcttgataacggtttgcaaggaccaagtaatcacaatgcaaggtcaaagagacggggacagaaagctgctgagcagacacagatcccaactagatctgagagatagtcaagataaccatgtccagtgcccagcactgttctcagtgttcaccagtagtaactcatttaattatcccaatcaccccacgagatggatatgatcattaaccccaattttatagacaaagaaatgaaggcatagaaaggttaaaaaaaaaaactatcccaagatcacacaaataacaggtggcaaagcgtggctttgaacccagactagctcagtctatgtacctactcattatactaggttgccatggtgatgaactgaaaagataaccttgacctcgaaaggaacctgttgagggaaataagtggctgcacagttcttccccaatccctgtaaaatggcattcagccagtctgcatgccttctgcccccattcactgcccaggcccaggatgccaatctgcacttctggaggaccaggcatagggggtaggctctgccccttcacctcataacggaggccatagtgttatagggaggagaagaaatggagtagggggcttaaagtcaggaaggcaggcacatgcagagaacagggggtggtgtgggcctcacatagtaatcgctggtatgtgaagagctcacacatgtgagctgttcagacagattcaagatgtagcaagaataaatggttacagggcacagaaaaataatgtggtcaaagcagttattttttaactggggggttgttaaactttttctataaaaggctagatagtaaatattttcagctttgcaggttgtattagcctgctagggctgctgtaaaaaaatgccacaaactgtgtgacttaaacaatagacatttatttttacacagttctggaggccaggaatctcagaccaaagttgggcagggtcaggtgagggcttgcttcctggctggcagatggccgccttctcactgtgtcctcacacagcctttccttggtgcctgtgtactctgatgcatcttcccagcccaatggaactaaggtctcatgcatataacctcatttaaccttcttataggccttgtctccaaacacagtcacatggggagacatcgcaaaattccttcacctttgtcattcactaagataagctaatcaagacagtgaaatccatcacatgcacagtccacgcaaggagtgggaagtactcaggatgtgtaccccagaggccaggaatcttgggggctgtcttagaatcccacccatcacagggggccacatgttccctgtcactagtactcaacaatgttattgttgtacagaaacaatacaaaaagaatgggcatgactgtgttctaataagactttatttattagcactgcatgttgcatttcatatgattttcacatgtcccaaaatagtattcttcttttgattcctaaccatttaaaaatgtaaaaaccattccttatttgtgggctatataaaaaccagtgaacactcagatttggctggtaggctatagctggctgacttctctttaacgacataaaaattcccagttttagcagtcactgaattttaatacagtcccgtgtattgccatttgaatgtatgccatgtgctactgaccctctcctccaaagactcgattgcagaatgtttcttcccgtctctgggaactggagggaggaacacgtctcccattgtctgctagccctacggataagggattgagtaaagaacactagctctttagatttaattaaacacttcatctacactacaagcttgtgttcttcattggtaaggagtagtacttccactttatagataaggaaactgaggcaggagtggatgatgcactcagcgtcagatcagggactgagccaagactccaatcatgggtttgtttcttggccagaaggtctgacaaccaaggcgacctccaagataggtccacctacaaaatttggagcgccccttgcaagactaaaatgcagagtctcttcttcaaaattaagaaatcaagatggtgccaggcgcgatggctcatgcctgtaatcccagcactttgggaggcctaggcgggtggatctcctgaggctggagtttgagaccagcctggccaacatggtgaaatcccgtcttcactaaaaatacaaaattagccaggcgtggtggcgcatgcctgtaattccagctactcgggaggctgacacaggagaatcgcttgaacctgggaggcggaggttgtggtgagccgagatcatgccattgcactccaatctaagcaacatgagcacaactccgtctcaaaaaaaaaaaaaaaaaaaatagaaatcaagatggtgatagcagagcattaaaccaagcacgggctcttctcttctgagttccagggcctgtatgactcagtgcccttgaagccaatcctgctctgtggacacatattccaaagataaaatacctcaacccccaaatcatggagattccaccctcgtgccaacaaatgctttgaaggcagggtaatatctaagtggggcttattaattgtgaacaccctatcgtgggtagctgattcttgcccccggaatgaatgtaaaccagccttccataaattgaattccttttctgaatatataattgaatttggagaagtgtgtgccgggggggtgtttaaataagtgcacaaatatggtaagaaggccttcacaccattacatctaattcagtaagcaaaaataatggcagggcacgttccaattagtgtttgatttatttgctttaacaaatccaattagtagaatgttttataaagtcatccaatgtcatacattcatggactcaacagatacaaacaatactcctaatataaaaaaaagttttaaagctctttgagcagtgaatttattataaataagatgatgtctctctgatggctcgagcattccccaaggaccaagaaaacagtgtctgatctgttcatttggttctttttctgtgagactttgtgcagcaactcaggttaatgtggcccattatattaaatccaggaatgaaaacaacaaaggtggaagttagccaaggaacttcaagggagaataatgaacttgctgctgggtgtcttctagatcagagacgtgtttcgacttccaaggcagcacagtacagtgggaaaagcccaggggtaacagaaacggcggtgccctagaaccaaatctgatgccttcatgcccttttgggtctccagttttctcacatattaaataaagagttcaatgaggttaagcagcccccagaaatgcccaccttgggtggtggatgatgttctttgcccagggagacacagaacaaggtagcagttaaagctatgaactccagagccagcatctaagctctgctatttttttttacttagttatatgaccttggccaacttatgtaacttctatgtgcttcatttctccatctgtaaaactaggataatagtgcctaactcttaaggctgttatgaggattgggtaatttaatatttgtaaacacttggaatagtacctggcacgtagtcagtgccaagttgtgtgttaaattaatatttaatcccaatctataaattagaaatggaaaaggcagatgtattacatgtggtcagctggcataatctcaccaaacaaacaaaatgttttaaagaaactgtatctgagtctgcccatcatatcccttatagatcatcagggctaattgtggtatgctattggtctgcatgggaaatcccagcttctgtcaccccttactactgtgtgactttgaataagtcatgtagactctagggccagcatttctccatgtgtgacagaagcagcaagttgaaccctctccgagaacctttttgttgctgttgttaagagacggggtcttgctctgtcacccaggctggagtgcagtgtcatatcatagctcacttgaagcctggaactcctgggctcaagcaatcctcctgtgccagcctcccaagtagctaggactacaggcatgtaccaccaaacttggctaatttttaaattttttgtagagatgggttcttcctatgtgctcaggctggtctcaaactgctggccctaagtgatcctccctcctgggccttccaaagcactgggattataggcactgtcccccaccttctaagaatcctttgacttctgacatcctatgggactacaattatgtcctcccttcatggtacctagctacatttgctgggacacaaaaagtaccaagagttccctgaaaataagagcctctgttcagaccatcttctctacatggtctgctatgggcctctgcctggtgcatttgtacattatgaaaaaagaacatcatggggtatggcaagcagattctgtcttctcacgggccccagccttcccaggcaccagtttgtgagcagacactgtgagatgcactgtgaccaaggagaaagtgcgatgaaagaaggaggccctctgttgggtcagcgccagcctcaacctgccgaggagaggctgagagaacagggggagagaacagtcaccttcagttgaaacgagtgaagatgcttcaagttggaggccagctggagagtccaaccagcctgaaaagtggtcccgcccaacccagtgagtcttctttcccaaaaacagcatgggagcagatgcagggattccaatgctctatcaaatttaaagagagaagggacggtctggcccagctgctaattttacaggtggacaaacaggcataaaaagggcaaggctacaaagaaagggggccccagcccagagctctgcccactcagatgccagaatagcatctttcatcttttctcacgcaacagtgctatcttttccatttttattttgagggagcagcgaaagaaacagatggccatgggtcatcccccgtctcagagaaacttcagatcagtcgggaaaaggtgaggaaaggttttctcgacacagaaggacaggcttaaactggttcctggcagctgtgtcagcgtctgaagcctgcagaagcccaagccaagctcttcacggtctcagggtcttggcacttgctgttcccccatggaacactcttgccctagcacgtgatgtggctgtctctgggcatcttccacatcaaaaatcaaatgcaaaacagcctcctcccttcttcagtcattctctatcataccaccttgtttatgcttgacgaggctgtttctcaaacgctttagttacattctaaaattgtttatttactcatttacttattttctgtcttcccactaccagcctaagtctaccagggcaggaagtgtgcatcccttttattcactagactcatcaaagagcctagtactttaactcttgagagcttgagggaaactctttaaatgctcatgaatgaatgaatgaaatagaatatgatgaagtgtcagaagcacaagatttggtatcagaggatgatgcatggcttggttatggcactttctttgtgactttggatgagtcagaagaaaatttctgagcctccacttcctcatctttaaaatgggaacaataatgatagcagcttgcatgtactgggaactatgtgctatgcaccgtgctagtccatttccatggattacctcattcaatcctcaaaagagccccatgagttaggtactgtcactatccacactttatgcaagatgaaaccaagagttaaataacatcacccaaatatcacagctgggaaatggccagagatattccgcaaagcattgcaacaggcaaattgccctgtaaatccatcaaagtgggggtgaggtcacattctgagagtcacagactagcaggtggtagaagaaaattctgagattggttcatctcaaagcccagcttggctcaagctaagttatattcacagagccagggggctaaacccaggtccttcccattcagtcaggtgtgtgtgaggccccttcctcagtaataagttataatcagctgtcttcaggtgctatctcttgagtggtccctgatggtgagcaggcagagactcctagcaaacatggatgcctggcttgtccccggtatgaatgcccaagtcctgtcatctctctacccctttccagcacttcctttcatcacagccacatccttgagttctgactggctaaaatcttgcttcagttcaccatgtcccccatcacacttcattcccgtagcatcaaaagtggtaatgccacccagagcccatatcacatagaagacaggagatgaaatctgcatggtgggccctcctcagtttcttcatccatgaaatgtggataataatagtacattgttgggagaaaagctgagtgttgggagaagctgaggcagggcttgcatgtctgacatactgtaaaagagtcttggaacatgtccggggtccagggtctaaaacccctcgtggcctttggaacaccaagctctgtgctaaagggtagaagcctaccctgaagcaccataacctaagcccagggcataaaacccctcgtggcttggaaagaatccagggctcaaggcataaaacccctcgtggcctctggaatgtgtctagacttgctggctccttgctctcccaggactgattgtatcttgagttaaaagaacctgctctccactatctcaagcagcagaacatgttccatatgctgcaaaggaaatgctaagccgtcacagctgtagatcatgcacttgccctttcgacccccacattctcaacacctgtttctctgtttgatcaccaataaatagtctgggcttccagagcttggggtctttgcagcctccatacttgcgttggccccctggacacactttctctctcaaactgtcttttctcattcctctgactccaccggacttcatcaccctcacgacctggtgttgggtctgtccaccccaaaagtacattcctgataagctgtcatgaggattaaataacatgtaagacagcacagtgcctggcacatagcaagctctcaacaaacattagtaattattactcccatcacagaatgtcatacacacacacacacccttctttataaacataaatttaaaagaagaaatgaaacacttgtgtatgtccacactgataaatttctacacttagatactcaatgacatatacttaacacccgcaatcccatacctgtctctgtggaagctcctggcacgtcccccacggtctctgtcttgtttagggaaccagtttgtgtcttctgttctggcttgccacgattgctagaatacatcgacttgaccacagtggtagcacagttctgtgtaagaaacaccaaccccacaagacccccatgggctgcttcatgccccctcctctctgggtgtcactcctcctgccccattaaggaaaggaagcagaaaaataaatagagaaaccaatgtctttctccaaatcaggaagttttaacacagagtacagcaaagtatgacctatgaactagaaacctagcctgcctcctgtttgtgtaaataaagttttattgaaacacagccatgtttatttgcctacatatcatctacggctgcttcccagctacagcagcagagttgagtagctgtgatggagaccacatggtctgtaaagactgaaatatttactatctagcctttgatggaaaaagtttactcattcttccttccaaaggcctgaaggcaatctaatagctgtcacccagggcatgcaggaaaccaggagatggatgacggcagcttatttttgctagtcccaaaagttgctaccactacaggaacatctggctttctaaaaacctcttcttctgaaagtgacttatttttaacatacaatttttttcagaggaaacaaaaaaaggaaaagaactaaggtccagagcctctgttggcaggcctcccccagcaagttccacttcctggaacagtgagtacactgtcctgatggctcaaggtcagtagagtcacatggtccacacatggctctctgtggaactctggagtgccctttgaccccactccacatctcagctccattagtgacctggcttaaagcagctcaggagagacagaagccaggtgctcccaccttggcccagtgaggatcagagggaggagaagacaccggtaatccccagaagagaacatcctgatgtcatgcaaagctttctcaagttctaccctgggaaaatcagcctttggtgcccactcaataatccggaaccattagatgccaggtactttccaaccactgccttattttgtccttagagaagccctgtgagttgttctttaggattcaagacaagattttgcaaaattggaacctgaggctcagagaggttaagtcacttctgcaaggctgcacagcttataaaggacagagtcgggattagaattactttcaacttgatcccaaagcacaaacctgctcaactttatgataatgtctcttgcatgaaattcccactcctccttattaccctcgctgaatttattcaacccatatctggatttcattcattaatgctagatcaagtgtctggtgtatgctagacattattctagctatcagggataaagcagtgattgaaagctatgacctctttctccatggagctcacatactagtaggggagatcaacaatgaaaacagggagagaagtaaagcaggtaaggggcccatctcggctcttgacatgacataatgccttgaagatgttaggcatgcaataaacatgtgcctaaggtgggtatggaaatggatccttattgagcagctaatctttgctaggcatcaggccagacattccatgtaatcttacttaatcttaacaaccatcttgtaatccaagaattaatcatcaccattttaaagataaataaactgaaaatccagcaagttaagaatccaatccatattccctacagttgtggattctgactgttttccttctccaaaagccatcatctttctgctgcaaaatgctatgcatgcagaagcccaaggaacatttaggactggctgacagatattggtttatgtacccagtttttataagtatattaacatttaattacatcaagtaaagactagggttccatacagtcaattaaactcgataatagcatccggcgttctataaatcaccaaactggtaattgtgtagataaaatattattgcggtctgagtattatcataagtacagttggttgtcagaagtcctctcaaaacagtgaagctttggcaatttagtctgtagttgccagttggactccgtgtaccttggccgttaagtgtgcattaattgtaggatggaaggtttttaaggacagaatacaaagaagcctcaactaagctaaagctgaaattatttggataccaagattgggtcaagccaaagggaatggtggattcagcatgttttgagatcacaaggatggtgatggtgtcttgggtagatgtaattacagctgaactagcacgtcacccagttaaatcagcaagccttctgctcttcctctctaatgttgacactttgtttccctggataggtgaatctcaccaagaaggaagtgtacacaaaggagaagcaggcactctcctagcaattacaggaagtggtctttgatgaatttcaaagagagatggtagggcagtcactaaggttcctaagcaaaaaaacagaccatctacctcaaagctgtctcatctctacctctctgatgcccgggagttcatgtgcatccaggatacataaacatgtttctcctctttggaacaagcactcagcaacttccagctctacgcacatttttttttaatctgcaaaggaccaatgcagatgatcctatgagagcagcctctgccaacctcactccacctcaggctaaaactctttgaaacagaagtgaacttctaacgaagctgcaacttgctaaatcacatagtaactcggggcctgacaggacaccacaggcaggtggtcttgaagattgaggatttgcctgagagaaaggagtcctgcatcaaagacttggctcttcctccagctggttgcatgaccttggctgagtcactttctgtttaaaatggatctggctggaagctcttgacagtctaccacagtaccaaggcaatgcccataacaacagtggaagaggtgaaaaccttccacagaattgaaaacaaggtcttgatacgggaagggggcagggaagtgctgggaagagaagggtgggtccctggctagggctccaccccatggacctaggtgaggacaggcatttctgttttcatgcccaaatgttgcacttcccaagaccaccctggcccaccacacccccatcctgtgcctataaaaaccccgagactccagaaataacaccacacatctacaaccatctgatctttgacaaacctgacagaaacaagaaatggggaaaggatcccctatttaataaatggtgctgggaaaactggctagccatatgtagaaagctgaaactggatcccttccttacatcttatacaaaaattaattcaagatggattaaagacttaaatgttagacctaaaaccataaaaaccctagaagaaaacctaggcaataccattcaggacataggcatgggcaaggacttcatgactgaaacaccaaaagcaatggcaacaaaagccaaaatagacaaatgggatctaattaaactaaagagcttctggacagcaaaagaaactaccatcagagtgaacaggcacctacagaatgggagaaaattttcacaatctacccatctgacaaagggctaatatccagaatctaaaaagaactcaaacaaatttacaagaaaataacaaacaaccccatcaaaaagtggccaaaggatatggccagacacttatcaaaagaagacatctatgcagccaacagacacatgaaaaaatgctcatcatcactggtcatcagagaaatgcaaatcaaaaccacaatgacataccatctcacaccagttagaatggccatcattaaaaagtcgggaaacaacagatgccggagaggatgtggagaaataggaacacttttacactgttggtgggagtgtaaattagttcaaccattgtggaagacagtgtggcgattcctcaaggatctagaactagaaataccatttgacccagccatcccattactgggtacatacccagaggattataaatcatgctactataaagacacatgcacacatatgtttattgtggcactattcgcaatagcaaagacttgaaaccaacccaaatgtccatcaatgatagactggattaagaaactgtggcacatatacaccatggaatactatgcagccataaaaaaggatgagttcatgtcctttgtagggtcatggatgaagctagaaaccatcattctcagcaaattaacacaggaacagaaaaccaaacaccgcatactctcactcataggtgggaattgaacaatgagatcatttggacacagagcagggaacatcacacactggggcctgtcggggggtagggggctgggggagggacagcattaggagaaatacctaatgtaaatgatgagttgatgggtgcagcaaaccaacaaggcacatgtatacctatgtatcgaacctgcacgttgtgcacatacttaaagtatatatatataaaaaaaagaaccaaaacaaaaacaaaaacccgagaccacagcaggcagaaacacacaagctgctggacgtccagaggaacacatcagcagaagaacccacaagcgtctggacatcaagaggaacacatcagaggaagaagacacaagtagctggacgtcaaaaggagcatgctggcagaagaccacactggcagacaccagcagatgctggaggctgaccgtcaaaatgacacagaatttggccggggcggtcagaggggagcacagccgctgagtggcccggctccagggggaaagccacgttcccactccatctccctcatggctccctcatctgctgaaagctacttccactcaataaaaccttgcactttttctccaagcccacatgtgatccgattcttccagtatatcaaggcaagaaactctcaggatacagaaagccctctgtccttgcaataaggcagggggtctagttgagctgactaacacaagccacctacagatggctaaactaaaagagcacatgcccactgaggcttcagttgtaaacattcatccctagatgctgctgtgagaccagagccctacagcctacccatctgcatgcttccctagaggtttgagcagcagggcactgaagaagtgagccacacccccatcacacaccctgtgagggggacaggggaacttttcccgtttcagtctcacaataaaactattcacctgcatctggaggaaactaaaatggattttaaaatgcaaatgacagactacctctgttacactcttgttctaatctggaaaaaaaaaaatgtgaaacctcatctgcctggaattaactagataaaccatgtgtttcctccatactgtcaacccccaagttcaaaattaccgcatctaacaaagagcacaccatgtcacaggccccctaatataacacctggtttaggcaccgggagtctctctcttccttacaacctactacctacagtcagaaaatgtaacagtgaggggaaaaaataagaattattatgagtaaatgaaaaaaatgaatacagtaggaaagaaaaagaaatcatcataaacatttaaaaagaagacctctgaaaatgatccactgaaagaacccgaagaacgctttaaatagtgtgaagtgtcctaaataggagacaaagagatgcagccctttgtgaaacaagaagagaaagccacacagagaccccaataacctgaaaaaacaatcggattaggagacagatccgtgtgttcataaaggatctcagggaaagtaaaaatgcaaaaagcagaatccatatcagtgtatcaaaccctccaacctcaacgttgactggaatgaagaaaaggaagcaaaagtaacaaagaaaccacaaacattgaagtttttttttaatgtttttctcattgacttggaggacgcgacacaatttgggcccacccaaaatgccacgaatttatacactacacaactcgttcttaacagagttgtacagtatgagatgaagtggaggaatttcggaaaacccagcagtatccgccagctggcatgtcaggggccgtggcgtgagagagctacaaaaaagatgaaggatgctcaacctgggtgtccttcagcctcttgcatcaacagtacttgaagtcattagtttgttattgtccttgtttcccatctaattcagatctctcagaggccctgggaacttctctcatccaggagagccccataactggaagggtacaagtgggggcagagtgaaaatagtaagaaatggcaaaatgattttccaggtgccccaaaacagcccaccaaacagaaataaaccatcatgattgtgcaactttcctccaggggctgacacaccctgaagccaatgaaagagaagttcctgggtaccccaccaagcataagaacccttcgggaagaggtaacagtctgaaagtcggtgaagtactggtggcagagtagccccccatgtcttctagggctccagccattaggagctgcaactgcgctaaggcagaaagaagcaaagctcacatcccaaacacgacccaccgggaaggcagcaagagaacgggggataagcatcttgaagacactgatgtccagcccacgaccatgtgaccttggacaagtcacttaacctctcccagtttcaatttcctcatctaagaagataataataatagccacccagaagcacgtctgaatttttatagcccgaatcttaaacaccttagggagggagcattctttaaggaaaatagtacaaacttagaaaagagactatctgacatgagaaaataattcacaacaaataataaattcctaacaaccagcaaataccacaaacactgtacaatccagaaaaataatatttttataaattatctttctaacaatattctcccctacatttctggacatattttctgggatgatctctttatgacaataattttgcaatatcattttttatagagagactagaaacttcagtgtcccctctagcaggttaatatttattattattaatatttttaaagtctccttcaagttcacaagtcattgtttatatagagtcatgtaaactttaaggctgtggtcaagtttggagaaatctctatcaaatttctttcatgtgtatgctatactatttcagggtattataagtgtgattgtccactgagtaatcaaatagtctttgaattcatgacattaggcatatttatggaagccatttccacactagggtagctagtattggtttaattatacacaaggaaatacaggatggtgccagggctcatgtttataatcccagcactttgagaggccaaggcaggagaatcacttgaggccaggagttagagaccagcctgggcaacatagcagatcccatctataaacaaaataaaaaattagctgggagtggtggcatgtacctgtagtcccagccacttgggaagctgaggtggaaggatcacttgaacccaggagtttgaggcctcagtgagcgatgatcttgccactgcacttcagtctgggcgacagagcaagaccctgtctctaaaagtaagtaaatacatacatatatacatacatacataaaagagaaatatctatgtgtgtatgtatcctatcatctatcattgctctattgatctagctatctatattctattaacccaagcttgacttcaacttctgcttacccagatttctaaaatgccctgcatactccaaaactgccacctcccacccctcacccctaaaaggacattatgatgaaggggaagttggagtggaatcataatagtcttcgccaattgtggttaaaattatcttacttctaatcattttataaaatatacaactatctgaacatattgcacacagcccttcctcgggccttggaagggtaacacaatggggatagactgtgaagcttaagcttcgtagctccacaggtacagggctttgaaattctcccacagatacacaagagggtgtggcatgtgcctggctctggcagtgatggatgtcctcatctgtagccatgccacatgtctgatggaggcacctgagacccatccagcatttaccaacctctactgcacctgtaaagctgtgtgtctcacctttctaacatcagacctcaggcaggagatgggctgggccttgggggaccagatcaccattattcacttgctttcacacaagcatgttggatttcaccttggggagaaaaaacattcaacaaccgggccagaaaacactgctattgtcgacagctctagcaaaacactgtaattcagacttttcctagtttgttaaaatttgctgatgccaatcggtatttcagagtctcgttaattttctcattactctcctattcttttctccctagcagcttcttccacgcctcaatcacacctttgaatcttttacagggacaccataaagctggttactttatccccttccatccctgcagcttgtttggctgcagatatatttcacatgaagccccaggccacatcagatgacagcccaaaccgcagcccccaaagaccatccagaaatcctgctgcacgcttgggagttcaaaactgttttgattcggattcacaagaatcaccctgatttcctcctatgagtttttacataaatttctcaccgcagcttctctacaaccctggaaggctcctccaggcaagccctgagaatagagctgtgccgcggttggccatatccatgtaccaggaatttgttgggaaacagcaaccagctcagtggtagaatcaatgaaaatttttatatcctcctttatcatttcctattttggggggaaaaactatgtaagatagggaaactctgttgtctagccattactgaaatcttaggagaaatgatgttgacaggatgagcttaaaggaaattcattccactggacttcccccaagtaatcgacagctggctatggggtcaaactaaacagatcactgagagtcacatacttgatctcagccatacattgctgtgagcctctagggaacccctttttctccacgcagccttggtgcccacaagagcatcataagagacaaacacacaaaataagggtgaaatcaaggttgaggtgattacggaacacaaaatcttctttgaaatgactttcaaaagaacattgtattagtctgtttttatactgctataaagaactgcccaagaatgggtaatttataaaggacagaggtttaatggactcacaattcagcatggctggggaggcctcaaaaaacttataatcatggtggaaggcaaagaggaaacaaggcaccttcttcacaaggcagcaggaaggagaagtgccgagcaatgaggggaagagccccttataaaaccatcagatctcgtgagaacttgctcactatcaggagagcagcatgggggaaactgcccccatgattcaattacctccacctggtctctcccttgacacatggggattatggggattataagatgagatttgggtgaggtcacaaagcctaaccataggaaacactttttttttaaatcatggtgactctcttaagaatctaatatatttatcttatatgctttgtgtgtcttagtacacacacagacagacaaagacacatacaacctcatagaatttcttagaggaattcaagtaagatgccaaacatgtagaaccaagaaaaacgtctggcacattttaagagctaaatatatactagctattattattattaggaatacagtacctataaaatgtattcataatttaacaacacacattttaacaagccataactattgacagatattaactagtaattattctgattaccctaaagtgacaaatactccaaatgcctactggcaccagtgcatttgacagcattgcattttttggtgtagttaacatctggaaaatgtatacattatctaggggcatcctccatatatttatttatatataaatctatgcacatgaatctgtatgcatgcatatgtcaggtttattcatttcaatctaattgcaaaaataacacatttttctccaaataatttgaggaaaatttaaaaacacaatcccctctaaaccgcatttttccaggagttgccactgttcatactgtgatctatggcttttgagactttttttccaacaacagatatgcacatatattttccaaagaacatttggaaccagaatgaacataaatctttgcaacctgcttttaaagtacattacagtatcagaaatattttcctagtttactaaatgttcttctaaaacccaattttaatggttgccatcctgcatgctgttaatttactaacccaaatcctcttttcttttttttttttttttttgctttcaaattttactacttataaggcaaggtaataaaccctaggaaatatccacatttatttccttgggataagattctaaaagctgcacttctaaggtcaaagggcaagcacaaattatatatacagtcaaaccatcttccaggacagttgttgcaattaacactactatctgcaatgtataagactgttcattttccttgcatcctcactagtactaagtatcatcactgtttttaatcattgtcatttgtcattttaattggtgaactgcagaggcccattagtttaattttaacttatttgaatattaggtgaggttgaatgttttttataagttcaactggccatttggcatttcctcatttgtaaactgcctggttatgcccttcactcattttatgattggactatttatccattctaatttgtaagtgttcttaatttagtaaacacattaacttattatctacattttcagttataaacatttctctagtttcttttaacctcttaattatttttggtacatgtacattgttgagtataaatacaaatcatttcccactctggtagaaatgcctacatagagtatcagatacttgcgtatcatactacagaagaaataaatattcacctgtatcattcttgatccttttgttaaattatgaatacatttaaatattgacttcctctagaaataagtttaatgcatgacatagtgtaagaatctaactttattttactttttaaaacactttcactattgtttcagcatcattaaaattatccatctactcccggatgtcctatatgaaatgcttataaatacatggctctatttctgagctttctattctgttccactgatctatgtgcctaaatatatcagtatcaacatgttgtaattattatggatctgaacatggcataattaatgctagtgctagagactagctcaggaaacagacaacctgagtttaaatgcctatcctacctcttactacggatggccttgggaaagtttgccaatgtctctgtgccttagtctctccatcagtaaaatagaaacaatcatctcttctttacaaaattgctgtaaaaattaaaacgactgtatggatacaaagtgcttaaaaaggtaccttacacagaatgaacactgaataaatgttatgctatatccatttctgaggagtgttataacaaagtgccacagactgggtggcttaaacgacagaaaggtattatcttacagttctggaagctagaagctggaaatcaatgtgtcagcaggattgaccccttctgagggagaagagggagaatctgttccatgtctctcccctggctttgggtggtttgctggcaatatttggcattccctggcttgaagatgtatcactccaatccttcatctttcctgcatctccacacattgtcttttctgtctccctgcctaattttttttttgtttttacaaggataccaatcatactgtatcagggtccaccctaaggacctcatcttaagttgattaaatcttcaaagacattatttccaaataaggtcacattctgagttactggggattaggacttcaaaataacttcttctgaggacacaattcaacccacaacagccattatttatggtaccttttcaagattgaatgatgaggttatcagacaacttagtcttaatagcaaattctatgccaatatttctaatttttcatgacaaatgatgacattaactttagattgagaaaagctgtttgtttatgtttagtatgataagaactcatctttcaatttccagttgtcccaagcattgggggtgttgggttgcttgctaattttaaaccagaatgagtgtgagatttttcaaaagcctttttgagactattgaactcatcatatggttttctattttttatttatccatgtaatacatattaattcattccctaatgttgaattttccttacaattgtaagataaatcctattgtagcatggtatattactcctttaacacaacactggagtagatttgtgtgttttgttgtttggttttgtttttcacagctacatccatcttcacttgtgtagttgtcctctatagtcccttgacaaatctcacaatcaaattgtctttgctttctcaggaaagggatttgtggatcagccctaggtgatcctcttcaatcactgtatctcctagaaatgactaagtatgaggcaaaagggtggtatcttttccagttcccaccctactcatgtcaggtttttatattttggtcatgttggttcatgtcaaggaaggtggggtgattagttgcctgtgctcaaatccccctctttcccagaagccgggacctattgcacatatttgtatgaatgactcatcaaagcaatcccagtggtctccacagtccgtggatccttaaaacccaattcaaaaaccaaccacatttgcatccatacaataaaatactactcagcaataaaaacgaatgacctattgacgcttgcaacaatatggccaagcatcaaatgatttatgttaactgaaagaagccagattcaaaggctacagaatgcatggttctatttatctgacatcctggaacagccaaaactagaggaaacacaaacggatcagtgcttatcaggagttgagggtgagggaaggatttgacaacaaaggaacagcatgggagaatttggtcgataattgaaaaaacacattatcaatacataagggataagtggataggggtatgggtgaaacaaaattggccatgaggtgttaattgctgaagctgggcaataagggcttattatgttattctgtaaaaaatccttaaaagtgtacagttaaaaaaaaaaaaaatacataccaaacattgcacccaatctgtgtgaggcaggggcttggaaaacatgacgctagggtaccctttaccattccaattttctaaacccttatccctctccaaatggcctacttcataaatatgctatccaatgattaataaaatgaaagctaaggagggaaaaagatataattaaggaagcagtcccaactttggccatctaaagtaaaatgactgtgctaatgtcgttgttaatgtttcgtggtcagagcaaagagaaaatcactccccagattacagcttttgctattttagggcctctctgggagccccactgcaatgcacaatgcggttcgaaatctgagcttccattaaagagtatgtttgaggcacggcttagagaaccccacaggaagactgcttagcctctcagaaaatgccctcaggcctggccaggctataggtaaggcctgtgggtccctccctgacagtagctggcccccagcaagctgccttctgatctgcataagggtccctgtgggggcctggctgctctcctggaccgggaaagactgcacagccacgtaatctacgtgcatcttcagagaggaccagatttgcccacacattctgtcccacacagctcagaggcatagaggcagccaccttaagagtactcctcacagctggggacaggtgaatcacggctactcagttgattggttatctatctatctatctgtctatcatttacctatttattttcagaaagggtctcactctgtcacccaggctgtagtgcaacctctcaaactcggccaatcctccaatcttagcctcctgagtagctgggactacaggagcacaccaccacacacagctaattttttgtattttttttttctgtagatacagggttttgccatgttgcccaggctggtcttgagctcctgggctcaagcgatcctcctgcgtcagtctccccgagagttctgggattacaggcgtgagtcaccatgcccggcccgctattgtttttaaatgccatttccctcatgagtgcccaattgttgttgttgttgttgttgtttttattattattattatactttaagttttagggtacaggtgcacaatgtgcaggttagttacatatgtatacatgtgccatgttggtgtgctgtacccattaactcatcatttagcattaggtatatcttttaatgctatccctcctccctccccccaccccacaacagtccccggtgtgtgatgttccccttcctgtgtccatgtgttctcattgttcaattcccacctatgagtgagaacatgcagtgtttggttttatgtccttgcgatagtttactgagaatgatggtttccagtttcatccatgtccctacaaaggacatgaactcatcactttttatggctgcatagtattccatggtgtatatgtgccacattttcttaatccagtctatcgttcttggacatttaggttggttccaagtctttgctattgtgaatagtgccgctataaacatacatgtgcatgtgtctttatagcagcatgatttataatcctttgggtatatacccagtaatgggattgctgggttaaatgctatttctagttctagatccctgaggaatcgccacactgacttccacaatggttaaactagtttacagtcccaccaacagtgtaaaagtgttcctatttctccacatcctctccagcacctgttatttcctgactttttaatgatggccattctaactggtgtgagatggtatctcattgtggttttgatttgcatttctctgatggccagtgatggtgagcattttttcatgttttttttgattgcataaatgtcttcttttgagaagtgtctgttcatatcctttgcccacttcttgatggggttgtttttttcttgtaaatttgtttgagctcattgtagattctggatattagccctttgtcagatgagtaggttgcaaaaattttctgccattctgtaggttgcctgttcactctgatgctagtttcttttgctgtgcagaagctctttagtttaatgagatcccatttgtctattttggcttttgttgccactgcttttggtgttttagacatgaagtccttgcccatgcctatatcctgaatggtactgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagcaaatcctttccccattgcttgtttttgtcaggtttgtcaaagatcagatagttgtagctatgcggcattatttctgagggctctgttctgttccattggtctatatctctgttttggtaccagtaccatgctgttttggttactgtagtcttgtagtatagtttgaagtcaggtagcgcgatgcctccagctttgttcttttggcttaggattgacttggcgatgcgggctcttttttggttccatatgaactttaaagtagttttttccaattctgtgaagaaagtcattggtagcttcatggggatggcattgaatctataaattacattgggcagtatggccattttcacgatattgattcttcctacccatgagcattgttatcaaaggaaaatctcaggaaaattgaacaaccagtgaaatagcattgccccctatcttcccatcaacctagaacagaagggaactcacctgtaccttggtacttgagagatgagacagctactactgcccccattttactgataaaaaaacaaagtgcctccagaagtcataactagtgaggaatgagcgaaagttgaggtgagggatggagatagttagctcttctccttcattctccatctcatacaaaaggaacttccgctgctgacactggagagggaagtgttaaaaacctttactctttcctccctgaaggtgtaggacttgctcatttgactgataaagcttgccattccttgggctaaatgtactagcggtcgcgtgtcccagaggtgcatctctctgatcctgcaacacttttgcccacctgagctcaggtgcctaggtcctctgatctgctctttcatctccttctgagttcttgtcttctttcagttcaggggcagtaagagctcacttggaaaatgatggtccagggccatcattttctatcctggagaccagtagtgagaggtcaaccagtgccatctgttcatgcaacacagtgggtgggtaagtcagggcagagctgctgttggcagggttgaacttcacccaagccctgtgctcctggttaagaaatccccccatctccaggtaacagcttacggcaaagaaccacctttccctgtacagcttagataagacttgtggatgatcctttaacaaggccagacacaggccctccaaattcctattctttgtctcagaaatgattagctgcactgtttgtctacattaaccaatctgactggatcaaattttagtcaggcttcactccttcccatgggccccttctaaggatttgctgaccacaaagaacatttccagtttggttcatcgatcaagccacctgctctcctcacccacgctgatcctgtccccattgcaaccaccccccttttcccattgcaatcattcccgttgataaaatctttccttactactgtacaaacttgcacatttttttgacactgtctctagtttagaaggaagggagacaaagaccaactttcatttgagagttcaaccgtttatgaggcatgctgcaatcaggggtcagacagtgcttgcccagatgaaaaggactggtggtactagcttcgagttttgtgtgtgtgtgttctgtcagatctccacagaaaagatgggcaaaaagctgaatctgggtgccctaaacacagcctgtctccctcttctagtttctttccactcctcaacaccagaagaggccctctcagctcatgccgcaccacctatgcaactcactaaacagtaaaacagattttgcatagcaaaggacatcagcttctcccacgtctcagggactaagggccaacaccaggaggcaaagcaggcaaatgaaagctcatttctctgctacaaaatgaaacacaaaacactcctggggaagagtccttctctgtaggcaccagggacacccatcacccctccagcctggggatcccccagagatggcataaagggacacccatttatttggtcgggcagctgggaattttaatggaacatcttaggaaacgttactacttggggctttgggctgggggagagctagatggactctttgtacttcctcttcttgaagctttgctctccttactccattgagtatggttgtgctctgtaatctgagcttcctttgaggactggaacacaggtctacagatggatgacaatgggattatgagacccagcctcaaagacatgagagtgatggctggtctgtggggctgccccagagatgccagctggaaaacgctaagagcaggtggccaagtccttaacaacttttccaaaaacaggggttctatgtgattccgacctggcaagcatagattcacatccataaaacattttgcagcacagactatgtgccaagcctgtgccaagtgttttgcaaatattatctcattgtatccccactaccaaaaagaaaaatcatttgaattaaagttacagagacttaatacagaagcagaaacctttaaaccttgtagacaagtaagaagaccttcgaattccccaccctcaaatatagattcctgtccattcatttacttacgaatgttccttttgttcattcttttagtgtagttcagtgaattttaaactgtagtgtgcatgagatttattcaacaaaacatattttatcatgggtgccataagagatttcctaaggttaatttggacaatacgcacttcccagcttaactgttgacttcagaggccaatccccgcctagaattctagtccactttgttacaacttctgatcatcacatcaaagcggggtggtgagccctggtacaggtggggcagtttgcattttgaatgtcctagatgatcaagaacatattaaaagaagctctttggctgtccctatcacttgcaatttaaggatgaataaagtgaatgagttgagtcagagacaagaacaaaaaataagcgaatggcttagcaacttgtgggagatccttgccacggaatattacccagcatgaactattaatatacgcaacaagatgaatgaatctcataaagcatagactaactgaaaaagtcaagcacaaaagactatatgccatattattccttttatataaagttatagagactgaaaaactgtagtatcaaaaagcagataagtggtcgcctggagcagggagttggcagggagggaagttgaggggagggtgataaaaagcaaaagggaagagagggagagaaggaaggggagggactctatatcttgatgggatggtggttacatgattgtgtacaatgaccaaaattcactatgctgtagccttacattttaaagtctaaaaataataccttaatacttttttttttccaagaggagaggaaaaaaagtcatggtcacatacatacaaaaagattagaacactttattccaaacaaaacactattgagcaatttgggtcaaaagaatgcacaaagcagaatcacattcttcctttcaaatttctcctttcacatttgtgaaagaagaggaaaaagaaaaaacaaactgcagcatacatttgaatttttcctttcagagaggggctctaatcagtgcagagaactgggtaacaagtaagaccaagagggtttaattaaactgagcaatcattaaactggatttaagagtgcttgtgtttgcaaaacaacaaaatatttacagacattttcttcatccccttcattagtttcagactccacaggaaatatggaggttgggaacaggtcctaatgagatcatgcaaattttaactactgaggttagcctggcaaagagacagcacggcaaaatgctcatgatgaaatgttaagtgaggaaagcaggatagaaaatgagcttgcactaacattatgagtgattccgataattataagcatggtagggggatgacaagcaggggctggacattaaaatattctatcagtgatggtacaagagcgatggaattaggggattattttcatctctgttttccaaaatttctgaaatatatgagtgtattacttttatttctttcaaaataagaaggtacactaaagcaagaccatcacttgaggccaggagtccaagacaagcctgggcaacatagtgagatacctacagaaaatgtagacttccacacagtgagatctctataaaaatgtagatctcaacatagtgagatctctacaaaaaatgttaaaagttagctgggcacgatggcatccacctgtagtcctagctactcaggaggctgaggtaggaggattgctggagcccagtaactggaggctgcagtgagctagcattgcaccactgcacttcagtctgggcaacagagcaaatccctgtctctaaaataaaaacaacacaaaaattttctaaaatctaatttagacatctaacagtcatacatgttcactatctctttgctgtgcctcagaacgagacaaaaggggaaggaattctgtaatctatagcggcagcatccgatctcagaacactgcaccttcactcactccaatcagggtcttgctgccactgggacagtgaaactgccctcctcaagaccacccatgaccctcatgtagctgagtccagaggtgaattcttggccctcatcaaacttgcttcatcaacagggttaacagcattgatggctccctcctcctttctcagattccacacagcgttctctcttgcttgtcttccacctactcttttgagatggagtctcgctgtgtcacccaggctggagtgcagtggcatgatctcagctcactgcaacctctgcctcccgggttcaagcaattcttctgtctctgcctcccgagtagctgggactacaggcgtgtaccaccacacctagctaatttttgtatttttagtagagatggggtttcgctatattggccaggctgatctcaaactcctgacctcgtgatccacccaccttggcctcccaaagtactgagactacagttgtgagccaccgcgcctggccctccacctactctttctcagcctccatgctggactctctccctcatcttgatacctacctggtggagtgcttaggctcagtccttgaatttcttctcttctaagtcccaaccctgtgcatctcatctaagcccacaacttgaaatagtatccatacactgactactcccaatttcacatccttattctacacctctctcctggactcaggcctgtatatctaactgcctagttgatgtatcgacctggatgtccagtagacatctcaagtctcacatgcccaaagccaatatcgactactcttctccaaacccgttcctctcaatcttcccttgcttggtgcctcagcatcccttgtaggtttccttagtcttgcccacaccactaacagttacttcattcaattctcttcgttacacacttttgagtagaattctatgtcctacaggaatcttgattgtgttccatctaggatgatgcccttggagggcgagtcctcccctgctgcttccatctgccccagaagtcacacctcagcctagattagctgagggtcactcaaacgcactgtagtctgtaatgcccttcatgcccttatctttgtatgcaggtgaagcatagaccacccttaccctgctgtctcctcacccttggaaatggagttcaagtatcaagcctccctcaggaaaatcttccctgaccatcgctcccaccccaagctaagatggcatcccacccctgtggttcccaacacttcactcatggctactttgcgaatggtcttatagcccatctttgtagacacatgaagctccatgatgaatttagggaggcccttcagcactccacccctgccccatcacacctgctggtgccaattcatacctgtaggagagccagtcacacctgcagcatgttcagcccctgcacctggagaaaaaacctagcaatccagaactttaaaggtcacttccaaggacttctgggttcacaggtgacataaataagcaaagccacagattgggtaggatgttcaatgaaccaaagaacacaaatcctatctgaaggcatccaaaagcaatttttaaagaacactgtatactcagaagaagaagacaatctgtgcattgatctgggctcatggtccgtgaatttgcaatctctaagccaaatggccacaaagtacctaaatgtgcaagacctcgcagattaatactgaatgaaggcctcctgacaggaaatgtctgcacattactttccaggtgacagattggcagataaagcccacgcgccactgtctaagtgacaacacacttttcacacgtatcttctcagtcatcctcatcatagccccaggagacaagttcattattatctctattttgcctttaagaaaaccagagcctgaacagggcagatgacttaacaaggtcacacaatgaggatctgaaagagccagaagccctggcaccagtcccaggtactccacgtgcactgctgggccagtggatgcttcacaacctgaaggatggccagggcctcttgggccagcagtgtccagcgtcatcaataccctatccacttcaagatgaatgggacatttttttcttttcttttttttttccttaagacagagttttgctctgttgcccagcaggctagagtgcagcagtgtgatctcagctcactgcagccttcacctcctgggttcaaacgattctcgtgcctcagcctccccagtagctgggattacaggcatgtgccaccatgcctggctaatttttggtatttttagtatttttagtagagatggggttttgccatgttggccaagctggtctcgaactcctaccctcaaatgatccacccacctcggcttcccaaaatgctgggattacaagcatttgctaccatgtccggccagatggcacattcttaatacatgctatgaactctcacaagaattcccatatcatgacttttataacctgccttttaacccttccatttaaaaaaaaaattatagcatgtgctacaaagccctggatgatctttgggtttaaagcagcatgcagctagctaggaaggccatggcatttgtgtgtaaaacagccttctattctggtaatggatgcagccgcggtctgataagcaggctgtgcagcattcactagcatctgaggccagcattcaccagcattgtgaacctcgggaagaaaactcaaacaacctgatgtccaacagtactcctataaggagcaaaattggtgagaggagcccacacttttcctaaaccccatacaaacatctctatctctgccatgatggcttaagcgtaagtgaaatcactttgactcacatcctcaaggtgaagaaagctgagctcacacagaacggctaatatgtgcacagaacatcacagctggcaaatatcccgatccgtacatcaatccccaaaaccagctgctgttaacctcacttttcagataaggaaatggggttgagagagattagatgagttggcaaaggtgagtggagatttgatcacaggtcagctggattcacaaatctgtgtacttagggcctcatctgtggttcccaaatttcactggtcatgtacatcacctgggagcttgttaaacgcagattcttgggctgtgctccagggactctgattcaatagttcaggggttggacttgagcatccatttttaaagagccttccaagtgaatctgatgcaggtggcgcattgtccacagtgtgagaattactgcggctgcattgagcctttcaaaagagagaagcgccatcctaaatgaaaaccttaaagccacaaatgatgagaatcaactcccagaagcattcccgggtctgtgagcacagtctttgcagaaatgctggcttttaggcatgcttcctaaactctctcactcctcatgacacaagcttttccaaatgctagtagcacctgtactaatatttagttaatattttttaatatgtcatttttcttaacttactttaaaaggaaactccgtatcactaccaaaatgaaaacctggtctcatttgctataaacacataatgaggctaaaaacaaaattaacaaaaacaaaaacataagtaaatgttggctagatattgttgctcccctagggttctgaccctagaacatggttcctcctagggaaaaatgagcatttgtaagtgttggaagggcaaggagtgatagaagctctaaaactcagaggctctttttatataaagaggtattagaaaagaaatgaagcattttctccatggaattcaatgctcatggatgccctgcccacacactacaaaaaattccatgaaccaccagtaatgtcccatatttcgggtgtcattggcttgaggcagtgttttcaagacttgagggtgaatcaaaatcacctggagaatcattcagattgccaggccctgcccccttgggtttctgattcagtgggtccggggaggggcctgagaatctgcatgtctagcaagtttccaggtgaggcagatgcttctggtccagggccatgccttgagagaattcagagcagctgaagaaaagagggcttcattccctggcactctctgatacctacaaggagctgtcaactgcacatgagtaccttctggtactgcacagtccctttgcagatttccgaccccagacattcccagctccatataaggtctttatcaatcacttcactccaggactcttctggaagccccctctaagaggggctagaccctgccaggtaaagcttttagatgggccgtcccctctcagggggtgtaggcaggaagttgcccactgactcggggctgcctcaacagaccaggccagcctgtgggtctgacctgcagagggccatatcccaccttcagacctgttgcctctatgcagcaggctctgcacctgcctgaggggtcatttctggtgggccctctctccctgaccaagacttagccttgctctgatgtcaagcctccctgcatccacccctctctcctgttctccatcctggactaccccagagccctgatactgccctctcccaggtcacaggccccaacaatgggctgcactagctctgagcttctccccagcaggtttgagtagcaaataataaatattttttttctaagcaactcttagtgcaattcaccccactgtgccttatgtttgaaggagcttatagcaatcctcaagggatccaggacgacacgggggacataatttagaggggacagatattcctccaccagaagtactttccagagaatctggggccaagactctggctgtgccctctggtgggatgacttccctgagcagagaatgcatagagtgcatcagagccacacacgttccagggtccatagagctaggttaaaatcccagcctctgcttcctccccgtgtgcccaaggacctgtttctgaacctctccatgtctcatttcttcatgtgcaatacagaggaaatcatatttgcctgcatgattgttgtggggatgcaattaaataatacacgtcaagcctcagcaagggggcagccaggcttacaatgcatccccaagaaaggacggcagctgccacaaatgctgccatcattattactgatggagcagccacccagatgggggtcacttcaactcctgctccaggccatcccagagatggctattaccagggaaaggatgtttccctgctggcacacacacactcattcaagatctcagcagccatagaagctaaaacaacatgggttgggatgtgcaggtggggttgtaaggttgctcttgatgtgactttcgatgtccaccaaggaaaacctgagggtgcaggaaggaataaacaaatccccttcatccaggacttcccatttgccctcaggagtaaggcaggtgttggcagctcccagagctgaagccactgcctcataagttaatgggaagagcaaaaggcaagacctgcttaaggggaccagcagaaagattgtagaaaaaaggggggctgggtgtggtggtgcacgcctgtaatcccagcactttgggaggctgaggcgggtggatcacctgaggtcaggatttggcgaccagcctgactaacatggtgaaaccccgtctctactaaatacaaaaaaattagacaggcgtagtggcgcatgcccgtaatccaagctacttgggagactgagacaagagaatcgcttctacctgggaggcagagggtgtagtgagccaggatcgcatcactgcactccagcctgggcaacaagaatgaaactccatcaaaaagaagaaagaaaagcaagaaagaaaagaaaggaaagggaaagggaaggggaaggaaaaaaggaaagggagctactcatggtggtgtggtagacccacgcctgcagtcaaacagaccagagttcacagcccagcaggtcactcaccatcagcatgcaagtccacgtgggacttcacctccaaagggctctgtttcctcttctgtggcccaggtatggtacagtgaactgagctgtcaggggcattaactaaaattccaataatacaaacagacgcttcctaattaggcatgtaggttgtacttagaccactatgtattatttctcctcattttacagagagatgaagtaacttgctcaaggtcacacagtcaacaaagaggagagctgggatctatacccatgcagcccacctccaagtcacatgctattggctgctaagcagcaccgtgtagcacagggcctgccatgcagcagttgtgagtacaaactgggacggggtaaggaggcagggaaggtgaaggttgctttcccaaagcctctatctggatgatgagatgggaagtgaatctgcagactcgattaatctaaacccaagctcattgcacaaggctctggttccctgccccaaatttaaacagctgctccttcaatgtagtggaacacaaatgtctgaagagctttgaattttaattatcacagtcctgatgacaatctgaatcaacagctgctcccagcaaggtggccctcagagatgcccagagaggggcagagggaggggacaggaggacacagtccagacaggacacagatgactgcatctgtctggggagccctgacacctgcagctgggagctgtgggatggacaaacaggttgaaatgcagtaagaggaggagggaatctctggggtgcacctgtccccttgccacagaacatgtgtgtctgtcatatgtcggggtgagtgacaatgcagagggagaatatcaggggccatggggagaccctaccatggtgtttctgatgagtaggccaggaggtgtgaatacaattgcccagggatccaagaaggggtcaaaaagaaaggtgtcagagggatggtcaaccaactaagaggtggcaaatgacagccctgctgtgacaataactcctatgttccaggtattggagcctccacccatccctacccaccttctcttctccaggtgagaaacgtccctcccttcctgcaactatttcagggaagacgctgccactcaacacaaaaacctgtccccaattgcttcaatgcaaaagagaaggacattccctccaagtactgaccctgtcagtcccatcttttgattcctgtcatatctaacacctttcttaccagtgacattgtctggataaccccaaactggaaatactagaataacaaaatggccaggagaacagaacataccccctgctttctttttggctttgcccatcaatttggcaagatggcagcagagcaggtactgcaggtaagacagtaagtcaccacaagatacccagaaggaagttcggacacatgtgtcatttctaacatccttagcatgcgagagtaattctctcctagggagatattttgtgccttacatgcaaggatactcagtgaagtgttctttacaagaatgcaaaaggaattcaaaaacaggagactaattaaataagttgtgatacactcacgcacttgaagtgcgtgtcattatcaataatttagagttccaaagagcccgaagtgtggagacatgtttacaataaaatgttaagtaataaagaaggacattaaatcatctgtcacatgtataattattccaattgcatttaaaggacagaggtgtataaatatgaataggaaaaaatacaactaaaagaaagtgcattaatcatctctgttcttatggatgggttttattttttctgtgtgcttcttcctattttcctaagttttctacagaaaatatgcattatatagagactttcaaatttattttcaatttaaaaattaataataaaagaggacagagaagttagggaaggagagatggtgttcagacaagggcttggagcccattttgaacaaacctggcctcattctcacagccctcagagtcaaaatagcggagaacattttccccttaaatcaattctgcaaaataatatttggtctgatgtttgtaggaatacaagcgtccttggctcctgcaagcgtggatcagacaaagcaactcaagaacccattcttgaaacctaaggattagcagttgccatgacaatgtgttagcaaacaatttattaagtacttgaaatttctcctccactattgattactaaatgggtattggaatgacccattactgcaagttctgtgtccccatctcagtgcctgatctggctgcaaatggtcccccaattaggacgcctggctgtaggcggctgccattcaaatgcttggttcccatccaagaaagcagtcatctgggaaaagtttaagcataatctctccggactagtttctgataaaggagggaagaggacagggaaaggacttggggagtgcttactgatgatgaggaagatgagccctgctttggaagcactgacaacttttgacagcagcctgcagcatcagtgagatggaaaaccacccaactgccctcctaggtccctcttctgatgccaacatcatcatcagctgagggggctggatccctgccactgcaggtctttgtttcagaagatttgggcccctggacattcagctccatatcattcattcaacaaaactccactaagagcacttgcaatgtgatggtaccaagcaagttccctaaatgcctcaagtcttctacccttgtgcacaattccctttactttttttacttatttctatttaattaatttttttttttaggaataggatcttgctctgctgtccaggctggagtgcagtggtacactgatagctcactgtaaccttaaactcctcagctcaagtgatcctcctgcctcagcctcccaagtagctaggactacaggcacaggccaccatgcctggctttttttttattttgcaaagacagggtcttactatgttgcccaggctggtcttgaactcgtagcctcatatgatcctcctgcctcggcctcccaaagtgctggaattacaggcatgagtcaccatgcccagaccctcatacataattcttgcgactttccctctctattatgaaacaaaactttataccatagctaccacatgtacctttcagcaagtagcaagatacagctgccaaataaatgagctgagcttatgataatagttgtagctggtatctagaatatagaagctttaaacaaacaacaacaacaaaaaactccttatctttatgctgtttagaccaatcaaccttcctccctcaaccccctccccatcttagccaccaccaccaccaccaatatccctggcagtgcattaactttgggtgccaagctctcagaacaggagtgggggtaaggagttagacttggacaagagcagggctaagatttgaattatatcccctaaatattcacgtgttgaagctctaacccccagtgtcactatatttaaaggtaggataagctcttaaaaggtaattaaggttgaatgaagtcataagggtggggtcctaatccaatgggattggtggagggtgagagatctctttctctttgtacacacacacttaggaaatgccaggtgaggacacatggagaatcaagtcaggaagaggcccctcaccagagagaaaactggccagaaccttgatgtgggacttccagactgtgagaaaataaatgcctgttgtttaagccacgcagtctatgcattttgtcatgacagcacaaggtgggagccactgcctcccaaatgctgaagaactagcacgttggctcagaagagaagtggagcctacgtgggcagagggtaaggagatggttctgctcagaatgaggtagaaccttctcatagaagaggcagagcaagcactgtgcaggcttctaggagacaagagagggagcgggtgagcataccatcactaatacatgccgctgcaagatcttccgcatcagatgggagttagatgagaggacacagcgtaggcgctcaacaagtatttgtcaaaggattgacacattttctttgtaactggacaccaggcatgcacagagacaacttacagctggttagcagtggggaggtaggtgccagagacatggctgataccagtaaaccctggaatgatagagtaaaggtcatgtccagtgattttcatttcagctacgtggcactaaaactcatcctgtcaacatgtgtcctgactgaatccatcccagtttgcacatgcaggctggaaaccactatctgaggccacagcagcctccttgtcccatgaatgccacacacgggcctggcttgggcgtgagtcctgcaagttcatcctgtcagagggtgagaaacagagaagcaggcccacacgaccaggggtgactatgagaacacagggctgtgcaggtgcctggggcacacagaaggcagggccccatccctgaggtgccaaagacgtaggttagaactgtggatcagggctagagccaagcctaggggaaatctggacctccccatgaggatcctggactcaaggaagctctgataaggcagacatcacttctcaagggggcatgtgcctggtctagaccaagagatcagggtctggctgcagcgcaggctgcacgtgaaggtgtcaggcctttaaaaggtggccggtgcttatcaaggacaaagaggacagagaactaagctgcagcccagaagaagagctccaaaagtcagaatggggtggtttctgaaggtctggctgagaagcaaggtggaggggtggtggtaagaaaggaagagagccttgtgtctcccaccctaggtagcatgtcatgttgtgcaccctggtcagcgtcaccctgctgacttgggtgaccaacgtgtcccagttttccaagaactttcccagtttctgcactggaagccctgaatcctggcaaaccacgacagctggtcaccccagcaccagcccaggctctggcgggggcttcactgagctcctggagaaggaccttaaaaatcctctatccaccctggacacctaggttacttctgaaacaaccgctccaccttcacgacctcctcaacaggcgtctactgcctttggaattggatgctattaatacaaagagaaaaatgcaaaatggcaagcagtaagtatacttcagagtgataatgaaacaagggtcctcatctttgcagcattggtcagcctgccctcattctcacctcttccaacctctcctctatagggatccttccaaaccccaaatctgaccaagcttgccctatttggacccatcccaggctccctgttgctctgagaacagaatctaatctttaatctggccctcaggctctttctggaccagactcccccatctgtctggcctctttcctgccttgcacccaacagccttgcacaacttttcaattcctccagcctggccaagctaattcatacctcagggcctttgcacaggccaaaccttcagccaagaatgtcttctgctcccctagatctttatcctgccacctaccaacccaatttatttgcctgctcagaaaggcctttatttatcctccctagttccctgcaaataggatcaatttggtctcccacagagcacaagccttcacttcactgtattgcaatttttaaatatatttacatgtttgtgggccacctcactcttccctgaaccctttgataacaaggactggaatctaactatgtttttccagtcccgagcatggtgccgggcacaaagtaggcatacagtgagtgtttcctggtctattgattgattgattgactaaactcacctcccccaaacccttcaatgtgagaatacattttcttcaaagtttttagccattataaatgacagacaagatgtctctttgaatttccaaacgcttatctcaaagcttttagttttgtctaccagctcatgccaccaaccggatgagcctcagcaaggttcctgtcaaagcatccctctttttgttgatttactttaaaatgcaactcagtggcttcaagtcagaagaagaagaggccacgtcttcagcctctccttaagcatctatcaccagccagctgagaagatgtgactgtcatcctcccaacccgacaagatgatttttctcaaccataatacaagcccagtgagccatacaatcatggtgaatcccctatcagctcaacatcctatgcaatttttcagagaatatgattctatctgaaaatacatgcaacagtctggaactcatttttccccagtgcctaactttcagattcctataaataccagatggccttccaggcagtgacacacgttggaattatcgaacaagcatcgcttatgactttgccttgggcagtgtcaaaaggtactgagaatttacccatctcattacggcgttgctaacagggtctcaggcagtttgctgggcctggaggtgtgtcaaattgcagtgccatgaatgcctcaaacgagagacagagaaagagaaagagaaggaatatgtgaatgtgtgtctgtagctgagggaaacaacaagagtaaagggaattaaactcttttaataaaggaaaatagttttcaaacaaagaaaaagaagtctaatggttagctactgctgcataacaaaatttccctaaaactgagcagtttaaaacagtatacatttattatctcacattttctgtgggtcaggaatccaggcagagctcagctgggtcctctctgtcagcatctcacaaggctgtaatcaagatgtaggccagggtgtggtcccatctgaaggcatcactggggaataatatgcttctaagctcactctcagggttgttggcaggactcagtttctcaggggttgttggacagagatattagctctgaactattgaccagaggcatccttcagtcccttgccttgtgagtgtcgctatagagtgtctcacaacacaccagcttgcttcatcagcaagtaaatgagagggtaagagaaagcaccagcaaagagagaatgctagcaagatgaaagccatagccaagcatggtggctcacatctgtaatcccagcactttgggagaccaaggcaagtggatcacctgaggttaggagtttaagaccagcctggccaacatggtggaaccacgtctctattaaaaatataaaaaaagaaaaaaaaatctgggcatagtggcggtgcctgtaatcccagctattcaggaggctgaggcaagagaatcacttgaacccaggaggtggaggttgcagtgagccaagattgcaccactgcactccagcctgggcaacagagcaagacttcatctcaaaaaaaaaaaaaaaagccacaaccttttgcaacctaatcttggaagggcgtctcattgcttttgccataatttttttttttttttttttttttttttttttgcccaagctggagtgcagtggcatgatcatagctcactgtaacctcatattcctgggcacaagcaatcctcctaccttagcctcctgagaagctgggactacaggcacgcaccagcacacccggctaatttctaaattttttgtaaagacaaggtcttgctatgttacctaggctgttctcaaactcctggcctcaaacaatcctcctgccttggcgtccaaaagcaatgggattacagacatgagccactgcacctggcctgccataacttatctttagaaacaagtgtctaggtccagtctacacttgaagggaagggattacacaaaggaacgaatattcaaagacagagattattgagagccatggcaaggcctctttccacagaaaggcttcagaaaattatgatcagagcctctctcctaaggcctggaacataagagtatctgggatattcattcattcattcatttttcaaaaagtatttaatgactgtctgctatggaccaaacatttctcgtctagtccggtctagtctagtccagtccagtccagtccagtctattcttctattctattctattcttaagatggagttttgctcttgttgcccaggctggaatgcaatggcgcgatcttggctcaccacaacctccttctcctggattgaagtaattctcctgcctcagcctcccgagtagctgggattacagcatgtgccaccacatctagctaattctgtatttttaatagagacagagtttgtccatgttggtcaggctggtctcgaactcccaacctcaggtaatctgcctaccttggcctcccaaagtactgagagtacaggtgaccaaacactattctaaatgctaagtgaacaaaggcagaagtgaacaaaacatacaaaaatccttgtcttcataaaactcatattctaatggaaggagaaagaccgtaaatgggataactagtgtgttggatggtgataacagctatagagaaagcaaaacaggaaagggaatgctggggaaggggtgggggcacaggttgaaatcaacaccacataggaaaggctccagtgagaaggtaacatttgagcaaaatcatgaaacaggtcaagaagctatcacatggttgtctgggggaagagcatttagacagaagctgcagatgcaagggtcttgggacaggagaatgaagccaggggctgcagtggagtgacaagagtagtaggaatacgtgaacagaggtgtcatgggcatatcacggaaagcctcataagcatttgtaaggactttgttttttattgcaaataagatggaaagctactggtggggggtggcctgagacacaggagtgatataaactgtcttatagcttaacaagtctcctcttgactatggggtggaagaccaatgtcagtggggtgacaagggcaaaatgcaggaattcactgaggaggctgcaggtctactctagatgagagccaatgatgacgtaatctggggcagcagcacaggaggtgggtaggttggcttctggatatattttggaagcacagcctaaggatttgctgatgggttagatgtggagtgtgaaggcaagaaacaaagaaataagacatagttctaatgttttggccctagcaactgggagaacagaattgaagattcgtttaattctaaacgaagtaaagaccaagagttcagttttggaagtggtagaaaactagggtgatcattagatcaaagttagaacctctgaaagcctcggccctgcatctgggtgatggaccgtggtccacacagcacactcgagcctcagtttcttcactgtacctgcaagtgcctaacacctcctaagtcccacatttagccagcagcccatccctgcgcagtgggaatctcggctttacacgttatgtgcgcatatcatattactgtacaataactcaagtcttgctatataggcacatcataaaactattccaagaggatagattacttgaaaccagcatttaatgtgcagctattacatgccaggcactatccaacgcactgctcctacgttatccacatgcatacacaggcactgggtgtcataggatctctagcagtcagagactgtggctctcaagctccttggcagtaggctgtggtcatctttcccacgtgtgcctgtgtttctctgcattaagattttcagaaatgagggccatgtctgggaatctgtttactactgcagttatgctgagccagacagtctctccctgtaaacttgcagtgatgggaacctcatgaccccataaagcagccccctccaatgttacagctagttctcagaaagtctttcccttttattatcagccaaaataaaatcctatagtttctattcattggctccagttcaccttgtggagccaccagagaaaatttcccctgccttccaaatcacaagctttcagagagttgagagcagctcttcaatcttcatttgacactgatgagaagagtgccagctaaaatctgagacatactctgtgaatcacacttggtaaaagtgtttttacaaatattatcccattcaccatccataatcactgaagattaactgcgaagtatcatttagctatcacttctaaatgggagaatgaatgggaaaactcttggaaaattttgagataattacactctgtatcattgttcccattctgcagatgagaacacaagtgactcagatatgctaagtcacttcaagattacctttaagtaactagtgttaaaagataatcttcaaaacataataaaatcatgactcatacagatatgaaataaatatgtgttaaagattttatcatcaatgatttatcaaagatcttatcaatggatttctatcattaattaatgaagattagaaagatgctacaagtggtttaaaagagaacccaaagaacagacagctaacagaaacatttaaatgggtgtacgaatggatgtaaaattttttgagggggaaggttgggtagctcagttgaacctctactggacaggatggaatgtgcatatcagtatctgtaactcataaaactgtaaaacagtttccataaaatcaaaatcagatacccaggaaggattacccctagagtctagagctagacaattactgttttccaccgaagcaccattttctctcacagcctagcatagctagggtctgcacatggttctttataactctttgccctctaagaaaatctgtttaaaacattcactgactttttttcaggcccaatcataatatagatgggccttcagtggctggcaacatatgagagaaggagcagaggcactgaagaagaaagagtttggcaaggacagttaagttcctgcctctctgcatttttccatgtcagtaagagcctttcccttcctctcttccccagcctgtttctcacttaataaggagttgtgcagggtatttccagcctaactccctcccccccatgcttgctagagagtgctccattgtgcaatgaaagaaggtaaggagttatgcatgtttttggttttactgaaagtctatagtgtttcaatagtctctttgttctctctctcaatagttcctgtgtcttaagaaattacaaattttcattcttcctatggcattagtagtttggaataaaaaaggaaggaaagaaaagaaaccaattaaaaaataaagtgcttaggcttaagaacagcatttataataacttcacaggtctaacctgcacttactggcggcagtttaaacagaaggttccttgagaggtgagcaataaagaagccatttagtacttgatctccagagagggttttatcaattcacttgcccccttaaccatcactggtttctgtgtaatccatagaaagatgagacaaaccaaccaactcgctcacatttgcatgggtcagacctcttattaaatgagttttccccaaatggcagtgcttagcatactctgatggcaaatgcttaaacatttcgtcaatttcaatgggatgtcaatttcccctgccaagcaaggtggccttccaggctaatctggggtgagggaggggagccaattccaaagtagagaatgattctgaatacatacagctttaattccaggtttgctcatcactcccgccatctcagcccatgcttctaccaacactggctcagaagttggaaaagatggagattgtatttctgttagactgagaggtggagcttgtctgtcttcccccctccttttcctttccttcttgagggcaaggcctatcttgttactctctgtacccactgtctcattcagtacctggctcatagttggtgttgagacactgttttttcggtcaaatggaactaaatccattgttttgtctttttcattccttcatctactatttacttgaaacttactagtttcaagttcaggttctcagctaagagctggggccatggcagtgactcaaacaaggtttttctgccttcaaagggcttatattttagtaagaaaaaaagacactaaaaaatgagtgaataaatgatattattattaatgatagcatttcaagtacaaataaggactcagaagtaaaaatgtagggtaaaatgatggagtggtagttttgacagggaagataattcaccttaccttcatctgtctatctaataaatagataaatagatataatcttatccattcagagggtacctgttggacagaaagatgatcttcccactcaacaccactattctgtcacccactgagagcaatggataagaatagactagaatttattgagtgtctagtgtgtgtcagccatggtgccaggcttttaatacataatatctgatttaatctttaaaatataatccccccaggagatagtccttattactttagttctaccagtgaggatacagaggctcgaagtcattaaagtaccttatctgagattacctatctatattgcctgatgtctccacctatggtggagccaagatttgaatatagtttcttctacctctgaaatgcacactttgtatgttatactttactggctctggacctgaggcattatgccaggtattctgggggatgtaaaatgttcagttagcagcctttgatgttgtcaaagagctcacaagctcactggggaaatgagttgtattcgcatagccataaccaaggaaaagaagacatgtatttcaagagagataaaaactgatgggctagaatgaccagaaaagcaacatgaaagggtaaaatgaatccaaaaagacaggatagatatgaaaatcagagatgaagttgaagaggagatgggagactgtttatacattggagcattgacagtgtgttaggcacgtgagtgatacagtcatatgtgatgtctgctcttaggtgggggaaaaaaaaagaaaaaaagctcacacctagctcagacacaagggaaccagaacatgatgtgcatctccctggggaagagtccagagagccacagtatgcttagcaaataaaaaccccaccatatggttttatcttcccatgaagctgggtacatttcagcacacaaaaaaataggatttcagctgggtgcggtggctcatgcctgtaatcccggcactttgggaggctgaggcaggtggatcacaaggtcaggagttcaaaaccagcctgaccaataaggtgaaaccccacctctactaaaaatacaaaaaaattagcaggatatggtggcgcgcgcctgtagtcccagctactcaggaggctgaggcagaagaatcgcttgaacctgggagacgggggttgcagtgagccgagatcatgccactgcactccagcctgggcgacagagcaagactccatctcaaaaaaaaataataataataataataataataagacttctgttatgcggttctaccttgagttccttaaattccatagattttattcctaggtaagtctggtcctcagcaaaataaaagtggagaaaaaagcttcaaagcccactcagctggaaacagcttacctctcagagctgcagtttcctcatcaatgaaataagatggtgattcaaaggattcaaaaatcattaagattaagagatgtcatcaggcaaaggactttgcatagtacctggcccataccagatgctcaataaatgtcagttccaatctccctccccttgactctccttttctgtaaaatatacctggtcatctagaaaatttgcaattgtcttgcctcttccctacccctttttcaatacagatattcaatgggtcataaagtcctactaattttcctgttcaccgtttcattcacaaatagtccttcttttcattcctctgactcctgatctagctcagttgctatggcttcttaacctgactccacgctacatgtttgtaccctcccgtccttctgggccccagatcaaccatcctaaaacctcctttaatgatgtcactagtgagacagcagaaagagagagatgggacttcaacttcacaggctgttcttagatgcccaggttggtcgtgaactccttgaggttaggaaaggaactattagcaaaatggaacatcctccaagtagaaaattatgctgatgtcaaacaatttcatgtagctttaatggatgagaggcaacatgatattgggcatgacatgcttaaaaagcattgctttcagtggcccagaaagtgtcataaaagaggccacatcaaagtagctcttctttagcacattacaattgagaagtcattcctcccattaaaaaaaaaaagcaaaatgcaactctttacaagggataggggtaggagaaaagggttgagcccggaagaaagaatactcaggctgcagaaacactatggctgtagttggagtgaaatacaggccacccagggggagctgctgtcctgtgaagtccactgatagaaacccgattcccaaaatatcatgcagtatctgcagatgcccagctcaaagacatcctgaaaatagtacttgttatgccatgtccatactggctggctgggtcaagaggaggatggggcactgggcaaccaacaggaaaggtaggtcattttaacacccaacccatccgcagtttccagagaagaacatatacaaacaaatgacacaagtgtggtatttctagacaggatatgcactgggcttaaatttcttttccctatggaagccttccccatccaaaaacagaacaggctgggtaccccaccacgtgttcttactacacttcacattcatagcctttattgtttttgtaattgtctagatgtttatctaaagtctgtctcctcacactagactaagagtgaaaggagagcagaagctttatctcgttctctctcgtatctctggtagtcagcatggggcttggcacttggggaacatagtatgggcgtatgattgctggctctgggtttacacaggctaagttcaaaccctatcttcactaactgtggctaaatgacctttagcaagcggccaactcttccaagcctcaatattttatcctcgaaatagggatattgatggtactaaccatcaagttgatagaggattttaagaattaatacatgtagaatatttaggtattccccagcatataagaagtgttcaataaatgtctattattattaactactttggtcaggactccataaatactcattgaattaataaagaaaagcttacactaattgcatattaaactctgcaacagagacttggcatccacagatgtcaatatttagcacttccactttgcatgagaagggccaatcgtttgttgtcatttacagtttttttgtggaaaccatttcactcatccatttatttagatcaaaacccaaacgcaacttgaggaaaagagtctttcaacaggggttcacacctcagctaagactggcattccaagaatatccaggcagacagaagccgagttgcctggctgccaaaaaggctgaggttgggaaaatgtcacagtgtggaagatgtcccgagaagtcccaaacactcaatggatatcatcccagggcagtaagatcagagatcatcagctcctggaagtgacccatccgctctaaagccaaccatttttggggattggcttgtgaagggatacgcacgcagagccttcgggtcagaagcttgtgcccaatgcctaaagttgagcgggtgcagggaagcttgacctaatgagaagagctgtccactgaagactaagttactcttacttcccctcccaggtgccaggcatgagcagcagcagcctctcctaggacacccctacccccgagtggcttcagtcctctggaatgatgcaaatcaggcacagggatgaggaagcacagcctccaactcagcctgaatctttcactttcctacaaccccttcttcctccatgagggatctgaagccatctgcttcaccatacaccatccagttaatctcgttcaacatatagttcacctcaacaaaccttcctggggcagggcacagtggctcgcacctgtaatctcagcactttgggaggccaagacaggaagatcattccagcctgggagttcaagaccagcctgggcaacatagcaacaccctgtctctacaaaaaaactgaaaaacaattagcctggaatggtgacgcatgcctgcagtcccagctacttaggaggctgaggcaggaggatcacttaagctcaggagctcaaggttacagggagctatgatggcaccactgcactccaacctgggtgacagagcgagacactgtatcaaaaaataaaaataaataaataaataaacaaacaaacaaacaaacctccttgaaattaagcccccactgcccagaaaagctctgtgtctttccacctccagtaacaccttccacattcctgggtccactatcttgccactgagtcatgaagacttctgagaaacacacaagggagagcagagaaaacatcacagtttaggattttagagccggggggcggaaagtgcttctgctggaatttctgtcttcctaggcagacaagcaaaggaaatgccggcttccacatggagaggaatacaagaacctgcaaactgctcttcctatcccactcacgaagctctccaaaccgttcttcctcccaatagcagtgacactcctggaacaaaaatccagtcacaccagtgcctgcactggcctccctttaatcctggaataaaatccaaattcgttgagatggcccaccaggcctacctgaagagcatctcaattctattcctccaaccttacctgcagctactttccacttgctgttccctggcctcactggtcttcctacagctctttgaacaagccacacgttctcccagcccagagcctttgcacgtgctatgccctccacctggagacctccccacttttcacatgaccaagagaaggaggtaccttctcttccaccaggtctcagtttacatatcgtctccccagagaatctgtcccaactaccgtatatcaagtccacagttgaagactatctgcattaagcacttggttggttttagtcccagtatttattgtaatttgcaaatatgtgtctgtgatatcttacctcccagtggtatatatgcttcatgaaggcaaagaatattgttcatctgagtcggtgtttgttccctgtgcctggtacatagcaagagctcaataaactcactgtatgaatgaataaacccactccacatttttatggataaaatgaatattcaccagtgtcatttgtggccagacattataaaatgttgtgtgtgtgtgtgttatatagtatttatatatactatatattataaaatatgtaatatttatataaaatatgtgatatttatatatatactttatatattatgtaaagataatatgtatctttacatttattataatgtaactctaaagatacatatatatgtatgtatgtatgtatgtatttatctacaatgatctaggcctcaccggttccattttgcaggtgaggaaactggagtgtgagaggttaaataaattgcccaaaggcacacagctaataaatgacagctgtttgacttgtgccaccaccaatcacagctctggatagtttatctctgttctggaactaaaggcatttaaatccggccactgaggaggatttaaccatgtctgccagggcgtctgctgtttctcccgggactaatctgccatgaagcagatgcaaagcttcatttatcacttccaacaaaacatggaagagacaaaaccccagcggatgctccctgcttccagtgtccaacagggcagggcttgtcccatcagggcctccaaggtgcctgtttccctgaggaagggcccctcctcccatgtcaccggggtcactgccccttgtgctggacccagggctctgtgctctgcatcagaccagctgagctgctctgtccactggggtgcttcgctcttaatgaggtaaaattcccataacatagaacaactattttaaagtgtacaattcagtggcatttggtacattcacaatgttgtgcaatcacacttctatctagttgcaagaccctttcatcaccgccagagaagacccccgacccattaagcagtcactccagttccccttccccagcccttagtaaccaataatctgccttctgtctctatggatctgccttgtctgcacatttccagaatcatatcatatacatggaatcatacaatacgcaaccttctgtgttgggcttctttcacttagaataatgttctagaggttcatccacaatatagctgggatcactatgtccttgcaagtttgggcccctggccagttagagatgtcgagtcagagagcagcacagagtacagagctgatagccagacttttctcaacctcctcagacccactaagaaatggggacatcggaatcattgcacctggaaattttctccttctgcaacaggtgggcaatccctggggggaacttgcccccaaacaatgaatcaccctgaggagtgccacagcagatggcagggcctgaatgtggaccagacccattgaggacaccagagtccagccctggccagtcctgggaggtccaatactcacaaagagaaaggaaaaaccttaatatttacatacctgggcacttttgctaaagaaaaccaaacccagaaatcccaagaactaaccaaccccaaaagtttaaattgtgctgtattttaagtacaacagattgtgatctgacctcactgtggcatcagcaaaagatgttacatacatgacagagggtcagaatgttatcagttccttagacaggggccctgagttgtcactataaatacaaccattagattatctggcaaaaaattcagtctcagcacaaaacacccattacttcctagtgggagtatcagcaacatgtaccatatatactggtataattcttgccctaaatcttcccttctttcttcactcaatgtcatggcaacttccatccaacacaaaaacagcaggatttacaacggggtttctcaacttcaatcaccgcactgttgacattttgagcaaggtatttgccctggggttgtcctgtgaattttagaatttttagcaacatccctggtctctacccactagatgccaggatcacccctcccacagttctgacagccaaaaatgtctccagacagtgccaaatgtcatctgagggtacaacatcaagaaccagccacttcgattcaggtcaaagagagcggctacagggagatttctgactgaggttgcatgagaagtgcaggtatgggattttgagccgtgcttccaaaattaggtgaattagaatcaactctgaattttccaggggccaattattcacatttccccaacccctgtgcccgtactacctgcattccacccaattcccagccactcacaggcagctggcatgatgggagagataaagaaatttggaatcaagaatgcaggcttacaggaaagttggattattttgttttgtttagactagagagacttgtgcttgttaaaatgcaccctccttgcatcttgcaaagtttcaatgctgcccaaccttcccccagcccctggcagcagagtcactgaagaaaagggaaggggtccccttcctctcatctctggatggcaggaattctctcctgttctccatagagcagggaaattctaatgcttcccctctccctccagaggccaatctccttcaggcaaatagacaaggagagaggtcttctctgggggaccagaccaaacaatatcgcaatgtttgagggcacagaagaacaaaatatacacaataagagaaagcctcactttcatattacagtaaataaactttaaaaatctcctcaatgtctctttcactcaagcccttgctccttttctttcctcccctgcacaccaaacttcttgcaagaattgtgctcattcactttgtccaccctcatacctttcactcactctccaatccagtgcatgaggccaccccaccccaggactcccggaaattgtcttgccaaggtcactgacgagtgtctctaccttgtcactgaatctaatgaccactccttcatccttatctaggatgtaaaatccatgagaacagggaattatgtctgtcttgtccacttttgtatccctagtactagaacagtgcctggcacacagtaggtgctcaatacatgcatttgttgaatgaatgaatgaatgaatgaatgagtgaaccccacttgacttctgcaaggtatttccaatgctgaccactctctccctcttcgtatccttcccttggtttctagaaagtgacatgccaatggttttcctcctacctccctgaggactccgtccatctcagcctctttatggtgtctgcttccatggctgatccatgagatgctcttcaaggccctgcaccaggaccccttctcttctcactcaacaacagccttttcccagactatctcatggcctcattaccacccagggagggcagtactgtttgagctgccctacaccttatcatcatttgtatctaggaacacccggttcatcctctggagaactaccccttcccactccagcctgccccaggtatgggcacatatctcagagttggcttctcagagcctcacctgcccctggcctgagtgaacagctcagggatggtcatgtggcccaatacaagccaatgtaagtgtggcccaggatttgaatggttggtgatgaaacttctctcttttccagtgagcttagagaaatagggatttggccatcttgcttccctaaggaaagagtgcatccaggagttcagccagctcacacaaaaaaaaatgcaaagtgaagagataagacagagagagagtgaaagatctgaaactgatgacctcatgtgagtccttaaattcagtgatgcttgaaggaccccaccctagaagtttccaagtaaatgacccaatacatttactttttgcttatgccattttgggttggagtctatcatggataaccaacaaccccagctagagcgatgactgccacatctgtatcaccaggcctgattcaactctgagcatcagacccacgtatccaattgtccatggacatttttatgacctctgccaaatggacaggctgctgggaacacgttccatgaacccaaatctggcttgattaaaagagctgctcaccatgtacacaaccaaccccccatgttgtcctcatcccactgttggatatcctgccaactacaaccctattacaaatgttgacttcctctctactatgatatcatcccattgctaaaaacagaaacttgggatgcttcaacggggaaacttatctccaagatgtctgccatcaattctttgcctccctggacatgcaagtcattctcagctaagggctgagctagggcctattcctactctccctttgcatctgctctggccttagttattttcttccccaatagaacgcagtagtagtgatgttctggaacttctgagcctaggtcataataaacttcacaacatctgctgccactgaagaagttggtctattctgaggtggccatgatggaaggaagcccaagctagccacaggaaaaagccatgtagagacagagtgcaatgtcaactaccctccagctattccagttttctcagccctggtgctagtcatgtgagtagagcaaccattcttggatattccagttctagcaaatgccacttgaagaagaagcaaggttccagttatatggattcatttgagctggccagccatttttgcctttgatccaccccagcgggagcatcaaacattatggagtggagacaaacttttccaatgtgcctgctccaattcatgacccacagaatcatgaacacattaaacagttgttggtttacattattaggttttgaagtaccttgttatgcagcaaagataactgaaccactcagctattttttatgtttgccaaaccattcctgaaatctacccaaaacaaaacactactttctaagctcaccctggccagaaaaaatctctattgtagaactgagacaaagttattgatttgcctgtctttctcccttaccataccttgtactactccagggcttggcacagtggctggtgctaagacatccagtatgtatccaacgaacaaatgaaaggaaggaagaaggcctgagtgccactgccctccatgaaaatgttctgtgagtcctagaactaaccgtgtctttgggactctgtggcagcaaagcggtactgcaagtgttattataataacagtgacagaatccaagcctagtaatcattaaccatccccaagagagctagttagctagcaaagaagaaagccccctcctcagggttgggagcactggtgccctgacggcacttggcttcaaactgaactccccacgccttctcacagagctgatctgtctataaaattggtggtttctatagaaacagaagcactgtagtaaagtgaagggaaatcgtacattctgtcagcgtacagagatcaatcctgttcttatatggggccaggactctttcacgctttatttttgagcatctcaactttcatttccatcccagccatctcatctcatatttatgaggctcctgcactggtaatcctgtcccttctcacctagctgcctttgttaactacgaccatgggcagaagtctgtggaaacagcatggaatccctggcatcccctcgtagtgccaatagctccaaaccccaacctgagaggcagaactgggatccctggtgttctggggtggtaaccaagatggtggacggagtcactacagaggaggcaccacagccttccacctagacattataaaaatctactctgtaattgggtacgtgttttacatgcctataccttagctttagacagtctccatgcccttaaatattaatatgtctgcaatctctgttttgcaccccaaagtgcaagtggctttctagcaggcaaggaaacagagtttggcttgtatttgaattgctcatgctgtctctgatcatctacagagaaaattagaaaaggcacaggttatattttagtattttagatgaaggtccaaattttgaggcacgtgttaactcatgaaaattgtctgcttcaatcaagattcactcttaaaataagaaataatgtgatgttttcttcatcaaagagcacttttatttctgacctaacagcactaaatgtattttgcctttttcctgttctaacaaatgactggttggatgaatagaaataaaatgatagatggatgagagaatgaaggatggatggagggatgcatggatgggtattaatcgtggatgtgtggatatatgatagatggatgggtaaacaggagatggatgaatacatgggtagatggatgggtgggtatatggatggatgcttggattcatggaggggtggatggatggatggagatgaattataaatgtgtgaatggatgatggatgagtagatgggggatgagtggatggatgggcagatgaatgggcagatggatagatggacagacaggagagggatagatgaataaatagatgggggggtgggtaagcgagtggatggatggatgatagagaaatcacccatcagcataatttttctaagatgtaaatctaatcatccatccatttattcatttacatttttgagcacctaccatgtaccaggcaagatgtgaaaagcactgaggattcagcactggatatctgagataaggtcccaatccttgaggacctaagatttcaatatctttaaagtagtaaatagattaaaggcaataagagtgggtgcagggagaggagtgcaacatctattaccatgatccaggtgagagctgatggtagcttggtctaggataacagcagtggatacacggaggcagaaatagattcaagagttatcagcaggccttgatagctgactgagttgcacagccctgagtctaaatctcagttcagccacttacacgctgtgtaagcctcaatttcctcagctgtagattgtggataattgtacctatctcccagagttgctatgaggaataaatgagatgaagtatgtgaaagagtcagacatagggcctggccaagaaaatgtttttaacaccaaaagcctccattttaggaaaaggcacccaaatccctgcttcttgaacccgggctatgagctgtgaggaatactaaatgctattagggttaaacagtagtcagaaggtcgagagagactcaaaggcatagcagggcaggatcatgtggccacgcagtgtccagcctacttcctcccctctcccaaggacgcaactagctgtgtgccacaagcctgctccacaccacatgagtccacacgtcatgccaccatggctagccattaaaaccacttcagaagcctgggcccatccatcgcagttggcgcaatcaccaaaattgaactttcatggagccagaatcaaagggctgcataaactaggattgtgtcctcctccatcagaatcatcttgcctctgcgtagctatgaaggacagtgagaacaaaaataagaataactaggcagaactctaagcaaaacagtgcaggaacaaaaagcagggacactggaacagctaggctgcctgctttaaacctcaattctgccacttactagctccattaccctaggcaatctgcacaacttctgcgtgcctcagtttccttatctgtcaaatgggaataagtaccttcttctaggcttatgataactaaggtgtgcaaatatgtaatgcagctggaacaccacctggaatacagtaagcagtatataagtgtttgctctaggtcgacttcatcactgccaagcactaatatgctccagttacctcactgagtacataaatgcactattccatttggtccacatgacaatcctgagaatgggttacaaagcagggggtctggaaatagatctaccagcatcttgctttatgggcagacacagaacctctctgaggctctctttttcccaccattaaaatgggtacaatagcactaacagcaggtacctaataaatgagacggtggattcttttgtatatactcttaaaaaaaatcttaggttggataaatagtccctttgtagacacagatctgaacgcagcaaagccattacctccactttcatgcccttcagctcatgccttaaatgggtttcttccccaccagcctttctctttttaacaacactctgtgccactgcagaatctgcaaagaaaactggaccaggccaacccaaaggaagttctgagggtggaggaaaggaaaccaaatctaaactaaatgacagctcccttgagtaggtatcctgagagtcagcagaggggcaaggctgcataaaggcggggagggtagacagagctgtgccttccaccactgccaaggtctcagctagcaggtgcatagtgaggcaggcctggccatccacagtgtgcagaagactgaggctcagagatgttaagaaatgtaccagaggtcacacagctcagtaagaggtagagctgggattcgaaagcagatctaactatctccaagtgcccctgccatggtacccactgccatccctcggtgaatcacacaagataaaagtataggtgagtctgtagttaagccataacttgttgttcacttgaagaagagctcagatgacctctgttcctggcgggggaagtatcttctcacttccacctgcagttaaccctgtagaatagagtctatcacactcctagaagagcctctggccccagcactcagaagagtcagccatctaaagctgcccagcccgtggagaagctgagccctcccgtttatgtaaaggcagcagaattccaccttgccaatttcttagtctctccagagaggacctcagatgactgagcctggctaaaccggggtttctcaatcttggtattattggcattttgcaccagattcttctctgtttagggggctgtccagtgctttgtagggtgcttagcagcatctctttcctctggatatcattagtacccctttcagtcgtgacaagcaaaaatatccccagaatggccatatatcccatgaagggaaaaatcacttgagattgagaatcactgccctggatggctatatcacagcctgggagataatggacgagtctgggagatgtcacagggggaggagggactctaagacctcccgtgggatggctgaccctggtatagtcacctgagctgagggtgggccctcgactctgcacaccgttagttcaatcctgccagagttgactggtctcagcgagactaactcagtagatccaactcataagaggttgatgtgtaacttgtattccaggctgttgatgtcccaggagaaacagaccttgcaagcagatcagattttcctgttatctaacctgtgccttcttctctagagggaactttggggaagcaaaatcatgataaggctcttgtttggtgagcaggactggagggaggaattgatggaagacttgggtgagtgctctggggccaaatctccctcccctggtccaggaggacagcatcccagcacctcttatcactttctgtctcctacagttaagccatgacctgacgatacatgcaacagtttgcctatcagacagctctgccagcctacaagttccagaaaggcaagcacagcatgttatccacatcttcagcagtaagtgctacatagaagatgctcagtcaacgtgcgtgtttgctttttttttaccatttgcagtcaccttcctaaaaaggaagggtgtgtggggaggggaggaagaaagggaagcaaaagagatttcctgttgcagaagaaaaatggcataaactctagagaggctaccatatctctaatttgacctgagctgagcaatatatccaggatttaaatgatgctggtcactcacttctttctaggtcacctttgtccaaggagacatccttagaatcacaatagtaggagaagacgatggaagaggagaggagagaagggaaaggaggagggaagggagggaaagaagaaaagggtagggaggagaggaagagggagaagggagaggagaaggttaaggaagggtagaaagggaaaagaaaggacaaagagggaagggccagggaggagagggaggaggagttacacagaagctcattccctatggacaacatgagtttaagaaacgccgcacactctatccccctcttagtgatgcacaacacacgttgccatagcaatataaatcatattaatgatcatcatcaacatttattgagcttttactgtgtaccagacactattctacaagcttatctgtattaacaccattaatccttcccacagccctgcgaggcacagatacattaaataacttggttactctaggttactggccagttagtaaagttgcacggctgaaaaacatggcaattcacagaccccacaaggtcctgcattaaaagcctacaatcccagaatttcccacacttgctttttatgtttgttgtcacaagcagcatcttttaacaggctgtggaacacattctggaaagcacagttcaaggacaatgtcggtttggttcaccctactaagtgcatgcctgaggcctcccaagaataagcctcaattgccatgactgaggggcataaccgtaattagtatgattattaacacttatttattataacatcctttcacttgtacttacattattgttccttaagctttacaatttcttcatgagtaaagtactgagattactgtcctcattttccagacgcaaaggctgaggctcacgaagactacctgactttgatccccagcccacaaaccacagtgcagcccaggaacagaggctgaggcagtacattctcacaaagacttcactgcaggggcaaagccaaggcagaaaaagtgagggagaaggagggagggagggagtgagggagaaggagggagggagggagaaggagggagggagggagggagggaggatgaacctatacaaggcagtgcatccccgggccagccacagctttgccagtaaacatcaccgcttgcttgggcacacggcagtgtggaagcccttggccttagcgcattcccttccaggagaggaagggagaggatttatctgctgccttggttcctggccctctggttaaagctttcccccacacacaggtggttaactctattgcatgtacaggttgtgacactcaagctcctccatgcagtcgttggaaaagccagatcctaccccgtagtatggggtttttccaagcattgtctgcccaaacttggtgagacagtttggatgttatcccctctaaatctcatattgaactgtaatccccactgccggaggtgggacctagtgggaagcaattggatcatgggggtgggatcctcatgaatggttcagcacctccttttggtgctctcctcgcaatagtgattgagctctcacaagatccagttgtttgaaagtttgtggcacctcccccagtaactctctctcttgctcctactctagccgtgtgagacacctgctcctactctagccgtgtgagacacctgctccccctttgccttctgccttgattgtaagcttcctgaggcctccccagaagctaagcagatgccagcaccatgctttctggaagcctgcagaaccaggagccaattaaatctctctctttttttttttaaataaattacccagcctcaggtatttctttcagcaatgcaagaatggcctaacacactagagcaccaaagactctgcagctcccacctgggcagaaagggcagaggagactgtgacaaagtctcaccttctcccctaggggaaatgagacagtcagtgttgttaagagtacaggtgacagcaacaacggtcaggactatgcactggccaagaagtcaaggcttggggaacaggtgggccaagtgaatctaggaggcacataaactgagtccaagataccgtttctttgaatccaaaaatgagtgttccttcattcagtggcaaaaagcattcaactcaccaaccaccccagcgcccaagtcacctggatctaaaccacccattggaaatgcagatttctgggccacacccagaactaaaggagtggtttcattgggagattcaaccacggagtctgcatatttttaacaagctctccaagtgacttttgtggtcactaaattttagaaacacctaggacagcatcaaaagctgccctgagcatgccggaactccccagctcatttgatagggaaaaatcgaaacctagaagtgattaactacagatcaataaaacagaacaatgaatcatgccaaaggtcgagtggcagtacgcagcagtacacggcaagccaatctaattaggggccctcgtaaacgtcacctgctcataaacatttataaaaacagatttcctgcatatggaagggtgttaatttttcatatagctgtaggtaaagtaaatgtatttttaatctcatacattgatttaacactgtatttctttttgaaagactgggagactcagtctttgtttactgatttctatatcagagaaactgctggagagagacgccagagcatactttctctcctcaggaataagggaaatcttctgattcttccacattcagactctcccttggttctcagagcccaggctgacatcagatgctacctaacagagacaaatgacacagggtgaggcaaggcatggaagaggggtgtcagttctgcaagggagatgctgtcacttgtaaagattttcattaataaaccttctagtacctactgttgcactgcactgtacccatctctggaaattttttaacaaactcagatttaattttctttctcattaattaattttttattcatctcttccattagagcctaaaacctcccaattacacattattagctcagaggaaagttggtaattgagatggtcccaggattccaggagtgccctgtgcagaatgtctgctttaattagatttccattaattacttttttatcaattaatattgggtactttgggcccaatacttgtgatctccacatcatgcactcttaaatgacacctcatttattgcagtcagtcaagcaagggacccaaaaagagttcagcagagagagcggcagacaggctctgtgcctcacatgcaaatgacatagcatgcttgcttgcaggggtgagtttcatcccctaatgtgtacctcgagaggctaggcaggttaggaaggagagatagagagagggagaggtggggtgggggacagaaggtgggggacagggagagagggagacagggagagggagaaagggaggaagggagagagtgaggaagggtgagaggagaggagggaaggggagaggaggggagggaaggggaggggagggagcaagggaggagggaggggagaggaggggctgggaagggaggggaggggaagaagaaagcaagggaggaaagggaatggtgggaaagggaagaagggaggaaaggaggaagggaggaagggtgaggaggaaaggaggggggagggggaggggagaagggaagaaaaggaaggaagaaaggaaacctacagaaaaacatcaaaagtgtctagtccaatcaaatcatttgcagatagataaatgatggccaggaagccaagtgacctcaccaaccctacacaacattaggctagaacatttttctcccctccacattgtcccctgcacctccctctacccctttactaggggaacacataatttatcatctacactaggacacttttaagagagaaaaggactgctgttaataattatactggggaacaatagacacaaaccccagcacaccaagatgtattgtcacccaacccttcacccctcggctgttaacttatgaacctcctcctgagagagacccactttttcaaggtggcaactctgcctctgcagccttaatatagctcagtatttgcctggaaaatcaatatgcattgattaatgacaataatatgatgcaacctccaccctctgaattcgcttagtattcccactgtctgtcttaaattaaatgtttcagttcacccagtatcttttcccaactcatttctcaactattcttttatagaatgtaacttaattgtactcaataccctaacctaattagattggcctaatggttaaaagtaacccaaaactggactacttgggtttgaacttagtggggtgtctttggacaggttaagttttctatgtgagctttcttatctgtaaaatagtacctacctcatagggttcttatgacgattacatgagctcatgtacgtcaagtgcttagaatactacctggttcatagaaagtgccatgtaagtacttgctaaattaaataaaaataaaaagttagagaaacggtgatcaccaaaagacataactaatttctcgccctaaactaagcggaatatctcaaagtcaaggagaagaaaagaaaaccagatgtgactgaacatagcttcctgtgccagggactgagacccgtacttcggatgcatcatctcatttaattcacagaaaagcccttgaaagtaggtattgctattatccccattttatagatgagaaaacagagattcagagagatgctgtgactggcctccaccatacaataaagccaaatcccctcaaaatccagcacaggtgggacaactggaaaaaaaataaaacaaaagcccagggtttcaggctgactttcaccttctgcttgaatcctccttgtttctagcttccactagcgcctaccccaagggagctctgctcccttctttaaggtcagaacccatgcacaagccattccttggttctgtgaacagctgacactggctgcaacttgcagaaagatttcctaagtccttaggggggagtccaagagagaacaaggacaggagacacagaaatagcccagccgacaatggacagtgccttatcttctggaggggactcactccttaccagggacctcgcaagctcatctcatcccatgctcaggttcctagaacaacatcactctcacctccaagggctggcccccttttcagacaccttgtccctcccatcatctactcacggagtgtctgggtccttaggtgacaatgagcaagtctggactctgaccacccaacctatttactagctactaggaactccctcatatacagtcaccaactagatcatatgtcaattttaataaatattttcactgatttattagtccatttctgctgatacaacaaaataccttagactgggtaatttatcaattgtagacgtttatttttcacagttctgaaggctgagaagtccaagatcaaggtgctggcaggtttggtgtctggtgagagcctgttctctgcttccaagatggcaccttcttgctgtgtcctcacagggtggaaggggagctggaggacctaacaagctccctctagcccttttataaaagcattaatcccattcatgaagacggagccctcatgacctaagaacctcctaaaggccccatctcttaatattgttgcattggggattaagtttcaacatgaattttcaagggatacaaacattagaccttagtaatagcaaaatatctcatgtagtcgcattaatagaagtaccttctctctgggtatgtgtagtcgccagcctgcatctgtcactgtttcctctccccccagtattgggatcacactaggtacatgcacacaggtacacacacatatacacacacagcccttaagcaactgggttgctaaacaaccagcaggtaatacaagcagcagctgccagagtgatacaacgatgtcataaacagcaccagagcagagagtaagaagcaccctaaatgattcatttccctatgttgggagaatatacccagacaggtatagctgttcccatttgtaaatcactaagaatgaaaaactataaccaatatggggcctaggaagatattttgtaaattaaataagaatgaagtatgcagaaaatgtatatttttctaagatgatttattgtatgaaacgccattaaatttcagactatctgttttgtgttcataaattcaagaaaacctggtttccatgaaaaacaattctttttttaaaaaaatgagataaacagataaaaagagatctggttttaaaagctagaaaaaaaatgaaggtaggtaattaaaataaagaaaagcctgtttgaaatccaattgttgataagaagattttaatgctgtaaggagcacagaactgtggaatacagaagcagcactgtgtacaactttccataaatgaagaagaaaagaaggtggtgataaagattgctatggtgcctgttggtgctccaaaaacataaaaccttcttttatccctcattccaagcagacctccatattgtgatacccttactcagagatgttggatattttagttattatgcacaattgcgtgctggttcaataaggaaaataggaagtaagtccttaaaaagaaagattatagctacatttcactggaaggaagtagaatgagtgtcctcgaacagaggaaaaggttaacacaatgttattccacatcacagacgcttcacagaaatgagcaaagatgtggggtgtgcactcctttagggcaggggagaggaaaagaaaccaactcaactgccttctaaaggaagagcatgtgggagggggcccccacactctccagggaggggtactgtggtcagttgaatgatgggcccctaaaaataagtgtccacattctaatccccagaacctgtgtatatgctacctcacacagcaaaagggactctgcagatgtaatgaagctaaggatcttgagtgatgagaggaggctggattatccagtgaggcccaatgtaatcacaaacgtccttataagtgaaggagcggggcgggagggtcagagaaggaggcgtactgatggaagcagagactggaatgacgcaaggccatgagcccaggaatgcaggtggcctctagaagctgaaaaaggcaaggaaacagattctcccctacagcctccagaaggaatgcagtcctgctgtcaccctgctgagtttagacttctgacctccagagctgtaagagaacagatctgtgtcggtttaagccactaaatttgtgttaacttgttacagcagcagtaggaaactaatacaggtaatgtatccaaaagaagagtagagaatgcaaaattaactctcagctcctacaccttctgcctagtttatagggttgatatcttcctatcattagttgaggcattaatgttgaacaacataataaatgcagaatttccatagagagttcaaagagcactgaaactttagcatactgggtaagcctgttgttacaggtaccagtgcagacagaaagctcccaataataaaatgaccaggagtaaattagaaatatgaaagacaaaagagatatgttatagggatgaaaagaatacctaaattacaaaaaaaaaacctttagaacagatttaaaaataagctacactgaatgtcctaaacatcctgaataacatttttccaagcatacaaaaagaaaaaacaagacatttacatggataaacatttatataagtaaatgactgatctcagatttctttacaatactgggctgaaaacgctaatgattaaatatctgcaggatttaaagcactctgttcatttatggaagaagcagaaaagtatttacaaatgtaaaaggactcagaaaggatgtacagaaacactaccaccaccatttacctcctccctctgccaaatactaaaagaaatgcctaaccaggccaggcgcggtggctcacgcctgtactcccaacactttgggaggctaggtgggcggatcacttgaagtcaggagttcaagaccagcctggccaacatggtgaaacccagtctctactaaaaacagtacaagctgggcacggtggctcacacctgtaatcccagcactttgggaggctgaggcgggtggatcacgaggtcagaagatcgagaccatcctggctaacatggtgaaaccccgtctctattaaaaaatacaaaaaaattagccgggcatggtggcaggcacctgtagttccagctactcgggaggctgagcaggagaatggcgtgaacccgggaggtgaagcttgcagtgagcttagatcgcaccactgcgctccagcctgggtgacagagcaagactccgtctcaaaaaaaaataaaaataaaaataaaaacagtacaaaaattaaccagatgtggtagcaagcacctgtaattccagatactcgggagactgaggcaggataatcgcttgaacccaggaggcagtaagccgagatcgcaccactgcactccagcctgggcgacagacccagattctagatttggtctcaaaaaagaaataaataaatatataaaaataaaaataaaaaataaaaaaataaaaacaacctaaccaaatggggtcatttttaaaaaataaaaaatgagtagttacatttttaaaagttggtcgtgagtgcccaagcaaattaaatatgaaattttcttaaaaattgatgtatatacagttatagaaagaatataaatgctataaatagttctttgtaaaagatagagacataactttaaataataattattaaattagaaacacgaataaaaatcccatacttaccattaacaactgagaaaatgagtaaggcttatataagggtaggtcaaactatgctacccaccctaccctgcacaggggaaagccaataaaatactttgtattctgaagacaattaaaaataagttttaggaaaaattaaatttagatacatacttaaggcagctaaacgtatccaagagtaaaaccaaaagcagaatataatagaaaacctaatcacccaccacagaatcagcaagctctctaagggccaaacagcaaatagttcaggctttcgggctacatccagttattgctgctgcctgttctttgttttgttttgtaaccctttagaaatgtaaatccaccattcctaacctgtgtgctgtcaaaaacaggcagtaggttgccagcccctgcaacctactgcctgtagggagttagggaggaagtcaaatttaaaaacaagcataagaaatagaaagcattaagtgagataaaattcagacacaatatagttatcatattagtataaattgcctcaacttctctagcaaaagaaattgtctcacagactgagtcaaaaatcaagtgtatcgaaatattttccataagatgtgatcttaagcaattagattgccaagaggttaaattgaaagcatgggtggatttaataggaaaatgtcaatagaaaaaaaatgcagatgtaccaatatccatatcaaagtaaaattcaaagacaagtcattgaacaataccaaaaaagctattctacattgataaaaggtataattcacaaagaaatatatcaactatcatgaccttttctgtagcaggtagcaatgcattgagatatagaaaggaaactgttagaaacccagaaatcaacaaaatacagtaatagtttgagaatttaatacaactctctttaagtcctgacagatcaaaaaggaaaaatttaaataaggaagtcatgactaatataattagtaatattgatttaaagacatatatcaaacctctctccctacatggaattaattatttttcctgtgctttgagtattttttcggtgatgattaaaataacaataaggccacaaagaaccatcaccagataatttttaaatgtttttatgttgtattatctgaccatgaggctaaagtttgaacaaaacaaggatatttcagcattcataaatcaattaataggtttaatccaaagaggaacatattttaagttaaaaatcatatatcaatagatgccaaactgtatttgattagaatatccattcttgatttacattcttagtaaaatagttcaattattattttaaagtgattctctacctactaaatccaaggttatcaacagaaaaattattgtaatttataaacaagttcagtaagatacccagcataaaagtaaataagtaaactcactgctttttcatataaccccaccaacaaatttggaaagataacgccagggaagaagacatcctattccataaacacacacaaacccaaaatgctataaatactcatatataaacagaggtgtgattgcaaatgttcacaacaggtcctctgggaaagaaagcccggatttatagtatttgctgctctctgtggcttaaataatgccacgatgacctacttcaaaagaccaacatgttaccactgaaggcagatatacaataagatactattatacagtgtttccaacttacagatatacaatagacatgaataacctcaagagtgtagataataaaccgtagtaaaataattagggagtcatgagttttgaagataacctttgtttttacatatagtgtatatagttgtaggtttctataacttaagtttaagaatgcctgtgtttaacaaacacctcatggaaattctgaaaatttaatagctcttatgagcaggtaccaggctgattccagcatatcaccgtttaaaaaagtccccaataatcttaaccagaaagattcagtacttgcaaaaatattactgaacttaactgagagccataaaacttcaacaaatagaggcacacaaagctcacagatggaaaaacttaacatggcactgatgttgattttctttcaattcatctatacatttaagaaatcccaaacgatacccccatttaattttctttggggacagtggagaagggatcctgaaaaagcaatcctaaatttgatgcataaaaacaaacattcaaggaatagctaggaaaattctacaacaacagtaatattcaatgagcatttaatcttaaagacattacaaagctagaaggtgcagaaaagtgtgtcactaaacaccggagaagacagaagctatggtctcagtccagtggggtagaaaactacccagataggtcattctagttccacacggtaagaaccatgatggaatagccaagaggagttgggggaaatgagaagcttgggaataccagagaaaggaagtgacatctgaattgatttgccttttcgggtcgtttgaacctttcgtcaaattggcgtccagaaagcttgcacaatttaaaatcccacaccagtatatgaaactattttctaacatgcttgccaacactgggtattataccatttttattttatcttgcctagtagcttaccttaattagcatgcctgatgtttaacgaggctggtaatatttcataaacttatcggttatttctatgtctatttttgtagaaatccctctttcctctgtgttccctcagtccctcctgctctcttattatagatctcaatacactatgtcacacgagctgtcacagccgcttgcccatccatttcccccagagaccaaaagtcagaagcaggcctgtgtctgtttggtcgctgcatctgcaacagaaggtaccgcccaacttatagtagaaactctgagaacatacacccagtgaacaagacggtgggttttagaacatcttcacctgggtgtcaagagcaatcacatgtgaaccacatcaaaatggtgctgcttcccccgcaacagagttctgccaacattattaacggcagctgggcacaaacaaggaggaaaaacaaaaatagagcaaggctgtagttcattccattgtacgtgatcatcaggcagagaaaagttcgtaaaaatcaaggagaaatttcttcagaaaatacattttccttaagagattgtttcagtgtacctgcggaactgtcagagaaaattagattctccgcaaataacagtcacttgcatttctactttatttctaaagaattcctccactttaacttccatttgttgtgcttttacaacaacttctttaagagaggcatttggtctggtattatctactcatcagactttggaaaggcacctcgggaggtgatatgactctttagcagacgatgagtttattcaagtttgctgtgacatttgtgcaagagcccagcccttcctcttgtagctacttaaagacaccctgagaacaggaactgctccatccctttggtagctgcagtgggttgagtggtggcccccagaagataagtccatctcctaatctcttgaacgtgtgaatctgaccttatttggaaaacgggtcttagcagatgtaattaatttaaggtatttaatttaattatttaaggtattgagatgagatcatcctggtttaccaaggtgggccctaaatccagtaacgagtgtccttataaaaaacagaagaggaaaagacacagacacgtggaaaagaaggccagaccaggtggagatcaaggcagagagggcaatgatgcggccacaaagaacgctgacagccaccagaagttggaagagacaaggaactgattgtcccctagagcctccaaggaagtgcagccctgctgacaccttgatttcagactgtggaccccagaactgtgagagaacaaatttgtgttgttttaagccaccaaatggatggtaatttgttactacagccctacgaaccgaaaacagtgaccaaccccattcaccagccccctaatacctttgtggcatttgtattcccccacccccacatgctgcctccttccctcctaggctgttattcaaaccatcgcagcagcctcctcattgccctcgctgccttcagcctcgccctctccaagcccacccccgctaccagatgtcaggaagaaattccaaaactcaaaccaaaggctgatacgttcttgccctacacttcactcaatgctggcaacccaatgagggacatcaggataaaatcgagaatgcgcggtctgtgcttgtgaattcctaccacctggccccagctagcctcccatcccttatatctgccaagacaaattcccccaaatcccctctcccctggccagaagtgacctccacattcagccccgattatggaaggctgtcacaggctattccttttgctgggtaagcccttccccctttcaagtctatgttcaactgtcatatcctttttgaggacttcctttagctcttccctccacctctactgccacacttaacagagcggagttgtctcctctggcatcccattgtcgatagcccactcctgagttacagcaacaacggccacctgactccactcatctgttgacctgtccatttctccattagcctatgatctcctttagggcaagattcatccttatctgattcatctttgtatcccagatcttagccaggcaaacaacagggatccagtggagagagagatggataggtgggtaggtgaagacacagatgtacggttgaacacacaaactggcaaagttccaaatgaactaataagtggacacctcactgagagacttaaatgcagaagggtgccaggacataagaggaacggctgcgagttatgaaaatgggctccatggggcaaatcaaaagtccactgaaggcaaatgcatcataacaagactggcatttcctggagtttccgggctgatcaatcactttcatatgcatcattcatttactcctcacaatgacctggtgaggtaatgagttactattagctcaatgcacaaggaagctgaggcttgtggacatcagctgaagtctcacagccagcgaatggcaggccagggcaccagggcctaggtctgcctgcctcttccatccaccttctgtcatcacaagccttctgatctccagccctctgatctgccccagtgggaccctcctgcgtctctgctctagttgtagaggacccatcaggcacttagagagaaatgagtggtgttgtgaacattcgactgtgtccatgtggaatccacacacacagtttgcctgaaaatgactgataggatggaaactgacaagtcatcatccgcttcgggcaccagcgatgactggttaacatgaatattgtgttgatttccgctagatagaagaagatgtcacttgtcgttaatggggtgtcacacgtacacttgcctaaaggaaaatgctcttttggtgattgttctcaattttcacctcattttatagccataaaaaagaaaagattcagcagaaaggatgaatccacctaggggtaggatggaaaggcattcttctcatttatttccttctttctttaccagaacaaccaaaacccagtgaaaatgctggtgcaagtcagaagagggggacctgggttctaagagcagccaggtactctgggcttcagatcagagcctcagaatccagcagttatgcccacaaggtagccaaagtccagccagtaccaccggtctctcggccagctatacttgcctctgctcaacaatgatgatttgaacgtacatgtacaaataataacagataacattactgagcactttactatgaactatggaatgtgctaggtaaagacgttactccacgtaagccataaaatcaacctatggggcaggtgcagatccacaaaccctgatttaagaattctgaatcctcaaaagctttgaaaaccaaaacattttttcgtaagtttggtacagacttatttggtgctaagatttgagttaaagtgatatacattgactaatagttttttctatctccttcttactattaatattcatactttttgctacaaaaatatcaacatgcttgatttaagggtgctaccacagcctctgctgagggatgttattaataaatatggtacatttactatattgctttcctttaaaagttaaataaatctaaatccgagcacatttggccccaaggactgcagacaagaaattgagaacctgttaaacccattatatggatgaggaaacaggctcagaaaaggtaggaaactttcctgaggttacagagctcaaaagcagcagatgaaggtttacatctaggcagccttgctccagagctggcccggttaatcagtgggctttgctacctttgacaaatgcccctgctagctggtctcagccccatcctcccagcgcagcagttcagtccctgtttgttcttgagcaagaagtaagcatgtgccttcttagtcgaggtacaaggcaatccccagggtatccggatcataattacaatgctttattaatataaatctcaggatatagacctgtgtttcaaatcaagagtcaaacacaacaataacatcagtcttaggtaactaccagtcaaggattcggatccagacttgcgcttttacaatgagaagcaaacaaagacgactattaattggctgatggtcagccagtatcaaattatcacattttctcacactacagtggttatacagaccctggagctagacaggttgtgctgaaatcctgggtcagccacttaatagttatgcgaccttgacaagttgcataacctctctgtgcctcagttcccttatatagaacatgggggtaatgctagcacccccctcaccagtcgtcatgaggattaaatgagattgtatttaaagcatttggaatatagcaagtccaatcttagcctctgctcccagacagacagatgattaggatggataaatagatgctttgcttcacattttaacttctctgaaattggggctcttcttaccattgatgtgtacttataatgtttatattgttattctcagaaagctgcagcttaactaatggtgcttctttttctttattgcatcttagatacgtggtaatatggtaaaatactttggaggaactggatgtatttttcctctggtctccagagaagaaactgagacgacagcaagtcacagattcaagctgtgttcataatgtgtttccacgtggaggtcacactttcatgttcatgggcagatgaattctaacaccaaacaccaggctgaataggtgttcccattgcaagagaagtgctgtgcacaatttttatttgcatttcaaaaccctaacaaatggccacaatcaactactacaaatttctcctaattagttttagtctgcacttctgtcacctttaggagagagccaaagattttaaccttcaaaattatcagcaatgcatgtcagaaagcatttcaaagaagagtcaaagtgcatgtagaaactaattgctgtatctgaaagtgctgtttgaagaatttttcagtcttcagagaagcaagttccccaccccttgggaaaactagtcttcaaactaaaagtttccccaaatcatatacctgagaaaaatgttaaaacagacttacccaaaaaggcaaagaaataaaactgtaagaataaataaatcagaaatcagatgtctctcccctgtttaaaatcctccaacagcttcctactttacttggaataaaacgcaattcctttaccatcaccttccaggcctcatgtggtctgtcccccacccatttcttccatttttttttcattctgtgttccccttcacaaactgctccaaacataccagtctttgttgttgtttgcttcaaacacatcaagtatattctcgcttcaactactttgctcttggtattcctccttcctagaaagattccctaaatattccccaactcccctacccacggataccaggctccgttgcacaggatcgccaacacacaaggtgacttagacccgaggtaactttttctgattcacacaaaagaaccatatgggctagagcagtcctgcttacctacaatgattcattcatttctagaacaaatgttaattgagcacctactatgaggtaagcactgttctgggcactggaattatagccttgaacagacagacaaggcctttgccttttggaagctcacatactagtaggctgaggcacacaatggatgacaatttaacaataagcgaataagcaaaatatcagaaagtagccagagtgcacagacaacctgacgtggttatatgacagtgactgaatggtaggtagtcaaagaaggcctcctagaggtggtgatacttgtcgtgaaatctaaatggcaacaaggaatcatcatggaatgccatgcctcccctccccaaccccatttgtttgtttggggaggggaggcacggcattccatgcagaggaaacccaaggtgtgaactttcacaaaggccccaagtagtgcacaatcaatttgttttagaaacaagaagttggaaagtaatggctagagaagagaaagtcaaagataaggccagacaggtgggaaggagccaggtgatgtggggctctacaagtcagaataaagaatttgaagctgggtgtggtggctcatgcctgtaatgccaacacttagggaggccgaggtgagcagataacttgaggtaaggagttcgagacctgcctggccaacatgatgaaaccccgtctctaccaaaaatacaaaaattagctgcttgtgatggtgcacacctgtagatcccagctactcaggaggctgaggcatgagaatcacttgaacccagcaggcggaggttgcagtgagttgagatcacggatcgtgtccctgcactccagcctgggcaacagaatgagactccgtctcaaaaagcaaaaaaaaaaaaaaaaaaaaaaggaagaagaagaatttgagctttattctaaagtgagctatgaaaatatttgaggttttaagcagggaggtccatgagctggcgtctattttggaaagatcactctaactcagggttgtcaaaaataactttctgcaatgaagtcctatatccacattgtcaggtgcagtagccactagccatgtgtggctactgagtacctaaaatttgactggtgtgacccagaaactggatatttaattttattctattttaattaattttcatttaaatattcacatgtggctggtggctactctattgatcagcacacctgaacagctgcatgaagaatacatgaagggtgtggggaaagatgagagtacaagcaggaagattaatcaggaggctaccacagtggtccaggggagagatggtagctgcaagcagagatggagagaagaatacctttcagggtggagccaagagtgtgagagggagaaaggaagaatgaggaatcgtggataccacctagatttgtggtttcagaaccaaatggatggtggtgccattttgatctgggaaagactgaggaagtagtacgttttggggaggaaaaaaaaccttgaaaataaccagctcctccccaagtcttcatgtggcagcttccctcttaacttttggacctaaaatgtcagctcaaatgtcacctccccagaggaactgttgcaatctccaccccacttctttatcccatcctctctctctctctgtgtgtgtttgtgtgtgtgtgtgtgcatcatattgctccattgttctcctccctgtagattatctgcaattatttaatcacgaatgcattgcctctctcttctccaaactgtaaactctctgtgcagcgacctcagccccttttcccacagtggtcccacctacctggaacagtatctggcacatagcaggtacttaaatatgaattattaaacaaacaggaataattatcttgccaaacaaaacacggctaaagcctcaaagagtatgtttctggtttgaatttcagacaacataaaatagaagaagacaaagtatgctcacacacctgctcaaataattgttgggatataactgggaaataattaattgggatacattttgtttggggttattttaccagtactccatttattcagaaaactgagtatagtttccaggtaatgagccacctcatctgacagatgcagaagagagatgctaatcaggacggtgattcctagcactacagtcccatttctctcccagagtatttggggagacagctgagagtgtgtagaatgaaagcagggtaatcccaggctgccatttttgaaagttcagagtgtccttaagagccacttgcccttagttaagcacaccaccatcacccacccatatcccgccaaccagcagcagatgctaccccagctgaacaggtgtacgtggctcaatgcaatgagaagggactttgcaattaaacagataataatttgaattcagttttaaggtcttgagaaaattgcatagcttctctgatcaccattccccatctgaactccccaacaaccaaaacctctagatattttcttgccaactacagctaagccacatcacccccaaatttttaagccccagagtacatctttgcatttacttgcttcagcaagttaagcaggagtttcactcaactttgtcattatttttcccactctcctctccaacttcattctctctgtaaacgcatcatacctcagtgcacgcgcgcacacacacacacacacataatcatacaattccacacccacagacacacacagagcttctctgcagcttctttcactctacactgactcacagtcgtgagaacacatttccttttcctcttcacaggctcctgaaatgagatcatatctgctaaaagcaatcgcaagtgctgggtgaacaactccagaaaattagtacaagttccactacggctagagacagagaagaggaaaaatctgttcaattttgactgtattcgcattacccacaaaaggaaacatacttcttatttcttccacttatcccaatccttaacaaaaattaaaacaaaagctataagctatttccagcactacccccaatggtcatttttaatttgtcatcagcattcgttccaaatcagaaatgtaccagtcacttcactttttgagtatgatttctcatcagtgctgctgcatcatctctatttccaaggaagctaaagacaacataacgttttaaaaaataactagaatgcattatagatttaaccatgagtcatcacagacattgaataaaagtataactctgcctccgtgagcctgacatatagacattctgaacaaggaaataatctgtggaatatctgatatagacacaaaggacaagagattaaaaaaaatcagatgtgaaaaaaatgttgttttccattgctttgaaaataattgaaatgaaaaactatctaatatccactcaatggaatatcatgcagccactcaaagctatttttacaaagagtttttaataacatgagagaagtgcatatgctatggttacatggaaaaaaaggcaagacacatgataatatttacagcatgatttcaattatatgaaaatgcaccaacaaccctaaaaggaaacacaaaaaaataccaccgatgattatctttgggtagtcaaaaaaatgtatggattcttatttttgtaatccattttcctatattttccagactttatggataggtacttttttatataaaaacctttcatttggcaaatttttattttaaaaaatcatctaaactttgtaaacttcttttattttgtgaaaatattttctgcaaaagcttctgtcttaaactgccttcatagtattgtgacgatgcttgaggaaacaagacagaattctcactacgcctatacccactaccaatttccaagcgggggcagctaaggttccagccaacactacttttctggaggctatagatgggtgggaaatctggcagtctagccgttacgtagaaatcccaaggcaatcagcaaagaaggctaaaacattaaaaccaccatggcacacgtatgcctatgtaacaaacctgcatgttctgcacatgtatgccccgttttggggaagaaataaaaattaaattaaaaattaaaaaaaactatcagtccaacttacccccccaccaaaaaaaaaaaagagagaacatcttagatagggtcatgaagcactcgatcttctcacatgcattctctcctcctttacacatgaaatccctgcaaggccagcgttatcatgcccatttgacagataagaaaatgaatgtatacagagaggaggaaccttgctcaaggtcacaaatcagtctcctgtcaacatctggaagcaaatccatgtctgtgatgctaatgatcaggatctttgcattataccatatggcagctttcatctggactacaataattgagaaaactgtatcagatacagggagccctgcatatcatcatcatcaggaaagacctgcactgggcctcctgccaaaggatacctaactgtataagtttaatgaatacaggcaaccaaattcccaccttatcccttaaaatcctagaaagaacacagagttgaaattaattgtatttaaagtatagtatgcattttttatttatttttttttttttattgagacagagtctcgctctgtcgcccaggctcaagtgcagtggtgcaatctcggcttagtgcaacctccgcctcctgggttcaagcaattcttccacctcagcctcccaagtagctgggattataggcacccaccaccacacctggctgatttttttcatttttagcagagacaggatttccccatgttggccaggctagtctcaaactcctgacctcaagtgatctgcctgccttggcctccccaagtgctgggattacaggcgtgagccaccacactcaggctgtttattattatggaatactatatcctaaacatgggattactacatcaaaatacaggaagatgcttaaaggctcttgatatttcttttcaaattttcctaataaaagtttatgtgagtttatatgtccataaacatggtatacaaataaccatttagttacatctttgccacctctgggaactgcaattttagaaaactgtcaaactgacaaaacaaagagggaagaaatggaagacttcctatgtcagcttttgaagaggtcatgtatgacataatctgaatatcccattcaaatttttaaccacagcactgccgaagccagccagccagcctgacttagccctcttatgggaaaatgtagcaagtggttctgtggttaaaacaagcacagactcataggagaattcaaaaaccaatgaagaccctgggttccaaatccaaaatgccagacagatgaaaggagagaatggaggatctagcattatatttactgatggtctatttggtaccacattctttcctatgttctaaattagcccttagaataatcttgtgaagacctacatttgctcccattttatagacaaaaagagtcaagattcaaaaacgtcaacaagggcacccagctagtaaatgcaaagctcaaatttaaactcagactcttccacccaaaactttttgattctttacccttatgttttggttttaatattttattttcatatcacttattacactttccaattttaaaagaaatacttgtttattataataaatatgtaaagtagtttggaagattctctaaagaaaaaaatcaagaattgttcataatctaccacccagagacaagaactgttaatactttgtttcattttcttccatttatttatgtttacatataatttaaataaaatcagtactagattgtatataaaggctagtttgctaatttttaaactaaatagagtgtgacttttgacagggcatttagtattacttgtaattatcattttttacatctgcagataattatatcaaatgaaagccacataattattttagctactctctattgctgaacatttaaaattgttttcctcagttttctatctcaatcttgtgataaaatccttttatattaccttttatgtgcatctctaattgtttccctaaactaataaattcgtgggaatggaattataatagtcctcccttatccacaggaactatgttccaagatctccagtggatgcctggtgcattggatagtacccaaccttatacatactacattttgtcctaaacaagatctccagtggatgcctggtgcattggatagtacccaaccttatacatactacgttttgtcctaaacaagatctccagtggatgcctggtgcattggatagtacccaaccttatacatactacgttttgtcctgaacatacatattaatatctatgttaaagtttaacttataaattagacacagtaagagattaataactaataataaagtagaataattataatgatattctgtaatcaaagtatgtgaatgtgatctttctctttatctctctttctcaaagtatcttattgttctgtacccacctattttcagaccacaggtgaattcgggtaactgaaaccacagaaagcaaaactgagaaaagtgagagaatacagggtcaaagagtatgcacattttaaggttctaaaactatatactaaactgctctccagaaagattgcaagaatttatatcctctagatgaacatatcactttatcaccaccaatactgtcagaggcatttgatccagagcaactccatcttgagcagtggctgggtaaaatgaggctgagacctactggcctgcattcccagacggttaaggcagtctaagttacaggatgagataggaggtcggcacaagatacaggtcataaagaccatcctgataaaacaggttgcagtaaagaagcccgctaaatcccaccaaaacaaagatggccacgagagtgacctctggtcatcctcactgctacactcccgccagcgccatgacagtttacgaatgccatggcaacgtcaggaagttaccctatatggtctaaaaggggaaggcattaataatctatcccttgttcagcatatcatcaagaaataaccataaaaacgagcaaccagcagcccttcggctgctctgtctatggagtagccgttcttttgttacctcagtttcctaacagacttgctttctctttactctaggaactcaccctgaattctttcttgcacgagatcaaagaaccctctcttggagtctggaccaggacccctttcctgaaataacactattgtttaaattgttgtcaacgtaaatcgagaaaaaatggtacctttattctttttaaatttatatttcagcaactaaaaggaaagctaattttttttcagatttttattgactatggcaatttttcttacatgagttgtaagaaaaacaactcatttttctgtcaagacacctttttgttgcttattagtgttctttatatatcaaggatagttagccattgtgaatcatatttgctgtaaatatttccctcaagttgttctttaccttttttgtaattgtatttttacttacaaatgtttatgaattttacacaactaactccattatcctttctcatcatttgtttcttggtttttacacttggaaagcccttgctccccgtaaaatcaaatacacattcacctatatttttgtagactttgttctttctactgcacgctgtgctgattcttatttcagacgggtgaaatgtcaaacaactgaaatatccttaaggtttgaaaaaaaaaggagaagtaaatctatctgagaggacacattcactggcagataaattatggatgatcctgccccctttgtaatctcagggatgacaactccagtgtgcaccaaaaacccttagaaaaattctaaatccccttatcctaggtctccagtctgggccttatgggaaccctaaagctgtgattctccccagggagtataaaactttggtctaaaggtgaataactgtagagtcaggtaggttttgtcccaaaatctcaaatcacccaggtattcccagaacgtctatcctgtgtccagccccaaatctcagccagagaacccagggagcacacaggcatgcctggagggggtctttttgagattccagaagccggagagcatgcaagtatgccggccgggaagggggggtgggggggggtcttcctgagagaaagcaattaaaattcacatcacaaaaggaatgaggctttttttattctaaactgcaaaacgtggtgtggttaatcagagcaattataaatggtaacatcattattcaagcttctatttccaaacgaagtcatttaaatgaatacattttctgccttggagcagtagctgccagtgagcctttaaaaagaaaagaaaggagaaaaagaaaaaagagaaaaccggatgaagccgctggtgcaaaaccttggaaaatagggtagaaagaactcagcattgggaattgggagcctggggtacaaacatagatccaacacggtctcattctgtaaccttgggcaagacttcagttcccacctgtgcaacggggaaatagatgaacttgtattcgtgaccccttcttgctctgacattgtgaatctagattttaaccactaaaggtctaatttttctacatgctgcagctgcaattttatagaattcatcaatgtgttaaatacattctcttattcaaattcgaagacaaattcttcagaaactgcctaagctgtctctaaatggtgacagacttccccccaccctactgcagcctgtattgtgtgtggtcttgaaggaaggagcacgtgagtgttgaaatcagatggtcctgggggtcaaatctcagctctgaccaagaaagccttgacattccttccccttggtttgactaaagttttagacaggtttcttcctgataagctcctcacctcccttttgttagagcgtctactttagaaaacttgtaactacaaattctttctctgctcctttaaaaaaattctgctggtcatttactagttttacaacccaagtaatgtctttctcaaggacctgggaagcaaccatttgaaatgtgagcattgaaggagagagcgtccctatctcccagtctgcggaagagtgggagcccaacttcagtgtgcctttctccaactttttaacctctcctatcatgaagatatgagaaagtttacttttcctttagtaaacttaagtagcaaacacagatggcctgagaattccagctcttaagaattcctcgtccctttgtttcaggagagttaagtcctgtctcgacctgattacaatggtcttgaataatatcttccttgcctgattaaatttgtcaggtgcaatttttacttaggcagttccaactgtgtaaatgtacctccttcaacttccttgaacttcagggtccctatccatgaaaagcaaacaacagaaaaagtccttcttttaaggagtgaatggtatatttcagggaataaatcagaacatgcatgtaatcacctgcacagagaaggtgggagattgtttgcaatatctacttccctgtaaccacacccttgggttatcccttcccacactgactgtggccctggccacgtgagttgctttggccaataaggcatcaacaaacatgctgcaagcagaggcttgaagaagtacttgcgcattgggcttgccctcttgttgcacttggaagcctgagagcatcacagggatgaacctgacctagcctgctggatgggaacccacatggaggagaaccaaggtgctccagagggcagcctgctgaactccagagatgtgagcagggcacttgagacacatgagagaacccagcagaaactaaacaagctggccagagaagaataaccacctactggacacgcatgattgtacacaaaataaaacggctattgtataagccactaagttgtgagatcatttgttacacagcaaaaactgacactatcaggcactgcatttatgttcatttcctttttcccttttctaatggatggctttgggtgttggctaggaaggctgagcactagcaaaacagtcaccaacccaatcagaaatggcaatggtctctttatggggcgctcttttcagctccttccagctccagaggccacaactagaccgagggaagaagacataggtgggaagatcccaataagtccctaaactcatctgaaaagatatgtgggtttcctaacaaactcatatagcatcaccaatatgtgggtttcctgattttggctcaggcacccttgggaaagtttcacgcattcctggaagtactgaaagaccttcgttaggttgacgaagaggtgtcatccatgagtttctgcctacacttaccaccaaattttcaaacgtactcagcatcattatgctgccggcacggggctgggtggtggagagagagagagccatgactaagaagccatccatctgtcctcacagagctcactgtgcatgtgggaggtagaccttaatagagtaaacaaacaagtaacataattatatcatgtgataaagattatgcaagaaatacacacagagcttggcagagcgtgactgagcacgggaccatgaacacccactcagcaaggagggaagggaaggcctctctgaggaggtgagatgtgaaataagatctaagcgtataaaaaaagccaaccattaggaaaaagaaaaatctgccaaagagaactatgtgaaggccctgaggcagcaaggagcttctagaagtcagaaggtgaccagtgtagatggatcgaaaggggaggagcgatgggagatgaggccatggaggtgagcagggccagctccgtccactcggcttccccagccaaggacctggttgcctcccaggtccttgatgagcagcctccatccctctgctcctctcccacacccgccctcctgaggttcagctccagggtgccattgctgctcttatgacacggagagcagaggttgaggatctgatgactgcaggcacaattcctctgtgccaggcactgcgtgaactttctgcccaacttcttataatctatccaggtagatataatcactacctcccacataccttacgggcattagacgatcttcccaaggtcacacggccagccggggtcagcaagcagctgccagtgctgggatttgggcagcaacctgtctacacaggctcagactccaggctggctccggtggctcctttggtgttatagtcacttccccactgggtgctttgtctcttctgctcttgttatttcaagctctcccatcctttgtgtgcacatcctttgtgtgtctcttcagggagccccaaaagagacccttaaacatctcctcttacatttcactaggttaaatttaggccactttgtagcctgtcacagccatgctgagtgctaaaatgccctacaactccaaggttggaaataacaatgaaaatgagttgagaagggagacccagtgttggctgagtgatttttctctgccagtcacagagctaagcactctacatcctcctgctgtttaatcccttaatcaaccccaggaagctgagcaacttcccaaggtcacagagacaccaaggcagagccacagtgggagtccaggcaccaccagggtgttctgcctcccaagtgaagtccccctggatgccatatccactatcagagggacatctccaagctgggcacatgacaccagcacagaaggtgtcttgcaggtcctgggctcctcctgggatctggggatgcccacttcacactcctgagacaagtgtagtccacagggaggtgtggccagaggccctgcccacaacccactagaaatgagagatggtttcacacaccttggaggtactgcccagagcttccccttccacttccaccccactgtcgtgtttctttccagtttcctgccttacttctggcaacctaatgttttgtgtataggccttattccattttccctgtttaacataggttgtatttccctgggcacgctggccccatctccatctcccatgggtcccaatttgcccttctccaccaccaacacacattcttccaatcagacaactccactttggtctcagctccccagcctggagctgactggtcaggtctaccatgcccatttgagttttatctgcaggataccaccatgttcgctcacaatcacatgcatgcaaatatggacaggtacactcagctgcaccaaaacatacaagttaataggcatgcatttatccacatgtgcacaagcacacagctccccatatataagcaggtatgttcatatatgaatgcacatgtatgtacaaacatgagtgtatatgcaggctcacagacacatacatacatgcacccttcctcaattcacaaagaagtaactaatcaaatgccacaagtcattcacaagccacgagaagactggaattgacagaccatataaagagacagacagaaaaagtcctgaacatgccagttaaaaaggctctgctattgtctatcacacagaagcttgtaaaaagaccacattatttctgacacaaatacagctctccactttctgtagaaggattccaataaagataagagctttctcattattctaatgtggaacaaaaacaatctcccctttccaaatcagcacacagaagtaaagtctccttagttaactctgcagctccctaccccatgatgctcagctcactccaccatcatgcagcaaattttcttgagcacctactatgggctgtcatgcaagttttattatttagttctcacaataacttccaaggtaggaatcattgcttttatttttacagaaaagtaaataggctcagagaagttctttaacttaaccaagtcatataggtagtagaagaagagcctaggcttgtctgacaccaaagtccattctccttgtatgatgccagtcataagaacaaagagttcaagaaagactcaagacctaggaatcagcaacagttaaaggaatgaatgcatagcatgtggtaagcagagccagtaagtgctaacgacagaggctgaccaggtggcttaggaagttttaggtggcctaaagggtgaatgtactggtagaagacagtggggtaagacagcaggcaattcaggaagaaggaatgaggaataaccagacatgaagattgagtgaatatgacccaactgggagctacagcaggagggatcttgaaagaacggaatggaagttgcaatgggggtcaggactttgaagagcaggttcaagagcctggatgccattacttcaacatttttacgactcagcaactccatgccaggccctgtactagaaagtgggaataccgccgggtgtggtggctcacacctgtaatcccagcgctttgggaggccgaggtgggtggatcatgaggtcaggagttcgagaccagcctgaccaacatggtgaaaccccgtctctactaaaaatacaaaaattagctgggtctggtggctcgtgcctgtaatcccagctactcgggaggctgagacaggagaatcacttgaacccaggaggcagaggttgcaggagccaagatcacaccattgcactccagcctgggcaacagagtgagactccgttgctaaataaataaataaataaagtggggatacagtggccaacagaacagaacagaacccaacagaaccaagacccctgctcttgtagagcttactctcttgtgggggtaggggtgggaaacagatcaaaaacaatgcacttttttaaaaatacagactttttaaaattatatagaatgaaggtggtaaatactacagagaagaaaacctaaaagtagatcagaggtaaaggggaggggccataattgtaaatagaatggtcagactcagcctcactgagaagatgttcaaagtctagcggggggatgaggagtgcgccccccagagccaggggaaggttgatgcaggtatcaacagcagccaaggtgaaggtacgcctccctgttcaaggagcagcccagcagtgtggccagcaaggctggagccagatgaatgagggtaagagaagcagaacacaaggtctacatttatgaccgtgaaccacaggagcctcaaaaggcaagacaacagggacataaaattagtacaatggtgtagtgagtccaagttaccgcggatcatttcattcatctctatcgatcattcattccatgaacagagcagcaggaaaaaaaggatcttaatatgatattcaactaatccttgacattaatatgaagctctgacactatgccaacgaatatgtcattgtacacacactaccttcctaaggccacaggaaatgggagcggcctcaagccagattttcttctgtaccagaatcattttcaagagcgattaggtgggagggcacagaccctgaggtgttcccagcccctctgtgactcactgaggtgttcccagtgtctccaaagcaaaccagcttcctgcagcctccacctgtccattttaggacgaccagcgtttgatgaaaatagacctaagcattctggcatcttcctccacctggactcatcctgagtcacccactcccctctgcagcatcctgtggaatccaactccagcattccccttagtacagctcgagagacagtttctgaatggagctttgtctagccctaagggtcatatgaggtcagatgaggccagcaaacagaactagagattcctagctcatggacgatgatggtgactgtgacaaagaaagcgacagtagatagtcatccattcttccatgcgtcactcactgtgggaaggagtttacatggatttatctcatttgaggctcatgaaactcctacaaggtagatagtatttatatcctatctgcagatgaagaaactaaagcataaacagtaagcagcctccacacccgactgtgaagacaccgaaccacacccagccctagaaagagagctgtacagtgggggcttctgtgaacaccagaggctggggacagactctcctctgggagaggactaacccatccatcctttgcagttgctgtcttagaggccacatccctgcatcaggctagaccaggtagaaacaaacacacactgactcccgcttcagcggttccaatcctcatatggtactggggctgtaggaaggcacaagaggccacagaactcaggacagttggtgggcagccatcatctccacctagacccccacatccacccctccctgcctccctctgttgtttccacccatcctcgcccctgcaaccagcactgcctccctacaaactcctctgaggtgataccactgccctgccaggagcttctcccccagctgcccttgcactttctacactgccctagagggtgcctactggccacatgaggctacttgaatttaaattgactgacattaaataaaatgtcaaattcagttcctcagtcgcacgagccacatttcaagtgcacaatagccaccaatggttggtggctatggtggtcggcagtgcagatacagaatactgccctcaaggcagaaagtcctgtctgcagctctggcttagctgacaaaatcccaacccctcatggggcctgccagacctgcatggtctcaccttgcttgcttcccagcctcttctggtggacacttggtcatgctgtcacactccagccacccaccctgtcttcagttcctcaaacataccaaatgtcagccacctcagacactcaccccgcccacactccgcccacccctcccccacagtttcctcggctaaagcccccattctatcaggagtcactgcaaactttgcttcctccaagccatcatccctgacacccccacaccaaaattcacccatacagataaacaatagttgcagtaattatcataacctctcactgcctgtctctcctttcatggcacttatgaaacgtgtaacatcttaaggccacagtcacccgaaagcttgacgggagctggggatcctcctccatgctcacacatgtggctgctggctggaggtcacgtgggcctcttcacaggacagcttgccattgcttccctctgagcaagggatcccacagacaggccgagatggaagctgtagtagctcttattacaatcgaatcttggaagtgacaaatcaaagcttctgccaaagtccactgatcacacacatcagccctggaacaacatgggagggattctacaaggaggcaaggattttgtgccccatcttggagacgggccactgaaggctgtgtgtcctgtttatcactgtgtccccagagtgttgaaaatagaataagtgctctgtcaatgttaccaaaacaaagaatggcagccttctcatcagaggggcctcactttccttgtctacaaaacctaggagtcaggcgtgaaaatatttaatgttcttccccattcgaaaagtcctctggtccatgttgactatgcagtccgtgcttgtcttgcccttagttgaagtggtgacatttaagtgaacagctgtggatctgtgctccacgggtctgctctctcagggacagggtcatgggatgggggagatgtaccaggcttccctccctctgacttgggtctagtccaggcttcccatcccccatgtgctgcaagcagctcggtcatacaacacatggcaactgacaggttcatgacggccaatgaaattatatgcaccatacagcagggaaacacactcacacaggaccagcagagccactgactttttattagatgcttctcccaggcaataaaccaggagagacagtggctgcagggaaataggaacccctggtcagaacctgtgactgggtcagtcatttgcagcagagatgaacattgagtcttggcctcaggggtaaagagtcaaccggagggacatgctaggaatgagggcaaccattcgacgaggtgacagtgtgccttgtgacctgcaactgccaacacccatgagcatcacaatgatggaatagtaatagctaccttgcaagaagcacctgctacatctaagacacttcacatgctttatccctaatgcttgcatcatcttctagacactaagcccatgtttatcctttatcataaggtctcaggataacatcacacagcatatgacagagagtaagcactcaataaccattgtgtgaatgaattagtaaatgaatgggcaaatgccatcagattggcattattatgcccattttatggaatagaaaacttaggtttatctctttgctccaagttatgtgggtggtactgagtaaagggctgggtttgaactctcaactccctgattccaagtctgagacccttttcacattacaccaaatccttaaatattttgcacatgggtgcaagcacaattagtaaaattctaccaatttccatgggatagcacagttcttcatgaaaacacagagatcaggaaatatttgtgtgagcagtgagagatgacaaaatgtagcactgccgtggtttgggagaacccgggagtatcactttagcagttagccagtgtacaaggcataccttggcccatgtggctggtgcccttcctgggtcacagcaagtgagcactgggctttcccagtgaggctgacaaggactgcccaggtagaaccaggggaacaggaaatgtgtcaccctagaaacgagtattggtttattattatacaaaactccactggctcccacaaatcaactcaggtaccacaaggatgttccatcaatgttttcattcccaaacacttgattccatttccccagccactccctcctccctcccttgacagcagaagagtctacagactgctgtattttctgatttgctttcatgcttcatttaccttacttaagtatgatttcaactgggaaaattgatgattataagctggaattttgagatgtaaacttgaaatcactgagaatgtgaaaggcaatgagcacagaaaaacctccagtcacagaaggtcacaccacagtcacatccccttgggcttctcccaataacaccacagcccttgtggagatgttgaatgaagactgagcagcattcaccaatgagtaggatgcacataggtgctttgtttcttataggcttgtcattattgattattgtagaaacaaacaaaaaaatgtgcctaagtatcatgacacgcacaaaacatctatcatcttacgaagccgtcaccgtttcaaagagatattaaaaaacatatgcacttttaaaagacattttaaagtctatgggaaaagaaggcatgatggtgaacaacttagaacaggggtcagaaaactatggttggctgcttattctaaataaagttttattgggaaaaaatctattggaaaaatatttcctagctggctttctagagaaacggttgccaacctctgatttagatactgcattgaggatttgttcagcttttttttaatgttggtatttatgaagatgttaagttaataagtgactgataataaaatcatctggtgcatgggatttagggttgttttgtttcgaagggagaaaaaaatgtttttaatgtataaacttacacactaatgggcccacatcaagaatgggtaaaacttcagagagccatagtgtatatcaaggccaccatacaccctacgacctaggtttacctctgtatctctcactgacactctcaccaaaaaagtgtgttcaacacaatagtgaagatgatatgtcttggaaaaaataaagcaaaatggtcacctcaattatatttttaaacaaactcactgtaaaatgagaagtgactttgaaaatgtaggtactgtcatggtttcagaactctaagtcaaaatcttatttttctttatgaagggaataaaatggtgacacaaagaaaggtcaaaatctaaataagaactaattcattactcaccttaatgaaaaggggagtttgcagagttagataatttagcagatattgtttcataactgaaaacattcttatgtgaagtggacagtattgatcagaaagagtttttgttatacaaaaaggaaagaggtaaagatgacctggtaggaataaagggtattatattagaaaatttagggggtgaaaggaaagctttacaggtcatttcgaccttgtggagagaagcaaacccaggagagaaagcgggcggaactctgaaatggtttgcattcttttaactacaaaaatgagggaagctgaaaacagtaagaatttgaccaggctgagttaagggttgtagttacatttatcgtgtaaaaatgcaccctcaagggactggacctgaggctcctttcccatgctaatgaaataatcatagaggccagccacctccagtcttgttctgaagtctgaaaagtttttctgcaaggcactaggatagtaagtatttttgggtccacaatacatacattatctatcacaactgctcacctctgctgttgtggggcaaaagcagacacacataatacataaatgaatgaacatagctgtgctccaaaagaaaaaaaaaaagaaacgtatttatataaataagctatctgaaatactgtatgattccacttccatgagttacccaaaacaggcaaatccacagagacagaaagtagagtggtggtttccagggactggtggggggcagatggaaatgggaagttactgtttaatgaacacagctttttgggggatgatgaaaaagttctagaaatggataggaatgatggttgcacaacacctgaatctacttaatgccactcaattgtacacttaaaaatggtcaaaatggtaagttttatgttatgtctattttaccacaataaacaaattaaatatatattttaagataaacacataatataagcatatctgattccttgttgcaaatatttgtctcacccttggggtccaagtgataactgggtggaaagtcccacgggataaatttaaaaccaggttcaaacaatcccagcccataaaaatttcttaagactgctagcaggttaaacagtcttccaaatacagccaataaacttttcattctattaaatattttttgcctgttgagatgagaatagaaacaaaattcttggttttcagtttactcaaagtactatgtgtgacataatttctctagaaattatattgaaatatttaacattactatttaaataataaacaaaaatcagcaattaaaaaaataaaagactgcccaatttggtccccaagtcatagttcgctatcccctactgtagaatttggaggacacatccaagaggttttgtgtgctacatcaagaatgatgtcatgagagaaagaacttgaggtctggataaaaggattaaattgaacccggacattgaaaaaacccctctgctgattctagacaagttgttgtagttcatatatagtgtcaatgcacatccatgttgcctcacctatttaactcatcagtgcccatccctggaaaatggagaaaaggaggaaactcagtctattggtgctcagtctattgggccagtaagctggcccaggaagcaaggaacctagctgccctgcctagcctttcttcctgacagccaggagggtgaggagcagaaaaaggagttagcatctttatccagcaaccaagaccaaaaaactcttagtgttttaatggcatgtgtcaagatagctgagccaaaaaagaaatcggaggattggaagattagacttgactagggagactgtttcagttacctattgctgcataacaggtcactcccaaattagttgtttaaaatgatctcaatcatttatggtctccatggatcaggaatcactagctcagctgggcagttctggcttgatgtcactggcacaactgcaatcacatagagactgatgcagctaagggctggtgagcacctctctcactctcttcatgtagtctcaggcctctccatgtggtctttcatgtggactagttagggcttcctccaagtatggccacctttaatatgttacatggtgacacagaactccaaagatgagtgtctgaagaaagagaacaacagttgcatagccttttctctaacctagccttggaagccacacagcatcagttccactacattctatttatcaagtcagtcatgagtttcaaggggaagggacacaaactgaggcatgacgagcttccggaaaagcacacggaacagaaaatatgtatttggccttttaaaaatatacaacctgcctgtaatcccagcactttgggaggccgaggtgggtggatcacacggtcaagagactgagaccagcctggctaacatggtgaaaccctgtctctactaaaaatacaaaaaattagccgggcgtggtggcgggtgcatgtagtcctagctacttgggaggctgaggcaggagactggcgtgaacctgggaggcagagcttgcagtgagctgagatcatgccactgcactccaccctgggtgacacagcgagactctgtctcaaaaaaaaaaaaaagtatgtgtgtatatatatatatgtatgtgtgtgtatatatatacacatatatgtgtgtgtatatatatacacatatatgtgtgtgtatatatatacacatatatgtgtgtgtatatatatacacatatatgtgtgtgtatatatatacaatctgccataagaactaaaactcatttgggcctttcagtttatttacatatgaatacaattaaaatactcatgataaagaaaatattctcggtcctctttctttgctcacacactccttggaccagcatttcccagactggtaaaccaagacatatgacatgaacaacctgacttatcaccaaaactcaccaacattagcctaaaatattgcatcatgccacctttctggtaggattcagtacctctctgcttggtgattgccctgacatcgcttgtcacacagcgaaataaccaatttatgcgagtaagccctgttgagatatcctgactcaaatagaagagaaactgtctggacacaagcccaaaacacattgtcagctctccactcagtatagtcttctcagtgacagacttgagtcagtgcaatttcatccattaagtaacgggaatagtagaaaacttttgggatgttattctttggattataatttaaaatatgtgtggcaccggtatgtattcatctgctatgtatttatccactcccatttcattgatctctccctaggcacataagaccacctcatttctgagcttctcttgcagttctatcgagaccatgtgactggattccaatcaactgcatgacttgtaggccacttccaagccttaccataaactccactctaatgctccacactttttctcttcttccttccaggctgaactcagagaccaaatgtcaatatgacaagttagaaggaccccagagtcaccacttgtgaggtgccacaaaacctattttgaaatgtgacttgaattagaaatcacctttgtatgtatgtattaacccattaggactttttttttttcctgctccaaaggtgagtaccaaatgaaaaaatacaaaactcaggtgctactggaacctagaacaatacaattttttgttatacaggctgtctcataccttagagagccagatgccaggcacacatcccaaccaaaaagccactgaaatgttagagcttattggtattgcagtataaccaagactagtctgactaatataatgttataaccaatatgaatatattaatgagcagaattaaaaattcacataaatttttaagttaaaacataaaactttaaagaaatgtcctccttgaggcaggttcatctggctatgccccagactcctgggagcacatgcactttctcatctgctattaggaaaacttcaatggtgatgtctgagaaacatcctacagcatttggcagagacagcctctgaaaccagatgaaacccagttctgctacttcctaactcttgaaccactgagcctcagattatgtgatgggggaataaactgttattgtataatgtggttaccactggtgccagttggccaagaagaacagcagaatttgtcatagaaaagcaacagctctttgtttagggaaacatcctaatctgcttataaaaggtgaggcctaccaggacatgactaagatgaaaggacattggctgatgagaattccttgtcgtattggttatctactactgtgtaacaaattaccccaaatcttcccagcttaagttgacaacactttgtttagttttacatagtttctactattcagaagttcaggagcagcttatctgcgtgcttctagtgtagggtccctcatgaggttgtagacaacattaatgaataaatagttaaaagtagaaataaccccactgattctgttttaagtcagagggcatattgaaagcattctagcaaggggaagagcatcagagctgggggaactgggagaaccgagttctaatcccgtatttgtcttgcaaacttgtgtgaaccaagtgacacacccaatttaggcatccacttcagggctcaggtcatccttaaacccctcctacctctgaaacactgggctccttgggcccaatgtgccatcctgacattgtgagcatgagaagtgaggacaggcaagcacccctgtactgagcacaaaaatgtcaggcctttccgagtcttcccaggaaggactgtcttcttcttcccacactctcagaacacaggatcttaccatccaactcactacattttcccccagagaagaaatcccatgtctaaaagcaagagcctcttgttttctttctctttcttcatccttttttgaaaagtctgtttctattgtgacaccaatccaacccattccattgctacctcctttataattttttttaatagtcagcgtatcactctgttgcccaggctgaactgcagtggtcatagctcactgcagcctcgactcctgggctcaagcgatcctcctgcctcagtttcctaagtagctaggactacaggcatatgtcgcacatcactatacccagctaaatttttattattttttttgtttgtttagagacagagcctcactatgttgcccaggctggtattgccatctacttaacacagttccctctctgcatgtcatggtagaacacaggaaaggtgacaacctgattgccaggtgaaagaagagagttcccagcaccaagtgtgcttccaggcatattaggcagggagtgaggcaggaaaggaggaggaatgccagcacacatgtgagcaacttctatatgtctggctccttgcatgcacaattttaagatccttacagcaatcagctgaagtacccacatgttacaggcaaaaagcagtgaggctcactccaagcagttacattggccaataccctgcagcgactgcatatgagaagtgagatttgaatagcatatgtgaacccaaacatggggtaaagaagaaaagaaggaaggaggaagagaaagagggaagatgtatccgtgattgcttccttccagactggcacaaaaatgaaaagctagctctccttgatgggacatgttgatggtatgcaaggttggatccactttgcacacacaagctccttctgctatgaaagagatttaacaacctcaatgaatccttagggtgtatggagtggtgacggagattattagaaaaaaattcttatctacctttgatgtggaaggaaaggggggcccaaagtggtcattataaccaacttgaatcattacttgagaaccagcacagcatatcgtcaagtgtggagactccagaggctgagtttgaatctaagctttgacacatatcaatatgaccttgagcaagtctcataatagctatatgtctcagcgtcactatttgtaaaatgggaacaatagtatctactgagaaaacttgttagaaagattaaacaagtcaatagatttaaagtgctcaaaagagtagctggcatactcttctgtaatactcaataaatgcttgctataataattagtggtgaagaatgtgtactccaaagccagactgccaggattcaaattccactcaaccattccaagctcatgaccatggagaattgacatagcctttctaagcttccattttctcatctgtgaaaggagcgggaaaaaaatctatctcagaagagttttagcagatggtattttccaaagatgactacaacagtatctcccacccccatttgcttctacactgtgactttgccactgccccattaacacgggcaggctcattctcctcccccttgaacctggttgtgactgttaacctttccacaaataggatggacatagcagaagtaatgctgtataacttctgagggtacattagaaaaagccaggtagcctcttcctggttccattgagatgctcacttttaaaacacagcctccatactgtgaggaagcccaagcagttcaagaagaggcacacttgagagaaactgagccctccagctcatagctaagctgagctcccagcactcccttgatagtcagggaagtgagccattttccagccctcaaactgtcccagcagatactgcatgaaacagacacaagctcttccactaagccctgccgaaaatgaatatgcatgagcaaaataaatgattgttattgttctgagccactaagtttctaggtggtttgttatgtatcaatagtaactaggacagaaacgctggggaaatttctaaatgacaataaaataaggacttagcttagtgcctagaatgtgtgaagaagtgctcattagcgatgatcattgttggtatcgttcagtaactttccaaagtcacacagctaataaaggtcatgaccaggattcaatccgaggcctccagtctcacttcatattatgctgaggatcaggaaggtaggcaaatccaatgttcaaggaaccaagcacctcttcttccactgagctggaaggctggagtatcaagatgatgggaacatgggcaatgcctctttgtggctcctacactcaggtttggattgcaagcagagaccccagagactatggatgagggaacattggctaacattctttcttttcctttaagctaagtaccaagagtgtgagatcgttgattctcaagggaaaagctaccccctctatggaaaagtaaaatatgcaaacattaaccagaggatagatgggaatgcataattcacaactagctgtctctctggaccaaagcaggaaggagttggttgaacttcaggtcagagaaaaacaattctagctattgcattccagcacctacgtattcaattaccataaagttttttgcccctggggagaccactggaacctgcatcagcatcaaaacctttcttaatatgattctgcggtaagctgagatatgcagcaccctggcaattgatatgcaaattaaataaacaaaacgacataataaataattaaatcagtctaacttgatgaatgaattaatcatattggagtgatgagaagaagccggcactgtcacccagaagatcattgagaaaaatgaaacattcataacaaggccatttcagcataggatgttgcctcctatattgattacctgcactagcctttgaaaagaataggtgctcaataaatattagtggaatcaaaagaacttttatcaccaagatcatctctctgcagtatatggaattattcattcaataagcgattgcatcaacattttctcatttcagtcttatttaagaataaagtaactctgaaagggagacaagggcagatacttactgatatctcccatcttacagttgaggaaaataaagctaagaccgagtgacttgcccactgtcatatggttggaatgagaggaacttagactcaatttgggagtcctggcctctattaccctcctctgcaccccactgatggggatatttctgtctacataagtgtgtatgcagggagagatgctacagccacccactacttctccaaccatttcccgtaataaatcaattccagattaatttcaagtttatacctgaatacattttgtgcctccacccatttttgccttttgtttagttactgtacatagcatctctttataggcaactaagaaatggaggtaggcatgaggaaaagaaaagtactgtgcagccattaaaattaatggtgaagaatatttagccacataggaaaatttccgcaatatattgctaagcaaaaacaaaggctttcaaactgcacatatagtaatagacacacacatacacaaagagacaaaaagactgaaagcacacgtcaaaaagcaaacagtcattatttccacatggcgggattataaggggtttttatttctctctttgggtatttgtaaatacttttagaaatttatacaataagaatgtattaacttttgtaatttaaattgttatttgtaaaactaaagcaaattatagtggtgggggtggggaataaaatgcttctgaggggtgggaatggtggtcaggctcatgagtgtaatcctaacacattgggaggccaaggcacgtgggccactggaggccaggggttcgagaccagcctgggaaacatggtgagacccagtctctaaaaaaaaaacttgtggttttttttttgttgttgttgttgttgtggtggttgttgttgttgttttaatcagctgggcatgatggcgcatgcctgtagtcctagctacttaggaggctgaggccagaggatcacttgagcccaggaatttgtagctgcagtgagctttaattgagccacggcactccaatctgggcaacaaagtgaaaccctgactctaaataaataaaaatgactctgagcccacatctcatagaagtcatatatgtttcagtattttgttttaaagaggatttcttatcaatatggctaaattttgaggctgtgtgggatgcgaaataatttagaacttcatcccacaatgagatgggatatgccctcaagtcagtggctctgaaacaagatgaaataattacaaaaaagaaaaaggaaggaagggaggaagggaagaatggaggaagggaagaagggaaggagggagggagggagggagggagggagggagggagggaataaaaacctgccaaaggaaaactccctagttttcctggaaatacccaaccctttcttcttttcccaattccctaaagggctaaataactcaaaacagaatataaacttcagagatagcccttatttctggctctataggagattcgatggtgccaaggaaaacaagttatgtatcaaagaaaaatcaactagactatttcagaataagtaagagacctgaaaatatacacttccattccaaaacgagttaaagaaaaaaaaaggcagaagggagaatcatgcagcacatctggggtgaaaaaaaaagagaagtaaatagatttttaagtgaattataagtttgctgtgtgacagcaatgacttgaactctcaaagaaattgaaaaaaaccacagaaacaatatatcaaaatctaaaatatgaaattataagacaataaagtgacatgatagagctaggaaaaaagttaaatcataagttcactgcagaatgcaaaataacataatggagcaagtcaacaatgtaattataaaaaaatcaaaacttgagattatcaaatagaatgcagaagtacatgacagactcagaaaaagcaacccaggagacaatattggatgcaaaaaataaacaacaaggatctagaatgagcgggcccaagaaagaactgagaaagcaaaatagaaagtagtcagtgatacgacagaagaaaatattcataatcttaaagaaagtctaattgtgactattagcaggactcacaggcaacagaaaaaaattactgaaaagcaaccaatatggagaaacatcctagtgaaatctctgaataccaaggattaaaatagaactgcacaagcatgtcattcaaacacttggtcacctgcaaaggaaaatatcttttagcatctctagatttcaggaaatcatccatgaagatctgaggaagaaggtattattcttcacccagccaaccagttattcatataaagggtgaaaaaggaggaggagaaaagagaagatgatcgtgaagacattagaagggaagaaaaaagatgaaggaaaagaagagacaaagatgaagaacatattctcaaaatacaaggaatcatgaatgcactattgctgaactgaaagctaggagtcacattctaaccaaaagttcaatcaaaatatagatctcaaaaaatgagtaagcagtaatatgaaggcatcttaaatttttggtgaaactcaaaaatagaattgagtctaaataattatggcatagttatacaactttttaattgttaaactttattatttaaaaaattttttaacctacagctagaaataaaagtagattgtgggtattccctatagcaaaggtggatactcataacaacaacaaaaaaaaaacagatttaaaggtaaagatatcagttaaaactaaaagcagaatggggttaactcaacagtaagacattcttaaaatgaatccaaaaccaataaaaacaagtatacaacatttatcaggaagaagactaaagctgtaactcaaaaacagaaaataaagacaaaaatataccaggaaaaaaaaattctaagaaaatgaaagcagagattattcttttatacatgattaagctggattcaacaagagaaatagtattaagttttaccaagaaagatcactttcaaattgacaaatggcacaatccacaataaagatataagtgtcaaaatgcccatggtctggattacacagtatcaaacattgtaaaacaaacaaacaaacaaacaaacaaaaaaacaaacaaaaaaaaccaccattgaaaatactaggtggatgttgtggggctgatatggttgggctttgtgtccccacccaatgtcatcttgaattgcaatccccaggtgttgagggagagacctggtaggaagttattggattatgggggcggcttcccccacgcggttctcgtgatagtgagtctcacgagatctgatggttttaaaagtggccatttctcctgtgcatgcactttctccttcctgctgccttgtgaagaaggtgcctgctttctcttctgccatgattgtaagtttcccgaggcctccctagccatgctttctgttaagcctgtggaacagtgaagtcaattaaacctctttcctttattattacccactcataggtagtattttttatagcagtgtgaaaacgaactaatacaagggcagtgaaagaaaataacagcagtgactaatcagaaagataataagtattaacgtaggggatctgattaatattattaaaatcgatataaaagctttacgcatactttgtgtactgtaaatatttagttccttttctaacactcactaaatcattataaaatcaaccaaaattaaacaaccaagaaaacaccattaagttttcaaaaaagaaattaataatacagattacagtctccatttacactacaaaagccaaaaattaatttcaaaagtagaacaaaataattatttcaacagcttggaaataatttttgggtcaaaaataaaaccaaaatagcaattacagatttttagagaatagcaataatgaacccaatacatatcaaaatacatggaaagtagccaaagtataccaaatgtaactttcatagacttaaatactttaataactgagcaagaaataaaatgttaattatttaagaaatcagctcaagaccctagaaaataaagagttgaatgaagcagaaagagaggcttaataaagataaaggcagaaaacaattcattaaaaaaacagaaaaacatcagaataaataaatctaaaatctggttctttgagaaaaagaaaataaactattaatagataaaacatgaattaatctcatcaaagagaaaataaaataaaagcataaaccaaagtagaaatgagaaggaaacagttacagaaagaatttcaaagtttcattcagtagaaaatacttcatctgtcaacaaatttgagaacttgaataaaattataatatatatatctttcaaaagagcactggatccaatcattgtctagggtaattcttgtgtctttatttgcttaattttattgatttattttttgagacagggtctcactctgtcacctaggctagagtgcagtggtgcaatcatagctcactgcaggtctaccaactgggctcaagcaatcctcctgcatcaggctctcaagtagctgagaatacagatgcatgccaccacacttagctattttcttttattttttgtagagactaggggccggtgggagggtctccgtgtgttccccaggctggtctctaactcctgagctcaagctctcctccaacctcaacctcccaaagtgctcggattataggcttgagaaaccacgcccagcctcttgtgctattttaagtcccttagaaccttgctacacaaaatgtcggccctgagccagcaacatgggcatcacctgattagtcatttttacttatactttgtgatttaaaatcccttttgcaatacagatttttaaaaacttttaagaagtatctcgcattgtttttatggtttcctgatggttcaggttactgctagttagaaaggcagactctcaagccccactctggacctactgaatcaccatctgtattttaacaagctcccagatgattcataggcacatttgagaagcatggttttagatctaaagaggaaagcttccattctttaagaatagtatgtaagagatctacagattattttatttatacagactcaaaagtccaagttgaaatttctagcaaaaagaatccaacacttcattaaatagataccattcaacaaagaagtggatttcatttcaggaatgtgacaatagtttattgctaaatttattaagagaaaagaagaatataagtgaatttactttaaaattattttaggctggggaaggcttttttgagtacaaccccaagccaaaaatataaattcagtggttgaaatacttcataaaaacttttaaaaatctgtattgcaaaaaacgttttaaatcacaaccaagatgtaaaaaaaaaaaaaaaagactacaaatatatatgaagcttcaaagaggggattattatctacaatgtacaaagagctactaaaacttacaaataaaaagacaatggatgaaggatattaatcacttcacaaaagaaaagcaaatgatcaataactatgttcgtgtcttccctcattcaccagcaagcattaaatggcactcatctagattctgaggactcagcagcaaataaaacaaggtaacttcccacaagattatctaactaataattaaacaaaaatgtcaactaatagactggtacctgacagactggcaaaaattcaaaagataaattaatatcctgagtcaacaaatacgtcaggaaataaacaccttcatacattcatgatgggactttcaactgccaccaattgtgctgcagtttaataaaataaggcatagcttctaacagaatatatccatagaaaatagacaaataggtatgaagatcttcctcacagcattatgcacaatagtgaaaagaaccttcgtgtccatcaacagaagaatggcacaatagcatcaccaacatttttcatctattgctatttgttcatatattaggtatgtattatttgttatcatatcaatagcagaataaaatactcttgaaatatttatttcacattatttcagatccaaggctaagatatgttagaggcaatagaaaccctaatacattttacatgacgatgatgaaataacttgtgtgggaatttggctttgtatataagatacatatgtttagggatgtaagcatcactcaaagcttcctgaaagacagatccaaggctgcctatgtgtctctgatagctgaggctgaccgtctcagaaccacactcaaacacagtgtggtgttcagatgccttcatcatcatgttcctcctatagttcacatcccctcctttgcatctcaccagcacccaggaaccagggtgctttttaaaaaaacacacaagttaaatcccagctcttcctccattggtttcttactgctgtaaccacaaaaaggtaaggtcccgattctaatggcccacgaagtcctgagtgacagtcaccagctcctgcccactctccaaccgcatcttgttgcttctttcctgtgactcccggtgctctggccacatgagccttctaacaattcccagagtattccaagctctgtgtcacctcagggactttgcacgtattctcaaactgggtgttcttttccctgttctcttcagaacaggcttttctgtccttcaagtttcagcctaaagatgctctctgcagcctggctctactccctggccactacaacaccctgcttgtctccttcaatgcacttcccacaatctgggggaaacagaggagagaattggccatactttgtgcattaattatttttttacttattcactgtgtgtctccttcactgcaatgtatgtttcagaaagctgaccctgtgtctattttgctcttcaccgaatccccagcagtctagctcagagcctgcaatgctgacggcattcaaattctggtaaatgaataattgaatgtgaacacaatttggacagcagatcaaaaaccttatacaattttaaaagaaatatttgtgatcatcttttcctcaatcctcagaaaataatcacaagaagtacacaaagattaatatccaaagatgctcgttacaacattcttctaacagcaaaaaccagacacaacctacaagcccaacaagaggaaaatattttagttgatatataggatggaatagtcaattataaaatatatcataatgtggtaaatttttaaaggggagtaagaaacaatgtgtagttggaccctgaacttacaaaatcagcatacaattctatacgcaaaatagaggaagcatatattacaaaatgagtcatggtttgtcttctttcatatatttcctacgttttccacctcgacatatttttaaagttttgacattgagcaagaggatacatttttaaaacagaaatgcaaaataaacatcatttttaaaaattaataaaagaggtcactcctccccatgagtataacctttacatctcatgagaaagaaaacttttattttctaatatattttaaattgtgtgagatacttaaaattgtgtgagattctatcaacatgtgaagcatatgttaattcattctggttctcaaaacccaaggaaagaatcattcatatgggctttcaccccaaaatctacagaaaccctctacatcctccagttctcctgtatctgcctgcctctgtagtgtctgctctggtctctccatcagtgtctctctttgcttgtgtgtttcacgatcagcttccctttgaactcgacatccttgccacccctattctccccgggggctgtcttttctcctcagttggccatgatatgaaaatagatgagaagcatttattgaactgtctttgtttttctcccattaaaataaaaccagataagtgaaatcatctgtttacatttctctcaaaaagaactgcattaaattactattggtcctacaggtcaccgaccctccgctgctcagcagtgcccctcaccagaggcccccagaaagacatgtccttgctgagaagtctagcacttgggcacataagcagacactgatgataagctgattagaactgcgaggcagggtatagtgtggcaatgtagagtctgcacagaagtccctgagaccacacacagtaagtgtaaaacttctaagaggtcacaaaaacagtatcttgttctaattcgaggggacccaccttcatacatcagcatgaactgaacccaggtgaatcttgccagaacaatcacagaaattagaacaatctaaaatcaatataaagagaagtctagagagagacgatcagagctcatgagatcctgaagtcaatcaaaaggctaaacaggatttgaaacctcatcacttatgtagaaaataaagtacccagcagagcaaaagtgaaagctgtctcctaactatgcagctctctcctttgacaatttaaagggttccaaggaaacagctgaacctcaggaacagaaaggtattttttggttctgatttttgatgtggaaacagaaacacatatttgattttaatggttctcagaatggaaatagtggcttctgaatttaaatacaggcagcatcagatcttattattctgctatctttagccatttttgccttcatgcgttatttatcatttcactttcaataactttgatatgtaaattaaagctactgtaccaaatgttatgatttagataaagatctagaaacactaatatttctcattacggattttgcttatccagctgaatccaacggaattatccaatttgaaccatgtaggggaatgtctggacagagctcagcagacttttgagaccatttaaaatccaaacccaccacccaaagcttttctaccgtaagggcttctcagtttgttgatgtggcacattgtccggcgacttcaaaatcatgactcagctttctttttcaaatgcaggcagaatcattccctggcccagtttgaaaagttctgagacttcaggctcagaaaaatagttagcatagttgttgatacttcaggcattatctgcacttaccagctctgtgaccttggccaagttataacctctctttgcctgagtttccttaactgtaaaatgggtgaagcaatagaaccctctatgagtgtgaaataagaaaagccaagtaaaagtgctgacttagctcagtccctggcacatgataagcactaagtgttagtaaattattcttcctgaggcagaatgctgcaggagtggctttgccacagatttaaggattcactctttaaagactgagaaatggccatacagtcttcaatggactaaatgtttaggtcccctcaaaattcataggttgaaattctaaccccacgaggtaagagtattaggaggtggaggcctttgagagataatgagataatgaaagtgaagttctcatgaataggattcatgaataggattagtgtccttaaaaaggggctccagaaagatcccttgccccttccaccatgtgaagctccagcaaaaagatgaccacttagtaagcagacactctccaaacaccagatctgctggtgccttgatcttggatttcccaggctccagaactatgagaaacagaccaggcaagatggctcacaactgtaatcccagcactttgggaggccaaggagggccttgcctgacttgtgatcaggagtttgagacgaggctggccatcatggtaaaaccccatctctactaaaaatacaaaagttagctgggcatggtggtgcatgcctgtaataccagctacttgagggtctgaggtggaggcatcacttgcatccgggagatggaggttgcagtgagccgacatcacaccactgcactccagcctaggcaacagaatgagactccatctcaaaaaacaaaacaaaaaaagaactacgagaaataaatttctgttgtttataagccaatctatggtatttttgttacagcaacccaaactcgaattaagatacaggctcctagtgagcccagagagccacaaagaaagaaagtctaatgactctcttgaccactcatgctgccttccattgcccgtctcctgtgttctgtgatagtcagagtgaacattaagctaccttggtcactcaagcacctctcaggtgggtttgggtctctccgcctgacttcacatgtcaagggcttccttctggaaacattcggaaggcttcatgagaacaaggtggcccatgagttcttgttcagctaatgatcctgataccttggtgagcaagaaagagctatgggcagcaatggcaagacagggcaaggagcaatgggagctgtgagtctacttcaaggtcaatgaatttttccccagcagctgccacgtttcttccccaaataagtcagaacatgagaactatcactgaaaaaaaagactaaacatagacaatatttcatctctcaatccatctattcaatcatttacccactcgctgacatatcgttgcatcccctgtgcccagccctgtgagagaatctgaaatcccataaagatgcccaggaggcagccctcatccttggggaacctacaggctactggggtaaaggcctatcaataaacacagcccagagtgttatgggccatgaaatgctgagctgggatgttgaaagacggtagagacacaggcaaaaaggaggttccaggaaagggaattggcaggtgcaaaactgcagaagtgagaggggcactatgcattcttcaaagagaagaagggccaggagaatggtgtaagatgaacttcaggcctcaagggaacttggaggcaggctgaagcactgactgcagctgagggcagtggagggccatcccgtgacgcgtaggcaggaaagtgacatgctggatttgcatgttaggaagatcgttgcaccatctttaccccagtccacacttgacttcttccattgactgggcatctgcgacgatggctacatttacataaattctgatcatctgaccccctcagagacccagggttcctcatacttcagtactctttatttcaggtttagtcgagcggagcagagaggaaaagcatctcccagctggctgcagagctgcatttccagctgcctgatagatttcaccaatctgccctcccagagccagtgtgaactcaacacatccaaggccaaactcatcatctttcccaccaaaccagctcttccttcttagtcttccagtcacccaagttcaaaagctccttcttactacctgctacatcccatccctcaccaaggcctgctgtgtcttccttcagaaatgtccccacctcctccctttccttgcagtgccattgtttcaccctgtctccatgtcgtgaactcttcccacactgacccacctgtgtcctctgtccccatccccccaatcatcagcctgtcttccattatcaagtcacttcctgccaaaactggtagactgcaaactccctgcagtgtagaaccgatgatcattggtaaggcttccaagacccaagtagttgggtctcaaagaggctttccagcagtatctccttcctcacactcaccttgctgatcctcacactcaccttgctgatcctccccattgagcaaatcacccaatccacctatcacatcctactctggcttctgctcatagtgtctactggatcaaatagtgttccccaagaacttatatcaacctagaactttggaaagtgaccttatttggaagtagggttggatgagatattgaggtaaagcatttagcatgcagtctcatacttagtagcaaaacgtatactggttgacagcatcatcgtcaaccacaacaatcaacatcatcatcgcattatcattgaactttgttttaaaataccttgcatcagctacgaacacagagttgcatgaatccaccacttgcaagaaaaaaaaaaaaagaataaaaggcacccttcaagattaatgcccccactaaccatgagtactaagcaggttcttcacgtatcaaggacagtgtattattaccctcataaaattcctttcttcctaagagattaaagagctggggaaatttcattccactcaggttcacaagtcccctgagagagaggcaacaggtgagcatcacttttccattgtcctcaggtgtgtcaaagcagagacaagaatcaaggtggccatctctagagctggaggctgctgtctccccaggccttgagagttaagaaaacgtgggccatcctcctgcttattcgttaggtattctttgcctactctgaaagcaaattagtacgctgcagggtgttggttcttattcattcacttcttcactcattcattcattcaaaatcattgaatgagcctatgttcccacaaactctactaagcattaggcaggctacagagaataagaggagccagagtcaagtgtggccacctaagaaaatgcccacgccacaaatggccagagtctgtcctgtctcctgaatatgaatggggaatgcttctaaaacttcaccagtcttacatgtctcctcctgtaatttttaacagtggaatttaaaaattcaactcaacttcaataaatactccaaaagaagatgatcccccaaacaggagtctttcctggccagaagtaagacccaccagcccttctgcagccatcatgctccagaatcaaagatacacatgaagtggagatcgatgcctcaagtgaagatgctccaaggaatcagagccttttattgttgctcctacctggactgaaatgaatctgagcataaaatgagaggaagctggcaggtatttacagtcatagcagcatttctcatgatggcccaaaattggaatcaacccaaatttccacccatggatgaacagataaacaaaaatgtggtttatacatatgtgatggttaataccgagtgtcaacttgtgtctgtgagggtgttgccaaaggagatcaacataagtcagtggactgggagaggcaaacctaccctcaatccgggtgggcaccatctaatcagctgccatgtgactggaagaaagcaggcagaagatggaaggacttgacttgctgagtcttccggccttcatctttctcctgagctggatgcttcctgccctcgaacatcagaccccaagttcttcagcttttggacttttggtcttacaccagtgacttgctaggggctctcaggccttcagccacagactgaaggctgcactgttggcttccctacttttgaggttttaggactcggactggcttccttgctcctcagcttgcagatggcctattgtgggacttcaccttgtgaccatgtgagtcaatactccttaataaactccccattatatatacatccatcctattaattctgtccctctagcgaaccctgactaatacaacacaggatggaatatttttcactcctaaaaagcaacaaaattctcacacatgctgtaacatgaatgtaccttgaagacatggagctaagtgaaataagccagacagaaaaggacaaatattgtatgattacacttaagatgaggtacctagagtagtcaaatttacagagacataaagtaaaatggtggttactagaggctgaggggagtggggaatggagagttagtgtttaaagggcacagagattcagcttcaaaagatgaaaaagtttgagagatagatatcgggggtggttgcctaacaatgtgaatgtacttaatgccacttaaatgcacacttaaaaatggtgtgttttgttatgtatattttagccacaaggaaaaataattagtgggtgcaatcaggagacttctccaaagccatgagaagaatgggcagtgctattaaggatgctgctggtgtctgctcagttcccctttagtgagctggtgcactctaccctcgccctggggagttggctccttggcagcccacaggagccaccgggaggttattcccccacagactaatcaccatcaccatggggatggccagtggacctccatgaaggtgcaaaatatctcttgcctccaggtggaactgagtctgtggtgcatctcatgccccagggctcacccacaggcttggttaactttcttgccctcacctgcttgacctgcctcccttgctcttctgagagcaagccctccataaatcattcacaggaatccctgcctcaggctctgttggaaggacagtgttcctcaaccttgttttcattactgccctcctaaggagtctttttatgaatttttttttcctaatcacccactaacaggtacactgtatatctgcttatgtactgtatatatatctctgtgttttttacttaaaatattgtaatttttttcactctctaataactcatttttattcttttggaagtgagttcatctcctctgaacatgcctggtctacagaacctgagctaacgaagtgtggattcgcctaaatgacccatgtgtggggtatggaattgtccctcaaagcatcgagagcttcaaaatgatttctgctgccatcaatgcattttattcacaacaagcaaccagcaaaccagccaatccaagaaaatataaaatctgccacctcttttgtgcccagagggtgtgctaaaccctgaagagacagaaaacaatgaacaagccagattcttgagtctgcttgcatgggaaataaaagaacaaacaggtggtacaatagctaagacagaaagtggggggtacatatctggaagtggtctaccctacccagagaccctacctttttggagtctgtggaccctctagggatacacagagacaacagcaattcactttgctgtcacaggataagcactccttgaagaagaaaagggagaactactgctgttactgacttgttcactcattaattcactcagcagacatttctgagcacctactttgataccctacactgtgctatccctggggatacaatacaaacgcagcaagacatagggagctagaagaaagggctccaggcagacagaactgggtttgagtcttcaatggctttgtgatcttgggcaagttccttaagcacttatgttcctgatctatgacatgaggagaataatagcaaatatctcaagggattgttgtgaggattaaatgtgatactgaacataataaggcgaggtcacttattgtcttaacacacagaaaatactcaacacatactaggtattgctgattctttcattaccaactggatacattcccttccgtcaagtacttggtggagagataatgattaaaacatagtgccatattgaatcatgggaaaaacacatctattctctcatttttggaaaaagagttccccctgaggacctggtaaccacatggcacttccctgacatgactcctggccattcactctgatggctggaaccctcctctccaagtctgtcgctctgttatctgcatataacaagataagcctacacttccagctcatttggcagatactatgaggaactaatgcctgcaactgtcaccatttagtgaaagatttaataaacggggtattttttcaagtccaatttcacaagccaagctgatgtttcattcccccagcattaatgctgccacacgcacatcaaaatgggtaccaagggacagggcattattttccagccacagtgagacacccagtgacttcagagaccacagccatatatccacatgaccagacgaggagaattaaaatcggcattccggggatggcatcaccaacactgagtttcagggggttatttatttattatgtgataatggcccaaaggtatacactactccaaaatctgccatgaaaattcaaacatctttgtaatccctgtttacaaagcatacagagaaattaaaacaggcttaatcgagcagtgtttgtgcatattaatgagcctaaattctaaatctggattttggaaataaaaagggtaaaagaggattcatttcagactaatttgtttttgaatatgacactttgcatgtcaaatagtataggggatgtgaaagtgggggcctagataagcattttaaagcatttccacacaaagtatggggcataagatctgttaaaggaaaagaaccactttccatggtctacctaagactttaatgacacaaatctctcttcagtctcctgtgtcctgttcagtgagggaccaataaccgttctccactgtgaccatagaatccttctcttttatgccctgtataaactttcctttggctaatcattatttacaatgctataacatgagtgctgggtgtcataagagacatgttcttttaacttgtacgctaaggcacttgtatcttagaaaacagagaggtagagggaggccagcctccgaattcagaatcagatagaccagagttcaaatctcagccctgcctctcaccaactacaagttatgtactctctcctccttgcttcaccttccacatctgcaaaatgaagtgataattcctatcttttcggccaaacttacaaaacagaacatagtaggtgtgcaaaagtgctaactccattctttgtgcttttctttggagcaataataaatcacggagtgaccaaaagtattttacgggtatcataattcagtgaatagccaacacccaatttcctatggtccatgtatgcaggaaagttaagagaaaaatcaaaaagatcccaaaggggacacttgggaacggggatggatattgggatgggcatgaacatacacacacatgtgccctctggcttgctttgcttagcataaggtgcatgatacaagcctggcaggcctcccgcactaaataagagttagatgtgggactgtggaatcagatatcctgggctagactccatgctctgccccttacaaatgactctgggcaaatcacaccagtcacagcacccttccagagactggtgtcctcactgtaaatggggacagccaatgcaacctccctagctttgcaattcatataagttacacctgtcagcagattcctttgcagatataaacataagataagaaaacaggcctgcaggattatgccccaatcagaaaggttcatagaataagaaaacacactaagtatttcaaaaagaaaaaaaaaaaaaagcccacgtccacattgcgacatgtcccctctctcagaatttgaccttagggatcccagatggttccagaccatccccaagctgaaagcatcctgttctctcctgaggattatctgacctgagagccccctgcccccttcactcataggtcctgtccaagggggtctacagatcacacaagagttcagagtttggggacagggggtatggagcaaggtccccactgggacagctgcacccacagcctccccctcttttccccatgtttcctccagaccctgggcactgtggagccaagagtgggctggccatgctgccaagcaggacccttccttgctctgccatcaggctctggcttataacagattctcactgttccaaccagcctctccccttgcctctggccctctccctctgttacttccctctgctgtctcgcctcatccttcctccctggactgtggtctcccctttcctttccctgcctgcatcagcgtcccctcctttccctaccacagctctccatgcctctgtctcggttgctgtctctgactctctgtctgctcatttctctaactgctctaaggccactttttttttttttttttttttttttttgaggcagagtctcattctgtctctatctcggctcactgcaacctccccctcttggcttcaagtaatcctcctgcctcagccttccgagtagctgggactataggtgcatcaccacacccagttagtttttgtatttttagtagagacaggatttcactatgttggccagggtggtctccaactctgacttcaagtgatccgcccacctcggcctcccaaagtgctgggactgcaggcatgagccaccgtgtccagccctctcactgcctatctccttttatgtttctctccttccctctctgtcagtctctcattctctttctcctgatttcactgggtattcccccatctctgtttctccctttcagggcagggactagggtgaggttggggtggtacttgacccaggcacaaaatttaaggaggtgccaaaacactcagtaatccaaacaaatattactttaatgtaatatttttaaaaatcaaaattaatgcaaaaaaaatccctgttgaacaaagaatcaaaaatacaaggaaagacaggatctgtccaccactctactccttgccccaacctaatccattcctagtctgaaacattattgacaagaacaggtggctggcccatagactgtagttcatccatttaatttttttaaatattgcattaaaatattactgatctcgatgattacattctgtgtaaaggggcatgctgcctgtgtttgggccctgtgacctttctgtgcgtttccttccctgtctcttctctcattcctctctgtttaccctcaccctccttctctgcttccgcccaatcgcatctccctccctcctccggcccacctcggtcttgctctccatctctgcccagccccgtgtgtgtttgcacaccttgtccctgttatgtctgtctgtcttccccctctgcatctgtttgtccccacttctccctgggactgactttctctctctcccttgtcaccctccccacctctcctcacttgcctgcacctgtggccatcccgtcaagcctgagcactgccaagagcacaaggaaggacagacgagcttcctcctggcaggaaagctggactgggagggaaaagctccaaattccatcctgtctcagacctccaaatctgcaccatctgccagagctcctgtgaagcctatcttgagcaatagatgccctgtgtcccagaggtagaggaggaggcagctggcagatgctgaagtcacacgccatggatagaagacagtgggcactgaggcagtgcgcagagcaagcctgctggcaggagctggaggtgctgcagttgggagggctcagattcccctagaaagggcaattcaccctccatgtggccatctcaggacagcaactagagaagtgtcacaggtggtatctgcctaacgtgcctggatgtgtcggggatatcatactctctgtttaacttaaccctaggtatgatttttcctattctgcaactgaaggaactgcagttcagagaggttgagggatttgcccacgggctcacagcttgattcaaacttagaacatctaagggtccaaaaggtctgaagaaccagcccagggccctttcctttaccatgttatctatttaagaacaaacttctcacaaacccagaggaataagaaataaaggccaagcaacccaataactctgtgttcattttttggaaaacaacgttcagagttggctaaatgatttgaaaaaaatattacattctccagattacaccaaactcagaataaattacaaatggattaagtaattaaatgcaaaaagaaaaacataaaacatctaagaagaaatacaggactgtatcccatgatctgaaggatgaaaagactattttgagggtgacataaaatcatacaagaaaaggttgactgattgcattttttaaaattgagagttttcgaattgcaaaagacatcgtaaacaagattgaaaggcaaatgtaaaatggcggggggtgggaatcttcagtctatatgataaaaggttaatatccttaaaatgtgaagtgtgcttatcaaccaaccaaaaagtcaaataactcaacagaaaatatgaacaaaagatttgaacaggtaatttatggaaagcactcaaccaaagcaaataaacaagaaaaacaacgcaaacaaaactcatggattcaaaacttcaagttaaactgatacacctttttttcacatttgaagttagcaaagcttaaatattcactatcatcaagagtttaaggagtggaaaacttttacaggattagggagaatggatattgttacagccctctattgggaaatgtgacaatatttattaaaacttcaaatgcacattcctgctgatccattcatttcactcttcaaaatttatcttactgaaatacatatatcacatgcacgtttatcacaacattgtttgaaaaaaagcaaaatatttgaaatatcctaaatgccctacaatagtactgagtaaattatactatatctaggtaatagaatacaatacactcaataaaaggagtgaagtaaacctatatgagctattgtagaaagatcattgtgatggttgatttgggatgtcaacttgactggattaagggatactcagatcgctggtaaaacattaattattctcagtgtttcagtaggcacaaaacccatcccatttctgctaaaagggaagccaaggtggtttggcatttgattagaataattgggctgtggccgggcacagtggctcacaccagtaatcccagcactttgggaggtcaaggcgggcagatcacgaggtcaggagattgacaccatcctggccaacatggtgaaaccccatctctattaaaaatacaaaaattagctgggtgtggtggtgcatgtctgtaatcccagctacttgggaggctgaggcaggagattcacttgaacctgggaggcggagattgcagtgagctgagatcacaccactgcactccagcctggcaacagagcgagacaccgtctcaaaaaaaaaaaaaaaaaaagaataattggactgccccagctgtgtctgtgagaatatttccaggagagactgatgtgtgagtccatggactgagtggcaaagatccaccctcaatgcaggcagcaccatccaatcagctgagggcccagatggaataaaaagctggaggaagagtgacgtctctgggtctcccagagccaggagcgtttcttctcctgcccttgaacatgagaatttcaggttctctagcctttggactctaggatcactccagcaaccctctgggctctcaaaactttggtctcagattgacagattgatagtaacaccctcggcttctttggttctgaggccttcagacgtggaccaatccctgggtctccagcttgctctcagcctccataattgagtgagtgaattcccctaacaaatcccctctcctctccctctctttctatatatatgtgagtgtgtatgtgtgtgtgtgtgtgtgtatatatatatatatatacatatgcatgtgtgtgtacatatgtgcatgtgtgtttgtctctatataattacatatataagtaatatgtaattatatatgatatttaattatgtaatatatatatatatatttatgttatatatatatttggttctttttggatagcccagactaaaacaatattcaaaagaaaaaaatgtagaacaaaatacatagatattatgatcccttttaagaatacatgtttatgtgtgcctgtgtatttatacgtagggaaacagacctagaggcacagacggcaacagtgcatgcatcagggaaagggagggacaatggaatactcactcttcaaacatcaccctactgtttacatttgtacaatgagtgcctgttacttctgaaatcttaagaatattcccataattaaaaagttggcagacgtgatttaaaatagaacagttttgcaaatggaaagcaccctttccaccccaaccctgccatgccccaccaccctatctgatcagtgagagcggcctgccctaagcatgctgggaatctgagataccgctcccatgcacacgtgacatgcatttatttgtaattaaacttatttatgttttgaggttttcaaggccccatgacatattctgaagcaaagctagaggaggcactgccttttatgtaatcaatgcttcatattttgtgttttataagctctatctttcccattgtcagaaagatcctattaaggatgatgctgctgctgctgcctattttactgaagaactttaggcacctgcttagagccaggattggaacccaggtctgttgtacaataaagctcacgtccatttcaacccaagccctgaagatgactggagacactccatgccaactgaccaaaccagattcaaagatactacacagaaactgcttacccagggtactattaaaatcaagaatatccaagatggatatattaaattatcatgtgtatcctccctaaaaaatcaacaattaaataaagaaattaagaatacagagttaatacctactcaaaggagatgatggtgagacctgataaggtaagctgacagagaaaatgctcctctcatacaaaccccatctttgcaaagtcctgatttgagagactacagagagaggccctacagaaggcatttcctaaacacatgttacctcaatttgttgaggaactgcaactgtaatagctgagcctgtcgctataaaaagttctggtcttttccctcaggttaggaccacctctcaaaggcaagaacctgataatttttgcccagagtccacactggagcccacccaccttggaaaccaacagtggacgtgaactcagttggatggggtaggtcatacttccagacaagcagaggaccagggacaggtgggcaagttccctggtctgttctgcctgggccccagatgtgagatggctgaatgggggctgggctggggtgtctcaggggccctagttaatcttggccagagtcctttccaacctagccctaacagaagagatacagacagttaaggtattcagatcactgaagcattgttactaggtgtaaatattaacacctgcactcaactgtaacagaaaccaaattaaattaacctgacctgaatgaattagggttttatttttctcacataatgggagatacaggaaaaaaaaaaaaaaggctacaggcattgagtcaagggtgtatggttgtcaggctgagaactctgcaattctctatccacatagtgtccctgttgtcacagatgactctccacctttagcatggtatccctgttccagccaggacagaagagcagggaaaaggacaaaagaggtatgagctactgagttggcttcccttttaaggatctttcttggaagccccacccacagctttctcttccacctcactggccagaactccatcgtgtggtcactcattctgcaaagaaggctgggaaatgcagctttgaagctagacacattttccaaaatagtcagaattttctagtgagggtatgcgaagaatgcatattgggtaagcaactagcagagtctgtctgaccagataatcaatggggataaacttggtgaattcttcagtgcactgatggtggaatgggtggcacataagattagaacgccctggattgctggcaatgggcccaattgttgcactagaggagactctcaaaagtccaccaacacaaggaaggcaaattatccttgcaccatagacacctgtggcttttccagtctcatctttgccctccagagagctagatactgagtagaaactaataacattaagtattaataggccttacatgattctatttcctttttaactgaggtccaaagatcatctaaggtgatggtacaccagtaacctaagaagtaaaagagtaggtcaaattgcttatcctatgtctggagagggggctgattccaagagctgagcatgctgggaagaggagagtctctcccagaacaggcagagaggacctgcattatggcaggggaggagttatctgatcccatcaggaggcggagtgaaagctagaagcaaaaatagaatatgtggccaaatgaggaggatgtaacagctgggtaaaaaagcataagaacacacaaggctgtgtgggagggtgagatgccaggcagccttcagcagctgcagactttgtcttccaccttgctagagcctgatattgaagagttggcaacatggttactccagacctgcagggatttaaagggatatttaaagggatgtaattgtaactcccagatgcctgaggacactaagagtgcccagccaaggcaaaatggttccaggggcaaaggccctcatagcaagggcaggtccctccagcctaccagcctatctcttctgaaagaaggagaaaagatatatacattgatcttgatgttaagagcttctttatcctaagaaatatgaaggaccagaagtatgaatctgtgcttgatgattatagagatgtgtgtaacatcgagtctgcaggaccagacccagccataacagaaaatggccctacacctctgaagtgagcccactccccaaacaaggtagattgctcagcctctgtgacttgaaaaactttgacctattttgcataatgactgtgtgtgacctgaagcatcctcctcaacatttgtcaactgcatgctcatgctgttctggcactggctgtgtgcaggtcataagtgtcagcttcatatgagggtaaaccaagtgctcatcccctctgacaggcacaacaaaagatgctcccctctgaggccaaataggtggcccatgctgccaagatttcctgctcacacaagcctgcagaaagtccatgttaatttccaatcatgttgcttcccttcctgagtggaactgagacaggtgggacctgaggccggctggttacttggcatctcctcacactaatgttccttaaatatctgttcaatgtttagagaagaggcagagagctgcctgagcaagggcctagaagccacggctgcttctcctctcatctccagcacagttcagctctggcccaattctgcatctctccctcaacgaagccctgtagctgccctaacctctccccataaaaggtagctttagaggctatgtcttgttattggagatcaccccttggcctcaccctttaccccagatgtctcatcaaagtgcctctggcccccacactgaggttcccccgagacaaacatcctggtaaatatagctttgtgtgctttcattatttattcccagggatgcctaatgcccctgaattgcctggcatcttggctctgctgcctgtcagtggatgtgtctctgaggacagcaggctccccacagtctttgcagcagcccaacacggggagctggggaatgagcacagtgagtatgagcaccgtatccaaggcacagtgcctgggtgcaaaacaaacccctgctccaccacagactggctctgagaatatgggcaagctactcaacctctctgagggtggcttcctctgcataatggagcaatactagtgcccaccttatagggttgttgtgaggagtaaatgagtgcatggatattgttcatcacagtagttgacacaaaaccaaggcagaattagaatttaatattagtatcagtgttactactaatgcaagagggggtaaaaaaaaatggctccaaggctggtagatcatgaggtcaggagttagagaccagcctggccagcatggtgaaaccctgtctctactaaaaatacaaaaaattagccaggcatggtggcacgctcctataatcccaactactctggaaactgaggcaggagaattgcttgaacctgggaggtggaggttgcagtgggccaagatcacaccactttactccagcctgggcaacacagcaagactccatctcaaaaaaaaaaaaaaaagcctcacaaacattcccatgtgaattgaatatgcaacttaaaatgcttacatgaaatggtattaataaaagtattgacttgagtagaaatgctggcttggccactattccattgggcctgcccaatgtccagtgttagatcccaagagctggcaatgagactcttccaagatcatccccaatgccatttctcaggccaacacatgctaggctcatcacaacctcacagctgccaatggctccagcttccatgcccagcccacccctgggagaaccaactctgtagcctcactgggctgctttgggtacccaaaatgtaccatagacttcctggtctcttgaccatgctgttccctggctcttctttgccatcctgaaaattttaaacatctcaaaagatcattcatacactaccatctttccaacaccttccttgactgacagaaacacagccatggcctttctgtggtcccagaagctttgttggtgtctgtatccacttacaggataacctgttctcccaatagacaatgagcctcctgtggaatatatctttagctcaccatgcctgatactaactagataccttacaaatgtttaatgattaaaagaagtattagagataagttttacttggcttgtgcacagctgtgtatgcacaaacacatacacacaaggtctcctaatgactatgtgaaggcaatttcaatgtggaaaatacaacagtatcacaaaagttcagtaagtcagggaaaccaacttccagaacgcagtccatccttttacactgatggtaaaagcattagcagcactttggcttgtgtggtacttaacagtttacaaagcacttataaatggaaggaccctgagggttggagttggaggacacgttctcaacatctagcctaatttcctgggtaaagcaggaatctcctggaaaaaatcatcactcagggttctgtagcctcttgccaatgcatcctgtgccccagagtttcctacctttcagaataattcacagtatttttagagatctctaatcattcaaaggttcctgtcttaggttgagttaaactttgcttcccaggacttgtcacctattagtcctggaatatctctcaggaacacacacaaaaaattttcttctggcagaattcaaattctattggtaactgtcatgtccaccctaatcttctgtgaggtgatccatccccagagcttcagtatttcatcctttgacttggatctcagacttgtcacctctctggcacccttgcttaggaagatgctacaccatccttctaggaaggatgccaacaggtggaataatgcacacagcaggtgtctgactggaagaggaggcatcattcacttggatgtttaggtctttagtgcagttatgtcctgcctaactgttctgggatgaattgtggccccccctccaaaattcatatgctaaatccttatccccctagtgcctcaggatgacactatatttagagacattattgttttgttttgttttttctctgagacggagtcttactctgtcacccaggctggagtgcagtggtgcgacctcagctcactgcaacctccgcctcccagattcaagcaattctcctacctcagcctcccaagtagctgggattacagatgcgcaccaccacacccagctaatttttgcatttttagtagagacaggattttaccatattggccaggctggtctcaaactcctgacctcgttgtctgcctgcctcggcctcgcaaagtgctgggattacaagtgttagccaccgaagcccagcctagagatagaatttttctaatttttaatttttgagagtgcgtagtaggtgtatgtatttctggggtacatgagatatattgatacaggcatgcaatgcataacaatgataataaccataataatcataatcttaagtggggtatctactgcctcaagcatttagcctttgtgttacaaagaatccaattatattctcttagttattttaaatataaaattaaattattggctgtagtcaccctgttgtactatcacatagtaggtcttattcattctattttttgtgcccattaatcatccccaaccccttccacaccctcacttcccttcccagcttctggtaaccatctttctgttctctattgttttaatttttagctcccaaaaataagtgagagcatgtgaagttggtctttctgtctctgggctattttactgaacataatgacctccagttccatccatactgttgcaaatgatggtatctcattcttttttatggctgaacagtactccattgtgtatatgtaccacaatttctttttccattcatctgttgatggacactcagttgcttccaaatcttggctattgtgaatagtgcttcaataaacatgagagtgcagatatctcttcaatatactgagttcctttcttttgggtaaatacctagcagtgggatcgctagatcatatggtagctctagttttagtttttaaggaacctccaagctgttgcagagaaggtctttaaagagctgattaaattagacagttacagccaggcacggtgattcacgcctgtaatcccagcactttgggaggcagaggtgggcagatcatgaggtcaggagtttgagaccagcctggccaacatggtgaaaccctgtctctattaaaaatacaaaaattagctgggtatggtggcgggtgcccataatcccagctacttgggaggctgaggcaggagaatcgtttgaacccaggaggtggaggttgcagtgagccaagatcgtgccactacactccagcctaggcaacagggcaagactccacctcaaaaaaaaaaaaaattagacagggtgggctttaattcaatctgactggtgtccttatgagaagaagaaatttggacagagagagagacagcagggacgtgtggcacagaagaaagaccacgtgaggacacagaagttggccatctgcaagccaaggagagaggcctcaggagaaaacaaacctgccagcacctcaatcttcaacttctctagcccccagaactgtgagaaaatacatttctgttgtttaggacactcagggtatggtaatttgttatggcagcccctcataaatgaatacactacctacatgtgtaactcacttctattacctacacagcaccgacagcattgaagttgccaatttctggtcaagagatgagtgacaagataccttctggaataaatctcagagccagttctgctccctttctgagcttccaaagaatgacatgcagccccatcagcatttccatcccagcactgcccgtcaccctaagaaacacttatttctctgttgaagcgaaagacccttccctgatacaggccagaattttccgaagtaaggtctttgtttttaatgaaacataaaaggacaggaagaatatcaaatcataaggcagacgagtcactgctaagtcctttaaattatcatacttgttcttataccacccatttagcctaatggagaacagagggcatgccctattgtctcctgcatggactcagttacgagctgctctccaacatatggagagaggcccttccagatactgcaagacatggagagaggctcttccagatactgcaagacacaagcacacctacttggagtgtcccttttgtccttgctttgccctttgaacttgatgcatagcaatattttcctagtaacaaacttggttcccctcccacctcccaacttccctgaagtgtcacaggtaaaatactctctcttcctcgacctagttctagaagcctccaatatcctgcactatccttacccctggtttatcctcatcttagggaactgaatgctactacaaagtagatccccttttaaaatgacataagcactttggtcttctccccagggttctgctatttcagggagacaagcagaggtcacaaagcatctctagaagtaaaatgccatccaggggttctgggccaccaacagagctgctaagtgctacttcctttgtcctgggcatccgatagcctaaggcaaggtacagatccctaggggctgaagacagagtgaatcaaatctgatccaaacgcctaggagcagcaagagctaagttgagaaaacctccagtaaatgccaaatctgagaccaagaggagaactgaaatcagggccacggctagagggaataagtgaaatggaacaacagggaggcagcgatggaatgggacagtctacagacacgggtcaggaagaaacagagtcaggcttctcagagtcaattctttatgcatcaccccttggagtccatcacccagaaagaaggctgtgcatcttcaagtcagggcaggaaaagaggagagtgggcagtcatccatctacctcctctcagctgcctgcccagaggtacaagctttgaatttcctctcctaaccatgagatctatcttgtcactaggattttctgttctttccacaatttattccaccttgtgaatgattggaacaaatctttaaaagggcatttttcaaagccatgatggtacagtagtcacactgtctggccctgacagctctgaacaagtcacaagcccccaaattacacggaacagctgtccatcaagtattgccatagtctactggctgcttgtgagatacagttaagtcatgcacacaggccacccaccaacaagcaattgtgattggaagtgcttcggctttcatcaccaacttcggcagcagagaatatggcatcacgccacaaatggcagcttccagaaacaaatcagatgtatcacgtagcacttcattctcctaccttcaatggccatgcatcctgcaaactggctccaaaagactccagggcagttagatcggggtatcacttgtatatggccgtacagtctacggtaatttgtattattgttcaaaatactactgaccaagttttctatctgcccctgccattgatattagtcttagccatgtaatttggagtgtttctccttggaggaagattatatatcccagaccctgtggtcaaaggcttggccttatgatttctggcatccttcctaatggaagaacatataccctcactttgctgagcttaagagtggctacgtaatttgctttggtccattaaatgcagacagtcatgtgtcatttccagtttaaaatccagctcatagttttctgtcagtttttgctctgttccacagaccacctatttccgagatagaggctgttgtatcagcctaagtaccagattagaggccatgtaaggtatggccacagccaacctgatatgcagcatagatgaaaaatgaacttttgtggttgtagtttactgaatggggaacatttattttcagaggttatttattattgaagcataatctagcctatcctaactaaaatatcttcttcctttttctctttttttcttccactaattaagcacctactaaaaattgagaatgctttataaattgagcacctactatgtgacaggtactggattgggcagggaatgcaaataaaagacatacctaatgggaagacccagatgttgcacaaatacattttgatacattgtggcaagttttacaacaagatgcatcagcagcttgaaggaagccattgctctgtcttctctatcaggagttgtggagggcttcatagaaatacccgtcatatatgatgctccaaaaataaataaggttgattgaatgactttgatattggggctaactttaagaaaaagatcaggggtttggttggcaaggaagaaagaaaatggcattccagtagcccaaaagggggaaagggcatttcagaacaaaaaaaaaaaaaaatggcataagccatgttgtgaatatacctctgttgttcagtgaggatggaacttaggatggacagatgaagagttagataaaatgatttcagataattccactggaatcaggttgagaataccgaaaggccattccaaggaggtttgacttagccttgggggttatggaggaacaaatggagacatctaaagcaggggaatgaggtggtcttcctgccacaggaggtggtgtggagcaagggatgtggctgggtttgggaatcacaaaaaatggagttcactctgggtaacatgagattacaacatttagaacagcaaatctccagtggagaaagggaaaagcacaaacccaccttagatcagcttccctaagcaacagactctgaaaaggagatgagatgcaagaaggaggtttactgaggagagctcctgagaccatcacctggaaaggagtgaaggatgcaggatggagcagaggaagaagtccagctgtgatgcagttgcaacatagtccatggctgatcacctagggagctctaaactttggatggcccatcagagttgtcttgaactgaggcaagagtatcagaccctcatactctcacatcaaccaggctttggatatgggttacccccaggaaagaggtgtaatcttgggcaagggacctcctttccacagaaggacgttaccaggacaagattctgctaagctgtcggtggcagtacacactcttagcagctggggcagtgagtgcctgggtgctgaacagggaatcagaatcttagaggcagctgttggcatccactacacaccctcacacggaacaacaacttgccttccaccaagtgaagacacagcaacaaggcaacatctttgaggcagagagcaagccctcaccagatactgaatctgctggaaccttgatcttggatttcccagcctccagaactgtaagcaatacaattgcattgcttaaaaattacccagtctaaggtatttcgttatagaatgctgaagggactaagacactggcacaacactttccagtacgttctatttttacagacaagaacatggaggttcagtgaggttacattatctgcccaagtgaccatggaatcagactgaaatttaactttagcagtgtctgactcagagcctacattctccccatacattttggtatttatcttcaaaaggtatgaatatctctatacaggggccacaccacagggaagaccaaccaaaaggacaatataagggactgtctctgaagaggaagacctccaatgccctttcatgggttctcaaaaacacctggggtctgagtctgatcagtactttgaaatcctgctgctcaggggtttctgcattaggtaactgtactccccaaccacaaagcctctccatgaccttcttccctgccccagtcaaggcagaacttggcttggaagggagctcagtgaagactgggcaataggtgacctgagatttggggcagaacggccagaaatcatcacaggcaccacgcatgactatgagtaccaggcactatcacccataccaccccattatcactcccattttacacttaagaaaactaaagcacagaaacctgagtcccttgtctgaggcacataacatgtatgcagctgatccagaattttgttctttcttcctggacctgcatcaacacagagtgaaacaaaatttaaacatcagttcctcaggtgcactgtctacatttcaagtgctcagtggtcacatgtggccagtggctatagtgggtaacatattgagtaggtcaggtctaagaatatttccaccattgcacaaaattctattgaatagtgctgataagggctgctttgaggtcctgggggagcaaaagagcctcggtgattatctaaattttctctatgcccctcacccactgtcccaaatcttttcattaaaaaaaaaaaaaaaaaacagtggcaaataaacctaattaatctgaggggggaaatatatataattaatccagaagggagaagggaaaccatttttgtacctgtttatgttcacttgataaacagaggaaagctaatgcctctgtagttccagaagagtccacaggggaattggaatctcttatcttagccccccgcagagcgtcaggcctgagatcaaagcagatctgtgcatgtcattactgcatatcctccccttccctcctacattttcaagtcttcttggttcagaagaatggcctacattagcctgcccgtaaaaagtgaagcctttatttcacaacaatactaataagtaaaagcaaaatagcagcagctagatgtccagctccctttccagacacctcccagatataaacgcatgatgtgcgatacagaattgcagaggtcttggcggttctctggtccaaatttccatctataaaatttatgccaagccattgtgtccttaaacttgaattaatttgaatgtctctagcagtgtgtgtgtctgtgtggtgtgtgcggtacctgagacctcccaaagaagacaactctattttgatacctacaaatgtcacaatagaggacttttttggatacatcttttacgttgtatccaaatttgcctttttgtggccactgcccatttctcttggatccctctttggggacctaaagaacaagtccagggccacatgtcagtagatgtgaagacaagacttaggaccccttgagccttcctctctgggtctctctcctgatggtctcaaggtgtggctttaatacctctctccctggcagcttcctcccttcgtgtgttcagttgcacctgcccacctcctgttgagagatggacagccccacttgagtcccagcctgtaggggaatggaaacaaccctctccaccaccaggacccataagtgaaggcatttgggagctcacaccttcagaagctgccacaccaaactgccctgtcatccgcacagggactcccacccactgtgcatctgcttctggactccttcctggtttctcataataaagtccaggttgggaaggagcaatgttaattagttacaagttgaaagctattaccataataatgaaaagatgagtaaatgcacaatctccttctttcacagaggtatttacaaaagaaagattaataaggtaattttacctccaaatctgcaaggagctcagcagatgaagcacagagaagatgggaaggtggaggcagatgctaaggtcatcaggaaggagggagggtatccctgctctacagaaaaacactgagcgcagtgaccttaagtaactctcaaggtcatgcagcaagtggtggagctggaattgaaaccccggaacatccaaccccggccctagagctctcgctcctgaccaccctgctgcctctcaccgcactacgccttcaccttcataatcccaatattgggtagtgggtactggccccattttataaaggggaagactgaggctcagaagaataactcatttgccccagccacacagccagagaagctctaagagtctgggtccgggggcctctgccctggagctcatgctctttcctgactgtgtgttccattctagaagaaatctgtctttcctgacccacagaaagaaccatccaaggaagtcccagatgggggtacacaaaagtgatttcctcaggcagccaggtcacaatagcttctcagtacaagagcccagactttggcataaagttcaggaccaaaacgcacctagaaggaaagagggaaaccccctccctttgatgcatcttgtagaggcagggatggctgaaactaaccaggagctgagccctattcacgattgctactgctgttacctgcctggtatgtgttgtaggctggggaacacgggaatgcctggtgtggctactgcagaaaaagtcaggactctccaaactcctacagtcctccaagggcaaacgaaccttccaggaggtggaattaaataaagctgagagatgatgtcttcactaattaaaaaaaaaaaaattaaacagcctcaggattcagaaactgaaaggagagaaagccctaatcctaatattaggctggtgcaaaagtaattgcagtttttgccataaaaacagcaaaaactgcaattacttttgcaccaacctaatatttcaaaaccgtgaacacagatgttagaggcaaataaattcacagtagaatgaaaaagtccaaaaaacactaatgctccacctctcctgttgaccaaacccaaggaattccccacttcagcactccggaaccgggttttgtctgtgcttagctaggattacttgctggagaggggggtccctgtctgtccccacaacgcctgccttcacccctacctcaaccccacccccaccttttcctcagcatgtccaatctctacctatgcttcaacacttattagtaacaatgctgggattaggggactcacccactaattctacccacctccagtgcaatgtgtagaggagtcacagcagaataaacagagacaaaggaaaatacagcactacttcccggttggctgggcttgggcacccaactgcaactctgaaacctcagggaagtgagaacaggcccctcgtagtgccccagcccctcagcagtccagaccaaaggaggctggcccagcacaccaagccatgaacacacctgagggtctgcaagaacactcccgcctcgaaaccacccaggaagtggatccaggccttaccaagagcacttggatactttagagtgtctggaggtctgtgttttctcaactctctgtatcagaggtcagcaaaaggcttctgtaaaggaccagagagtaaatatttcagaatttgtgggccatacggtctctgcggcaactgctcaactctgctactacagcacaaaagacaataaaactttatttacaaaaacaggtggtaagttggacgtggtcagggtctggtccctgccacgctgtcattttctggcctctgttctagaggacaagagttctgtctgattcatccttgtttttgcctttcaacactgtgggtatttcataatcctttgcggaaggaagagaggaaatttgttttcaaaaaccagatgaacaaaggtaactactgagacctgatatgtcctaaggtatgcttggatgtcaaagctaaaagattaagtgcaaagaagttcccaacagtttaagaaaacagaatttggagtccactgagcaaggttaattactcttctgtgtcaatttttttccacacttacagcaagccacttagttgaggaaaattccagataaagcaccattattcaaaatgtacatggcatcaccataatgtccaagactgatttcatgctcctgtctggaagctgaggatggaaaggagtttgccctgaaccataaacatacactggataccatccctggaccagcaatcacacaccagtaacactcattcccctgggcaccagggagtctgtcccagcatcagtgaggggcccaaatctaaggacaaaggcaaatgcagctggagaaaaaactccttcttgaatgcttccttcagagtcagcaaagaaaaagcaacaagattatattttatgtattatgaaactgaatgagctggtcatgtaaatcacttgttgctttaaaaaaaattttgttttgctatgtattttcctcactgtgtatcctggtgtctcactgtgtatcactgccccagctggagtgcagtgcttattcacaagtgggatcatggcatactacaactttgaactcctgggcagaagtgatcctcttgctgcagactctaaagtagctgggactgcagatatgcaccactatgcccagctttatttttagattgccttcccaaaaaaggagaaaaatgcaacctggtccatattattcaattttgatgggaggaataactgtcctcaaatttgtcataaggttttgtaggatgtagggtggaggcagaagagaagaaagaaagagaaaatttaattttgtgtttaagaatttacaaaaaaaaaccccatgaattccaaagattaaattctacagctcacaatggaataaaatctgaagttagctatgaaaggttagatatttaaaaactcaatcccactcaaaaaccttaaaacaataggctaacctatttcattaaggaggaagtaaaatataattacagactaggtaggaagatggagaaaaaataccatttaagactttcaggttgcagttaaagctgtattcaaacaaaaatacatacctgacttttcctattaagttagaatgaaaatttaaaaaaatggtcaatcaacttataagtttaaaaaatacagaaatgcaggaaaatgaattaataaactgaaaagaatgtttaataaatctgaaattttctaagtgataggattgattcatataatagctggttcttttcaaaagaccataaaatacataaatctttggcaagagggaaaaacataaacatacaacattagaaattgactaggtgaattgccaaattcaattcttctttcattctgcaaatattcattgatcacctgtaaagtggcaaaaactggtgacacaacaatgaattaagcaaaatctttgctttagctccctgtaaaggagaaagataagtaattgcatttatggcgtgttatgaaacatatgcaaattttatgaaagactactatgtgaaactatgctaggaaactacatctcctagaaatgcactattttacaggaaaatataaaatcaaaactgatttgactacataaataaccgttattctaaaacttaaatatttatcaaatttgccttcaaaaactgtgcaatgacaggtggcttcgcaggctacttctgaaaagccttcagggaactgatgattctggtgcttcataaactgatctacagccaaagcaagagagagggatctcgtgcactttaagccaccagtaaaaccctactaccaagctaaagtgggacaaagcaaaggacaaaacagcttcactttgggatgttaaagctaaaattgaatacaagtctacagtcttatccagaattctgaaagtgaaaaagttctgaaacctgtttttttttgtttgtttttcataagtcatctggtggcaatggcctgtgctgtccacactcccctctcttccacataaccctcattgggtacacctatgacagaggcatacaggaacgtaaaatctccagcttccttgttccaatagagacagccctaaagagtcacctatactatttccagaactcccttgtgcaactgagctagagtcaccttctgtgggactctgcgtgatatcatacccttgttggtctccttctcttccatctgtttttcctgagaacacttctgaatcaaccattctcacatgaacccttgtctgggggtctgctgctgggaaacccatcgtaagacagtaaaaaaatctgacctaaactgcttctgtggctacacctgacctgagcctatttatagcattatttatctgacttagctttgcagtcatatgtttggctgcataaatattaacatgtttgattaaggagcacttcctcagactccactggggttgttacataacattcacaatatacgtatcatattacctccctaaaatctaataaaatacgaattacaaacacatttcgcccaaagggtttcagacaagggattaaggagctgtataaaatactagtagatcaaatctagcactatattaaaggaataaaaaccatagacaattaaagttaattacaacaatggtttaatatttagaaatttagtcatacaatttgtaaaaataataggtcaattgagtaaaaccacatgacaatctcaacattcgttcctgatataaaaataacctagaaatagcatgcgagttcctcaaaatgattaagaatatttatctgaaaaaacagtcatcatacttaataaaatttcaggagcattataattaaatcagaaaaaaggatatctgctatgattatttaacttcattctagaatttatagcacaagcaaagcaataaaaataaaagagctataagcatttaaaaagagaaaacagaagtatcattatgtgtagatgacattattgtctaccttcaaacccaagagcataactgaaaactgttggaaatgataaaagatttttagtataggagccagatataaaatatgtgcctaaaaccacatctatttatacgagcaatagccaattagaaaatataacggaaacatttaacccatatacaaaagaaatacagataaataaaaaataaacaagaaatatgcaagacctaaaaaaagaaaactcttaaactccactgaagggcataacacaagcgatttgagtaaatgccaggaggtatgttgtacttagataagagaaatcaacactgtgaaaatgcctgagatctctaacttaatctataaatccaacgcagagccaaccaaagttcaaacaagatttgaggggagcacctgacaaaattactctaaagtttttctgggagaataaaaatgcaaaaatgcctgggaaacttttgagattttagagtactggggaaataatcctctccaatatgaaaacatatcatagctacagtagtaaacaagatagcatcactgtatggatagacataaatgaaagctaattagaccccaaaatacatattattctggttgcatgtcctgtaagtagaaaacacatgaattattcagtaagaggtattaggacaactagctatcttcttgaaataaaatgataaaaaaaaaaccacaaaatctctatctcactccttacaccaaaataagggcctgatatggtaaagatttaaatttataaaaggaagagaggaaaggaagaagggagggaaggaaagaaaaccataaaagcaccagaaaaaaaagaaagtatattttatgagagtgaggaaggcctttctgatgatgccatgaagatgaaaaatcagtaacatactgataaatttcatcacataaaaatttaaaaacaaataaaaaacttattgtgaccaaaaataaaaacccaaaatcaagtaaaaagaaaaccaccacctgagaaaaaaactactgcaacataaatgataaagaaagaactaatagttctggtgtccaaagaccatttacaaataaaaaagaagaaaaccaggccgggtgcactggctcacacctgtaatcccagcacttcagtaggctaaggtgggcagatcacctgagctcaagagttctagaccagcctgggcagtatgacaaaaccctatctctacaaaaaacacaaaaattagccagctgcagtggcatgcgcctgtagacccagctactcaggaggctgaggcaggagaattgtttgagcctgggaggcagaggttgcaatgagccgagatagtaccgttgcactccagcctgggcaacagagcaagacctggtctcaaaaaaaaaggaataaagaagaagaaagaaggaagaaagagaagaagaaaaccacctaaaagaaaaatgtgcagagtataagcaactaaagcacaggaaggaaaatgaatgccaaacactaaataacacttgaaaatattttcttacctcactaataactgaatgctaatcaaaaaatgttttcatctatgcagtaagaagataaaaaagactgatgaaaaccagtgctgggaatggaagataaaaactacaactcttttagatagctgtttgtcaatatttagaattatgactatcaatcataaaatacctaaaagatatataactcacacagccaatatggttgccaacagagcagaactggggaggaaggacaaaattattcactatatatacttataaaacaataaatatttttaaaatacacgaaattataacagccaatacttactagctgcttggcatatgccagactccgtgttataaggcactttacctgcacatacccgcaccccctcacaacccattgttctactttccccagaatgacagagctccctcgctgtccttggtcctgaaagatgggaatacctgctaacacttcctcctcttgtcagaagaggaccaaagaggaagcgccggtttgtctcttctttccttgccaacccttccagaagaagcattgtgaataaaattgttgagagctagacctgcctgaggccatgtctgggtagccatggctgattttcctttgcttcaaaagctgtgtctccctgtgcccactcatgattcctgaggatacagtgggaattccctgcttcctgcttccactccattcctcattcaaagactgtctgttgggaaataattcgaacctggaacatttagcattcttttgcccagtgtttcccaaattgtggcaccccgaccagcagcatctgcatcacctgggagcgtgtgagaaatcaaattcttggatccaccccagacctactaaatcagaaactccatgcatagagcccagcaatctgtggtttaacaagccctgcatgtgattctaatatagctaaagtttgagaccgtctccaatcacttaccagtgaagaaaactaagactcggagagcttaaatgacttgcttcagacctgcagctagaatgtgccagggctgggatctgaactcagatctttctgtttggcaaaccatggtcatacacactgtgctatagtactttttaatgtattgcttgtgtggtataaattcagggaatacaaattttcttttaaaactacaaataatgttcttaaatgttgttataattagctttagcattggctttttaaaatttatgaaggtgacaacagagcagaaaattatgctaatcttatctcctttcatttaactccatctacatcacaggactcctgtgtgtggacaacagggacaagtccgccctgtctccccaaagccagcaacattgagttgtaggaaagtacctataagagccttgccagccttgggtgatggccataacgtgccacctacttcccttagatcatcgtacaagggctacctcttccaagaatcattttcggctggaaagtaaacctatccaacctatggtgagcaaatgtggtgtttactgtcatgccaaatattcttgttgtcatgccaacaagtgttggcaagctgcagtccacaggccaaatatggcccactagctttttttgtaaataaagttttattggaacatagctaagcttatttgtttatgtattatcaatggctgctttcatgctacactgggaaaattgagtacatgaggcagaaatatgtcccacaaggcctaaaatatttacaacctgtcactttacagataatgtttactgacccttggtctaaatggttgtcactcaaatcgaaagagaacagatttttgcatgcctgaactcaagttctaggactgacatgtaccagaatctgatgttcagaaagttctttaccctccctgagcctcaatttccccatttgtacaatagctgctccactgaactgtggtgatggttagatggaacaagacatgttaaaggcctggtgcacagcaggtgctcattacgggctattttcctcccttcacctacttaggtacagagattcctaaagaccagtggtgtcatagctccagcacatagtaggtacattgtttattcagggccaattccctttgtaaattcagaatgcagaggctctgcaaagcctgtaggctgcaatttaaaatgtctcatcgtccagtgatccaggcgataatttactaaccaggcagcacacttagacactatcatctcccaaagccaaacttgtcctgcccagagccaacagtcagctctggcttgaaaatgaaaaatgggctcctggggatagcagatcccggctgcaggagggaaagagaaaggggcaaaacggcaaaactctgttcccacagatctctgcctcaggaagagtccccccttggtgaccttagaatctttcacaagcagaggttttataactctcagctgcctcagaacagagagctcaatctgtctctcttcttggtcaagcacaagagcagccacacaaggaaagttgccttggacctgggtagtgagaagggcattcttccacccaccctcccacccgccatctctcctcccacccaccatctctcctcccacccaccatctctcctcccacctgccatctttccaatatttcctctatcccaagcgctaatggtttatgccactctctccttccaatttgagcttctggcatctcagatcatctcaactgtggttttgtgccacatctttgctattctcctcctattttgcctgtactccaaccatgttaccatccatatgtagaatcatcaattttcagtgccaagtatcctattgcccggtgtactgggcaatagcccatggtcacatgtggcccatctgaatcacagaaaggatacagacaacctgtaagcactggatgagataaacacattgtgcctctggcttccaggactctggtcttaatgaaaaggaagccttcttttgccaaagcgaggtgcaccagatgccaggaacctggtcccctgcaagttgaagtgctgattgcaaatacactgtatctggcaggggtgtgagaggctagcaaacgacgccctccctcagccctcagggaggcattgggaacatcctttgatgggttaattgtactgattaatttcagtacaaaaggtagaaaagtgaagagctccatatcctgagaaaaaaagaaagacaaaaagacaagagggtgaggaattagggcaagaaggaaagaaaaaaaaataagcaatagttagtattaacagattttattgtgtgctagatataagctaaataatttgtctgaattatcctgttcaatcctcataatctttgaggaagatttgaatgttgaccctgttttacaaatgaagaaatcaggtctcagagagcagaactcattttcctaaggttacacagcctacatgcagccaaccccgccttgagcctttctgcctctgagcttcacaatcctaacccgcttcattcctttgcacggaagtaggttaaagttcaaggacaggccaggaaacaggcacagagaccccaggccacagacttgcaaaattatccagtccagccttcctatttaacaaatgggtaaactgaggtctgaggcaagaatatgaccttttgagggtcacccagtgagtcatcagcctgaatactgtgaagaagatgattttttaataaagtgctttcacatcacaaggctgggaagtgggtaagaattctcagattcagcgcttctttctccttcctctgtctgcttatcccaccacagagaacagctgatatgcccaagtctggtctcttgtgatgctggcctaagggagtcccagggctcgttcaatggacagacacccaggagaagtgtctgcgagatggcatcattgtggttcaagtggtccaaggcagatggagcaggaccctggagagcagcaacaatccagccgccagcctgagaaaatgattaggctgaatttggagcacctgccagccttgggtcctggcaggagaccagaaaacaaatccaggaagcccagcagaagggcaaatccacaggtgggcaggggctgggagaagacagaaggcaagtctgaccagagggcagttgaccaggagtggccacctgcatacatggggcttagggcagcctggaaggctggtggtgatagtgtccgccagggagactggccagggaaggttacagtttccccctctccaggaagacttgcacagtggagagtgggctgcaaagctactaatcctttccaatgtgtcactcctgctgcgatcagtacattttaaggtcctcagaaacaaacttcataacgtactgaaaaggggactgaaagaggaacatttccctcttttcagaattgccaacacagatggcatggattcaagtccggcctcagcacctccctgccgcatgcccttgttactgaggcagccccttcaagcctgtgccactccacctgtaaaacggggacactgatagcacctacctcaaagcactgtcaggaggattaaatgcaccaaggtgtgtaagacgctcagcacagggttcttctcatcctaagtagtagacagccagtgtagtgcacggtgcagacaactcaataaaatattattgaacagattaaaactttcacacagaattcatttaacttgttaaagcaaggaagtgtgcagctgcagtgtaaaggctttttgcttttaactactcaaaatcaaattggtattccactctcctatccctgcactcaacgctaaggttatttggcaggtctggcatatgactacttaagatggggtaacagcctctaattaagccttaaaatgtcactgtaagacgggcaggcaggaaggaacatctcctcaggaaaacatttctgggccaggcttgggccaaagagctgtcaatcaagagattattatgtttcagagttttacacccaaacaaatgttgagatccaggagggaggatccttgaggataatttcttttagaaacagagcacccaagtccaaagggtagaggatttggcccagatcccctgagttagtagcattccttccataatacctcttctccctaaaattcctcccttcagttaatttcattagagctaactggtactgacacagcctccatgggcggatcagatacaataacccaatctttatttgtttattgagcaactactttgtgccaggcattggggcaaagcaccaagcaagacggacaagaactctaaactctaacttttttctttttctttttttcattttttttttttttttgagtcacagtctcgctctgtcacctaggctggagtccagcagtgttatctcagctcactcttatctcaacctcctgggctcaagtgatcctcctacctcagcctcccaagtagctaggactacaaggcatgcaccaccatgtccagctaatttttctattttttttttttttgtaaagacagggtctcactatgttgcccaggctggtctcaaactcccgggctcaatcaatcctcctgcctcagccccccaatgtgccagaattacaggtgtgagccaccacacctggacaatccctacccttttgagtttataatctcctgggagaagaaggacacgcataagaatacaaataatgattccaaacagcaattacagatgacaaaggtgaaaagggatgaaaggaggcaggggaaccgaatttagattccatagctaagaaatgtctactgagccaaaacttggaaactcacaaggactaagtcatgcagagttcaggaatgggcattccaaagagatggaagagtgaatgcaaaggccaagaaatgggctaacacaggggagggataagaggtgagtaggggtagaatcatgcagcatctcgcaggccacactaagattttattgcaagtgcaaaaggaagccagatgcagcagagagccatgagggtaacatgttctgtcttatgaattaagacaatcactgtagttggcaacgaaggcggccagcagtggtgggaactcagagagaggcactcagggacccagactaatgcagctgttacatcagtcccatccaaggcctaaaaaggctactgaggccaggcgcggtggctcgcacctgtaatcccagcactttgggaggctgaggcaggcggatcatgaggtcagatcgagaccatcctggctaacaccgtgaaaccctgtctctactaaaaatagaaaaaattagctgggtgtggtggagcgcgcctgtagtcccagctactaggggaggctgaggcaggagaatggcgtgaacccgggaggcggagcttgcagtgagcctgggtaacagagcgagtctctgtctcaaaaaaaaaaaaaatggttactgaaagcttccccgtgggctaagatggcttggacagcgggactgaggtcgggctgtggtgggggcatgcagttctccagtggcttcgcctcatctcaccaggaatctccctggacccaaggaaccagccatcccaacaccagcatcctgcacagttccgagactggccctagagacaccctgggtttcaatgaacacttgttcaactaaaatgaactcagtaggcaatccctcgagagatacaagctctgctattgatgaaggctcacagtgagacaaggataatgggttcaaatcttgttagcaaagtcagagaactgagaaatttctgagctccaaagaataatttcccttctgctttcaatatttttgcagggtgagaatctttcatagggcggccaggaataattcttcggcaattattcagcatctcttggactggttttgcttattttcatcaagttaaagatcattcacgccagtttcttttcaataccgccctcccttcccctccctcctccctcttcccctcagatctatgcctcataatctgttttccccgattcgccctctgcctttctcccccatcctcctccatgcctgatgcttctcatgtttcatctttcctgagaacccacagtgctgcgcttgagctcagcaactcccaacttttttatttgacgtcccagtgtgtctccagtcatctccaggggagttttgaaattcattttcattcactttaatttaaaaaagaaatataggccatttagttcttttaagagggggaaatggggtgtcactcaaccagcagggaggtgaatcctgacttcagctattagcttattgggcaaagtggctctcttccaagtgttcttggttcttgggtcgcttaagcaagtaaagtgttttgctaatgtctgagagacattcactcttggggggcaggaaaataaagttcagggagaaaagagacatgagaaaattaatgttttctattaactccatttccaataaagtaggaattcaacaaaataactcatatcactcatccatttagtcattatattcaacaacttatttagtatttaacattttccaggacctagtcatgctaatcatactaatgatgatgatgatgatgatgacaccgatgacaatgatgataacagcagctaacattttattcagcttactcactctgtgccaggtagagctctgcaataattacctcaattaatccccacagaactccataaaataggggttcttttgtccctactgcagaacagaggctgagaaaagttaaacaaattacccaaagtcacaccaatgtaagtggaatttgaactcaggactctctcatcaccaccatgacacactgcagccttgtctcagggttacaaaggcaaatgaggtacagccgtgcctcaaggatctcaccttagcagtgggcaaaacaggcaggtaatcaactgcatggatcatttggaaaagccatagaaaagaacatgggagtacaaaggtggggtctctgctcagcctggaagcagagaatgcataaagatccacttccagaaggaggtaaagaactcctgggagttggctgggcagagggggtggggtccaggagaaaagggcttccagagagatgaaaaagagaggaaggggtcgctcaggaggatggaccatgcctgagaaatgcagatatatggaagaggctggtgccaggggttggtggatagacagtccacgagccctggctggggagactgtcaggggtccagtggttattaagtccctttctggcaggctaactatgggtcctagggagccagggaagggggtgcacaacagggtggcacaaccagtcatggaatcttagacatggccccatggcaacccggatttggcaatatagagagaggttcagggggcccacctagaaagatgtttgatagacatctaagcaagcatgagcagatgtgggcttggccccaggcagtgggccaagggggtgggaaacagcagatatttgagagaggctaaggggagagaaatgatcgctgttggtggccctcatagagaagtctaagaatattggccattatttttctaaattctcctggggaaaaaatgtttctgcttttatttttctggcgatagtgaatttctaatgtatttttgccatctgctccacaacagagaggcaaataggattaacaaagtttatgacatggagagaagccctgtcctgtccttgggcctgtggggggagagaggtggctgaccaacagcagtcttcctgcaagtgaccctcacgaagacacctgctcgcctctgcccagccaccctccatcacaggtaacacatctgccctgctcttccccacaacacccttggcctgactcccaagagcagcaggggtgtcagatgaagcggtcaacacagataacctgacagctaaacaagagaacgaaatgaatattcagcagctggttctgcttcagaggctgttaccctgttctccatctctccttcaatcccaggaacagaagaaaagaacaccaatcacctctcagccccaccattctagatccaggtccatggtggtagagcagattgtggagattaacattcaaattcaaacagtcgcagcattctgtcagtgcttttaataagaaaaagtgtatatcctttggataaagcagacccaatttatatatctaatgtatgatctcttgaattcataaaaggccatgtaaaacatacatacatacatacatacatacatgcatacatacgtagacacacttactttgaaagctcaaaacacaaagccatctctctacttcaacatctgaaaaatactatcttgccaatgtatttcccaagaagaagacagtaaaaaggagtataaacaagaggaaaaaaagtataaaacctgattatcatcttcaatccaaacatctcagacacaggtagacccaaggctttggagaatccattccttgcatacaactcaattcctgctgagcctatgtgaccagacagacaagtgcagactggctttgtgtttaaaccctaaatgataccattaacatgaggctttcagttctcctgcccaagtatttcccggggaaatcactccgacaaataagctttcctgggggcaactggcatcctctttcagctctaaatatgctttagttaacagcatgaggcctgttcatccctgccctgctcatatatcctaaatgagataggagctagaagacctaggctcaaggacctgctgtgtcacaatttgactatagaaattagactaattatgggatctccctgagccagtggctatcagtaagaacaattgctaatatttcctgagctgctggggtactatcaactttatgttaagcattttacatggattatttcagccaatccttccagtgttttatggtgcccatttcaaagggaaggaagtggaggctgtcagtgggagtgctgggtggctgaccacaagcatcctcaacatggtctctgagctccagggcaccacacaggttaccaaggaagggaacatgcagcttgtagcaaggctggttcattcagcactcactatggtgcaggcactgcattgaccctgttggaaaacagggagagacaagagcatgggcactgcctggaaggagggctgtggcattgggacacacgactggtggtgatggtattgggctagttcacttggtttaggcagaatttcagctggacaagaagacgggaagggagctccagggagagggcactgcaaggacaaaggtctggccagcttagctactaaaggcccggattggtgctgagcaaggccacggccacccaggcagggcgttcacaggccatctaccaccagctctccctcatacggcgtctctgctcattgacagacccagccctgggccagtggctttctgctcataccacaaggtccaaatccgttacaggaaaccagtaatggcctaacctttgacactgggtaaacataagctctgatcctgggtctacctcttcacagatgaataattttgggcaggccacttcacttctctgagcctcatctgaaacatgggaatcatgtgactattataacccaaatgttggtgtgcatagcaaactttccattcacccctttcctgataacagaacctccctctctggtgggaaactcatcccatgggatacagatgggcctgatctctgtcctccattcccactggaaggagcacaggcctcaagcttgaccaatcaaagcatatcccatctcctgggtgcactgataggttctaagatgagaaagtgacccaacctccctcaatctgaatcctcccaaggcagttttttgaagctatcagaagaaagtggctctattctctggaatgacaaattgtacaagtgacacaaatctagagcatctgaatatatagaacattctagagaatgagctcaatagagagaaagcaaagtataatagaaccaagatatggagaggtggagagaggctgaaagcatgtttgcatgttctagcgaaagtctttgagttcttggatcaagctatacctgaaatctggaccactccttagacttcctacatatatgtgccaataatattgcccttcttttgctaactccagtttgaattgggtctcttgccacaaaggtcctgtctaaagcctggtaagtaagttagctacaaagattaaataagtcccagttaagtaaaactgaattgaatgcattctgtgcatttcaatcaatgctctttcccttcccttagttctaggtctcttgtcctaggcagatgtgaatctgtaataactacagaatatttgtagaaacttactgccataaaatgttcttaaacaaatctaaatcattcagttataagagtaagacacaaacatttggccaaatcatctatttaaaactctgctccaatccacccatttcaggaagctgccccagattttggtcacttatggtccttccagccacactctgtaactgtaaaaaaaaaaaaaaaaaaaaaaaatctacattattctatattattttataaatcaaattcctgtgtttcaaatgcaacttattgaaccgcagctgtatctctctaggaaaaaaatctcatcaaagacaatattttactcaaaaattcagcaagctttaaacaactaaaccgttaaaggaaaaaactatatagcgaggtagataagtaaaatcctatttcactaataacttttttcaccaaattgaaactatatgcctccaagggaaccaaaatgaaaacaattatcaaaaaaaattacttgaaaatgtagcaaattttaaaaagctaaacttttaaaggtaattttgattttatattttaaagaataaatgtgaatgaatgaaaaattcctggaactacttttgatacttgaactaatggtctcacggaaacaaaataataaaagatgagttggacacagcacatgtaatagaagaatcctgggctctcgtcatgggattcccaatgtccctgaagacagcccaggctttggcagcccagcttcccatactggcatgaggtaaaagcgattgcctttatagtggtagacttggcaggaaacacagcaacacaacaggggtaatgattcaaaattcagcataaatgaacaaagaaacatgtttactgaacccacctggctattgtgtaaaacaaaatatcacgtgctatctataataagccagttctctggactacaaaagcagttcacttactcaacagatgtttattggctatttggtgtgtgccatgtaccatgcaagggttgggaacacagcaaaaagctaggtgtggcccctgccctcagggagctttcaatcttgtttgtgcaacaaaaagtgtgcaaataattgcacaattctgaacttcaatgggtgtgtttacatttgaatctacaagtttattaatgctttgtgaaaaacttcatataggatgaggtcattctatttcccttttaaaaaaataggtttattaagatataattcagataccatatgattcaccagcttaaaatgtagaactcagtagtttctggcgtaatcacagatctatgcaaccattgccacagccaattatagagcattttcatcaccacaaaaagaaaccatatcctttactaagcatccttcaatctccccaaatgctcccagctttaagtaatcactaacacactttctatctccacagatttgtctcttctggcatttctttgctaagttcaacatagaattaccagataacctggcagttacattcttaggtatagaccccaaagatgtgaaaatgtaaagatgttcaaacaaaacactgtacctgaaacgttcatagcagcactgttcacaataggcaaaggtggatatggcatatccatatgatggaatatgcctcagacataaaaaaaaaaaggagtgaagtactaacacaggctacaacacgggtgagccttgaaaatatgctaattgaaagaaactagccccaaaacacgtatgacttaattccatttatatgtattcccttggcctgaaagttctcttcttgtgttccttctctctcttccccatcactcacccatcctctgtgatctcacatccaccccctccactctgtccccagatccactgttctggatgccagcatcagtgctcatatctggatcatggcggctgactcctctttggtcccttgcccctgggctttcccctccaacctaccccatgcaccagctacccgggtggtttctctaaacacaaatctggcagagctgattacaacccatgagtggcagctccatccaccatcatccactgaattaaagcaatccccatcacacacaaactcccaggtaccagcacccatcattcatataacagacatggagccatccagcatgatgaagttccctggatcctgcactcttcactacccacttctgttcctgcctctgtttgtgctccgcctggattcctgcctttgtctttcctacctagaaatactgctctgtcttccagacagttcactccttctccaatactgagctggccaccaccctggcgattgctctccacagtgtttgaggactgtttaattaactactgctaaaaaccaggagctgtatctgctcaccgctataaccccatgaactagcaccaagcctgccttgcacattttcccaatgaaaatgagggagaaaggaacagaagaaatggaggaagaagttaatacatatttctaagaaattaatacatatttctcaataacttaggcacctatttatcaaccaacaaataactattgtctcagatattgaaaacatcttggcctccttaagctttttttcctcagactcgcctagtctcataagggacaaaatcaaactccagagttgaaaacaatagcaacaatagagaaaccacaagaagcctcagctcaagtcccaaaccagggtaagaataggaagtcctgccttcctggagtcttgttcattttagaagcttcacctccaatctacttgagaaacaaaatagggactggtagagaagagttaatagaagcatcaaaatggagacattacaaaggttttaggaccttgatcttaaaaccttggttcccagccaggcacaatggctcacacctgtaatcccagcactttcggaggctgaggtgggcagatggcttgaatccaggagttcaagaccagcctgggcaacacggcgaaacttcgtctctacaaaaaatacaaaaattagccaggcatggtggcatctgcatatagtcccaggtacttgggaggctgaggttggaggatggtttgagcccagaacgtcaaggcggcagtgggccaagattgtaccactatacttcagtctgtacaacagagtgaaaccctgtctccaaaaaaagaaggggaaaaaaaaaaaaaaaaacaaccttggtccctgatctctacctcccaaatctgagcttttaggctttttccttcatttctattttctggaatcctgaacacactgatcttttctttctgatctcttgtttggagaagctcttgtggactctgtagtccctgacagcacctcttttcaggtaagacacataaaggcaaaatcatagataatccatttgcctccagtgggggtggggggagcagcaaagacagcaggaaggtttacagatttttctaaagacccatctagttctaactctctatgatacttggtagaggacaaaatagcatgaaataatagcaatatgcgtgagcccaatcaaagaatttattttcaaagataaaaatgcaaaggtgttgttcatgatgattgaaagcaaaaaataataaatagtgacatttgagattggtcttgatcactcctgatttctaaaatctccccatcaccctaccattacaatttcccactaattactacaagcaattttattaatatacttttcagcctcattaaatattaccttgggcctaacattaaaaatgatgaggctcagtaatcttaatgagcatccaagttgcaccgacccctgaaaacccagaaaacagagaactaaattcattgctgaactactctggtccccaggcatgcaggaatcaacttcagaaacatgaaagaaatgatacgtacaacccagaatgaagcctgattggaagcacataagtttagcttggcctccttcagttcctgtcaactaagggggcaggaaaacgtcgaggaaacatctgggctttatcttctcctcccctttcaccctggttataaacagcatccatcagcatgctgttcaccaatattaagtctttcctgggactctgacaggtagagcttctagtgattgtgggctgggccaagacaaagcaaactggaaatgaggtatccactgctctagcaaacagaaatctgtggctttctctgaaacggtagtggaagcacaaagaatagacagttgagggaattaggaagataaattttatttgttttcttcctagcatgaccagaattgtctgcattcctcaaacagcaagctaggcaagacagtgagaccagcttcctggttctcaaagtaaattatttatcaggagctgaatttactgctttcctgactaaactgtcaaaaccctgccatttacaatagcagttgtactgtgtgatccccaagatgcttaggtttcccctagcttctaggttaaaaatgaatgggtaacagtaaaccaggggatcagctgaagagaccagcccagacttactgaatccacctttggccaagatctgagagagttctccatgtgtccgaaaccagtaaacttagcacaatgtaaaactattatattagacagaaatctttggaattatctaatttaaaccactaattacctaaaagaaaactgaagtccacagagaggaaatgatttgtcttggatgaacaagaagagtcaaatccaaaacctgaactcttgggtcccattcattatactaccatggatattgtcaacctgaaatgggggctgtaatgggaatggaggcagagacaaccatccaccaaagaattgtggtgtccctctttcatggcacagtgctggctctgggacgtggctacctaccaggaactacatcttcgcatccttccacccactctcatcccactaccttgcagctgagtccagccacaggaatgcatcctagccaatgaaatgggtatgaaagtgctgtatgatgccacttctgggcgtgacccatgcaaacctcaaatccagagcttctccttgccttgccctatctaatggctgggtacagggaagtttaagatcataggagatagtgaacctagatcttcaaatcacctgagggaacaaagtcttttaagatgaggcatacacacacggtctgttgctgaagcaagatataaaattttattgcgtgaatctattaaaatttttctgggggggtgttattcattacagcacctgctattaacctaacaaataccaggaacaactttatagtggaaaagatctcagacacattgagcccaaagcaaaactgaaagcccataaaaagaaccttgttataacagtgggaaaacattaacaaatcaaataataaaaatgataatttatcaatttgccaacttgctcagcagactcaaacggattaattgttccaggtttctgagggggaacaaaacccaagtaaaggctagtcttgaaaacaaagtatttttgcaaaggaaatttttcctcaagcgtccttattcctgcttccttttatcttaaaagtgatggcaaatgaactatcgatgcatgcaacaaccttgatgaatctccagggcattgtgctgagggaaaaaaggccaatctcaagggcctttctactgtctgattctacttatataacattcttgacatgacaaaattgtagtgatagaaaacagatcagtagttgccaggggcttgggtggggaagagtgtgtctcttaaacagtaacacaggagagtttctttgtggtcatgggtcagttctgcctcctgactgtggggatagtcacttgaatctacacacatgatgaaagttcatgggggttgggagggtggggaatgaaggaaggaggaagggggggaaggggaggggaggggggaaggaatggaggaggaggggggaaggggagaaggaggggaggggagaaaggaaggaagggcagggaggtagggaaggaagggaaggaaaggaggaaaagaaggaaggagggaaggaggggaggggaagagaggggaggaaggaaaaggagggttgaaaggaaaggaaaaaggaaaagggaatgaaagggaagaaaaaaactaaaaaagaaagtgcatgtgaaaactagtgaagtccaaataaggtagatctctaagttaacaatttcctggttttgacaatattactatgattatgtaaaatattacctttagagaaagctgggtgaatggtacaaggaactctgtactatgtttgcaacttcttgtacatctgaaagtatttcaaaataaaaacttagaattctttaaagtgatggcaaaggccctggaccaccaggttctgagttgggaaatatgccttgtacttccagattgggcaacatgaatatgataactgcagagagttcaggggctactcacaggacctttgccattagtcacatgattatttgtttattctttgtcttccttctagactataaatgcctggaggtcaggagccaagtcagttttgttcccccactcaatgcctaacccagtgcttagtacatagaaagcacccagtatatatgtgtgagatgaacaaaaaaacaagaaggggaacaggcaaggaaggaagtatcactcacgctttacagaggcagtggtgtgcagaggtttccatgccttgcccttgtgcacacagctggagagaagcaggacaggtacaaaaaccatcagggcttccagagtgcccagtgaccttttcttagtgccatatgcctctcaacttagatccctggtagttgctttatcttacataataaaaaaagtaagaggggaggaaaaaaagagcagacacagagagagaaatgagacagagagacaaagagatatgaggaaagtagtgagagagatcgggtgaaagagggcaagaaagagggaggaagagaaagtgagtggggagagagaacaatgaagagagagagggaaggagagaagagagaaagagagccagagaaagaaagaaggagagaggaagagagagagagaaaagaggatggaaggaaaggagagagggaaggcaagagaaaatctgccccaacatggaaaatgacattgaacaaatggattccaaattttaacacggccccacaccataggcccaggcctctgtaactgctctaattgctcagaaatggtattgtaatgtgaacaatatgtcattaagcaataaacgcttcatgcaaaataacaaagtggtcatcagtgagatggaaaccaggaataaccaagggaaattgtgctccacatctctccatgctccaattatcagactgatcagtggctccttttgtctgttcagaaggtgctgcagttttcagtacaacataatataatgtgaaatgcaatacaccaagactaagaaaaccttatttttttttcagtcttacagagagagcaacagattcaaatttgaattcaggctctgctatcttctttgcagccactgcggcccaagctgcactggggcccactggagaccacctcgggtgaccaatgagtatagcatcagagtgtggggagcagagtcttcaatgtgaggtggcgccaggtagggcatgtcaaggtcctgcagccactgggagctcttcctttgaaaccagtctgcaccctgcacctagcccttgcactctgagcctatgatggcaggggcaggtctgacgatctcagaatcaactttagggtcattcttccactgtcttggagaatagctcctggcttccgttaagactgctgattcatactaatctccttatcaaacagttgcttggacatagccttaatgttctttttttcaatatgtataggctgagaatttttcaaatctctaagttttgattcctttttgcttaacaatttcatttttgagtcatttctctcttccttgcattttactctgagcagtgaggaggagccaaggcataccttcaacattttgcttagaaagagcttcagctaaatatccaattttatcattcacaagttttaccttccacaaaacactagaacatgaagacaattcattcagctaaaagctttgccgcttgataagagattgtcttttctccattgcccaataacgtggctctcatctccaactgagacctcagcagaatggcctttaccatccgtatttctaccaacattctactcagcattacttaggtattctctcaggaggtggaggctttctcttgagctttcttcctcttctgagccctcaccagaatcacctttaaaggtctgttcaacagccaggcccagtgactcatgcctgtaatcccagcattttgggagactgaggtgggcagatcaactgatgtcaggagttcaagaccagcctggccaacatggtgaaaccctgcctctactaaaaatacaaaaattacctgggcatggtggtacacgtctataatcccagctactcaggaggctgagtcatgagaactgcttgaacccaggagggggaagttgcagtgagctgagattgtgccattgtactccagcctgggagtgcaatgtattctgagacagagtgagactttgtctaaaaaaaaaaaaatacattattttatttttgttattattatgtctgttcaaggcagtgtaggctttttctagcacgtacctcaaaactcttccagcctcattatccagttccaaagcctgttccacattttcaggtgtttggcacaggagcacccccatttctcggtaccaatttttatcttagtccatttgagctgctgtgacagaacaccatagactaagtgacttatcaacaacataaatttatttctcactgttctggagcctgggaagtccaaattcaaggctacaagaagttctgtgtctggtgaggacctgcgtcctggaacatggatggtcttcctcttgctgtttcctcacatggtgtgagggacaagggggctttctgaagtcccttttataagagcactgatttataagagctttctttcctggcctaatcatctcccaaaggccccacctccaagtaacacacatcaggggttagatgtcaataaacaaattgtatgggaacataaacattcagtctatagcagtcacttttcatctatgtgactatgagcaagttaatatttttaattcggctttattatctgcaatacaggcacaacaatacatactttgcatggttattgtgaagattgaatgaaataatttatacaaatgtggctactagcacagtgcccaccatgcatttagcactaaacaaggacctctgtgttctcttccagagagctcttcatccagaagctcaacacaaaatgttgcacactgtaggaccattcatatgacgttctacaatcaataaaatgtgcctagtaagaattagacttgtttgggaggaggagaactaaagggcacaagggtactttctggggtgacaggttgtgtattttggtaagattataggtgttacaggagtgcatgcattagccaaaactttctaacccatatatttaagatctacatactttacagtatttaaattatacctcaataaaaaatttaaaatagatagctagatatctagatagccagatctgtaggtaggtgggtaagtaggagggtgggtgagtggatgggcggataaatgaatggatggatggatggatggatggatggatggatggtcagtcagggtacctacttcagcatgaggctcacaataagcattccacaagtatttctgaagttccagaatcaaaattaattcctcttaactcctttccgtcactactctcgctcctccagaaacaatctactcaactgtagggtggcacagccagttctaaaagtgcttccttctatgtgcctgaatcctggtccctgatactccgactcaagaggccaggtggatgacatctgcccactgcctccttataacagaactcaacggtcttgagtatcaaatgtgctcggcctcatgttgagcacctttaagtccttcactgtactagtcaccttcaattcttcaaaatctccttggaccgtgagcccagatgggcctctagatgtcatcttttaagtatgtgtcctcaacgaatgggctctgggcagctctactgctatgaagtggtgtccaccatctggagctcatgcctgtggtttggtgcatagtaattgccaatatctactgagcacttactccatgtctagcactgttctagatacaacatgttttcactcctttagcctccacaataaatcaaagaagtctatgtccttcccattttacagatctgatccaacagaatttcaaggtaactctttatctcagggtcttttcagaccccattaaatcccatctgcaaatctcatctccacacctttatcccacccatcgttataatcgaattgctgtgactcaggcagaacaactcttgcctaacatacaaagcaggagttcaatttaaaacatgacagtggagttttgaaggaacaattgactgatacaacaatgggtgaagcttaaaaacattacgctgagcaaaagcagatgaacacaaaacagtacatactgcatgtttccatttctagaaaagatcaatctaatctatagtgaccaaaatcaggtcactggttgcctggggcttagggtggaaggaaggactgcaaagaggaaggagagccatttctaggtaatgaaaatgttctatgccttgatcagggtggtgattagctgggtatgcacattggtcaaaaccaaaactctgcacttaaaatgtgtacattttattggatgtgactaaagctgatatgtttatgcaaaaacaaagaaaagccttctgagccaacagctctagctttcaatctcgctttgtcttttcctggctgggtaacctagggcaagccacttaacagatctgagccttagtttcaggctgttgtcagggttggagataatacatgccaaacacctgggggaaaaccaggctttcaataaatcgcagcttctgttattactgttaattaataataatgagaaataataatctgagtaacagcttcaattctctacttcacttcgctgggagatcttgaactgctaaatgttccttactattagctctccctgaaaaccaacacacactcttttgcagcatgcaatcacgttaacgctatgctagaagaataatcaagaatgaataccaaatgtatgtagatgaaagaattcatgtttatatatgaatatgggccatgaaatcttggattaattcaaacctgaacatggttgacagttactattttctttccaaggaatcagattttctgcctaggtaactccatgggagttttctactatattgttacacagggtgtaatttctctaataaggtcattgaggggaaaagaatcctggactctctaatccctttgtattactttttcctaagagtgtctttctcaagggatatgacatggggtcagcatggcaaatttcaaatgtatagcaatctggtttgggtcgttttcaagctaaaatctgtgagctcatctctttgttttttggtcacttacctccacactcagaaaattgctttgtggaaaactgttcagctctatttaggcttataaataatttatccaaagctcaagcaaaggtgaattagaaattttcagggttcttggtggaactaagactcagtgtgaggtcacaaaagattaaacaataatggcaaatcgtatgtgaaaatgaatgaaagggactaggtagaagtggcctcaaagttgcaaacatgttagtcaacccatctttcagtaaattcctccaaccatccttcatttggggaacatccttgttccactgttagtcatccaaagagccaacttcgggatgtgagggcaatctggctgcgacatctgtcatcccattgattgccaggattgattcagctgatctggctggctaggtgggtgtccccttcctccatcaccactccatgtgatgtgcgtccctcctgaagctgcgcagtgggtcaaagaggatgaccatccccgagagagtaggaccagtcttcagtaaagggtataccaatatctgcgctcccctgatagaacctccaaacaaagagccaacttctcctgctaaatgccatgctggtggcattccagtgtgctctcggtcttagcacagatcaactcagtgtcatgagtcatctcccttttggaagaaattcctaaatgttctggcttcatagtgagtgctggagaattgagagccttctaaagacttaaggaagctccaaagaaaagaggaaacagtcattgcctagacaggaaccactgaaatacagctcctcaacccaaaaagcagctctgcaagttcccaggtgttaggctccattctgagttcacatgaaaccaagttcatcagttgatggactcaacatgagttcagaggtctcagagagtaaaaactagcttccagtcctacttggactcctcaggaaataaaatttgctaatagcatggtacgtttatgatttgactttccttatatttacccgtggactttccatgagacccaaacaacttttcttaaaaaaaaaaaagttcccttctatggcacagactactacctattcatcctacccaatttcctcttcttcttgggaacagagtgagaccacatttcccaggatcccttgcagttaattcctaaatttacaactgaattctagcagatgaaaggtagactttatatgataatggcaattcttaggcctggtccatgaaaacctcctaccccatcctccaccctctagtttcccatcaccagttgaatttcacagacctataggaagacagagccacaagatgggaaatctttagtcctgaatgactgaagagtatagtcctctgccagtcacactggagtgatggagaaaacaaatctttattatattaagacaatgaaatgttgaggttgttataagagttagcctgtcttgactcgcataccctcctctatggtcatcctctcaaaaactccattaaatgatttcaaattaaaaaacaacaacaaaagaacgttaacacctagcttatgcaagacaaatacttttagatcaaatctcacaagtcagcctgactgcttcagtcacagctgcttcaagttgtgaactgcctgtgggtgtcctcatcccctcctctcaacaaacatcaagttcaaagaagtcttctggaagtcaagagctgacaggagctggctgatgtcaaggaggaagcccacatgtctcaagccacctctggtaacacttcaattatccaccacctgcttatcatgaggttctgagtacagctttttccactgtctcccaaagaaaaggttaatggaaagtgtcaagatccaacaggccgataaatcccaacccttggttgagaaaacagagcttatttctagacttagtcatgattctggatgctagcttatattaccctgacccctcctgtctttacatttgccctttcctctgttgtggacatggcttgccctcatcggtgatgatgatccttctatccatggtcaaaacttcctctcttccaacccacactcttaaagggtcatgctctaaactgaaggaaactccaaaagaagaaaccatctccttcccctttgcatctcctgccccaagcacacaagaggtgcactcatcagcacaggataactgctacagcaaaaatcttgatattttggtggcttaaaacaatgaacgttttctctgcgttcatgccacagtccaatatagattcacagatctaggatcctataattccaccaaactctgtggcatcagagtcttccgtagtcaagggaggagaatgcaaatcacatgtagtaaggatttacaagagccaggcctgaaagtggtatttgtacataactttcactcacatttcactggccagaactcaaaataggcccatacctaatgacaaaagggcctagtaaagtattctcactagagcttaaaaggaaagaggaaatggattttggtgacctctccactgtatgtgacccagtgggggagggagtgtctcacagaaggcagttagccagcttgtaaggacatgacccagagatctgttggtaggaaaatgaaatttcccagaactatgcaaaggagatctgctaccttagcacaatgaatcagatgatgtacaccagccagaggttcaggtaaggtgggacctcacatgaggtgagagcaagttatctgaaaggagaggctcacatgtacatgaaagagaccaggaaaggtctaagagggaagacaaggtgatgttgcctcatagattcacgctggttgaaccaggctgacttctggtttcctacagagtcaaagagctcagagtaggcagacctctcattttacagttggggaaaaaaaggtgtccatagagttaaagcaatttgcaagttgcacatctagcaagcaagagaaccaggactggaactcctgtccctgactctatcactcccagtccaccttgtcagctctgtatatacccctatatctgcaaaagtctaggccttaaaaaaaatagctaccagccagtttattctctcagacaaaagatttccagaaaccatgtcttccaccctggtattttgctcttcccaactctctctctctctccttccaaatttacataaactatacacgtggcaggtgcctgtatgaggtacaaggacaaaggctctcacacacccaccagtctgtgtcacccagatggcttcctgctcatgcaagaaggacttggctcggttttcatccataaatgtgtcttcatttgtccccggaggcctttctgtcacctacgggagcacttctctgcaagctctgtgaattataatcttctagagggtatgttccagacaatgaacttctttccttccgtcttttaaaatgagattaacccaagaacattgcagaggctcccagtgataagcatttctcagactccctaacactggtgcaggaataagtcggtatgcttttctgaatctgagaaagcctagaaacccaggcctcatctgaagaagtacgagagacaaacagttatttctggctacattcctgtgtattccaaccgaattgcacttccccccatccacccattctcccttgttctccacacctacctcaccttaggtcacctctaccctgttccaacctgaactgtggggcatagcacggagtggtggaagggtagggaaggtggcaccatcaaggcaaactctgaattcctgggagagtggcttcatctttgttctacagcagggctcagcaaacttgatgggtcaaatctaacccaccctctcttttcgtaaatgaggttttgttggaacacagcccacagccaagctcagttgttcacatattttctctggcactttttgtgctacaatggcagagttgattaattatgacagagaccctgtggcccacaaagcctaaaatatttgctctctggccctttatagaaatgtttgctgagccctgttctgcaggaataaagaaccagttttctttcaaacaaatattcatagcagcattatttgctatagccaaaaggtggaaacagcccaaatgtgggtcaatgggtgaatgaattgtggcatagccatatgaaatattcttctgccataaaaaggaagtaccgacacatgctacagtatggatgagccttgaaaattatgctaagtgagagaagccagacacacaaaaatcacattttgtataatttaatgtatatgaaatatccagaataggtaaatccatagagacagaacgcagacgggtggttgccagggaatggggagtgggggttggagagtgactgtttaatgggtacaggatttccttttagggtaataaaaggttttggaactgtatcaaggtggtacttatagaacattgtgaatgcaccaaatgccactaaattgctcactttaagatggttattttatattatgtgaatttaacctcaatacattttttaactcaaaaaatatgtaattttttaaaagaaaggagtcagtccctggagattttggagcagaggagtgatatgatctgagatgtactttcaggcaagaaccaagtaatgcttacaggaagggaagtcctcggatgactgttgggtacctgagaagagggtggcaacaaattagaaacaaagggcaaggcacagtggctcacatctgcaatcccagcactttgggaggccaagacaggaggatcacttgagcccaggagttcaagaccagcctgggcaacagagggaaacccccatctctacataaaactttttaaaaaatagctgggtatggtggcacccacctgtagacccagctactcaagaggctgaggcaagaggaatacttgtgtcaggatttcaatgctgcagtgagctataatcatgccactgcattccagcctgggtgatgaggggaggggaggggaagggagaggaagggagggaaggaagggaggggaggaaggaaggggagggaggggaggaaggaagaggaggaagggaggggaggaagggaggggaggaagggaggggaggaaggaaggggagggaggggaggaaggaaggggagggagggaaggaaagaagggaggaagggagggaggaaggaagagagaaaaggaaggaaggagggagggaaggaaggagaggaggagagggggagattgatttttaaaacgaattaggggccaggcgcagtggctcatgcctgtaatcccagcactttgggaggccgaggcaggcggatcacgaggtcaggagatcgagactatcctggctaacacggtgaaaccccttatctactaaaaacactaaaaaattagccgggcatggtggcggggaacctgtagtcccagctactcaggaggctgaggcagaagaatggcgtgaacccgggaggcggaggttgcagtagccgagaccgcgccactgcactccagcctgggcaacagagagagactctgtctcaaaaaaaaaaaaaaaaaaaagccaattagggaaggggagctcagtttgggacacactgagtttgtatacctgtgggacaactgggggtataacaacagggagttatcagtgtgggactgagatttaagagcaagatcaaggacagagctagtgatgcaggaatcatacttagggaggcagtattgccatgagagaagaaaggagaaagaattggacatgttagaaaatcccaataactacagggcagtcggataaagcacagcctgaagtaatatcaaagaaggtataagaagagggtcagaaggaagccaggtgaaaagatagccatggaaagggtacagtcagtggcaccaaatgctccaaaagcatggaggaggagacagaggaagaaaacctgatgaaaggtcactggagttgcagggtagcagtagagctcaaaacctactacctggttctcatcttttcttctgagcagcttaggttgctggataagtgaggtcatgaataatgaggtcatgcatgcagataaatgcatgcagtctagaacccaaaggaagtgagattccaaagatgtgagctctgctctcctctgaccctcagccccaagcttggaaggacagcacagacagcatccaatacatgtttgatcccagccatggccctaggtccaaaggctgagctcccttcccaaaattcagataggatgtctctaacactagcacacccagcatatgcttgggtccctcggttaacgcgcgcatccagctgggacacttcgtagccatgccttgatgttactactactcaaggtcttccaacaccagcagctactaactggtcagtgctataaccatctccatctgcaataacaaatcttctacaatgttacattaacatcaaaatgatgacattcagagtataacagcaaattaattccttagaaacagaatgaatccaacttgccattattaccttaagtgggaatccaaaaaggctgtaataaataatataaacccattatatttattcatccctgatctatcctttataatattaaaccaaagaggtaagcaccatggaggagaaatcattatttctggtatgacaaggaagagactttgctggggaggggggcgttgcttgacaagaagcggtgaggtatcttttagcaaaggcaagtttataatgaggactgagtcggcttttttatataagagcaattcagctgtgaaatgggcttccccagaaatgaggtgggagtccctcagcttcttgggagccgtactaatgggttagtcatgtatgacagcttgcatagtggttactccagttgagaaggctttggacagccttcctgtgatttatacaatatcaattggaaaagcatcctattttgccaggaaagatgtcctggaaaaccaagcccacgggctcctataaggcaggtgcttcaagctaacttcaggtgataaatccaccagccccctaatatgcccttttagaaaacgcttttgcccaaaagtcacagacaggcagcctatgagccaaatctgacctacagatgtatttcaatggcccagaatacttcctttgtgggttatttttttttaaacatctgaatctgctcccaactctccaaactttcaagatgcagtgcatgctgctggtgcacagtccggatagtcttgaccagcaggtgaccagccccagatgctgtgggctcacagcttcctccttctccaaagaaatgcaaatcaaaaccacaatgagataccatctcacaccaattagaatggcgatcattaaaaagtcaggaaacaacaggtgctggagaggatgtggagaaacaggaacacttttacactgttggtgggactgtaaactagttcaaccattgtggaagacactgtggtgattcctcagggatctagaactagaaataccatttgacccagccatcccattattgagtatatacccaaaggattacaaatcatgctgctataaaaacacatgcacatgtatgtttattgtggcactattcacaatagcaaagacttggaaccaatccaaatgtccatcaatgatagactggattaagaaaatgtggcacatatacaccatggaatactatgcagccataaaagaggatgagttcatgtcctttgtagggacatggatgaagctggaaaccatcattctcggcaaactctcgcaaggataaaaaaccaaacactgcatgttctcactcataggtgggaattgaacaatgaaaacacttggactcaggaaggggaacatcacacactggggcctgttgtggggtggggggaaggaaagcattaggagatacacctaatgtaaatgacgagttaatgggtgcagcacaccaacatggcacatgtatacatatgtaacaaacctgcacattgtgcacatgtaccctagaacttaaagtataattaaaaaaaaaaaaaaaaaaagaactgccctcaaccaaaccagggccacttacctctaccacagagcagtggccaatgactgaccaacacaagggtatggtgatgacaaaggcaaggcaaggagggaccaaatctggtgcagtttgcagtccggggttccttgaggcatcaggctgaagctggacaccagccaaggccacatccttgcggagctcctatccctggctgtcttgcctccttctctactttctccttagagcagggttctcaaaatgtcgtccctacactaacaacattagtatcacctggggctcgttagatatgcaaatctcaagccccactccaggctttctggattggaaactctggggatggggcccagccatttgtggttgaacaagctctccaggtgcttctcatggatgctcgagtttgagaactgcagcctcagagtgcagcctcaattaaactgcatttacatgggcccccagctccagttctgcttcagggaacccagttcaagacaggaaagttcaggccaggcgcggtggctcatgcctgtaatcccagcactttgagggggccgatgcaggtggatgacatgaggttgggagttcgagaccggcctgaccaacatggagaaaccccgtctctactaaaaatacaaaattagctgggcgtggtggcacatgcctgtaatcccagctactcgggaggctgagtcaggagaatcgcttgaacccaggaggtggagattgcagtgagccaagatcgtgccattgcactccagcctgggcaacaagagcaaaactccatctcaaataaaacaaacaaaagacaggaaagttcacattttcaaaagaatctgctctgtccagcacctcttgaaaacggcttctttcccacagggaggcaatgcacttggcctggaagagctgctgccccacttaaacagtcagtcaccattgttttccattggtttgcacccagcctatctcaggcatactgcctggtctatgtgggccattctagacatatgatctagctctctagactgtgagcctcttgaaatcagcacttgcctttctcatatttgtatcctcacagcctggcacatggcactcatcaatgtctaccgagtcaaaccaaactgcaccaaccctgtctcttgaaagtggccaacacttctgagactcgaaggcaaaattaatgcaattaagaagccaagaaacaatccctgcaacaaattaatataatggccttatagacatcatagtcatgcattggctataatagtgcaaagatgtaatatgcaagagaaattggttgctggttcacctgatagccatcctaaggcctgaagcctgcagattaataacccttgtaattttatcccagtccatgtaattgcaagtgccatctttacttatttaacatctaattcctcaaagtaggtttgcaggcctctaacacttggttcaaatattctcattgtcttcttagctcagagagacattctttattaaagaatcaagctgaatgtgaaataaacacaaaataaaatctggctgcaaaccttagctctggaaaaaagaaaaaaaaactcatttccaacccagtgctagctgcttgcaaattacccatgtagaaaattgcccaaacttttctacccaaactgcatttgtttctgattttaaactaagttccgttcctaatttttcttcctttctccaaagcttctatctttagaaaatatggagcccaagttctataatttgcacttcatttgaacactaatgaaaagaaatgctcttccccttcaaactatttcctcagtcaattaaacaaatcctctaagtggagtgtgtgaagtgatttgtgtccaagaacttaattagtacttaattctggaatttgtatcttcttaagctcacatccttttaagtttccaccaagctcaaaaactggtccaggtgtggtcctttaccataagatcaaggcagaagctgatttgaagaagtcaggaggaataaaagaccatctgtgtgctcaaaaagacttccaagcagccttatggccaccaactaaagtcccttgcaagtccacaaaagagacagggtcaaagaggacttgcttacactgcaaaatactagctctcttatcataaggggaccacacgctcatgaaggaaaaaatacaaaataatataaaggagaaaatgcaatcagctacctagagatagactctcttcctccatgttttaactgttaaatatacaatggatgtattacattgtagatcacattctgtgtatgtgtacatgttttcccatattttcaaaactgtttccatacgtctgtctcttatttcaatgtgctccgttatcttggtaaatttgcctttcagacccttctgggctgttactctaatcatgcatcctcaaatctttagggggaaatgagtggcaaaatatagcttactctttatgtagaaagcacaggaatatatatatatacacacacacacacgtgtgctatacacacgtgtgtatatatatacataggtgtgtatatagcacatgtgttttttatatatataaatatattaggttggtgcaaaagtaattgctgtttttgccattactttcaatggtaaaaaccacaattacttttgcaccaaccttatagatacatattacatatttaattaccactttattcaaaggtgtctccttggaaatcctggctaccctctaggttacaattgtttggctggtgggaagggagagatacatgatccaagcagagccagggtctcactctgttgcctacgctggagtgcatggcacaattacagctcactgtaatcttgaactcctgggctgaagagatcctcccacctcagcctcccagtagctaaaactataggcatatgtcaccaggcccagctaattttttaaaattattttgtagagacagggtctcactatgttacccaggctggtctcgaactcctgggctcaagggatcctctcacatcaatctcccaaagtgctgggattacaactgtgagccaccatgcctggcccacctgtgctttatatacaaacatatagtatctctgtggtattaaataaatgttatgggccgagtggcaattaggaggaaaaaatgtctaaaagacttcttaagggggatgtaatgaaaaaaggttgaaaaactgtgcagtagatgactataatataattgacttaaccaattcttttaataaaatctgccgacacacacttattacttgatgtcagacttaaaagcaaaaacaaaattttataacgtctattaatgatcatacgttctttttcagtgtaaaaagatcagtttccctaatgtctggatctccaacaatctcagcattccatttcattaaaatgaaactgatctacttgttggcaatctgtactgggctcccaagcttccatatgtccatcatttaattcgactctgcaggatggaaagtaacattgaataagtcctcatgtaatccttggcacacaccatgaagtttgctcgtgcatttattcaaacatttatttaggttctgagaagttatgtgacttgctcagagtcacacatttattcagtggcagagcctaaatttggtcctaatgtcagtctgctttccacactcccacagaaccttaatgaagtcactcttggaactttctagtacttagtttctctatctgtaaaaagagagagttgaactagatttctaattgggtcttgccatttcaagagttcatttaatcgagtagctagatgtttaggttcatgggtcaaacaccacaatgttaagaccactagaaaatggaaggatatcgatcttccttttactcctccaacattttggaagaaatatatccgcactcttgagattctgcccacagagccaaagctttccagaaagaatgtgctgatgtgcttacttcaactgcgaaagcacacatctcattctgccccttcccagagcttttgcataggctcattccccggacagagcctctggggagatctctgcatggatgcagaacataaacatccagcccttcatgaacagtgttttgtttttctccaggccatcgtcctgctttccggcactaaacagcagagatgtatctgcatcaaaagactactgtctaattaaaagaaagttttaagaactatgagtcctggtgggatttctcacgaaagtgttgagcatccccaagctgaaagaacacactgagtttagaaggtagcgttgcatggcagcgtttcaagtgcatatggcctgttttatctttctccatctacctggcacggtgaagagtcctctcctgcggagatgcacacccagccgtcgagagctccgcagagcgctggaatgaggcatgcgctggcacgcgctggatggcagttgcttttcttctactgtgattcattatgcagccaggctatgctctaataagcactcgtcaggttccatcccacaggttgttgttgcatctcgaggatggagctgggattcctgcacatatgggccccagcagcatcccaagtgaaatgtgttacccaactagacatcattctcatttaacatgaactcttccatttaaaggtaaaagcagaataaatcttccctgactttggttaggcaacttagaccattcccctgactaacctacagctatgttgtgggctaaatctgcatggaccgatggaagaactaacagcaaataaaatctgaaatggagagcatgtcttagaatttggaataaaaataaatgtgaagaaactaaactgctaacagaacaggtgtgcacacagttagaatttctaaagcttttgcataaagtagtagtgagagctgtatgctccctttcaaagcaggaaatgtgagttcccaggtttcaaagggtcgaaacctcttttttgcttgccaaaactccagaattctatgccttacagagttaaagaacccctggtcagaggcttaattttatcaaatttttctaaacatgcatgtctgtcaagaatcttaaatctcctacttaaaaatcattcccactactataattagaagaagataataattattggtttgggatttttttaaacataatagtgaccacagtataactaaattgtttcccctgttgggtgggcagatagtgccttttccttctgtgcgtgtcttttcttctcatttttccagcaaaatctctaccttcccagtttctcatgattcctagtgtccactgctaagactcctggagtctaacactaaattctgtgattcatctggaacacggtaagtcgccttaattatgtacaacatgaaactaaaataaaatactaccatgcaatatatttaataggatttgatcttctcttcctttatttttaatgcaagccaaatgaaaccaaaaaaaaaaatacttcaggaaaagaagaagcctaatgagcctgctttttactttgatgtggtcttcaactgaccttttactgtagatatgtggtccttaattggaggagagaaaaaatattcccaagagccttctcagttccccaaaaaagattccaagcaacatgttctcaactccggaactcagaggccacctactagttggagcaaagaggaagcaaaagtccataccacccattacccccacctctacccactgtcctctggtccttatcccatgatggtgctgctgcccacagggtcacccaaggtaaaggctttcaggagagctttgattcctctctttcccttacctcctacaaccaaaggtccctgggtctctattaaagcatttctaaacaccattctttcctctccctttccctcccctcctcaagtcatacccttctctcaggtcttctgtgcatctcagctggatttccaaccagctcccaatgggacttcttgtcctgcctcccaagtgtctccagagtgctggttctaaactacaaatgggatcacaccagttcctgctcagaaaacatgaattggtcctcattgccaaagaaggttcagaatatcaagcatggctaaaaggaccaatgtgatctggccccagcccactttttaatttcacctccactcaattaatggtagcattcagtggaatttgatgaataaacagatttgggtcaagaaaaaaagagtgtaagattgtggcaatcatgacacccaacactacaaactgcataatctcctaagggttgtgccaagggcttcatgtgcattatctcaatcttctcaacaaggcaggtcttattaggtcccccacttgtcaatctgaaaacaggctgcacagctcatgaagtgacaaaggatgaagctgaatccaagtggaaatggcaatgtccacatccttatgtatataccacactgcattccacacactgtcaacatagggagcctgggtgacctggagtatagcggtgtggatcaaaattttgttgcaaatacccaccaggtactgatcatgatactcacttcagccaaagcccctaaaatgtgcaaaagagagccccttattgaagctaagagctcagctttcagagggttcagaagacatcaggagttctgagttccagagagagtagaaaaagccaggcacatcccatgctcataatctaaaaacacaccggcttcagttacctttcccaatcatccctgggtatatgcagagggaaaaaggatactgaaggatcccaactcccagtaaccccttttgtggagtccactgctcatcaagcaccattctaatccctgctggcttgtggtgtggaacaatctatgaaaatgagaatttacaaagcagtagacctcaggacctttgctcatgctgttctctttttctagaccaaccctaactgtccacaaccctcactatttgtcctaattaatgactataccatccttctatatcaagtgggaacatcatttcttcagggacaccctccctgagtatatcagatacaccattagatgctcccagcatgttcttcatcacagcacccaatgccattataatttttacctttgcttttgtagttacttaatgtatctctctccatctcggttacaagcttcatcatagcagaaactgtgtctattgctcagtacagttcctggcacagagtaaatgaccaatcagtccttgaacaaatgaatgaacaagcaataattttagccttcttaacagttagatttgtcattataaattagtaagttcagcatctggttttggcaccagtgtcttgtgaacttggtcagggaagcagtctccttgaagctgaccactcagccagccctgaatgaatgagtctggcacctgtgaagataaggaatagatatctctgaatagatattggtgaccgaacacagcccagcttgggcatccaggtgattttttttctctaatatttctctctcatcccttgcacccagaaaactgtgtccaggagtggtcactgcattacttatagacattactaggcacataaattttggtttgatagctcctgtttcacgcacactcactctctaaaatgaaacaacaaatgcaaggtggcacggagggctgggaaacaacaaatgccatagggaaagcaacaaaaatctaactcaaacaaacgctttccacttagagatgataaatacaacatgccatggcagcatacactgtcagcaggctgcccctttaaaaatgtaaccatcaatctgttgttaagcccacaaccagttgcaatattaatcatacttttctggcaaaagaatccatttcccaataaagtttgagtggcagagaaaaggcagagccaacaatcaggaaataaactctgcttccaaatgatctaaggaagctgctcttcttgccggctgctctctcaccatcctgctgctagcaccagacacacataaatacacatgccactctgcttcccccacatcatatttccatcattgcagagtgctctacagttctgttctagacccatttttcactttgtgccatttttgtatactttgaacccagatattccctggaaattaagagtcactttttaagcacgaccaccacctctatttagttgctcactcataacctttctttcctttttcttttttctctctccctttctctctctctctctccctccccccccccagccccctctctccctctctatttctctctcccccctgtcctctaccattaacctggaaccaattatgataagcaccatttctgttcttctgcctcaccttcagtcaactctcaggatgctacacccacgttgcaggctgtaggaaaaattcccactttgatccattgttattttttctttaagtagttactcatgaatattttccttcaatacaaatgttaggatgtcttcaaccaaatccctctggaaatgctgtgatattattgcacctatgttaaatatataggctaatttgtaatgaataccatatctacaacactaagtcttccttcctatccataaacatggtatatctctctgccttctttcataccctttagagtttctccaggcaaactgcatacaattttggttaggttaaatcctagatgtattacagtggttgctattgtgaataaacatcttctattatatattcttaatttattattgtggtacaaaagaaagttattaattttcatatgtttatattatccaacaaatttgttgaaccctctactgctaagggttggtcggttaattatttttttctctaagtaaatgatgttatacgcaaataaaccatttttcttttcccttccaatccttttaactttctatctgctttaatgcattagccagaagctttagtttagagtagtagcaatcatcatgtgtattcctatttctttctaaccttaaaagaaaatgcttctaaaatttattaactaaccataatgtttgcagtaggctttcggagaaaagcctttattagattgagaacatttccttccataatagattatattattgttctcaattatttgctgcctctctctaccaggcctacctccatggggcccctcacattgggcaaagtatggagccactacactgacatcagacttggccatgtgacttgctttgaccaatgaactatgaaaggaggtgacatatgtcaagtccaagctgacacttggagccattacatggtgcttctattgatttttcctgtctgctactgtaccaccacatcccaggcaggggctgctcctccagcctggctcctgcagtgacgactacagagagcagaaacacagccaacctacaaccaacatgcaacatgtacaggaaatcaacctttgttatcataagccactgacattttggagttactgctacagcataatgtagcaaaagctgactgatatacaacctatttttatttttctctgggcttttgtcataatagctgcctttactacacccattgagatcactgtatggttattctccttttgtctgttaatgtaatgatttcagaggttaaatttgtagcagacattagctgtccatcaaaaatactagtgctcttcctcccacagtgtggtattttcactgggaaatggctgcccagcctgtagctacactctccagctcttcttgcatgtagaggtggccatgcaactagttaccaccaacagggcatgagcagaagtgacatgtcacatgcaggtccagagctcttacaaagcagttagagattctcacattctttatttttctgctggctggaaatgcaggacatggggccttagtgagaagtcgaaccacaagatggagggagcctgggtccttcagtcatcacatggatcacctgccaaccacggcaccattccatgagcaagaaataaacctgttgtatacaggtgcttatttgttagagcaaccagtgttaccctaatacaccatccttgcacttcagggataaatccagtgatatatgattttttaatacgatgttagatttagaatgttatcattttatttaacttttagctgaagctggcttgtcatttgtcttctttggtactatcctcattcagttttgatactgaggatataaatttggtattacacttcagaaaataacaagagcagctttctcctttttataaatctctggagcaacttgaaccaggcagggattatctacttatataaaactgcatggccctaatgattttgggaggaggagaaagtttttgccatcatttccatttcttcagcagtgattgttctagtcaagttttccatttatcaattggccaacattggaatttcatattttttctacaaatctattcatttcataagagttttcacatttcacatttcacagctatacatttgtttatatacagttgctgaaccaaatctcttatgatatctaaattgcttctatagctatgattatttcatatgcaccttctctctttttattccttgatcagtctctctagaggcaaatccatcttcctaattttttcaaagaacatttggttattctaatcattattatttttccatcccccttttattgatttttactctaccttattattttaatccttcattgactcagagaatatggtctgaatgatatcagttcttagtccaagactgactttctgacctagaatataatccatttttgtgaaaataccatgtgtgccccaaaataacatgcatttagtgttttctgagtgtgggattgttaattgtgtttttcaaatccttctttgtcttttttcccagtttgttctgtttccaagaaaattatattcaaatctccatctacaatggagattatctatttaccactataattcctccaattattactttatatagtttgaggctatgttgttggttatgtttttgtcatcactattatatcttcctggaatattgtggtattgtggcattcccagaaaaaaccatttttcatcttttttgatgttcaccttaaattctacttcatctggtattgaaactgctagcctggtgttattgtggttattttcctagaatgccattttatccctttattttcaacctgtgtctttgtttatgtgactgtcttaaaatcacatattgcctgatcttttctgtaacgtaatctaagagtacgtgcatcttaatcagtgagattaaccatttattctgtaaccactgatactgcaggtttgatttcctcaccctattttgtgttttctatttactatgctttttttattttctgatctctcactgaatatattattttcttagttttagcttaacaaagtatatttttatgatttccatggttgcccttagcttaagtaaggcctatatttatatttgtttattcctttaatatctaaagactattcatgactatatcctccccacagcaagacacaacccttggactgctttcctctacctgtgatctttcacacacactcacacacacaaacttcatttctcatgttagcattgtctggaaatttagttccaggttggttatgggtcactccctccccctgttttttcagacatctccagaaccctgagcagaggaagagaccaggagaccatgctttgtttaccacattgattcaaaccagaatttaaaaccagcccaattgtgccatgaaactaatgcttatgggtttttttgaataaacatagaaattgacccccccaagtcttgaaattaacaaagttgcagttgtcttatctgagttcctctctcaggaaacaactatcaggcctcccagatagtatcaaagagctgaaactcatcagataacacctggacaatgagatgccagacccctcactcatcatgatggcctaaccgaccacctgcttcctgctgacccactcttcttcttcacccttccctaattcgtatttttccccatatagtcagatttctttcctgctatataaacccctaattttagtcggtcagggagatggatttgagactgatctcccatcttctcagctgcagcgcccgaataaagccctcttccctggcaatactcattgtatcactggtgggctgtctgtgcagcgaacagcaggacctagactgaacccctggtgtttcagtaacaaattatccttctcatttcttattattttttgtttattgctcattgtgagttatttagaatactgattctatgaatgctattattttgaatgcttttttgaggtataatttatataccataagattcacccacttcaaatgtatatatatatatatatatatatatatatatatatatatatatatatatacattttttgagacagagtctcgctctgtggcccaggctgtagtgcagtgtcacgatcttggctcactgcaacctctgcctcctgggttcaagcacttctcctgcctcagcctcccaagtagctgggattacagtcacgcaacacctgcctggctcatttttgtattttaatagggacggggtttcaccatgttcggcaggctggtctcaaactcctgacctcaagtgatctgcccaccttggcctcccaaagtgatgagattacaggcatgagccaccgcacccagccttaaatgtataatttaatgattattatttacggagttgtacaacaatcacaccatcaccacaatacagtttttagaatatctccatcactccaaaaagatccttcatgcctgttcacagtcatccctgttcacagccatccctgttcccacccctaccccaggcaatcagtaatctaccttctgtttctatggattcaccttttctggaaatgacctatacatggaaatatccaagatgtggtcttttctgacttgtttcacttagcatgatgtttctgaggttcatacatgtggctgcatgtgtcaccatccatttcatttccttgctgaatcgtattgcattggatggatgtgccatgttttgcttatccatttgccagctgatggatatttggactgtttccactgttgtgtacctgtgtcttcctgtggacgtaggttttcattactcttgggtagatgcctaggagtaaaactgttgagtaatatggtaaatttatatttaactcttctaagtgactgccgaactgtttttccaaagtggccatgccattgtacatcctcaccagccctgtgtgagggttccactttctccacatctttgctgtattagtccattttcacattgctatgaagacatacctgagatggggtaatttataaaggaaagaggtttaattgactcacaattctgcatggctgggaagggctcaggaaacttacaatcatggcagaaggcaaaggagaagcaagaaccttcttcatatgatggtaggagacagagcaagcaatggggaaactgccaaacacttttaaagcatcagatctcatgagaactcactcactatcatgagaacagcatgggggaaaccgcccccatgatccaatcacctgccaccaggtccctccctcaacatgtgcggattacaattccaaatgagatttggaggggacacagagccaaaccatatcatttgccaacacatgcttttaatcatcgtttgttattgttcttcttgttgttacatccattctagtgggtgcacttactatatttataatcagaaaaaaataagcatgtagataagtatatgaaatttatgtatataccatatcttaagggagaaaaaagaacaaaaatatcagaaggaaatacaacaaaatattaaatatggctgtctctagatgacaggattatgggtttttcttctttctacctttctgtatttttctctttgataagcaacaggtatttgcttttataaacaaattcattttaataaagtaataacataccatgaggtgttttacagctagtataatctaactttaactaccttaacatttcccagtagtgatgattagataccaaagcttcccttctgctaaagatcatacatacattgttgaattactgaagaaattacttgcctccagattgactcgcagggtaactgttggttttattaaactccagagaagaactgcagagcttccagggcccttcctcaaagcagctaggaggcatggatgcacagctgtcaccgcattcctctcacagtgcttcctgggccagcatcaaggctattcagaaacatctcattcttttacaaccatcctttgctcctacaccaaactctacaaggtgtatggcattcaagtagttttgtgtttggctagtgatgacaaagccaccccatcacaaaaaactgtttatatgctactctattagcatataatctgggaatcttgccgaagcacattcatccaacaagtattatctgagccccaactatgtgaaaagcattgtattagtctgttctcagctcctaataaagacatacccgagactgggaaatttataaagaggtttaattgactcacagttccacatggcttgggaggcctcacaatcatggcagaaggtgaatgaggagcagtcacatcttacatgccagcaggcaagatagagcaggtgcaggggaactccccttttataaaaccatcagttctcatgagacttatcgactatcacaagaacagcacgcgaaaaaccctcccccatgattcaattaccttccaccaggtccttccccgacatgtgagaattacaggagctacaattcaagatgagatttgggtgggaatacagccaaaccatatcaggcatcttgctgtgtccccttaagcttacaatctaagaacaaacactctacccaaagtacagagcgctaaggatcctaagggacaaacacacagaagggcttgtaggagtttggaaaagagttgtcttccccacccccccacaactgaaagaggaaagacatttcaaggaaacagtcacttgccagttttgggtatcattgaacatggaaccagaggtccaggaattacacgatggcccaagacaagcatctaaagggcaagaccaaaggaagagcttcccttccctgcacccattttccctctcaaatgatctttccctgatctttattctctgtcaccaccaaacttcttgcctctgtctagacaggcatacaagggccaaccaacccgctgtgaataggtgcctcaggcaactgaagtccaaatagaatgaggcaagggcgccctcactcaactcatccaaaacgagaaaaaactaagaagtcccaaccagagtcatgtttcttctacaccatgacactgcatgtgtaagcccaccctacatccttttaagaatgcaacattttacaaaagaataacttaactgcacatcatatgccaccgttttatgctaaagatcacacgtactgtgttgaattacttcagaaatgactttaacatcgacagccaaagcaaaacctttaactagaggggactgggtattttggcctgatgaataatttgcactcagtaatagggagtcatccaagccaccaagcgtgaattactaattttcaaaagaccaaaaactaacaaagtacattcaaccttaaaaccattttgaacataatcttcctttgaggattcaaaaatgcctagaaacactttaaatctgtgaataaggaccacgactctgtgttgtcatatccatacaaagttattgaataaaacctagcaggcttagagcttactaatcctactgttataaccgggggctgggagggaagaattgctcttctaatagtaaatgtaggtaaatgccagcagaactgggtataagagatgtgcctattaaggaatgtcactggttttattttaatttattctgggtttattggatacagcaaaattcaccctttatagatgtacagttctatgaatcttgacaaacatatacaattgtgtgggcaccaccataatcaagatataaaatgttcccatcactttcttaaattcatgcccctttgcagggaaatgcccctccccatttccccagtccctggcaaccatgaatctaatttctgtccatacagttttgtcttttccagaattatgaatctaatttctgtctctatagttttttcttttccagaatgtcacagaaatggaatcatacagtctgtagcttttgactctggcttctttcacttaatcttttaagagctatccatgtcattgcattgattttgtttgttaaccaatattgaaccgagacttcaaaatggtgctggtggcctcacacccaccaggttcttcgtcactgttcacactgtccgtcctttttttttttttttttttttttttctccgaaacagggtcgcccaggctgaatgcagtggtgtgctcttggctcactgcaacctccacctctcagattcaagtgatcctcccacatcagcctctcgagaggctgggattacaggcatgtgccaccatgcccagctaatgtttgcatttttagaagagagagcctttcaccatgttggccaggctggtctcaaactcctgacctcaagtgatctgcctgcctcggcctcccaaagtgctgggtttacaggtgtgagccactgcaccttgcccacattgttcttttcaggggcctctgagccactcaataccttcttcatatattaaaggagggacgaatcttcatctttcaaaagggagggcgatggttttaaaagcaaagctctaacctatgagcttttactccaggacacaaacactggcctatggagctctgtggcccaagcacagggcagggtactcagtgggggcacaacacagaggacactgaaggctgggaaggggaagaatggatgggagcgagattcattaaaggttacaaaattacagctagataagaggagtaagttctactccataccactgtaagatggctgtacttaactaaaatattctagtttcgaagagttagaaggaggatacggaacatttccaacacaaataaatgatcaatgttgagacgatggatatgctaattacctggatccaaccactacacattatactgaaacatcactatgtgctccataaatatgtacagttattatgtgccaattaaaaaaatttaaacctgttggttcaacttgactgaactgcaatctgatcagtagtcaacatgaataataccatcttagttcaagagtaaaacaatctcactgagaaaatttctcagaaaaagactcccaaaatgttatattgtgttaggttttgttttgctttggggtgtgtgtgtgtgtgtgtgtgtgtgtgtgtgtgtgtgtgtgtgtgttgaaaactggctctgaaagcatttctaaaagtggagtttccaacatcatcgtgaatccactcctgcacctcctcattgtacaaatatttactgagtgccctgtgtggctacaccaagttcactgctaggaatgattcaacttctaaacaccatcaggaaagtacagactctgggttgagatggttctgaaatcaaattcccacttttggccctttaactctgactctactgccctagagattccccagcagggtcacccaaacagagcttgatgacccaggtgctcaaaccctctgcccaacccatcctccagcacactctgccgggcccatcttttgtggtctgcacaccttgcttgttaccagtggatctgcgaaactttcagaacatccatcctggaaaaatgctcacctctgaataataatttaagtctcgaactgtcatcatccagggaagaacttctcactctgaatctgtcgtgattctagagcattcctagaatctagaggttctagattctagatcctgactcctatgcaagtagctcggcaaggagaggggagcaatggctggagaaagtgataaattctctaaatctggtttttctcactcataaaatagagttattaatccctccctgctgcgaggataaaataatggataataataatagcagctgttattaattgaaagcttatttgagggccaaataccacagaatatgcattacttatttattgattttaatccatgcacccaatcttatgagtaagactattattatccccaactaataaatgaggaattgaggctcagagatactaagcacttgctcaaaaccaccagctagtacatgcttcactgagggtgtgaactcttcatcgttatatttaacctcattcaacttctggcaatcaatcccaaagaaataataataagtcactcatacacacagaggcgcctcatggtttgagaagagaaaatcagaaaataattaaacatccaacaatgaggcattgctaatataaactgcctccatgttggtcaggctggtttcaaatcatgactgcaaagaatagtctgtgaagaccagctgaagacatgtgttcacctcccacttcttcccaaaactcactgatatcccagtaaataactacaagtgagacaatatcataaaatcactgtgaactgataaaacagaagccaggtgaggtggtgctggtagcagaaccagggcaaatggagaaggagagggaggtggaatggtgaggagaaagaagctgtttcccatcatggaagcaccagcatgggtggatacagataccaggagttggaggaagggcaccaatggtgaaggctgtctgcaggaagagtccatgggctggcctcccccagtctactcaacaatcacctctcacctcttcccccaagagcagcaaatgaattttcccaggctgaaacaggaaatataaccactaaggatccttaacaatcttccaagaaggtgcttaaatttccagagtggggattatcaccccaaaatatgttcctctttggcttagcatgaggagcagcacaacttgcctgcttttgttccacaaatgtccaagtgaaatccgccaatcaactcacctgcccgtggacaaacaaaactactcagcaatctgtgccaccacctagttctacattcctaaaatgaataaacaatccaaatcattaatgctggtggaggcaaacaataccaaagaaagaagtaagctgaacccataaaactgactccaggaaaaatagagaatccagacacaaacaagaactttcacagaacccttaattaatatcttccaagatactgaaggagattttatacacatagaacaagaacaggtgactatttttttttttttttgagatggagtcttgttctgtcgcccaggctggagtgcagtggcgccatctcagctcactgcaagctccgcctcccgggttcatgccattctcctgcctcagcctcctgagtagttgggactacaggcgcccgccaccacgcctggctaatttttttgtatttttagtagagacagggtttcaccgttttagccaggatggtcttgatattctgacctcgtgatccacccgccttggcctcccaaagtgccgggattccagtcgtgagccaccgcgcccagccacaggtgactatttttgaaaagcaattaaaactcagaagtaacaaatttacagaaattaagaacatgcctgctaaaatgaacgccaaaggaaaaaatatcaatagaaaagctgaaataaaaaattaaagaaatttcctagaatatagagcgaggagaaatatttagaaaacatagacaaaataacagacacatgaaagaccataccatgaaacaaatatccatctactagatgctcctagagagatcatagacaaaataaacaggaggaaataattaccaaaaatatatatatacttcacagaaatgaagaaagaaagaaaatgcaaagtgtccatcaagtgccgaacaggataaatgaaaaataccttttaaaaaatcctggctgggcacagtggctcacgcctgtaatcccagaactttgggaggccgaggcgggcagatcacttgaggtcaggagttcaagaccaacctggccaacatggtgaagccccatctctactaaaaatacaaaaataagtagccgatgtggtggcaggcacctgtagtcccagctactggggaggctgagacaggagaatcgcttgaacctgaaaagcggaggttgcagtgagccaagatggcgccactgcactccagcctgggcgacggagattccatctcaaaaaaaaaacaaaccctgaaatcttccaatgtatgtgtgttgagagaagtggcgtgcagacaaaacaggtaatccatgaaggaatggggattttaagtactgagctaattagcaatactgaatgttagaagacgactggatgtactttgaaatgtcaaggagaaaattattttgactctagctttctagagtctctctctctctctctctgtatttctctctctctctctcccccctctctttctctctctctctctctctatttctctctctctctctcccccctctctttctctctctctctctctcacacacacatacacacaaacacacacacatacagaatgtgaggatgaaaaagagattttttcagcctttaagaacaaaaagttttccacatacctattattttataaaatattaattaggaatagactgagacaaaatgaaaaggaatacaagaataaaagaaggttggggattctagaaagagaagaattccaggaccgcaagaagagcagccccaagatgatgatgagctcatggtcccaggaggaaggtaggagagcacttcacagcgtgcaattgaacaacggtgagatattcatgattcggtgaagaagacatccgcttcctccactcacaagaaaagcaaatgacaattagaatataagaagctgtacaataaggtcacaggccagcaaaatcaaacataacatgccctgagtctagcaactgatggagtgatcaagaaagcaaattcatctcatcacagttctgggatggggtacggttctcactgcagagacattcatccctgtcttgcctgggttttctcaaaaaacaaagcatacaacaaggacacatgggaaagtggtttatttggggaagtgattccaagtgacagtatggcaaactgggaagagtggaacagcaaaggagagaaaaatcaatccaggagtgtagcacacagtggatccccacaggggacaaacgagactccatcccactctgagaattatctgcctgggagaaggaagatgagaatgtgtactcatcggcttccatcccccattgaccaagggctgccccatgggtctggcatttccagatgtccattacatcagaatgtctgtgcaggaggcttcccaaatgccagatacagaaaagtcccaggatataaagtgagaaatatgcattgtagtatttagaactgtattttccacatacataatattttgtaatagtaactgtgttaaggagagacacaaatactatgtagacattagcactgcttgccaaatgtttttggctctcagcttcccaaacatacgatggaatcacactctttggcccctatgtggttgagtgcaaccatgtgactagttctgcccactaaactgaagtgaaagtgatatctcacttccacgttaaaacatgtgaattttgacgcaagacactccagagttttctttcctccttcttcttcctttccagcaacataacagataacagttgttccatttccatgggttgccaaataaagaggacccacagcagaggcccagttcactgtaatagacatgagactgacgagaaataaaaccttccttgtgtaaaggctctaagatctggggattatttgttactgctgcctaacctagcctatactgactgatacaatgaggcaatgctttataatgttgtttgggaagacaagtttagaaaagttaacacacacacatatacaatgattacactgtacatttaaaaagctaaatatagagaaaaaagggatatcaagtgctaatagtgtatgcccttggttgacagaatcccaaggaaggttcattattagatggtcactttttaaatcttacataacaagcatgtattatttacacaaaaacaaacattaaaagaaaacctcaagtgaggggctgtatcgaggaggagagattggtggacatcccagttatgtcacgtgcttatgaactctaaacttcagtaccttttccaccccataaaatacacaaatctcttttcaggtatcagggcaggtgggtgtcaaatacccaaaactttacttccactttacaatgtgcatatattcaaagtcttccaaacatccaagaaagttttagttgtacgttggactgtttctactcccttcttccaagtctcccaataacttgttcagcttttgcaaataggaattgtttcccaaaagggaaaagaatttgagaaaatccagtgtctagaacttaccaacatgaagccttgtgaatgcacaggtgtatgctcacacgcatgcacacacacaacaggtctgttaagtcctttctgggcccagtcttccaatttcttccacatccctctgatctattttccaagagcagccagagtgatcctcgggaagttaacacttcatgtcaattccctgctccaatgccccactggcttcccattacacttatggaatgaaatcgaaacccctaaccatggccctggagatgcaggtgatctggcccctgtcccactcttcccttgacccagtatgtaccagccatgacgatattcctctcaggtccctgaacacaccaagctactctttccatgtctgggcccctgtgctgaccatttccccttcctggaatgctgttctctggggttcccacaagccttcttccttctcaaccttcaagattcagcctaaattccacttcttcagggaaaccctccccaaaggccaccattaaaaatgagccccatccccgtcattctctcccactatcctgttcctttctttcagacacttcatcacaatcctatttcttctctgtttttttctttctttctttctttttttttttttttttgacggagtcttgccctgtcgctaagcaggagtgcagtggcgcgatctaggctcactgcaacgtccacctcccgggttcacgccattctcctgcctcagcctcccgagtagctggggctacaggcctgcaccatcacgcccagctaatttttgtttttttagtagagacggggtttcaccatgttggccaggatggtctccatctcttgacctcgtgatccacccatctcagcctcccgaagtgctgggattacaggcatgagccaccgcacccggcctctttcttttttttttttttttttttttttcagacggagtttcgctcttgttgcacaggctggagtgtaatagcatgatctcggctcaccgcaacctccacctcccaggttcaagtgattctcctgcctcagcctcctgagtagctgggattacaggcatgtgccactacacccagctaattttgtatttttagcagagatgaggtttctccatgttggtcaggctggtctcaaactcccaacctcaagtatctgcccgcctcagcctcccaaagtgctgggattacaggtgtgagccaccatgcccggcctcttctctttatttatcaccttaggtgtttattgtttggcttccctgttactacgggagctctatagggcctcatctgtctacacatggctgcatctccagcatttagaagagtgtctggcacataatgagtgctaataaatggacgaaggattacagacaggctgtggaaaggggctaacaggggtgtgcacagagtatggaagaagatgaagcaggttaccagggtagatttctaagagaaggggatgcttaagctgaacgttgagggatgatcaggtgttcagggggaaaggcatgagcagcgagggaaacagaggtgtgcaaaggcctccagccaccaaaaagagcaggaccagtgtctggggaggtctttctgcattttggatattgagtgtcatgcccatttgggagccttggagagagcttttatgccagccacctctgccttgggagagacaaagcccatttccatctgggagctgggttggtgcaccccagactctggttcctgagtgccacttgcagggtggcctctcatcaagcagtttcacacccagtgatacctcgtactttcaccctgtcacctgccattagtcatttctcccaccagcactgagaggtaaatcactattattatttttcagttttacagctgagaactaaagagtgtggaggttaagtgactcgtcagagttagtggccagatggggttcagaattcagcacctgtgatcacacccaaggcctagggcccacaacatttgtgtttctggacactcaaaccagaaggccccatgtggctggacatgtctgcatggctccccacccaccttgcaaattttcccagccccccggctatctctcaccctacttttctccttccttgccctctcctctctttcttctctctcatctctctctcccccaccgatctctctccctgactctctcccacctctcttccctttctctctcccttctccctgccctctccctgcttcctctctctgtctctgtttcttcctctctctctctctctgctcttttctccctctccttctctctccaacctctccctcccttttcctctctcttccacacctctctcctccccctctttctctcccccaccctctctctctccctctccctttctctccttctctctttccaccctccctctctctctcttcccctctctccccacctctctcctcccgctttctcccctcccacctgccttctctctccctctctcccttctctttccctctctctccttctctctttccaccctccctctctctctcttcccctctctccccacctctctcctcccgctttctcccctcccacctgcctcctctctccctctctccctctctcccttctctttccctctctctctccccatctctcctctctctccctctcttctctgcctctccctgttcccccttcttctactctatctccccgccttgctccctcactctctctgtctctctgttttccttttctccctctccctcctcttttcctctctctccgaccctatttggctctttagattgaaaacttcccaccacctgacttcagacagggatgggatcatttgccttctcttcttaacagtatcagaacctgtaggctcacaggctcctttcttaggagagcccagcatgtgaggaagggctggtgatcccaagtgagagcatagaaacatccttggggagtcagctttgggaagaggctgctggcaagtaaggcctaatcctcatgcaggagctctgcgccccattcagcagctgggcccctcctcctcctggggctcctgacagagggggttcctccactcctggccggttccccagctcagcaggctcccgccccccatccacagctctgcctgtgtaaggccagaagcccagcatgcctgcctggaatactaaacagggcccttccagatccagatgcactgagaaggccagacaatccctcacctcccccatccccaagggcctggctggagagggctggaatctagtgcattgcagggagcagggaagctcatcacagtcctcatgtggggacagaggaggcccctgatccctctgggatgtgggtggcaggctgccagctgaggaggttggaggccccaggctccccttccagacagcataaatccaatggtgtggggtccagctccctgtggcccagcacacaggcaggattgcaaggatgaaggcccgaggtaagtttggaggagattaaattaaaaagccaaagcttctgagcaccagaaggcctcagcgaccataaatctacttgcagaggagcacacagaacacgaggccaaaccagttttatttaagttgctgatgagcgttggcctctgcaaaggcataattcaaccacacttgggcctggacagtccctgcttccaagcaatgcacagtaagggagccaggaagtggaagtatggaacacttggacagtggcgaggggcctgagctacaggatcagagaaactcatgctcaaatcccatctctgtcatttctgggcagtgtaatctcaggaaggtcgcctaacctccctaaccctctttttccccactcagaaaacgggttaaaccagatggaccttccagagtcattgtgagtacctgccccacaagccccaacaaaatggtggccatcacaacaaagttgatgatgatataggaaagtgaagttaatggccacagaacattaatgagctaacacaaggcactcattctatgccgggcactgtttactctttcagtccttagaatgatactgtgataaaatgccatgatggttcccagttcacagttgcagaagctgaggcacagagatgctgagaaacttgcctaaggtcacatagctggttatggatagtactgggattcaaacctgggcagccaggctcttccacagtgacagacactgcactctcctgactctcagaatttgagagcctaaaggaacacaggaatcattttttccatattcttggaagagggagacacctaagcccagagggcaaaggacacctccagacagtgacaggatagctgaacaccagccacagctccttagaggaaacagcacaggggtctttatgatcttaagtatcttctgtgtggctctgacaaccccaaaacttctcttgttacatgaaaatcagcttacattaatatggatgcaagatgcaagtgcagcacagtgcgcgggctgtacaaagcaagcagggaggcttccgaagatgacccccaggctatgccttggcagtccccttcgccagcttccatcccccgaagccacgtgaggaaggccagaacaccaaggtccctccagaactctgagtagagaaacagagccagccggcccagccatccccagagatggaaggaagctccaaggggactgatgacaagctaaaatttggaactttatcacagactcatggttaccaacatcaaatatttaatttgcagctaagactctttttgcttaaagccatgaagcagcagcacagcatattggctgaatgcacagaccttagagccagacagcctaggttccggtcccagctgaaagaccttggccatgtgactcaacccttctgcctcagtttcctcatctgtaaaatggatataactgaacttcccaggatcattttgtacattaggaatattcatattaacagagtacgtagaatattacccaatcccctaagagtgccaggtaactaagtattcgttaaataagaagcgctccctcataagccagccctctcttcaaaaggtgacaactcttttttttcttttttttttttttgtttgaggtcttccttaggatcttcaaagatttcaccgaagaaccagcatgtgtccctgacctgatggaatgtgtccttaccaggataaaaaatcgatgcaatactgttggaaagtgaccccatggtttgaagcaaaccaaattatacgttaaagcaaaaaattacctccagaataaacgctaagcacagtgactgtctacaaaggccatgttttaagcattcgcactccaggaccctgggcttagtggcacattagacactcaataattgcatatctagcattcagaaacttttaagtggttcttattttgattcctttcccctctctgtagtgggaactgccctcaatcattctgacaggtatttctcttgccgcccacaaattttcagccctgcagtataccacattggtctggactctagcatatgcaggatttatgccaggcttgcaaaagatccctgaatcagccagtccaaaccccctctttgtgccatgtctacctcgggtgatggcagtgtgacagcattctcacctccacccccaagacacacacacacacaccctggatatctcaccataataataatgtattttatatcatgagcaggggaatacgattaaatcttcctcctataccccaggttcagaaaagaataataatgatttcctatattatgtggaatctcatagttcacaaaataatttcagatccaccatctgctttgaatgtcacagcaccctgtgtaataagtaagtcaggaatggtgtcccattagccacagatcaaagaagcatggaccagagtaaggaagcaattttctgaaggacacacagcaaattaggaggaggaatggaccccacacacaagtctgtgtactctgggctaatgctcttcaaggcctttttcctccttgctctgagcttacttcttgcaggtgtcagaaaggtacattgataggacaacttgcttcccccagacagccccacctcttcaaagatatccacaagtttgcccacacaagtattccatccctacctcctaatttccacctttacaaatggcacgtcccagccccacattgcccacagcacctccgggtctctgcttctgtctaaaatcctcatctccattcttgtgcctccaatcctgccagtctttcaggcccatctttaacagctctttatccaggacactctctgatgctgccatcacagcctgcaacagccacaggagaagccacccctctctgtatccctgtaacccttgattcttcctcgcatggtcatcatttctggtcttgggacttctcttctattagcccagtgggtacctggagggcaggaaccagggtacacttgccttgggagctcccacagacctcacatggtacctacatctagtagggactcaatcaatatccatgcattcattgtattaatcttggaaggaagcacaatgtgtattacatagagggaggtttacctgtgcaaggacaacccctttataaattcaagaatatagacacaatgtgtcgggcacagtggctcatgccagtaatcccagcactttgggaagctgaggcaggtggatgacttgagatcaggagctcaagacaagcctggccaaccagggtaaaaccccatctctactaaaaatacaaaaactagctgggcatcatgacacacgcctgtaatccccgctactctggaggctcaggcaggagaattacttgaacccaagaggcaggggttgcagtgagctaagatcgcgccactacactccagcctgggcaacagggtgactctgtctcaatttaaaaaaaagaaagaaagaaaggatatacacacaatgtaaaatcactgcaccgagtcagtataggggctgccttaaactcagggaacagccaaatctgtttatgaattaaaagaacagtcactaaggaggcaagatcaagtatcatcaaaacattaggccttgacatagaacctgaaggattcccccaagccctagggctgtatccagacagaattttcattccataactatcacaaaatgtctctttcatttccagctctgtgttagaggtcagggacataaacggctctcatctccaggccctgccatgatggacctcacagcctaatggggaaaagagacacaaaaccagacaatgacagaacaatataaaagcactgggggacacccagacaggcataatagcgcaaagagggaaggtgcccaggtgggagaacctaggctacgttatgaagatgacatttcccatgcaaatacacataaacgtgtctatcactcttgtgcacatgtgtggggctgtgtgttgggatggcattaatagtagctaaggtgttaaaaaatacaatactaaaattcccaggcaaagcaaaagtttccaccaattatccgaataatttttccaaaagttcagataataggcacgtttaagaaatttctggtacaaagaaacaaacatgtggctaccttttcctttttagcaggatgctttaatgccacataaacacatgctcattaccaagctgaaagctgatttacatagcatcacctctgaagcatacaaagataagaaaattcaagtgctccgaacctcagttttcttaacaataatacggaagtaaaatacagacctcgcaggatttgctggggggagattccatgagatgatgtatgtaaaagactctttgcaatgaaaaccacaatagcaagctcttgatcacttttagctcacacgctgggaatcagcatagtattatgggcaggaacatggactggagtctgtggatgtgggttcaaatcccagctccacccaactgcaatgatctgaggcaacactacctatgtagcctttcttagcctgagtctcctaaactgtacaatgaggattttaatgcgtacctcatagctctaatgattaaatgatgtaatatggtgaaataccacagtacaggtagtaaattctcaatacagcataactagcatcatgttactcttgtcaaatattttgtctaatatttcaagggaaggtcagaagatggagttcacaatctacataatccacagatgctcaggtgttacaagtagtgggagggagacggcacaatatgggacaggctaagagttctgggtctgattattccattcagctgctggcatggggctgactctgggagacagccacccacagtcatgggagtaggggcaattctctgaagagggcaaaaacaatcaagggtgtcagctgcatgtctcagattattgattatcttcatccatttgtgctgctataacagaatgcctgagactggataatttatacacaacagaaattcatttctcacaattctggaggctgggaagtccaagatcaaggttcagcatctggtaaagacctattcatcatagatggcaccatctaggtgtccttacatggcagaagggacagaagggcaaaagggcatggagccctagctaattcccttgagcctttttagaagggcactaatccattcatgggggtagagcttcaccgcctcatatcatgacattgctgatgaagtctaaacatattaatacagggggcatacattcagaccatagcatatgtctcatgtacttacatttgaaataagaccagcttttcactggacatctctctctctctctctgtctctttcactcacacatcacacacacacacacacacacacacacacacacacatacacttcctatgaggagaccccagacatctttttaaatgtgtacaactagttttggaaaataaaatattcagctgacctaatttttacattgggaataggagacataagtgtattttcaataaatccaccaaaatatttattttatttcaacattaagatgtaaaaagtcagagagagagaacagagtatgacagcgtcagtgagccgcccacctccctttggtgctccccaaagcctagcgcctgcagaaagctcctgccaccaccaggggcgacctgcatctccagagtgatggcaatttgtggctgtgggtgcagagcaggctggaagtgacagatggtggagaatcatccctacttccttataccttggtgggcaattatgagtctctcaggaggttccagcaggactgcacgctggtacctatggcaggagcccctggttaaccctctttgtgggcttttcctcacttccttgtctcacaatccctctctccagctgtggtttcttgggatcacctccagaatgaactacttaaacccaaacccttggctcaaggtgtactttgggggatgcaaaactaagacacagagagaaaaatgagaaaataatttagaaagaaagaatgaaggcaagaggagcattataactgatggcaaggaagacctggagggaaagagatgagattaagtaggggaaggaaaagaccagagatgaatgtcaggcttccatgaccaggaagcccctgtttactacctgccaacccaactcgtgccatctgccaaaccacacaccccaaaaacccatgcacctgcccccagatgttctcagatcccccgtccccactggcgttggtgagcactcaccccttgtcacctggtccaccagccaatgcagaggacagagtctagccccatggctccaactccccaacccaacacctccaggtcccaccttcctccaaaatcatgggtggggattttcggtcagacaactggccctgtgaggttagagaccccaagagtgtaagtacaataggaacctacactcttgataaagcccctggctgagacaaatctctttcccaagaacgtggtgttacaagagatgcaagagacaaattttaggaaacttgctgagaggctgagacccttttcagatgacaccaaaagctaactgcagccatgataagggattaccacccttgccataaaaccccactttggaccctctattctttgactttacaatgctttatataaatcctgcatcctcaatgggggcaatatcacccccaagggggcaaaaattgttcttaggatggagagccaaataatctcagatattatcgtggtttgtgaccctccaaagctcaaccctgcacaacaaaatcttatttcatttcatttcatggagaggggagatcagtaataataataataataataataataactaaaaagattccttagggtagtaataatgaaaaaaatctcaaaaaaacactgatataatgtgaaaatcctgttctggattcattttcaactcctcttaggaaataacatctaccgcaataagattttaacttctatctctcatctaatatcctgtggaaaacaaatatcacaaagtaatgcatggagagcagatgctttaaacatcacacgcgcttgccacagtaattgcactttgtaacttttctagcactttcataaattccagaagttatcttaatctccaatgctctgtagtgaggcaacagaagaaagatgatcattacttccaagtaaattctaagacttattaattgaatgactcatgctggatcacagaatgaagctctaaaaatgtcaacatttggagtcttgccctgtcccttcatcacctcgaatgcagctcccagcacacaatagggccttcagcaagattctgatgaacttccttaacttcaccatgttcaaatggaacccatttctgcccccaaacttattctgcttcccgaacccccagtgccaccagctacaacatcaccccctgaggtcccagacaacaatcttggggtatgtgtgatccagtcaatcaacataacaaagcagctaagagtccaggctacacccagcttccaaacccaatattgccacttaccaactatgaccccaggcaagctatttaacccccctgaaaaacagaaataacacctgccttccttgcaaggtaataatatggtttaaatgtggtgagacatattaaaatgcttagcacagtgccaggcacagagttggagctaaatagatggaactttccatgattgctcctgtcattgacattgggaatgcttttgctctgcagacttctaaaacagttgcacagtgtcagtgagaagactaacatggcagacagactgacaaaagtataatcccagctccataattcagtagagcagactcttcgcagaattcatttccctcatctataaaatgtgggcaacataacatctaccttgcaaggttgtggtgagtattaaatagataatgcacacagcagatgcccaacaaagagtgtggtgactgctgtggacttaattacaacctatctcaaattatcctacaattgtttctcacacagaatattgttttcaagtaccgggtcaatctggggtacaaaatatcaaagggacccctagtttccaaggtcctcttaccaagaagaaaagcaggcattgtgaggcaaacttagcccaggcctctgaggtctggaaacacatccagatggacaggggaaggtagagtgtaagcaaggtcatgggtaaagagcgtttaggctaggtctgtagtagaagcatactagaaacgcaaattttcaggccctacctcaaacctactgaatcagtaacaggggtctacaatctgcgtttacaaaccctttaggtgattctgacgcatgctaagtttgcaccattggtctatatatatggactccactgcttccagcttcatctctcccccacttccccagcccccttcatagggaccaatagctttaccgactccatgaagatcagtagttcattctcttctgatactcttttttttttctgagacagagtctcactctgtcacccaggctagagtgccatggcacaatctcagctcactgcaacctccacctcctgggttcgagtgtttctcatgcctcagcctccccagtagctgggtctacaggcacacaccaccatacctggctaatttttgtatttttagtagagacaaagtttcactatgttgcccaggctggctcaaattcctgagctcaggtaatccacacacctcagcctcccaaaatgctaggattaaaggtgtgagccaccgcacccagccttctctgctctttctcatggactcatcacataaaattcttcatgtttgcagcctctaaggaatgccaaagggcaaagtaaaaataaatactaaataagacagcatataatcatggctcatggcaggatttcaattatagttggttcccttctcctttgactcttggtgggagttcttcattcttgggtggttaagcaagtccaccctcagattaatacactcttcggcactccaggtgctagtttccactgtcaaggaatggtgtgcactgaagcccatcattcacaaggatgcaacaggttcagggggtgaggggcaggtgcctggggaggcagccccagacagactgtgcctggacaagccaaggctgccccagaccaaacaaaagatgaggcaacaaccaactgcagcagactggtgcagtaggaacagcatgaaccagaggtcaaagggtctctcctctggacccagacagctacctaacttctgggttcctctgcccaaaccacctgccctctctaagcctcttcagtaaaatcaatgtttagactgagtttcccaggagccctgtagccccatgcttttcagtgcaaatgttcagtaaaataacaaaaagaaagtaaagggttaatgctcctccatccagttttcttccagtttagaaagagacatatgtggccgggtgcagtggctcacacctgtaatgccagcactttgggaggccaaggtgggtggagcacctgaggtcaggagttcgaaccaacctggccaacatggtgaaaccccatctctactaaaaatacaaaaattagctgggcgtgatggcgggcacctgtaatctcagctactcgggaggctgaggcaggagaattgctggaacatgggaggcacaggttgcagtgagccgggatcgcgccattgcactccagcccaggctgacaacagcgagactccatctcaaaaaaagaaaaaaaaaaaaaaaaaaaaggaatgaaggaacaaaggaaagaaggaagggagggagggagggaggggagacagacgtatttgtgggaaagtaaacatttaattaaaattaagtaaaatatttttaactttctttttttttgaaacggagtttcgctcttgttgcctaggctagagtgcaatggcatgatcttcactcaccacaacctccgcctcccaggttcaagccatcctcccacctcagcctcccgagtagctgggaatacaggcatgcaccaccaggcccagctaattttgtatttttagtagagatggggtttctccatgttggtcaggctggtatagaactcccaatctcaggtgatccgcccgcctcggcctcccaaagtgctgggattacaggtgtgagccaccgcacctggccagtatttttaacttcttaaacatttttctaattgtttctacttaaacagatgaaagaatataaactgctttaaagaattttcaagtgaaatgaagatgccagatgacccaaaccctccaaacagagtcaaataaggaagaaaatagtctcggattgatatgcagctggggtgtgtggcagacagctagtcggctgaggatggacatttcatcttcccaactattcaccacctttagaaaagtttgctgaaagaaaaaggcagcaaggaaaagaagaaaaataagcattaacccattcacttgactaatatctcccataaagtaaagtggcaatacaacttgaagagtttcacatcctctggttgaaagaatgaaataaaatacaagacatcaccttccactgggctgagaaaatttagactaagtggtgtaaccgaaaaattaaaaacggcagtcattttacatcaagatcagcctcctggttaatgtctcaataggcagatggagtcagccacgttaacaggcactttgttctcagcttaaaggatcaatatcgcaattacacagtgccagcagaaattaaaacaggtttacacactagggtaatctaaacacaagaagaggaaaatcatcaggaactcggttcctgaacagagtccagaaaaacaatttaaaactcgtaacatagctgtgtgtgtgaagagggatgaggcgaagaaggtgtcaagtttggaaagaaatggcatctaaatctgacatgcttaatatttgcttaggtaatacctttaaaatgtcagagatcattagtgaattaatgttgggttattcttccgtgtagggaatcattcccaaagcacactgacttttggaataactgcaggcagggaaagctgaagaaatgggagtgaaaatgttgcatagtgtatttttcaaagatggttgcaacaatatctcccatctccatttcttctacaaggtgatcttgacactctcccatcaagtggtagagtctctctatccacctgaggatgggtgggtcttccgaccactttgaccagtaggatatggcagaagtcatgtgctggctccaggcatacctcttaactggcctggcatcttctgttttccacctcttggaactctagttttgaggatgttccctctcagaactcagctgccatactgtgagaagctgaagccacatggagaagctacttgtggacaatctggttgatagttccagctgcgtgccaagctgatgcccagtatcaactgccagcccagttgagcctttggaagacgccaatcccaatgctatccttccatattctcatcacagacctcagagaaggaagtgcccagctgagtccagtcaacccacagcaccatgagagataataatacattgttaagtcattatgttttgggcgatttgttatgcagcaatagagaactgaaacatgtgactcgagacagggttgggggcgggggcttgaggacagataagaaatctgcccctcaaaggtcttctgaatcagagttgcccttattttcttataaggacctcttcaaaaataaagcactccaaattccctagcatcgcacagaggcagggttggcgtgggggatagagggaggatgtatttgaagccaataatgtgaaaagcaaaataaacatctcaccacacataccattttaagggtgttaaaatcactgctctgagccacgcaatgggacaatcaaaataaaattttaaggtctgaaatttaaaaaaggcttcgaaaagatgcaaataaccttatcctctttaagtccctagtttaaagtaataagaaatgcattcacccaatgcattgccttcagcactaatctagaatgaagtcacttaaattctaagaccagaccccactaccccataataattggatggctgcatccaaggagttatctgagagctcaagcccttactgagttttcccattttctatttttttttccccgctttccctttctctgctgttttccttgctctccaggacacaataaagcaatggataggcggcaagtgctataatgcagtgattgcagtcatgtgagcaataatatcaggactgtatgggaaagggaccagacttcattataaataggaaaataataaagacagtagactgtggctggatgaacctcccacacatccaagtggatttagggctgagtcctcttgctgattgcttggatggaaactgggagtgcgtgcttttcgaaactctccagatacaaagatcacaaacacctccaagactcaggaaccacaggcacccaccaaaaccgggcctgatctcgactctgagcacttagttgtgagacctgacttcacttccagcctttagtccctcaagatttgatattcacactcagtatacatttttttcattttttacatctaatatttatttagctactcttgtgctaggggctgaggatatggtgacgaacaagtcagacatggtcccttccttcatttgagtgaacattcaagtggaaagacaagcaacaaccaagaaaaaggaaataaagactcaagatattatagacaatgataagccaatatagaaaaatatagggaacatgacagaagtggacaaggaagatcctgctgaaggggtagcatgtaagttaagacccaaagtgaggaaaggagttggagaaacagcactccaagcaaagagctaagtatgtgcaaaggtcctggggccaaaaagaaatttggcatgctctaggaatttttagggggaccagtgtaatagagtggggagagacaggagggagatgagtcaagaacagaggcaaaggtttgacacaaaatggtaaaaagcgttttatctcaggagcaatgggaagttattggagggtatcttaatcctttttgtgttgctgtaaaggaaaatctgagcttataaagaaaaattgtttacttgactcatgattttggatgcctggaaggttcaaaatagggcatctgtatcaggagaaggcctcaggctgcttccactcatgatggaaggtgaaggggagctggcatatgcagagatcacacagcaagaaagaaagcaagagagaaagtgaggaaatgccaggttctttttaatacccagagggaactaatagagtgacagcttctcaccctggagagaggcaattaatccattcatgagggatcacccataagttcccgatgacccaacacctcagaataggccctcctccaacactgtggatcaaatttccacatgggatttggtagagacaaattaaccatatccaaatgataggagagggttttaaggaggaaagtgactaaatctggctgatagttttaaacatcactccagagttaacagaggttacctttggggagaacagtaacagggaggggacagaggggggcttcctgggtaaagacgctatcctatttcttcatcagggcactgtgtacatgactggtttcagtttgttgacagtctgtcaagctgtatatttaagatatatgcccttttctgtatatatggttttttcagtaaaacgtttattaaaaatcactctggcttctcccaggaagtggggaggtagacagcttagttagaaaaccagtgtaggcactcggggtgagaagtgagggtggtttgagtggggctgggagcagaggaggagaaggcaaatggagaaagtcaagagacacctgtattttcatgtagttctgccttcacatgcagtgagcctcttttctgacctccactcttatgctagctccagggactcaagtaccatctcagtgacgaggcagcaccaactcgaatgaggtccaatgtgggtggggggagagaaactcagacaacaacaaatccatccaatatttatcatgcatctactacatctggaaatggctggaaaagaagaaaccagaggctaggaagggaaaggaaacatgagttatcgtgtggatagggtgatccaagggtaggggatagacaagcagcccaaggtgcaggttggcaggcacctgagaccctccgtgtagtctgggtacaagggggtccccacacaagctataggagtaagtctctgttcatactactgtgtctgatcactcctcaagaatggtcacataggctgggcacagtggctcacgcctgtaatccaagcactttgggaggccaaggagggcggatcacgaggtcaggagtttgagaccagcctggccaacaaagtgaaaccccgtctctgctaaaaaaaaaaatacaaaaattagccgggcgtggtggcacatgcctgtaatcctagctactcaggaggctgaggcaggagaacctcttgaacctgggaggtggaggttgcagtgagctgagatcgtgccactgcactctagcctgggggacagagcgagactccgtctcaggaaaaaaaaaaaaaaaaaaaaaaagaatggttacataatgggacttgtatatccactttagatcttctctaaggctctgggttctaggttctgttttaaagaacagaactgtttaaaggaaaaaaatatgatctggtgagaagtgaggtctcagaggcagagagctggagtcctcatttggaaaggaagaaaaaaaatggatccttaaagaaacttgtataatgggtgactcaaaattaatcaccttttgggaaacaggccatgttaattattcctggagtgggcaagtcagcttttgaaatgagctgccagtcatcagactttcatgtttagcagagccaaccacagcttttgtttaaaaattgaaagcccattcggatgtcatggtttagtgccaaggagggcatcatctcatcactaggcaggacatttaacatttccccagaagaaggcactcttctcacctcccgcccactccaggggagaattctccaatccacttgggtgggacatatcctcatatgtatacagcaatgcaacaaagaaacccaaattacctctattggtttagcaggaactagagccacacttagcagggtgctatccgaggaacagtgcattctattggcttatcaattacgtaacatctaacagctccttctcatcttttcagatttttatttgattggatagaaggcaaagtagttcaataaacacacacccaccctaaaagtcaaactcataaatctatccaactctaaagggtgccaaggactattgatgagggactgcattgtagaaatgggatcctctttgcttgtaaacaatggcatgggaaatttccatatgggataatgagacgtacctgctttcaaaaccagaggttgttcatttcattccattctattctgttgcatgttacgtaatataaagggcatctaagggtcaggaaactagatgaggaaataatgaaatttgagactatgtggaaagaaaggatggagtgaaaagaaaggaaggtaggaaaatggaagattgctttcaaagtaagatctttgtgcatttggaatgaaaataaaatcaatagggagtgcaaggaagttcctctggtttgaatgaatctgcccggcttcaaaaagttttacttcatgattgaatcgaaactcaaaagttgaacaaggaaattcaagcacgatttttattaaccccatatggcccagggagacttttaaaacagagacacttgctgctttctccagccctggatgttggggttttgcatgtaactcattcgtgatataaacgtatctcgtggggttttgcatgtaactcattcatgatataaacgtatctcctggggttttgcgtgtaactcattcatgatataaacgtatctcctggggttttgcatgtaactcattcatgatataaacgtgtctcctggggttttgcatgtaactcattcatgatataaacgtatctcctggggttttgcatgtaactcattcatgatataaacgtatctcctggggttttgcatgtaactcattcatgatataaacgtacctcctggggttttgcatgtaactcattcatgatataaacgtgtctccttcttttaattaactacttctctcatcaagggaaggggaaataatcccaatctaacaactcatccatgatgaactttgctgtctttcttctgtttccaaatgaatttggcttattaaaaaagtaatgagctattaattaactctacactcatacaaagctgtttaattctcaatctaattagccgcaatctgatgaaggattttaataattattttaactttgctaacagaaacatcttttcacttttcataagttatttatagaacagttcacattggatcctgcttggtttttaatttgatgacatttttattagatcctctactcttctaccatctctgtgtgacagagtttagaactgtcatcattgaaaagcccagaaatagtatcctgggtcacctacatggccaagacagtgcacccttctgtctttgaaaaaatctccaatggatgaggtatgggaggaccagaagccctgtccttctgatgtccttcttaaacaagaggcaaaactcaagtacgaaccaaggatagacttaaaactcccagtggaaagatcaaaggcttggggttactgctgaggctggatttggcagggagggaaggaaacatgccaccacacctataggaatgactttttcataactgatgcaaacaagggtattcccgaatctcttgtttaagaaacaacaggcagtgagttacatttcatttgtgtatagaatttctactggagccactacagtacaatgtgaaaagatcaaatgatattttatgtgcatggcctttatgatatgcatttctgcagacattagaaatttctatgtaaattacatattaatgtaaaggcctatgtacatcaaactatggattcaataaacacacttacacacatacacaaacttcacaaaaaataaaatgtgtttattcagaggcatttttattcttccctaggtattataagggaatagattatgttcagtgagccactctgcttctctaagatctaacatgagataagcctatttcacagttagtctcgccactttcctctaacacaggagggaacatgggagactgtttcctatgccacccccaagacttagtacatgaagaggctatatgtgtaatggtttagaaaacgaattctgaagccaactgcctgcgtacaaatctcagctccgcacttacttagctgtgtgcctttgggcaagtcaataacctttttgtaccccagttttctcatctaaaaaaaaatgggaatgaaatagtacctacctcacactcttgctaagaagattaaatgaattaatatatctaaagtccctggaataatgcagcacctactacatagtcggtaacttctaaataaaataaactctagctgggtacttctccctataaaatacatagagtttgagacactgcaaggccattatcctactaataacaatattttttaaaagctagaagctcatattatagagaacatttggccactgtagcatttcttataggcatttttttctgttgcttttttgagaaaacatagatatggtgctaaattaaatggcttacgttctgagccctcaccagtgttattatttattaaatgtcattattcattaaaatcctaataattcactaggtttttaaaaaattaaacacaggaccttgaaaaaattaaatttaaataagtaagttgaatattaatggagtgggaagcctaagggagtatgttctgaaaactagttatttatttattttaccaaaaaaagagctgtagttataaatagtattaataataacagtaataatagccagcatttattaagcattatccacattccaggcagtgtgctcagtgggttacatgcgccatttcattgcatatatagatgtgtgggaaggcattcatactggtggtcctctcctctctggattagctctctctcttatacttctttccccccaattacttatcccatgtagccagtactctgagaaggacatggcctcctccttcttgggaaaagatgcccaattccaatattcctgccctagaaggccccacaggagctgagaaggtgcctggaagacagcaggtaccaagcagatggatgaagcctggtttagaccttcagctggggagcaaggtcttcccatgagcctgtgtgtccagcatagttcatcaaggtcagagaacacacaggcatttaaatccaaagcccatcaagaaacgttctctgggagttctccactttgttcaagccccccagtcaaaaattctggtttcctttaatgataccccatcgatgataccacagagccatggttctcaaccaggggttattctgtccctcagtggacccttggcaatgtctggagacattttgggttgtcacagctgaggaagagaaaagtattaccagcatctagtgtatagagaccaggaatgctgctaaacatcccacagtacacagaacagcgcccacaacaaaaaactgccaaccaaaatgtcaattcaattaccaatttcagccaagaatatgaaacactgccgtggagtgacttagaaacagcacagcctttgggtccagacaccccgtccagggctctattacaagcagttgaatagccctgggcaactaacaatcaatcagtgagctctgcttttctcatctgcaaaccaggagcctgaggaagtcctctgaaaatccccttgcacagcactgcgaactcagcaaactgcagcaattatcaccatgactttgtcctcaaataaacctcgcaagccactgtggaatctccatttttctgtaggtgccaactctgggtactcactgaaaaccttacctttgggtaatgagttccaaaagacaaatctaattgatccttgcaggggactgaactcacaaccttggcctcattagcaccacatacgaatctactgagcaggacaaatgaagacacccaagaatcactttttcatgtaataacattcggcagctcactcaacacaatcaaagcacgtcaaacacaggatcagccctgcagaatcatgagtctcaaatgccgcatggaaccactgactctcagataccactgactctcagataccaccactggaaaagcagccatcacatcttaatggggattaaaaaccagaatacacaaggtggtgggggattaaatgagatcaggcaagcaaaacacccaagggctttgccttagacagtgttcaccagtgttattaccatcaatatcctgaaattaatgacacaacataggactacaccaaagcccaagagttatttatcagacatacctttgtgaaaataaataatagcaaaatagcaatgtcctttccacctgccttacttattcacataatgtctactcaggcttaaagacttagctcacacattatcacctataagaaatcctacctgatgagccctcaccccaggactggctgcccctctgtgtttcagtaactcactaggcttaccactatcaccactgctttcccactttattgtaattgtctctttttctttttccaccacaaatgtaggtacttctaatggtagggaatatatttttgttcatgtctacatttgcaacaggtgcacaggttagcacataccactactgaatatccatcaaatgtggactccatgtggttgaagcatggctgtattagatagctcttgcaacaaaaaaacactggcaccaagcccagtgacccaaaacaaaaacattcgtctgtgctcagatgtctgtatgttgtctggggtcaagctgaccagggtgtggcttagctgggcttaacttgggcttcaggttgggtccagatctgttccacatgactctcatcctccttggaccagtgaaccagccaatgtgtgtttctcatggcaatgaccaaaacacaaaaggggcaagcagagacatgcgctgcttcttacggcctgggtacagacacttccacctatattttattggcttaagcaagtcacgtgcttgacagcaactcaatgggtggtaaaaacatgctgcatctctactgggaataggtgtcaacttatgtggataaagggaggggtgaagaattggaaacagtaatctagtctaccatgagaatccttggatccaacgcagaaagctgcatttacacacttctagagtttgtgtatatttatggaatgtttatcccattccataatctgttatcaggagtcaacttctaaagccttcctccaatcttattttcctgttccaagcattagttttgaagtattttgaaagcagtgtgacatactcaaaagacttttgagtaggaggtgggggtcaggtgggtgggggacagccaagagccagcctggtgaactgagccatatctccaagctccatcctcatccacgcaccaaagggacagggtaacagaaactctcagacattctgtgatctgagtccaagggattgtggcccagaatcaacttcagaaaaacaagtgcactgtagcggcaagagtctcagagtcagtcctgcactcttacaccaaacacttccaaaacattcccagtgaagcttcaagttggacaatgccaggttttgctctgaaacacacacaacatagataggaagcaattcgctctcatttaaggtcaacctcactttttcccagggaagtctaaaaagattggtgtgtcaatcaaagtgtaaggcttaaatcttcttgttccttttgtaactagatagcatcgacattcagtagagtcaactcagccatacacagcttgggtctatcctctttcatggaaaaaaaattgtttttagaagtacaatgcacttacctttcatgagttcagaaataaatattttgtggttgatttgaaacagggatcagcaaaattcttctgtaaagggacatataataaacattttcagcttgtcgctgcagtgtgaaagcagctaccagctgtatgtaaacaaatgagcaaggctcatgaggtcgtgctccaatataactttagtcacaaaaacaggaggtggaatggattcagcccatgggccatattttgttgatccttgagctaaaagaatgagtaaatatttgcctaatgttctagaacattggtccatacctccaagaagcccaagaaaatgtacaaaattcaggtcatttttttggcagagtctgatttaaggaatgcctctgaacacctggtacttcatttaatcctcctcacgggtcgatgaaataggaaaatatattcccattttttgttttttgaatgagtctcactctgtcacccaggctggagtgtacagtggctcgatcttggctcactgcaacctccgcctcccaggttcaagtgattctcctgcctcagcctcctgagcagctgtgactacaggcacacgccaccatgcccggctaatttttgtatttttagtagagacggggtttcaccgtgttggtcaggatggtcttggtctcctgacctcgtgatccacccgcctcaacctcccaaagtgctgggattacaggcgtgagccaccgcacctggccatatattcccattttataaacgaagatactaaggtttctgaacttagtgatccacccaagatcacacagctagtacatggtaaagctgggattccaaccaaatcctgtgtaaatgttggttcagtagttttcaagaatcataatagatgttatcattacgcaccctgagcctaaaatggttacaaagaatgaccagaaaatgctaattttattctaagaaagtcaacagtgatgaattcaaatttatgagtaagctgttcattaaagccctttttacaatagtaaaatattgcaacaatctaaatatccaatattaaagggacgcttgagcaaattacaatataacctttgaaaataatgttcataagaatatgtaatgatattggaaatgttcgccataatgttgtttttcaaaaaactagaaaacaacacagtggcaaaggcatgactctgttgttttagcccttatattaaatgtataaaaagctctggaagaagacaccttgtttatcatcatttagctcctggtttggggacggcaagtagttttatttttattctttgaactcttggttttgccaaactgtgttcaatatacataaaattctataatctgataagtatgtctttaaaatgcaatttatccttgttttctattttttcttctattgttctattttattcattcttttcttataagtaagttgtccataagtgaacacttcaaaagcaacaattccatcccctggattcaaggaagaatcctatgcataatccttcacatgcatcatgacccagattatactggtgtttagaagggtgaagcagtggtcctttgagtgttcagacccagttcccaaggagcacagatacacctgaatcccatcttgggttgcaagccctgttgagtaaaaagaaaccttctggtttcaacattcatcctttttatgattattgccaaaaaatttttaacaaacattaatataatgcataacatcccagtaccacttgtgatgtgtttaataaattctgtgtggtttttacatagccctgagaggtaagcaatgagtcaggagtttcctccaagcacctgttaagtggcatcatataaatagcaatgtcaggaaatcaggtaccagaagaaccaggcttgagtctccagcaaggccacatgggagctgactgaccctggttaagtccctgaaaccctcgggcttagcaactttattcttttggtttttgttgttggtttttgtttcagtggtgtgatcatagctcactgtagcctcatactcctgggctcaagctttcctcccaacttggcctcccatagtgctgggattataggtgtgagataccagacccgtccagcaccctgattcttaaaccaggagtagtaaccacactttcaacacccacaatagaattacgaggatctaatgaaaatcacaaactatatcaaatatataaagggtgttctgccatgatggccaattataatactgggagtgcttcctgtccctaccacttccagatccagtttttttttttttaaatggagtctcactctgttgcccaggctggagtgcagtggcgcgacctcggctcactgcaagctccgcctcccgggttcaccccattctcctgcctcagtctcccgagtagctgggactacaggtgcccgccaccacgtccggctaattgtttgtatttttagtagagacggggtttcaccatgttagccaggatggtctcgatctcctgacctcgtgatccgcccgcctcggtctcccaaagtgctgggattgcaggcgtgagccaccacacccggcccagattcagatttttaaaaaacattgttatcttggaaattggttatctacttctgtactggaggaagacagtgtgtgcatgttgctgcacgtgtgtgtgtccatagatccttgtttcattcagctgtgcagcaacaggggtcaagtctacatgaaaacgactgacatattcttccagccactgccagtcttactgcttccttcaatcaagctttttggttttccataaacatttttcatgttttgcataggtattttaagtaaatttttgtattgaaattttgtattaatatatgtaaatatacatacagaaaaatgtacaaatcacaaatagattgctgagtaaattttcacaaacacacttcgataactgccagccaggtcaagaaataacatgctaccaacatcgcagaagctcccttcattgttctttccagtccacatctcccggctccttctcccaggataattgctgtcttgacttctatcactgtagatgagtattgcctgtttttgaaatgctcattaatggtatcatacgctatgttgttacctgtgtctggcacttttatacccaaagttgactgagattcacccatttcattgcaagaagtagttcattattcattatctttgctggatggtatttctttgcataaaatatatcacaatttatccattctactatgggctttggggttgtttccagtctttggttcttacaaatgctgctgagaacatttgtgtacatgcccatgagtaaatatgtttacccacttcggctagctatacctctaagaatgagataatgcttcataaattatgcatatatctagcttattagatctgccaaatttatccttccagtagcgatgtatgagagtttcagttgctccacatccttaccaacacaggcattttgtctgtatcagttaatgaatctggtggatgcatactgaaatatcagtgtagtttttatttgcatttcctggtgactaatgagattcagcacctgtgcatatgcttagtgtccatttgaatatcctccctggtaaaatgcctcttcacatctcttgatacaatgctttctttttttagagacaattcttgatttattcatgccaagacaagaaggagtggcagagaaaataaaaaataataggtgtttcgaaaaaatattttaaatttgtctttggattttggttttgatgctaaacttgagtaggaatttccttgaatttttcaaattcataataatgccatccatagagaagctagaaaaatactaatgaaagctgtcatttaccgagtcatctcacataaagtgttctatgaggacactgaggttcagagaggttgaataacttgcccaacactgaacagctactaagtggctgaaccaaaattcaaactctgtctggggactccaaaacccaggctcttgatcacctagctattcctcagcattataggattctagtccccggcttcagcatgctttagaatccccgggaggatcccatcctcagggttcctgattcagtagggctgcggttaggcctgggaatttgcatttctaacaagttcccaggtgattcccaggatgccagcccagggaccacactatgaaaaccactgttctgaaaggtggcaatcaggtctcacttatctctgtatccaaaggccccagtccagtgcctggcaggtatcagacatataaatgattgattactaaatgattcctactccctcttggtcctctgtctggcacacagagccatgccgctgtgacagctgtcagctaatgtgagtgaaacccctctcagtcctagaaaggcctgtccacaaacatgaagagagcaagaaactccacttatgatacggtttgggtgtttgtcccttccaaatctcatgttgaaatgtgattcccagtgttggaggtgggtcccagtgggagatgattggatcatgggggcagatcccttatgtatggtttagcgccatccacttgttaacgagtgagtgctcgctcagttagttcatccaagatctggttgttttaaaagtgccttgggcctcccccttctctctctcttgctcccattctcaccatgtgatacactggctccccattcaccttccaacatgattgtatgcttcctgaggtcctcgcaaaagtagatgttggcaccatgcttcctgtacagcctgtataactgtgagccaaattaaacctcttttctttatacattacacaggcccaggttttgttttgttttgtttgttgttgttgttgtttttgagatggagtttcggtcttgttgcccaggctggagtgcaatggtgcaatctcggctcactgcagcctccacctcctgtgttcaagcaattctcctgcctcagcctcccaagtaaactgggattacaggtgtgagccaccacacctggctaattttgtatttttagtagagatggggtttcatcatgttggtcaggctggtcacaaactcctgacctcaggtgatccacccaccttggcctcccaaagtgctgggattacaggcgtgagccactgcacccggccccctggtatttctttatggcagcacaaaaatggcctaatacaacttatttcttccactttcttttaaacaagaggtggataaatcaacacaaggggaagagtaaaactgttccctggcctggttgactgcatttgagcaaacatgcccatgacctatctcacttgaaacactttccacactaggtcttttagaatgcatgttgtggcagaaactgtcagtcatctcctcgaatctactctttcctttcttattgagtgacaagcaccatgactactttctgagccataagatacaagcagagttagatcttccagggagtcctcttaaaagagagagaacacgcccttttctatgtcttcctgctgctagaactcaagtagccaccttgggccatgaggttcagggccacaacccctctgaatggtagatgagaaaactggaaagagcctgggaccctttcaactgtaaagtgccacaagaccagctgcattgcctcttctgtgacaagttttacaagaggcagaaatcaatttttatcttgtttaaactactgttaatttgaaacttctctttaatgcagctggacattatcctaactagtacctacaggcactatgacccagctgaaagaccaccagatgagatttagccttcctcttttgtagtatatcttaaggcaagtcacttcagttcctgaggctcggtttccccatctgtaaaaaaggaagaaaaatgtgtgttgccattgattcgaaaggcttttgtgagacacaaatattaccttgttcagacatgctttatgaaatacagagccctatgaaattgtgaaggacttttatttccgacaaacaaaggaatttttaaaagagaaaatgaagtaggacaaggccttttataagaagtcttttctaattaaggagaaaggactgaactggaccaacagcttctctgctcatctctgccaagtctcctctcccaattccatccaggtcattctttattttccaaatgggaatttaattttgctctaacaccattattacatccaaattaaatatttattgggctgactatcaattgacttttagaaataaagatttgaaatttatgagctaacagagtaattcgataattgtaaatttcacaaccgagctttgtaatcaattactgtttagtaatgatataaatgcatgttcttctcaggagaccccagtcaactataaattagattctgcacacataacaatctggcaacatctccacactggctttgtctcttctcgggaggaaccaaggccaggaaataatcccgggctggctttccctggctgtgcatttggaccccagttcacccatcagtcaggctgtgctgagactagacttaatgagtagtcacacaaaacataattcagaagataaatcacctgcacataaaacctcacaatccaactcaaagagacgctgtacaatgggtaggtaacagagacaatctttcacgcattcaacgatccaacagatagctactgagtgcctactatgtgccaggcacctttctacatccgtgtagaaaacaaagatacagtcaccctcctagaggatgagaatagggtgcaatgaaccataaacaatacatgacagaaataagcaaattacactgggctgactttaggaaataaagatttgaagttcatgagcaaacgtggagtgtgaaaagactggagtgttagaaagtcataaatgctatggaaagaaacagatttttgagataagcattgtcctaattttatgaataaggaaattagagctcaaagatcaaacttagaaactaagttagatttgggaaattttttttttttttgagacagaatatcactcttattgcccaggctggagtgcaatggcacaatctcagctcactgcaacctccacctcccaggttcaagctattctcctgccccaacctcccaagtagctgggattacaggcatgtgccgccacacctagctgattttttttttttttttaagtagaaatgaggtttcatcatgttggtcaggctggtctcaaactcctgatctcaagtgatccacccacctcggcctcccaaagtgctgggattacagttgtcagccaccgtgctgggccagatttgggatttgaactctgaccttcctggtgccaaattccaccctctttctaccacccacactgaatgaatgaatacctgtacacaagcacttttgacctcatttctcactgactgcacaatagaaaaatccctgttaataagctccccccatgtaagagactctcaaactcagaaaataaagctaagactaaagaaatgctctatagctagactggacgttagcatctataagcatccaacttgcttaaatctagacttggcttgagcaaaacttgtattttaattttgatgtgataaatgctagcattattttcactatgaaaaaatgttcaagcaattgtgtgtattactgttcatttgaaacccattctttgtctttgcaggactggccaactataagagaatgcattctaaattgagtttctattagaagtaagcatggtcaaaggggattctgaagccctcagggagacctctgtcataatccacagattctggtaattgattagagagcttttaagtgaacttgctgattacattttgaattcttttatattaattattaaaggcgaattatgttgttgaaaaggaaagccacagaaagatggtaatttaatcaaataggttagagaggcattctggataaggtaattgattttaaaagtgaaaggcatttgggagaaggtttgtcaaaaatggatttaaacaactgaaaactgtgtacccaatcactgtttgtgtattgcttaaagatgaaaagaaaggaccgggtgtggtggctcatccctttaatcccagcactttgggaggctgtgaggcaggcagatcacctgaagtcaggagtttaagaccagcctgaccaacatggtgaaaccccgtctctataaaaacacaaaaaatagccgggcatgatggtgggtgcctgtaatcccagctacttgggaggctgaggcaggagaatcgcttgaacctgggagatggaggttgcagtgagccaacatcacgccattgcactctagcctgggcaacagagcaagacttcgtttcaaagagaaaaaaaaaagaaagaaaaaaaaaagattaaaagaaagtcattgagaatttggtaggacctgtccaaataagaagaaaaggaagttttgttatacttgtaaaatgcacttgcccactgttatagtcaatgcctgactgaacaatccctgcactgctatctctttataattttcagtggatgagttcacacaagaaaagatttcacctgaactctgtagttttcttcaactgtcccttttcaacaaagatgctaagacttcccaaagatacaaaaagatgttacaaaggtcagagcccaggcttgaaaattactatattatttaaagattgaaaaataaaattttgttctcttgagaatgacaccaccccctccagccccaatatccctttcagtctctcctcaggagacgaggccaccttgtgatagtaatagtaatagtggtagcaggaagagcaggaacactgcacagagtggtggtgcttcccaggagtagtaaacatccatagagtgcttcttctcaacctgggtcccagaatcatcccttgaaggacatctgcccagaagcaacatcgaaacggaatcaactgcattggattctgcgtgaacaagaaatagacttacgattattatttccaattcttcttttcattgccacaggaaatggaaataaggcaagggtgaaatatttgtggggtagatttacttatgattgtaagctatttttcccttctttggattcctcctaatccctaaacaagaaaaaaaatgcaactctaaacatggcggccgggcgcggtggctcacacctgtaatcccagcactttgggaggcaaaggcgggcggatcacaaggtcaggagatggagaccatcctggctaacatggtgaaaccctatctctactaaaaatacaaaaaattagccgggcgtggtggtgggcacctgtagtcccagctactcgggaggctgaggcaggagaatggcgtgaacctgggaggcgaagcttgtagtgagccgagatcttgccactgcactcctgcctgggcaacagagcgagactccatctcaaaaaaaaaaaaaaaaatagctaatcagaaaacacagccaggaaacatcaccaccctaatgcacctgctaacattaataagagccagagaagcccggaggttcaataactcccagcaagctccttggccatcctctagccatgttcctgcagccacaaacaccagccagaaaaggagatgcaacagaaagcccaggccatcacactgaggcacaactcagtgcagacgcagcttcttatggccaacctgggcccagagggatgttaaagagcccaggttggtgagtcatggacatgtccttctccacctgggcattccaaagagaaactctttttggaaggaatttgcaaaaagaaaagtaggagggtatagtttctacaataagagagcctagggccttgctgtttctgatggtgggtgaagcccattccttccatgctagacttaggctaacctctacctttcacttggttttgatgcatggcattttgattgagcgattttcccaattttcttcccatagctgcaaatctggatacttggagatactgctagttctttgatggtgacaactgccatggaataataagagcttaacaaaaagctactctttccatagtagcggttatggctttgattggagtgatactccaaccatgagcatgggaaggcagggttagttagatgtaacttacaggaagaagacaaagatacccactgtaagagtggtgagaagcagagcaagtctgcatgaagtaaacatgttagaggcagatgaagccagcccaaggcccccatttggacaactgggagatgttcagttgaacacttacggacataaaaaaggacaaacagatacaaagaaacgtcagaaaatttttaataagggaagatgaataaatgaccaattgttgactgatctgcactcagtcttgtcttggaccaattgctacatctatcctatctcatattacaaaacgcagaactctgaaaggttcaagtccctacgacaaataagcaatttgttgctcttgacagtcttggagttaccaacccattcttttggcctgccccagcacaaccactatgggggccccaaaatagtcaggtgaaaaggacagaaggcagaacagcacttccactgggtaggtcaccaaatgagaaagttccagcaatgagaagaggtttcctaatatcaagaagggatgcagagatgcaccagtctccccattattaccactgctcctggccgaatggacttgggctttaggactacagaggtgccaaacccttggcttcactggccttcagcacatttgaaagacaacaaaaaatcagacagcaggctaccagctgttagcccactctgtctggctgggtttcaaagttaggaggtcatctgtatccttctcccacagctgcccacactgtaagctgagggaagatgccccaagtcattctcaaactatacctatcacccttcatcacaattttaaagttatatttattcgtacatataaagttatacacacatatatgtatacagtacatgcatgcgtgtgtatatatgttttctatccatctggcctacaaagctataagctccttgaaggtcctgcatgagggtcctgcttgttttcttgttgtattcactctcatctagccctaaccctcaccaggtcattcataaattagttcagttaatgactggacctttagttttagagcctgactctgcccaagggggtgtagggggcatagaggccgaggtataaatggcttccccagcatttcaagtaggctctaaccatcactgtaagaggaaggaggcagagtcctgatcccatatgtcaggaccaccgcctgtgatccttcacagtgtgccctgcaaaggagcaccaagccacgaggacaagagtcgaattgacaggcccctctccccacatttagctaccaggggctgcatccgtgaagagggagtacttttttccagtttgtgcacatcgcgtggctagtgagctctgcctgccacaccctttctgagcccacaatttttatactctgatgaaaaaagtgactgatgtgtgatcctctgtcaagttcctctcttccccttcttaccaaacagaacgctgcctttagactcagctgctcctccagctccactcccctccccgactccaaagagttctttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactatgcccggctaattttttgtatttttagtagagacggggtttcaccgttttagccgggatggtctcgatctcctgacctcgtgatccgcccgcctcggcctcccaaagtgctgggattacaggcgtgagccaccgcgcccagcccaaagagttcttttcgggagattttgtaacacagaatcaagaattcacagagagacctagaactaaagaggcaggagacacaaggaaagaatttaagccaaaacaactaagttgatctacgtaacaaaaactatacaagtgggtaagagcaggaagaaaaaaagaaaagaatgttgtgaaaatatatatttggattcccattgatagtcttgatgatgtgagtggataagtgaatgccctcttcatttgtttgtgctcctaaaacacaaccgtcattcagagactgaaccacatgggtttatgggtttataagtgttatcttttattgagatggaaggaggcaaatcccagaaaattagacagacactggggaaaagtagaaaacactggaacatattgtcttttcccttaccccaccccctacccccagaataaagtgcaccaggtaggagcagaaataaaaagaagccaatatttattggtaccccctggtaccaattcaaggggaactgtttaaaggccaaacccatgacctacacaacagccacaggattcaagagaacattcacctaccacactcacgaacaatgcaattgcctcgtttctcaataaacatgacttctgaatagattcaatcctgttcacagaagaataaagaaaaaaaggaacttattttttacatattgaaaaaaaattggggtggagaactgcatgaagataccctgcaggtatatgcctctgaaaataatctacagaatccagaagaaaatttcaaaaatctgttcgtcatgctgaaaaagaggccaagggctctgagagtcagtgcagagagtcactgggagacataaggcaaacacgaaaatgtaacaagatttggtgaaataaggaaggattttcaaaaaaaaaaaaaaaggaaaaagtatgtatggtactaaaagcaatatctttttaaaaaatcaatgaaacggaataaagctcagaaacaagccaaagtataacaagatcaagtcttcagcaactggtgcagagacagctggctaagcatctaaatacaaatgaagccaggatctccacctgacgcctacaacagtttgaccatgtgtcaccagtctgcacctatcaggacgcaggtagaaacacattaacagtagcaattcaataacactggcttctgtcctattgctgatttagcacctccagcctctaacaagtactcccaagtatgcctgggcatccccaggaggtgtttcatacaaccacacatgcatccaccctccacagcttcccatcagacttggtccccacaccactgtgctgagccctgacacagcttcagggaagcacaggtgtcctcggatccttccaaggacaagcttcaaagtcattcatgccaaaattgggaatcacacctccactcttgtccctgctgggtaattccagggcagatctgctttttcccagtatgcaacagacattagtaaaatgactttcatgctgttttcacgttttggaactttcaaatgtttctgtaataatgatatattatttctataataatttgaaaaatctgacttgacagaaaataaaacagaattttcctcgaccaaatttgtttttaaaaagttacttacttactttctatttcttttaagtatcctctgtcttgtcaaagaattattcctcaaagaaacattcaggcctagatggattcataggtgatttattcagacaagcttttatttttcaaacaaagccagcataatactgataccagcatttgacaaagaccaggaaaaaagagctcaaaatcaagtaacttatgaacataaacaaaaatcctaattaagcacttagcaaatagaaattagaaaaacattttttaaaataacgcatcatgctttaataagattcatcccccaaacacaggctatcaaaataaacaccatattagtaaattaaagagtaaacattttatagtaaacttaatagataccaaaaaagcatatactcattcctcatctatgcctgagctaataagaaaaaaaacacatcttgataaaatagaactcttgcttaactcaatgaaaaatttacacacacacacacacacagtcacaaccatgccacaaaataatcagcacagtacttaagggaaaaatgctagaagtgttcccattagagaaaggaaaaaagcaagaatgcccattatcaccattgttactgaacattgtactctgagtgctattcaatgcaattagataagaacaaaataatataatgaaaaagagatagtaaaactatctttacatgtagatccttgtatatttgaagaagaaccaactaaaaagcttatagaaaaactaagatttcagtaggtggattttaaaaaaacataagaaatcaattgctttttaagccaagaatagaaaaaatggaaaaagatatttctcaaaagagtaaaaacaaaactaaatatttaggaatgaattttacaaaatcacccgtaaccctggagggttttatcagaggacaaaaaggaactactgaattcagtgaatatgttgttcttggatactctgtaatatccaatgttgtgatactgcagacgtaatcccaatcaaaagtctcaatttatgaaccttgacaatatgactccaaagttcatctggaagaataaacacagcatgaagaatcagaaaaatctaaaaatatgattattttaaggatttgaggagacttctcctgtaaagagtaaaacataatgctgtaatgcaggaagagacaaggaaatataaccgaataaaataaccaaactagacacaggccaatatggaaatttaatataagctagaagaggtatttcaaatctgtaaggggaatagagagaatacaatagatgatgttaggacaacttgatagttatttgcaaaacttggataaaagatttaaaagctttatatatagtttatatgatataatatgacatataattatatatgagtaaaggaaaaggtaaagtgttttatcatcttggattggataatgcggttcttaacgtgaaaccaagttgagaaaccaataactactttgattacataaaaaataaactgggcagaaagagatagcataaatagtttaaatacaggtgcttgcctggggaagaggggcggacatcaactgaaagggagctcaatggggggttctggaaatgttctatatcttaatctagatggtggtttcgtaggtgtatacatgtgtaaaattcgctgagctgtacagttaagatttgtgcatttatcatgcataaactattcctcagtaaaaaagaaaaaataataaagaaaataaatcatgcatttatacttcctttcccataaagactacatttcagggtaagaaagacttcggactgagggaaaattcttcttcatgcaagttacagctaagaaagacaaaagggatgaaagaaatagaaactcgttattttgcaattcctactgaagtaatctggacaatgtcaatggttgttaaaagcattagagtgctggccgggcacggtggctcacgcctgtaatcccagcattttgggaggccgaggcaggcggatcacgaggtcaggagattgagaccatcctggctaacacacagtgaaacctcgtctctactaaaaatacaaaacattagccgggcatggtggcaggcgccttgtagtcccagctacccgggaggctgaggcaggagaatggcgtgaacctgggaggtggagcttgcagtgagccaagatcccaccactgcactccagcctgggcaacagagcgagactctgtctcaaaaaaaaaaaaaaaaaatagtattggagtgctggttctgaaacgctagcctgcatcagtgtcagagggtttgctaaaacacaaattgctggctcccactcacagagtttctgattcagtagacctggtgggggcctgggaactggcatttctcacaagttcccaggtgataggtgataatggtgctgctggtccaggcactacactttgaaaactcctgcattagaaaaaagactgatgttgaaatttataatgggtaaatcaggctgaaaacacctgaacttacggatcagtctgagcttcgattccacgggacatggaggaacagagggacatgataaacaccaccataaagatatagtcagccaaatccagtatgggaaatctacagaacaaataacccagagtctccaacaaataaacacaacaaagaaaaggaagggggagccgttatagatcagtttaatttatttagaagtgaaaagacaaatttagatactgacaaagattctttgcttggccaaactttagtcaggcttctgaaccttttccttggcccatctgtgtacttccttgtaaaatccagctgaagaaagagtgctgctaggtcagtttagcaagaacttcccacctttgctctctgatctccctcacttgaaatctgaagtttctcgtcctccatcaccctggcgtgtcttcaggaagagtcctcttaggtcagtttagccagaattccccttacccctcatgtttcttcctggtaattttctatccactgatccccaccctgctccttggctataaatctcctcttgcccatgctgtattcggagttgagcccaagctctctccccaactgcaagaccccattgcagtagtccctatacccatcatgatggccctgaataaaatctgtcttactatgctttaacaagtatcactgaatttttttcttctttaacagggctgattcaaactagctacctattttctaattgggaggttaaagaaaatttggtggtattaatgaattgttgtcagttttgttgtctgtgataatagaatgctgtttatcctttttgacatcctgatctgttagactaagggtttattaacctcagcactgttgacatttggggccagacaattctttgacgtagaggactatccaatgccttgtagggcacgtaccagcatccctggcctcaacctgttcacgccagtagcacccaccgccaccattcccagctgcaaccacccaaactgtctccagataatatcaaatgtcccctggggagggagtgcaaaactgcccccagttgagaaccactgagttaggtatatcttctggaggatttgcaagtgaagggttatgtctggggttttttgtgttttaaaatactccagagaaaagcaatggggagtgagagtaaatgagatgcagctagaaaggcacgatgctgccaactgtcgaagtggggttcagagtgtacctgggtgtcgttagtctattctctgtgttttaatatatgtttgaacacttcttaagaaaagtgtttacaaaaacgtgaacacacataaaatcatgctgtagaaacatgtttctgacagatgttcatgatagtatgtggggaaaaaaaggaacagatcatgcaatatgtacgcggtgaccccgtttggatataaaagagacacagagagaaactcagaagagagatgagtcaaaatattcacattgatggtctcctggtggttagaattgtgggtaataattttcctcttccagtctgtagttttcaaagctctccatgtgaacatttacctcctattcaatgtagacaaacaaataaaataaaaactaacaaagaataaagggactgttacaaagaaacacactgttggttgggaaagaaacagaaagatccttcaaagcaaacacaagatcttacaaagtacaacaataagagaccactgagtgtagtgaccaagatatcacacagcccttaaggaaatgctgcattaaagaatgcaagttcattgacagtgtattggaggcggtggggggctttcgtctttcctgattctgaccttgaggcatctgaattccacttgatctcccctgtttcagaaggcagagtcacatggaataaattttagaatgccttctctctaaacagagaatggtgtttttcctgccaggcaaatgtttaaactaaaatttttaaaataatcacttggtgcttaaatccacagcaaagtggaaatagtcagctattaagctagtctcatgcctcaaaggttctgggcaactggagttttgctcttctgcttttcaaagccaaatataaattatctgctatttaatcacctgttgctatggctcacctgagcagctgcagcccggctttagcacaagtaattaatggcgagccagaatacccagttttatgaatcattctgtagcatctggcctaaatgtcagtttcctttccatcttaaactttcccatagtctgctgtaaattcatctccgccttcactagaacatggaacccataaagaaatttgcatgttgcctccttcaatgctgtagctttactgcctagaagaaagcccagcacatagtaggtgctcaataaatgcttgctaaataaatgactgaatcatgttttccgcccctttcttgatttctggccttccaagaaaagaacaaatgttctaataaatacgaaaatttattatttctaaggctaccaaatggcctgaattatcagcttccttagactccagtaacatgctgcttacctgtatttttggtgagtgaatgaaggtattaacacagacctatctacccccatactacacacatgcacagtacatgtgcaacacacacacacacagagcactctgcaacaccctcagacacctccacacccttggacctaatgatacgtgtattttctgtttactccctgtgcctcagctagtaagcgcttgatctcattgtcttcctaataaaatgaattaattttcagagttaaaattcatgaggcagcatatgtaaagtctgtgtctataactgcttctgaattccctccagctgcggacatttttattctgcccacaaaggctcccgagtttatttgaagacgtttctttgtggccttccccagggtccccagcagcccacagtgggttttgctgctacttccagacatttcctgtcaattcactccagtgtttggcaggagaactaatgccagattctagaatccaggctaactttaagctaacaatctccttccattcccgtctcctggtcttctacctgtgactactcaggtcccccagaatgtcactccaaatccttcctaaccaacccttagacatctagtccaacctcctcctgaggagaagggaaaactggggcccagaagggtgaggcagcatgttatgggtacatggtaagtgagaagcaatgcagggacaatgacagaggtctcctgacccccaagatgtcagtgttctttctccagagcaagaatcagcaatttacagcctgtgggccagatctggccctctgcctttttttgtaaataaagttttatttgaacacagccatgcctactaatttccatactgcctgtggctatttggggctataacaacaggactgagtagttgtgacacaggccatacgaactgcaagccttaaatatttgctatcttactagttgcagaaaaagttagctactccttctagaagggtcaaaagaacaggaagatggatgggaaagggctgacacaaacaccccatggaaaaccaactgagcctctggctgttctcctcacaggaggccggctccacaggggaatgggaagatcctctggggcggcaccaaccatttccctgactcctcttcccccaacgctatagtggcctctctcctttgcagagactgcagccctatctgctggcaggcaccttaggctgaccctgccaacacatgcacacatgcactcagacacacacacgcgcgtacacacacacatgcacacgcaagctgagttccaagtgtgacatggctgccataaatcagcctggaatattaaactcaagctgccatgaaagagcctctcaactccacagcacacagaagaccaagaggtatgggacccatcttcagggaggaagccttttgcagttcaattcacttccccgggttcaagttttgtctaccaccctcgccagctgggtaacctggtgttacctaatttctcagcccgtggctcctcatcaataaaccaaagctgacctctgttgtgaggattcactgaagtgatgcttgcagagctccaagcatagggcccggcacagagtgagtgctgagtgggcactggcaagaggctctctagggattgcccgggctctctggacaatgcaaggcatgattctagtgtccagaacagcctctgacacacagggtctgaaacagccttctttattccaaaagctcagaaacccaaagctaaaagccaaccgagtaggccagagccaggaggcccaggccgccctgtttggctggaacacccgggctgccggcgtggctcggagccagcactgcaggcaggcagccttgacttcctccttcccagtcctgatagacatgagccatgcgaccctgggcaggccaccctgtctccatgagcctcagtttcctcatctgtcacatgataacagcatttaccccacagggttactgtgaggactgagtgaaacaaaatacccgaggacctttgtaccgggcacaggtgggcccctccataagtgagtcactgccactgtcatgtaacacggtaatagttcagcctgggaatgtcttccacagtctgaccacagaaccccctcacctgtgacggggtcactcgcatctccgcccactctacccggggattcagtctaagtggagcctccctcttacccttcccagcctagcctcacgccccaccagtcccctgccacagccacacatacctggaaggccacaccttgccactgaccctgttcccacatcaaatgattttgtcaacatgaaaccaaaccacaaccaggtggatgcagagcctctgtcacactcagtccttgctcctcagtttccttcctgtgtgaccatgggagagtcattcaccctctctgggcacaaactcaatcatttgtaaagaacaggcttcagatcagatattcaagttccttccaccttgagaaacactgcagagattctactatgaagccctaatgaagacgccccatgtaactggctaactccaatgtcaatttccacccaaatgcatccacttaatctaatagagaccgcatggtacaggcaagaagtgttgctttgctaacaagaccactaaaggcctcagctggagactgtgactttatcaatcgtcctggcctcctccctgtcttgtgctcagtctcttttgcacgtgtcttctccccactcgattgttgttaaatcttgatttttttctgttttcgcttacatggaaccatggggcttttccagctctcctccatactccctgtgccttcactctctgtggcttcttggtcagtttgatttttcctgaattagaattaaaggccttggagaagctccgagcagtgcaagtcctgggagaccacgttccaggacaccagaccttgtttagtattgcccatcgcagtgtgaacactctaacaacaaagaacttgccacccgcagtggcagtccaccccatgttcacagcattctgaggctggaaaattctaattttctaatggcccgtccctcgacagcaacagaaggcagtgtccgagggtcccctggagccaagccagacactgggctattgatttacctatgagggagggaggtgttcttcctctcccaagtgtaaagtatctaaggtggcccaagctggaaaacggtcaccccaggcctagaacgcacattagagccccaagttggtgttcccaatggctctgccacgtggggccctttctcctccttctccagggatttagaagtggagcagcatcggcatctgggcctcattgcagaatgaggggacaaaaggcttcttgtacgataaggagacaaaagcctccaagggacttaccacaaaacagaagcaatattttaaatgctttttagaacatttgcatgaagataatccagaagtacagtgaaaaagaaatacaaaagatttgcaatgaaatctccttcctgtttctgaccacaggccacccaggccccttccccagcgtttattacaatcagtttcttgcatttcctctcagtgataatttatgcaaaaaactacatgtatttaaatatgtgtgtgtgcatatccttttgttttacaactgataaaccagaagacaaaattctgtacctcgcttttttcaattcatcgatcttggatattgttccattaatgcttagagaactggtgctttctctttaatggtatttcacagcatggacatttgcctcatgtctagccttttgcaagtatgagtaaagctgcaataaacatcccagtacatacatttcctgcacatgaacacacacacacacaaaatcagataaaattcctagaaatagaactacttttagatggacaagagttagcaaacctctgggtagtgtgtgtgtgtgtgtgtgtgtgtgtgtgtgtgtgtgtgtgtgtgtgtgtgtacatacatgcacgtgtgtgtaagtacatgcatgtgtgtgcatgtagtgtaaagtggttttgggtttttttaattaatacaatgggctgagatcttctagttgtagagtattagagctaaattggagctcatcctatttcacttcatctgcttttctttgagtctgttgttcctcaatttcatccacacttttggttattaatgcccccattcagtgtttcagattcaccagggcttcttaagccagtttacttttttgagacttaatgcccttacagagccactgtgtgtgaaattatcttttacaatgctgaatccaagcagtttatagttttcagtcaattactcccaaccaccagagctgtgctcaggataacatttctggctaaatttcttacttcttggatcatgaattctcagacactactaatcctggtgtctggtgagtcaacatattcggactcacactcaggccaaagactctctccaaacttagaaatccacattcaataagccacatgtgcactggaaaattgtagcacaaatgccaggctgataatctcgataatatttcacagtccctgataaagagctaacttttaagaaatcctgaagcaaaatcatttataattttttaaatttccgtggctaacaaaaaacaaatcactggtcattaattcaaccatgtcagttagctctggctgtataacaagctacccccaacattcagtggcttcaaatcgccaccacttatttaccttatgattctgtgggtcaatgctctgagctaggcccagtcgggcagctcttctgctggtcgtggcgaggctcagttatgcatctgtgatcagcagctgctcagcaaggtggctctgcttctagggatggctggttatcagctggggtgactggggcaaccgggccatgtatgtcaacatccagcaggctgatctgggcttcttcacatggaggtgtcagcagggaccccaggaatagcaagtaaacaagccccagacacaagtccctttcaaacctcaggcagtgtcacatttgctactctcccattggccaaaacgagccacgtgtccaagcccagattcaaagggtagagaaatagactctacctcttcatgggaaaatgtacagtgttgcattgcaagggtatggacagatggtaaggggaagaattaatggccatttttacatttatcacatcaacagtgtataaattcatcaaacctaaatagtatttgtataagacttcgcaataaatagaacagctctcaattactctctttattcccagaacagtttcttgaaacaggatccacataaaagcaacacctggagagacttctagtgcccgtggttgagtatccacagaaccattccaagccatcctacaagttagcattcaggcacccttgatcagatgtggtgagcctccgagcagctttccttaagaccacagacacacagaagaaaaagcatgcgacgtggagtacagaagactcaagtctaacctcaactctcaaagcaaattacttcagctcttctacatgccatctgctccctcatttgccagcaggaacagcaggaacaatctaagaattgctaagaggactcaaaggaatcatcctatatgcccatgccctaggcacctggaagtgcctggaacagcacagcaaagaccttgaaacagtgaatcatgcccaacgttctaaacggacttgaatgctcaaataaaaatgacagatgtgagcaggaggctccaaggaaagacaaggttgtgagccagcacacagaagtgggagacagaaccagcctggccacagggcacacgactgtcccccgggcaggatttgaaagttgaagatggcagaactgcatgttctctgtaccctctgtggaagcagccaggtcttggatctgcacaaaacattctctcccctcaaagaagagtgagtcccaggcatgtctttcctggggaaacagccctgcctgacctaagaaaggcatgtgaatctatagggccctattaagggcctgaagaatcgtgctgcttgctgtctacagaaggaaaaaaccatcccccatcacatatatttcaaggtaaataacaagagctatagctacaatttgttgaacagccatatggcagaacctgttccagtcaacccacctacattaaataattagcattcatgctgcaattatctacccaaagacaactgtgtgcctatggtgtaccagattccacccaaggggcaggagaagccgtgttgacatggccataccaggcatggtaactgcccagtggagtcttacagtctggtcacaatcattaatgctacagatgctgcctctaccaacagaaagagagcacttaacttttatgaatgagcatgagcactgcatgctggactttgcacacattatttcagtgactctccacaattacccttgaagtaagcatcatcatctccaccttacaaataagtgaactgaggcccagagaacttgtctaacagcaacaggcagcatggggctgagctggattcaaaccgggggcaccttccaagagaccctgccctgccacggctcctcttctccccataaggaacggtgttgatgagcaggacaatgttcaggggtggtgatcagaagcctccctcctcttcaccctgggttactcccaacaatccccctacctgatcttcctgaaactcttagacaaaggtaagtggtgcccatttctgctatccctctccctcctcccttcaactttccagagtcttcagcaaattgatctaataaaaattcaacagctcactggctctaaatctcaggtctggttttttaactgcctaaagggctcacagggttgctaactcggcccttgaataaaatctaaaacttacacacttgtgcattcattcattcaacaaaaacttaccaagtgcccaccaaatgccaagcccagcatgacagcacctaggtaatactgaagaggtttacacaggtaaggctgggcaccacacatttacagaggccacattttttaggtctgagggacttttctctagcagtatctagccacctgataaaagggaagaaaagagaaagagctgtgtttgtccaggtgttaaggttgagatagagatctaaggaaagggtactgggattccaaaaaagagaatggtggatatgatatctatggaatccaagctgatctgggaagcaagtagacacagaaagaggcagacagacagcagaatcaaccaagggaccttgcttgatgtgggcacttccatcaaaaatggccattcaactggagcaaacaagaccagaccaggatggtgtctagagttcacataagcagcaatcccacctaacgcatgagtgccttctatagggtcacaaggtgctgctacatctggtaacaggaaactctccaccttccaaggaacccattgccaagtgagcatctgcctgctgggacttttgggttctggttcttccatccacagctacatagagcaagggtccaggatggggcaccatacttccagtgcaaccaggctgccctcggcccttctcaatgcacagatatccatccacttccacgattcagtgatcaactttgtgccaatggctccaaggtctaaaatttcagcctctatccaagcttcagactcaaatactcaactgctcaccagacaccctgaccacaacatccctgagcactcacactctgaatgcatgcaaacctgagctcgtggccttgtccccatatacccaaacactgcattggaggatggatcctacccaattcccaactgggcaccatccttgatctctcttcccaaaacacacaaataatcaccttcctattcattcttcctcctaacaggttctcagatacagccacctaatcccttctatccccactgcaatgactcccaacaaggtcaccaacatctctctcctggcattattatctttctcagggaagttttcctaactagtcttacttctaccaccttacccactctatccattttcctggcatggaatcaaaagtgatgtatgagtcaatttttatgaaatgtccagaataggcaaatccatagcgacagaaaggaggttaacggttgcctggggctggaggtagggtgatacagggaatgatgctaatgggtacctggtttcttttgggggtggtgaaaacgttctaaaatggattgtgatgatgattgcacaactctgaatatactaaaaaccgttgaattaaaaaaaaaagtgatgttttcaaaaagaaaagttggtcacaacacatcactgcttaaaatttataagcagcttccactgctctgggaatgcagtcatcagttacccccaggatctgcaggatctgaccattcaccccactggcctcacctctgatgctacagcatacctgtcaactctgtgctccagccacattgggcattttgttcccacaacatgccatgctggctcacctctgagccacagcaaaggctgttccctctgcctcacccctaccctctgcttctaatgaaacactagacttctcctctcatggtatctcctgctgttttgtaattttctgcccatttatctgtctccttccaaaatgtctgatcaacaaggaaacatgtctatgttgttcaccaatgtctccctagtcctgacacataggaagccctcaataatctactttatttatgtatttatttacttatttctttatttattgactagaataaagtagattattgaaggtttcctatatgtgtaatcctttcatctactccaagcttgttgaaagaaagcaagaatttccaactatcaatcaccttcactgatctgtttcctatatctctattaatgcagccccaaatggcataggcttcttaagttgccacaattcacttcagatgcacacataatttccccttgactgaagaactcaaggatttttctattacatactgttaaaccatctcatacccaagcaattctccaatttaaatacttgctgcaggagtttcttatcaagacagaaagaaggaaagcccattttcaggatgaaaaagagaatgtgaacactttcagcttccatttttatctggttcagccctggctcacagattaatttctggcaccaggatctgggaccagataacagagaatcacacagaagagccttctccagctctccaaagccagcaagaatcactcttttcacaatcgtccattttacaatgtgtctaattataactgaataaattacttctgccattctgcagaaatacttaaaataaatagctctctttccttgaattaaaatcatagtcttttgttcactgttttctgttccataaagcaacagagtctgttgattaaagatcatttataggacttcgttttcaatcttttttatgatatcactttaaaatacccccaaatattcagctgcaaggagggataagaactactggaaattggctctttgagagtttttgatgagaaatgaagtcgtggatgtaactctcagcgaatgagcatatattagaaaagtcgattttaataactacttggttcttcttcttggactttttttctctacccaacttcctacatttttcttgagattacaacataatccccactgacacactaaatattacctctctgtattgaatggatgacgctgagacaataaatcactttgagctaacacaatatgccaaccagtcccagctaagccaaatatttgacgaaagacatacaaactgaaatttagcaaggcaggaatgctttggggattatgtcctgaatatcaaccatctctagaccctatgtagtgaaaaaaatagatgttcaaggaggccatatgtgaatgcataagatgattctgtgttcagaataaccacagttagccaattccaggagatatcttgggatgagattgtgattaggccactctccaaacactagtggatgtcacgacaaaataaagactcttcacttctgaaccaaaaaaaaaaaaaatcaccccaaaacacataaactattgttcttctgcagtggtgtagaaacaaacatgatgttgatgaaaaagactgtctgggggtactgagcatgccactagggaagctgacacctcgggtcctctcacttgcatgggcccctttcaaagcccggtgctaatttggtatctgaaatgctgtcttctttttcttaaagtgggcccctgaattgtgcacacttccacaaaaccttccagagctgcccctgtggaccctactttagaaggattgaaatgggactccagagatgccctcagctgtcaatacgatggaactatattcacaggtcatcctaagtcccctaaaaggaagacagagcatctctggccagcagccaaggccttcccagggcagctccagtgaacttctctgactcccatctcactcgcccaacctgccttccactgaagcatcagtgatcactaaccagcttcatccactgtcatgtttcactagagctgggacctcagccaagcatgttctacctcatgtcttctctccaggtacctctgctcctccttcagaacctactcgaggggcatcagctctaagaaacctgtcttggtgcccccttcccccaagatgaaactgtgtcctcctatgtgccctgcagcttggagcttagtaccttccctgggtctgaaatgtggctccctcacttactagaaacctcccatgcctcagtttcctcatcagcaaaatggaaagcaacagtactcccctcataaaatggacacgaggataatccttgttgcacagtagaaactcaataaacgccaaccatcatcatcatcatcctacacatcgcttcgtcagaaatccctcaacaactcattctacctcccccatcagaccagggacttctcaatagcagagatggaagcccctgtgcccagagcctggtgctccataaatgtttgctgagcacatgaaggaattaagtaatatttatattatgaccaacagaggtaaaattcaataacacatcccacagcctcttgtttgctaacatttcaagtctatattggagaatttgatgaaaagcataagaagacagaacagggagcaaaacagctctgcatcatgtttctctgtctattcccaagagcatcccttcttcatcatgggccaacagagcccagagctgctagctgtctacaaaacccatctcccaagggcagcttcattcatcgacctctctttgcagacagacttccaaggtgccttcggctgaaaaattctttcatctactccaagccaaagcaggatcacagaacctggcactctcacccagaaatcaccacacacaccatttgacccatctagattcttcctatcaggttagaaaacatgaataactctatagccatgatgagactttaaatctacccaagacctcttcaagcaaagcaagggctctgtctgtggaagctgcaataggtgtcatggaagtgtacacgtgcaatctacacagagcattgacatttccataccctgggctggttgggtggggggatctgcctccatgtttaacctcatcttggccacaccctcacacctgcccttcactcccaactccacaaaatcaatctgcatatcctcatattaaatatatgcttcaattgttcacatgtcactgtcctagcacatttgtcactctgcctggaacggttctcaccaaccctccatcgcatccctggggcaagaagtatccatctcaataatgtctccctactcctttcaaccccatccccaacttttgaggcctcctggacccctcttcttcagactcccctagttcttgccccatgattctctcagcactgttgttgtatgtctctcatccaccatatgttatctctgcaaccccagcacccagcacagcaatggatgcacacagcatgtgctctgtgaatacctgatgaatgaatgattccacgagaaatctcccctgagatcacagacttaaattatgctccacataattcctgagtttcttaaaagaagaggtgttcccatccagtgggtcattgctcattaaccccaaaaccatcccagctatttttatagagggagtaaagaatatgtgggttgatttttcaggaagaaatttcccatagcagaaccactctgaaggctgaggtgtagcactggtatagggttcatatgcctcaaaaatgtactgtctgctaccttttttcataggcaagaaaaataaagccgcagaagtgaagaaataagatgggctttactctcacctccaagattgcaaaacatcagtagtatctgctcaagaaatctttaacgtgcttgaggtaggtcagagatgttgttttttaaaatgtctgtgtgatcctcttacttctgcaagacaaattaatgctgcagaataactgggggaaagaaaaaaatctagatccatgttctgttggaatgcagcttgctctaattgttttctcatgtaattacatatattaccaatataattacaaataatacacatatttgatttgtgcaattatagaatagtatataatttttaaatgtggtatgtttctttctacccaagatccctttgtgaagaaaatgatttatcatttctaaaaatatgcccctgtgcattatgttttaataaagcaaaaattagtaaatatttgcctttcttttatatttcaacaaaataaactttgtcatgaaaattcaagttttaaaaggctcattatatgctttgaaaaactgcttgcactaggttaattctattcactggagaaaagccaaccaaatactatgattctcaagaaaggtaattataacagacaatgtataaggcacagtcaagggaggtatttgagaaggcctgggataggaggaaataacacctcaatgaatgggtgaggaacagcctatttaagagtgaaagagacaagtgagaaaactgggctgtgtcccttatcagttgtgtgtctttgagcaagcaactgaacctctcagaactttcatgaagtggaggtaatttaccacctcactcattgtacagttgtgaaaattaaatgaggtaacatgtgtgaaaggccctagcactttctcacttagcaaccatgcatgtcacgtggtagatggttcctgccgtaacagcataaatcataaccctcatctaccattactgtatttctctttgcaagatgacagttcaccagatctgctgcacagcatctggaacaccgtggtctctaagtctccctttttggaaggtaaaatggcaacagcctgcattcattcaaagaggagacttgtgaagggtccagggaagaaacgtgtgaacatccgtgagatgtgaagggaaatgcagaatattaaactgtaaagaccagaaaagaatttccagataatcctcatctgactagtgactcacactgaggttctattggatccacgcaatagaatctttgtttaaaaacttagccaacatttaaaattaggagatttcccataaaaccttggaagtacacattctcattctgcaatgagaagcctgggtaaggctgggcccaagatcctctatggcagcaaccggctggagccaaggagtttgctccctaggtagccacactcgaaaggctgccctctccagtgttcattatttgcataagctatggcaccctgagacaaaaaataaataacactctcaagtcgatcaacagacaactcagaactgaccagtaaaggataacggtctccatccccacctaatactcagccagctgctgaagcctcctgtttctggggccaactttgctttcccagcagctataatcacaacggttgtcacgacttccacagggtcttttctttttcttttttttggagattgagtctcgctctgtcgcccaggctggagtacagtggcaccatttcagctcactgcaacctccacctcccaggttcaagtgattctcgtgcttcagcctcccagatagctgggacaacaggcacgtgtcaccatgcccagctaatttttgtatttttggtagaaatggggtttcaccatgttggccaggctggtcttgaactcttggcctcaagcaatctgccctcctcggcttcccaaagtgctgggattacaggcatgagccactgtgtccggccttccacagggtcttcaaatgcccaaagctcactccgcactggggagaaaggtgaccctaggagaaaactgttacagagttggtacaatggagtgtcctgcctacctagagatgaaggcagatgtgatctgccttcatgctgaacctcacatttaagaagagaataaatggatcacagtgcatctgagatgtcctgaagactccatctaaatattcaagaatatgtatctaatcttagcacttcagtgtggtaaaaaatggcatagactggtcgggtgtggtggctcacgcctgtaatcccagcactttgggaggcctaggagggcagatcacctgaggtcaggagttcaagaccagcctaaccaacatggagaaaccccatctctactaaaaatacaaaattagccaggcatggtggcttgtgcctgtaatcccagctactagggaggctgaggcaggagaattgcttgaacccgggaggcggaggttgcggtgagctgagatcgtgccattgcacattgcactccaacctgggcaacaggagcaaaactccgtctcaaacaaaaaaaaaaaaaaaaaaggcatggactccatggcataggaacagaaagcttctaataaagagagttaataaagaggtgggggtgggggaataccaactttcctggcaagaaaactgagtcttggaaagttttagtaattcatctgagaactagaaactgaatccaggaactgactccagatatgaataaacaaaccatgtagccttacttttctagttacttccctccataggtacatcaaaattaagaaaccaagaacttggccaggtgtggtggctcacatctgcaatcccagcacttcagaaggctgaggcaggaggatcacctgaggtcaggagtttgagaccagcctgaccaacatggagaaaccccgtctctactaaacatacaaaaaattagccaggcatggtggcacatatctgtaatcccagctactcaggaggctgaggtaggagtatcacttgaacccgggaggcagaggttgcagtgagccaagattgtgccattgcactccagcccaggcaacaagagcgaaactccgtctcaaaaaaaaaaaaagaaaccaagaacttgaagactaatgagactgatgagatacaactctcaactctcctgaagatggagaagaaggctgagctcaggaagccctcctgataaagccatctatatttttgagccagcaatagtataaagaatttggagcttctttttactgcaacatctggatgaagctttttaaatatttcattcgggattcattcctcgtcatggaaacaactatttcatcaaataccagaactgctcagaaaaagcctctgtctcatattcaagttgaaccacaggctcaaagactaagtaaataagtgtacaactaccttgaaaagttagccaagaaaaaaaaaatggaaggaaatatgccagaatattaaagtggttaactgtgtagtaggaacacaaacagatatcatttttgcttctgtctttttcccctagtatctttgttttctcaaatgggcttgtattacttgtttaaaataatctataactagacaagaaaaaaatacatatgaattcattgcacacaagtgatggagctgagtcaggcgtcttgtcctgatctggacccacagatctatctcagtgtagcttagcccatttttgccttctctgccccctgctagactacgtgaggtctccccaatgccttgccatccccactgtgtgccccaatctgagcagcaaggtcctcagcacatagtagctacctaataaacatttataaagtgaataaattcatagcatcttgtatttcctttcacacattcttcctctggacctgtcaatgtagaggatgatactcaggtgaatgatatttcctggaagatactatacaattaattacccttgtaacctcaaaaatcatatttgaaatcaaatctgcacaagtgacaagtaaaggatataaaacatggcattctccttagcctcttaattacatactatatatcaagcttctcccaagctctgaaaatgtcccatttaacattctacacttggcattcaattgcaaaacctgaaatggagattgtattacttaaatacttcccaattttttttttacctacttgttctacatttttacccttcaaccaggttttatctactccctgtttccctcttatgctgttgtatgctagccaagaaaatttagggtaacactcaattgtttaaatccagatacttccattgtcctaagaccaaggggcatttacctagtgcaaaacacatgagtgagtgggcaaaggcatgttgaaggcacacaacagaatcatccctctgaccatcctctccatgaagctaatatcttgagatacatagtggacaccaatatatatagtatgaatgaaactttgtttaaaaagtatgcatgtgtacaaacacagatatgttaatatatccataggaaaaagtcagaaaggatacacacagaatagcaaataataattagctttgcatgaggtgaagtggaaaagccagtgggctaaggaggtagaaatttttacttattttccataatctagataaataaggcaaaggaactataaatgaattgttcttatgtttacccttttattccaaataaaaaagtactaaaatggtatgtaagtgagtgtgttatctgtataaaggttagttccctgccttcaggagaaaaacacagtataaaataattccagaactcacattatacattattacaaccacagagacaaagaggactctccggatacataaatatatacccatcctatctcctcaaacaaatggaaatcagattcagacaacatggcctcaagaaagtctcaataaaggtcgcatgctaccatgccactatttgggtatttggttctgtttatgggaggagttctgtaaaaagattagcgcaatcggtcaatgtaactgcagtgggattgaatttccacagaggctggcaacaagctcagcacagagaaggcaagaggatgaataaattatagcaagaacatgaggttcataaccaggaaagaggagcgaatgaagccagcctctcagaatcaggtggcttgtagagaaacctctagagatggctccatccctctccccaaaaaaagaactgctgcaagttccttgcaggtgagaagatactccaattctatatcttcacgtcttggggaaggaaacacccaagtagtaaatccattaatactgtccttacaggtgaggtattcctgaaaactgcttaattccccataaaagcataaaattgttttcttctaatcatttcatcattttgggacttatatttaagtctttaatccattttcagttgatttttgtacacggtgagagataaggatctaatttcattcttctgcatatggatatccactttcccgaataccatttactggcaagactgtcctttccccattgtgtgctcttggcacttttgttgaaaatccattggctgtaaatgcatggatttatttatgggttctctattctcttccattggtttatgtgtctatttaatgccagtaccatgctgctttagttactacagctatgtacagtattttgaagtcaggtagtgtgatgcctccagctttgttatttttgttcaagattgctttggctattcagggacttttgtgattccaaacaaattttaggagtgttttttctatttctgtgaagatcatcattggtattttcatagggattacactgaatctttagattgctttgggtagtataaaactactagaagaaaacataggagaaaagctccatgacattggtctgggcagtgatttttttggatatgacctcaaaagcaaatggaattgcatcgaactaaaaagcttctgcatggcaaaggaaacaatcaacagactgaagagacaactcacagaataagagaaaatatctgcaaactgtacatctgataaggggttaatattcaaactatataagaagttcaagcaattatatagcaaggaaataacctgattttaaaatgagcaaaagactcgaatagacattgatccaaaaaaaaagacatacaaatggccaacgggtatatgaaaaaatgctcagcatcactaatcatcagggaaatgcaaattacaactacaacgagatatcatctcactccgttagaatggctttcatcaaaatgacgaaagagaagtgttagagaggatgtggagaagatagaacccttatacactgttggtggaaatgtaaattagtacagacattatgaaaaacagtatggaggttcctcaaaatattaaaaatagaactgccatatgatccagcaatctcacttctgggtatatatccaaaggaaataaaatcaatatgttgaagagatatctgcattcccatgttagccaagatacaaaatcaatctaaatgtccatcagtggatgaatggataaagaaaatgtggtaaatatacacaatggaataccattcagccatatcaaggatgaagccctgtcacttgcaacaatgtggataaacctggaggacattatgtcaagcaaaataagccaggcacagaaagacaaacactgcatgatctcactcatatgtggaatctaaaaaaaagttgatctcatagaagtagacagtagaatgatggtacgattggctgggatggttagcagggagaggatgggggatggtggccaaaagatacatcattacagttaggagagaaataacttcaagagatctattgcacagcatggtgactctagttaatgatgataaattgtattcttgaaaaatgcaaacagggtggatgttgtgctctcaccacaaaaatgataactttgtgaagtaatgcatttgttaattagctagatttaaccattctgcaatgtctatatatgtcaaaacatcatgttgtacatgataaaaacatacaattttttctgtcgatttaaaaaaagaaataaaacattaaaataaatttttttaatgtaaattggtttctcactcttcagaaattagcagcctgagccctcaccacaagacttccacatatgtgaagggagccaagtcgcttgttcagttcctctctttttaaaaataatccctgttctcagtattcctccctgggagcactttgaaatctgtccatcattttatctgggcatttttacacactattcacgacacctccaagcaacattgaacttccctgaaattgagaaaggcatggggagtgctgggtgggtccttgtgctgggaggaaccttgtttgggggcttctctctttgctcctggtgttggaaagatgaaaggccttatttcctgatcagcactggggacaggaaccacagatcaagtggacaagctccacctgcatcaggcatggaggcttgtccataacagaacctcagaattaggagctacagcatcagaggggccttagcaacatccattttacagatgagaaaactgagacccaaaaaagggagcgggtgcctgtggtttcctgggaagttaatgacagaaggagactggaatctagggctctgagctcaaagagctaaaatgactgatgaatggagagatggacagatgcctggatggcacagagacagacagactcaggggatgactaattggcatcttggtataaaatgatgaatgaggagaaagtcttctcccaaggctgtgttggcccatggttccaaaacctgtcctgagaccccaccccaccatcttaaaatttcctgccatggtttacaatggacaaagagagtgaatggttggatcaaacccaatgctgacttggatggaggagggaggattaaagcctacatactctttatacagcaagagtgccaggatctcatcagttcctcttcagtcattgatcatccaatggaaaaatttgctacagctacactggagtgtctgagatcattgagagacaccagccacaagggcttccctgcctggcttgcagtgagagctctttgttgaacattttgagattcaaggaggggtacacccacattaatcagctccttggtcagggttcaggcagagatggtagctggatgtgatgcatcagttgtcagaagccttctgccccttcatccatgcattcaacacctacttgctgaatccctatcacatgccactgttttaagccattgggacacagcaattaaaaaaaaagacacaggctgggcacggtggctcactcctatcatcccagcactttgggaggccaaggcgggaggatcgcttgagcccaggagtttgagaccaggctgggcaacatggcaaaacactgtctctctactaaaaatacaaaaaaaaaaaatagccaggcatggtggtacacacctgtagtcccagctacttggggagggggtggaggcaggaggatcacttgagcctgagaggtcaaggctgtggtgagtcctgatgatgccactgcactctagcctgggtggcagagtgagaccgtgtctcaaacaaacaaaagatacaaatccctgccctcttggatttacatcttactggggatgggaagcagaaacagacaattacgagaaatataataaagtacactgtaaaggtagaaccttaactgactccctctgcaagccaacccatagctgattatggtgggagggagtgggcactttgcagtattaaactaagtagttggtgggggaaggagactcactaattttcccaggacagtcactcctggcttattccagttgtagaccaattaatgtcaattagtttcttttagtgctacctttgtatctcaaaagtgtcctggtttggatggcaagttatatatcggtcatcttattgagaagtatgctttcagactccaaggaggcaagggagttagccaagcaggtatcctagggaagaacaagtagagcaaagactccaaggtgggagtgtgcctgatgtgttcaaggaaaagcaactgggcccagaggctggagcatgcatgggttacagggactaaatagtcatgggcccttccaagttttccaacaaaaactgtggttttgctgagtgagatggaggaatttgggtgagttctgagcagaggagggacatgatccaattctgatttgcagtgagcctttctggctgccatcttgagagtagattctgtcaagacaaggcagaagaaggaagactgattaggaagcccttctaataatcccaggggaaaagagggtggcttggccaggtggctcgcaagtggaggtggcgagagtggggggactctggatgtagtttgaagacaacacattggacttgctgatggattcgatgttggtatgggacatagagaggaatcaagaaagactagggcaacttggccagggcaagtggacgtgtgcagttgccattgactgacatgaggaagtctgagggtggagctggtttggagaattaggagttcaattctggacaagttccatgtgagatgaatgttagacatataagtggaaatgccacgcagttaaatattggaggcaagagctctggagagggttctgtactggagatacaaattcgggagtcattagcatggagaaggtctttaatgcaatatttaccaacaaagaacatctggcctttagtccaattcaaagcagcacaaattatatggtagttgcctatcatttcatctcccccattctgttcgtgctcccatcaaaacttcctatgaccccaaactacacagccagacctcactccagggcctgagcagtcagagctgcaaggcaccccaaggggtacaagcacttcctgaaacaattctactctataacaatactggtactcaccaaggacaccttgtgtaaaataggaagccagttgtggggagcagtgaacatggagtcagaaaatctagaagaagaatcttggctctaccaatggtttgactctagctgtgtgaccttgggcaagtcactcaaactctctgtgctcagctctctcacatggtttatattgtgcagtaagtgacaaaatccatctcaacagcttagcacagcacctgggacatagtaaccgctcagtaaaaatcagcaaaatgactgttttgttgccattattattagcatttgacttaagatgaggataagggaacaaatcatttatttggaaggtaatcctagggggcactggttaaggagaggccaagtgataaagagaaagaaagaagccagtgaagggtgtgttctcaagccagttatcgctgtcagcaaatagagctgaactccaccagggcaccctgacatccagtgtagagtacacaccccagagttctcccacctgaggggtgagggagctgaggtatttatacaccaactcccaccaaccatgccatgagagctgggggtggatactactttctagctttggagaaagagatgcaattggaagtcggctggtgcatactgcagtggtaaggcccaaaggatgtggacagggcacacactggcacctgctgcagagtcatcattgcctatctggggcaattcacccagcttctctgagcctcagttttccatctataaaatggcaggcatcatatctgcttctcagagttggcatgaggatttcagaaaataatgtttgtcaaagcacctggcgtgatgcctgccacatggaatttcaatttcctttctccctttctcttctcctcattacgccctttccacatgaagggaaaacttacttgctcacaagccacacagaaaatgcctttcagaagggcactttgtgttttacaacattgttctctggctgcagagcactccttccatataatatactctcagatgtccataatgatcttgctaagtattcctttctggaaggaggaagtagaggtgctttgatagtgaggacggaggtttgtgcccccaaggtatgcttcatgtctgtggtcgctgtttttcgccccgaccatgtcaaggccccctatctccaaacaaattggtcaagatggagtcattcctaatctgatgacatccagcactgccatgtggtgtaagctgctgagctgctaacagagacactggtaagttgacccagaaaggagtcaatcccttcttacttccccctgcaaaaaaaaaaaaaagaaagaaaaagaaaaagaccaactcaaaaggcccctgcaggaaacaggcctgcccggtgcaacccaccagcccatacagcagaacagacgtgggcccaggagacaagtgcttatgtgtgagcaagaagccaccagaataccaacgagcagggaggtctccatgccaggaaacccccacaacggctatttgtttggtgtcctgggaaaactgagcaccaactgaggcctcacggaggcatccaacagccggaataaatctgaaagaagttgaccacgctgagacggaccaggcttggttactgacacacaaataagtccagttgattaataactactctctgtttagagttagcaacggtcccaaagactggcatcttgctgcatccaaagaggtgcttgctggcatggataaggcaataagaataaataaaattaagtggtttctttacacaggactttgctaagaatctcacatatggcatcttgttgatttttcttggcagccccaacacaaacatgatcatctccattttactggtaaaagaagcctgaagctcaaagggcttatcaataatttgatcatggtgatataaagccagtcaacaggtaagcctacacttacccacccatgaagtcagccttgaaagaatattttttttttaatctacagtgttttcatatacaagatctaatggaaaacaaagtgtatttattatgtttagaagccagaatagtggttaacattgaggtgaaatgaggggtaacacccaggaaggtgccagtataagggactttaagatattggccctgtactgcttcctggccttggtggtggtttcacgaaactcaccttgtgatagcaattcaccaaggtggacacttagtaaccagtgaattttctttaaaaaaaaaaaaaacgtagagacaaggtctggctatcttgcccaggttggtctcaaactcctggcctcaagtgatccttccacctcagccttccgaagtgctgggattacagccatgagccactgtgtccagccaactagtgaattttctatacttacattatactaatggaaggatgagaaaatcacggccagagggggccagctgtctgtttttgtaaataaagttttcctggagcagagccatttctgtgtcgatgtattgcctgtgattaataatccgatcctctgcagaaaaattttgctgatttctgtgtacactgttcagaacttggtttgagcacacattatatctagctttctgcttgcgtttttcgtaggcaaacatgtaaatgagtttgcagacttgaagaacacaacaaatgacatgaaggagaaagagctctatgttaccctgacacattcattaaagaagttatacggtcattaataaaaacacagatgatccaatgagaatgtaaataaggaaattaggataaactgaagaaaattaagagcaaagagaaagacaggtataacagaaatcatcttacttaaaattactaagatttggctgcaactttgactcagagtttcatggatacccaagcaaaattggtaagacactcaacccagacgctccaaatgccaaggaaccaagcagagcttcaaacttcctctccagaatccacagagcatccaagcctgtgcacacaactgaaagctggctgttcctgatttttttttaaaagcaccttttccccatttttcctgcaaaaaagcaactcattttttgctctgatgggcaaaaaaaccctcaggagcctaacttttgccaactgccatgtggcactgcccattcccatctgggctggctggcacagaccacagcgagcagaacagagggcccaggagggtcctcagatcgtggctacatcacaatgacctacttgggattagaacaacattttagagcataacagcgttttatgggtcataaatattgcacagatgttccttatttacacagactcgatagattattattgcaacattaccatgctaatatggtgattcctgttttcgaaactggcgggcaagaagcagggaaatgtaattaaacaagtatggtgcacattttaggaggttgttcagtaaaacaaaataaaaacacacactaaaactgctacctcttattcaattttattccacaactgactctcgatggcaagagttaaacttttcacaaaatagcattagctgggattggagaataataacttaaataacagcaatggcagtaacaaacagctagcattgaatgtgtgcttactacgtgttttatacatgcattaactcacttaatgctcagaacaaccttataacgcggatcttataactatgcccctttgacaaataaggaaactgaggcagaggtggccaagcaatttcccagagtcagaaatcttttctcagtggaaccagcatctgacttcaaagtccatgttctggtaataaccacacaacaagcaaagacttactgacagctttctgcaaaagcaaaggctactccgtgcggtcccatcctgggccactaaagcacacaacgatcaatgccccaacacataacatcacctctttgaagacaaagaatggaaggtcggtctccatggtccatcactctggaggcagcaaggagtcaagcttccaggatctggtctggggctgcctggctccccttcccttcagccacaccagtcagtcacccatggttccaaccacaccaaagggtttggcttttcatgatgacccgctggacagcagcttggctcaggctgctcttctgtctgctccccatctcactactcatagccaagcatcatttcctgccagaaaccatccctggctccagccaagtgaggctgctccttgcagcagcgtcttacacctaccatctccgtatggtgatagccaacatgcccatctgtctccccaaaccagacggtgagctccttgaggacagaaatgatctttcaggtatcccttgctggtgaatccacagtgaccaacccagagaaggaactcagcaaaatggtgaaccagaagaactggctaggaagagagcggagatagctgcaaggatgccctgctaggaactgtggcaatccttacaaaagtttgccctgaaacaatcagcatcctcttagcaatttttgagtctccaaaataaacatctgtggtcaacaatgaaatgcacagagtgctcactttttgacagtccgttctataacacaaatcttgcttggaggccagccacattcacccttaatcctaggtgtgatcacatgaaagtgttcacgtggtccacgcagtacaactgggaagtaaagaacaggctgggccaggcgcggtggctcgtgactgtaatcccagcactttgggaggccgaggggggcaaatcacgaggtcacgagatcaagaccatcctggctaacatggtgaaaccccgtctctactaaaaatataaaaaattagccaggcgtggtggtgggcgcctatagtcccagctactcaggaggctgtggcaggagaatggcgtgaacccaggaggcagagcttgcagtgagccgagatcatgccactgcactccagcctgggctacagagcgagactccttctcaaaaacaaaacaaaacaaaaaaaaaaacaggctgtatgtggaaggctgtggctcattcatacacattatttggatagttccgtggctcctgcactggactggttccctcaggggaaaaattatccaaagatatatacaccgacagcacatctatctcatgtgtgtgtctttgtgtgcatagaaagaagtggagaggagagggagatatgaacacatccgttcctcaacctctcctttacgaaatgtgttcctaaaaatgagttgcaaattgaatgtttaaaatttggactatacagatccttgcgtgctataagggtagagcagaagagggtatacatgggaggacgacttctaaaaaccatgaaattttacctttggtatatatgtttcattttcttaccccctgagtgtcatgcaatgtactgatgattatttgggattatttaaaatattaagaaataaattaagttacaaatgataaacttaattttggaaagtcctaccttaaattccaattatctcagcttactgaaaatacaattcatgcaaaggagaaaacgagtttgctgttagggacaaggatgtgctggcacagatatagcagaggattcggcactggcttccactccttcatgcagtctttcaacatttgtagagcacccagtacatgccaggtgctttctaggtagcaagcaagagagaattgcttctttaagtgctttctccccattacattcaaatgggagaagcaaactaagtaaataaccaaataaataaatacttggagatagctgataccattaacctattaacacacccaagcttatgtggacagaaagtgaaggaaagatatttgagctgagttggaaagaaggcacgtcccaagtagagggaacaactagagccaaggtcttgagggagacagaggtgttgactatacgagaagagaaaaaaaggccaaggtaactaacacagtgcccacaaaccttttctgtagagggctaaatagtagagactttagcctttgcagggcatacggtttctgttgcaactaccaaactgcaccattgcatgaaagcaaccataaataatatggaaatgaatgggcagggctctgctccaatataacatttttatgaatgttgaaatttgaatttcatagaatctttgagtactacaaaataccctccttttgattcactatctaccatttaaagatgtaaaaacctttcttagttcacaggccatacaaaaacaggcagcaggccagatctggcccatgggacacagttttctggctcctaggctaaactcagtcaagtaagctgatatggtttggctgtgtccccacacaaatctcatcttgaattgtagctctcataatccccatgtgtcatgggagggacccagtgggaggtaactgagtcatgggggtgggtttttcccgtgctgttctcatgatagtgaataagtctcacaagatctgatggttttagagaggccagttcatctgcacatacttttttttttttttttttgagactgagttttgctcttgtcacccaggctggagtgcaatggcgcaatgtcggctcactgcaacctccacctcctgggttcaagtgattctcctgcctcagcctcccaagtagctgggattacaggcgcctgccacaatcatgtctggctaattttttgtatttctaatagagatggggtttcaccatgttggtcaggctggtcttgaactcctgacctcaggtgatccacccgactcggcctcccaaagtgctgggattacaggcgtgagccaccacacccacccctgctaaacacactctcttgcctactgccatgtaagatgtgcctttgatccctttcaccttctgccatgattgtgaggcctcccagccatgtgagtccattaaacctctttttctttacaaattacctagtctcaggtattgcttcacagcagtatgagaacagactaacacataagtgaatggcagaagaggggataaaagacagtatcaggagctagaagcaacagtttcggcttggggctttattctacgtgcaagtggagcaatttaaaatgggagagatatggtctgacttacgtttttaaaaaattactttggcagttgagtggcaattctgatgatgtcatcaacttccttgaaaaaaatgtgtcaacagggaatggaacactatcctcttgatcaagcagtctggagcaaaccatcttcccctcaaaagctctacggggcaaggcatggtggctcacacctgtaatcccagctctttgggaggccgaggcaggcagatcacctgaggtcgggagttgaagaccagcctggctaacatggagaaacgtcatctctactaaaaatacaaaaattagctgggcatggtggcacgcacctgtaatcccagcactttgggaggccaaggcaggcagatcacctgaggtcaggagttcgagaccatcgtggccaacatggagaaaccctatctctaataaaaatacaaaaattagctgggtatggggtggtgcacacctgtaatcccagctactcgggaggctgaggcaggagaatcacttgaacccaggaggcagaagttgcagtgagtcgagattgtgccactgcactccaaccccgggcgacagagcaagactctgtctaaaaaaaaaaaaaaaaccctctatggatctgtagatttctctctgtatttgaatcactgaaggctttatttttctttaatgctgattgtctgtccacaattttaaagatttcctcattttcttccatcactaaacatggccttggagacacgatgtcttaggttacattttcaggatttcatgtgtgttctttcattttattttcctttcacaagtgaagtcatctgaccagtaaccaattgaagttaaatagtcaatactgtctgtacatctgacagactctatccttgcctcaaatgtattaccatgagtaccggcattttcacatttccattttctactcatttttataatgtaagaaaaaactggagaaaaattcaatcacagctgtacagataaggggggtaagagagaaaaactggcctcatggctggcagacatcagagtacaatggcttcaaatggttttgtaaagtccaaattcaacaccggggttataaatgaataataataaagaaaagtgtggtttctcccttcccatcaattctgccctatatgagaggaaaggctgtcagggacttggtccttttaggcttccctgtgtttctctgactacccctcctgaatcccagtttccagtgtcctgtcaagagcctgacttgacctgtttattggttcatagactgtgcctggcatcttgacattcaacttagtctagcagcctagctccagctaaccatgccccagcagagagggagtgccgtcatgttagtcaagtcagaaaagcctttactcttgacaggtttggacctcttaaaaatccaaaggcattcaacccttgttagcctggacaagatacaactctggctccctcaactgtcataagaaatagataatgacaacttcttagacatacagcaacaaagaaaggaagtcatgcatttcaaactctcttcaagacacttaataaattaaccaaggtaaataagtaaccagatcaaatctatcagaatttttcatctcccaatttcagtctcttagttaaatttcaacccatcctatgtccatagaagtgaagccttctgtaacaaggctctgaataatgcaaaaaaaaagaggtggggtgggagttaagatgtgattctgtgacagctatagtctaaaatggccccaatgatcttcacctcccagtactcacatccttatataatcccttccccttgaatgtggctagactagtgactagcttctaagcaacagagcatggtaaaggtgacgggatatcatttatgtgattaggctacataagatgatgacttctgtcctgctacagaagtagcaagaatatagcagattgtctcccttgctcaggaaatggggcaagcccacatatgttagaaaggtccatgtggcaagaaactgagggtggcttctggccaacagccccctcaaggagctaaaatgcttagtccagcagcctgcaagaaactcaatgctgccaacaactatatgaggttggaaacagatccttccctatggagccttcatatgagatcacacccctggccaacaccttgactacagccttatgacagatgttaaaagcaaagaactcagttaagctgtgctcagagactactgacccacagaaactgtgagacaataaatgtgtgttaagtggctaactttgtggtaattggtcacgcagcaacagttaactagtacagggtccaacttgtcgtttcagtttgaattgctcaagtcatcctaatccaggagtcacatgttgtcaagtctctgcacacctctcgctgcattatcataagctttcatgaatttaaaagaacagattagaggttgatttcttctaaagaaccactacagtaaaccagtctcaatccctttcttccagcaaagggacatcatcaattgccacatcttcccctttgatgcaaatgacaaagaggaaaatcaaaccatgtcattgccatctctgagtccaggagaaagagataatgacagcacctggcctgtcttgcctcacatcaggaatgcagtgagatggttctgagccatggactttcccagaccatttgaatgagactgacatcatgaggaagggggtatcctctggttgggaatcctctagtggctgtatcattattttctattaaagcccctattgcataggaattttttcccatgctgatatgaatctctcatggaaaataaaagttatttttaactatgagcctcaggctataaattcattctccctaaagagttaggatcaagcaaaatcaaagaagttagaggaaggagagaagaacacatcctggagtgacttggccacacctgcaaaccatgtgccctgccccacaactgtcctctgaatgctcttctgggacctcttccctctcccttttacctgtgcccctttttatgtatttcctcctacatgctcatcccaccgtgccttcattcaacctgctcctaagaaaacttgactttaagacagtaagagctttccaactagctaaggttgattcttcaattcaatgtactactccaaatacttcaatccagagttcattaggttgaaggcatcatgctaacccccacagcagacatgtgaacagctgtgtctgcaaagcctttaaaaatgatccacaaacttccctgccttcttccattatagaatggggccagagtgcgcaccccaggttcaaaacctaaaaagcaggtttcaggccttgccccaaccctcagttcttgtgcagccttgggttggtcctctaaaccatctaagatccagcttcctatctgcaaaagcatcagaagacttgttgaaagcaaggattaaaatggaatggtatgcctgaaaatactctaaaaagagtcactgcgattagggcaaacaatttcaccttttcttataactcaaagttatccataaaataatcggttatcgtactgggagcccacatctattttttctcctcctgacattatcattgtcatgactgccactacatcttcagtaaagcaataaggtgggacctttggggtcttccaaggagaaaagcatgcttggccctcatacctagcagctgcaactactgagttgattgagctttcatcactgctttttacatttatacctcctaattcaacactgggggttataaatgtagcaacagttaactaacacagggtccaaactgtcatttcaattcgaatttctcaagtcatcctaatccaagagtcacatgctgtcaactctctgcacaattctcactgtattatcataagctttcataaatttaaaaggataggttacaggttgatttcttctaaagaaccactaccgtaaaccaatatccctcctcttctctagtaatgaggtcatcaccatctttatttatcagcactgcaagcatgcctccctgaagcagccttctccctccttctaaaccttctgagcttagaaatcaaataaaaacttgctagaattgtaggtaaagtaagagctgctggccactgaaggagagactaagggctctcctctggaggaaaaaacaagagctttgtgtgtttaatatctctttggtggctcagaggctctttagcttctttctaggttccacgcagtgcattagaaggcaagtcttctatttacacaatgtctggtatatagttaccatttcctatttctatctaggatctcacctggtgcccacccaccggtgttgatgtgtatctgcatgtctaatacacaacagcaatgagaccatgggcattccactcttaaattaggaatttcccccgtatatatactcgatatatatacgggggaaattccttatttgatatacagaggaaattcctatttaagcatgatcatcatttccacactatttattcaccattttatatatgttacttcatgttatgctcacaaccatctaatgagataggcactattattcccatttgctaggcactattaatttccataaagaaatttaaagctcagagaggttaactgattttcccaaggatatagagagagtaagcatgatgattaagaatcccaacaagtctggcttcagagcccatccagatggcgatgaaaagatctccaacaatggctataagttcaagtcacattacaaatttttcctaatgaacagaagtgaactctaaaatccacccatcaaattgaaatttatcacgacacatgcgtgagttaacaattctccaaaaggtaataatattataaccaccactgctactatccctcaccaggtatttgacatgcatcctctgaaatcttcataaccccctgccagactggtagaattattcccattgacagcggggaatctgggctcaaaacatcacagtaatttgcccaaggatgcagactcagtaagtggcaagagctgggattttaattcagctctctctgactccaatgcctcttctctttccaacatgttgagtgacccaagatgagatatatttaagggcaaactagtcttcaacaatatagtcaatcttcacaattcagaagattcttgtgaatctttcgcagcttcgaaactgagacaatgctggtctggaaatgaacatagctgggtggaaaccaggtttgtccagttaacagctgcgtgactgagtatgtgcataacctcactaagactgcatttctttatagtaatgcaatttcacagggtcttgacgtggattaaatgggataatgtgtgacatatgtgcaggtatcaaggtctgtggcacacagagggtactttaagtattctttctttaattattatctttctttagaaaatataaatatgaattgagatttctgaatgacagatttaagataaaacagctactattatacaagacagaacacagaatcttcgattcaagattaaaattgctgaaagtatcctagaaatcactgaatattcatttattcaccaacattaagtgagccccgactatgtgtaggaattgcgctaggcatgggggatcagcagggaaaagaacaaaatacggatgattatggagcacaaattccagtagaaaaaagtcagaataaaatagaaaagagtctaaaataaaacacaaagataaacaagaagaccatttcagagagttaagtgttatggttggagacagcaaagctccctcttatttggctgagaggaaaactgatctccaaaccagagaagggatttgattggccaaagaccccacccaggattaatggtgtgtctttgttctctagaccagcgattctcaaattttcacatctatcagaatcacctgaaagggtttaaaaacacaaatttctgggtcccacgccagagttttttattcagtggatctgctatggagcccaaaactttgcatttctgaaaagttcccaggtgatgctgacactgctggtccaggggccacactttgaaaaccactgccattgaggaacacaaccataccagaaagtagtgaggcagaaagagcagaggacaagtaccctaacccctctcctcctgccataccatctcctaccagtgccaaactccatcactaaactcagtcaggaatcagaatgcaaaagagtcgaggtcatgtagcctcctggaacccagcgcagtacagagaagggctccattaacacaattccctccccttgccccttttcacattaaagggttcaaaacctcactgaggcttcccactagtcctagtctccaagtgcctcggcatcccttgtgagttctcttaacctcaaccccgccacatgaatagtccctttgttaaagcctcttgacacacaggagttgaattctgttttctgttaagatccggagagatacaccaccagatcccagacagttccactagtgggataatttccaaaactgacaaacagctcttctatttcttcctaaagtaacagctataaaatgcaggtcaaatatcagataatcttttttgctacacaaatacaaatcgtatatgcaattcgcaagcccttgcacaggctgtgcagcaagatcactctaaatacagcttgtgggcctgggatgagcattagagtgaccgactcatcctgatttgtctcaaacattcctgcgttttcaatgagcactgaaggtcctatgtcctaggaaccatctccatcctgggcaaacgaggacaattggtcaccccagccacgcactcttatgttttcttgcatttatgatgcctccactgaactcccagcaatagcactataaccaaggatggctagtatttatggagcactttccatgagcctggctccttgctaagcatttgacatacctcacctcattaatttctcacaaccatcctacaagcaagttactacaatttgcctcatttcacagatgataaaatcgaggctcaaagggtttaagtagcttgttcaggtcacacatacagcttataaattagcacaggcttaacttgagcccacagtctgagatcagagtctgcagtcttttttttttttttttttttgagatggagtttcactcttgttgcccaggctggagtgcaatggcacaatctctgctcaccacaacctccacctcccgggttcaagggattctcctgcctcaacctcctgagtagctgggattacaggcatgcgccaccagacacggctaattttgtatttttagtagagacgggggtttctccatgttggtcacggctggtctcgaactcccgacctcaggtgatccgccggagagcctgcactcttcaccaccacatggttcatgacagagcagatggactcacctgccccagatctgattccataaggaaggaagattcagccaagaactaccaaaagggcatgttagaaaccaagcattaacactgcagtcacagagcggaaacttagaggggatctacatgttcttcattttaaggcacacaatgaaaaagtcaaccgcaaggtgtttggtgcctttggaaaatcagagataaaattatgcaggcccttatatctcagaatcagagattcttgcagcaaaatctgtggcattcaacacctgatgcatcctacaaatgcaaaagcagtcccatctgatgccttggcttcgaactcttatttgtaaaactggaataatgatcacctgtcttaaatccacaaggtggttgtcctgtggagaaagtaaactcaactaactctgtccagccagaagtgttttcctaaactgctgtgcttgcgggagccccagaggtccaaagtccacagtgtggggtgatccctggggtttggtatacggcaccttcaggtgctgggtccccagtgtgaaatcaggggcagctatatctaggggctcaacctctgttccaggacaggtgagggtccttccctcagaattacctgcttgtatgactgggatagttgagactcacttgttggggagatggagcttccttctgggaaagacagtctctctctcctgtacttcttattcccataaaaatcttctaacattcgacatcacatggtgattaagaacctggactctgaatgagacgaccacagtgtgattgtgaccaagcccttgaacctccataaaaccaattatcttatctgatacatgggattgctgtgtctgcctcatgggatcattatgagaattaaatgcagtcttagaatttccccaaagacatgctcattgaaaattctgaacaaaggctttccacccagtaatttcaaacaggacctaattttctccataagtatgaattttgcacagcacatggcacaaagtaagccagacagagagaacataaagtaatgcccaagaacacagaatctagccttgaattcctctggctcaagtcaagttcccacactgactagctgtgtgacctagggcttgctacttaaccactctgttcctcagttttgatgatcattatacctacatcataacagtgttatgaaaactcaaggagtgataattagtaaaacccttgaaaagtatctggcccattacaagtatttaaagcatgtaataatgttagtgcttcctatttggtagtcatttcatctcctgcatttattcctccgattttcagtttagatccttcatattcagcagaccctgctgcacctgtgattttcataactcttgaatctagtccctgttattatcgcccatcatccatcatttcaccatatgatttttccccttcttgcattttctgcttttcattccaacttgagccaaatgctcttctcctctgtatactcttttgggtttagaaaccttcctcccaggaaagtgaaaatccctgctgtcatattcgaatgtggacagttctaatggagtcactgtttgaaatgaacaatcctggaaacaggttgctttatctcctggacctggggatttcaaaacttattccttttgaacaaccaaaccatgagtagtgtcaaataacaaaactgatccattgggaaaatatattttaatatatttaatctttatcaaagatatccaatgatttggttttcagaacataaaataaaaatcctaaagtcagaggcctagaagtttagtctttaagaaacatagaaatcatctggacatttcacagatgggaaagtgatgcccaagttcacagcatctctaaacattgaaaagactgcgcaacattattctttgagtcaaatgtgcctttctgacgcctcaggcaaacctaaggccaaaggctgtcctatgaaagaatctctgctatttctctgggatgcgaggaagtctcctccatggagatgccaggaaagagaaagagacggaggtgtgacaagggaatagaactgatggctaagaaggtcccctccacgggccccatgcactcctgttcaaatgtctccctgtgtctgtgataaagttctctatttcccttcttctgcatgatgcaggggtgttaggattcccaagagaaatcctttacaaactcggaaataaggccttccatatagaaaataaaacctaaatttgtcttgaaaagatgacagaagcaaactgtacatatatttaaaattcctattatctgtaccttattaataaatcttaaatttcaagaacatctcttggagctgtgactgtgccactgcactccagccgggcaacagaacaagactccgggctctgactgtgccactgcactccagcctggcaacagagcgagaccccgggctctgactgtgccactgcactccaacctggcaacagagcgagactccgggctctgactgtgccactgcactccaacctggcaacagagcgagaccccgggctctgactgtgccactgcactccagcctggcaacagagcgagaccctgggctctgactgtgccactgcactccagcctggcaacagagcgagaccctgggctctgactgtgccactgcactccagcctggcaacagagcgagaccctgggctctgactgtgccactgcactccagcctggcaacagagcgagaccctgggctctgactgtgccactgcactccagcctggcaacagagcgagaccctgggctctgactgtgccactgcactccagcctggcaacagagagagaccctgggctctgactgtgccactgcactccagcctggcaacagagcgagaccctgggctctgactgtgccactgcactccagcctggcaacagagcgagaccctgggctctgactgtgccactgcactccagcctggcaacagagagagaccctgggctctgactgtgccactgcactccagcctggcaacagagtgagaccctgggctctgactgtgccactgcactctagcctggcaacagagcgagaccctgggctctgactgtgccactgcactccagcctggcaacagagcgagaccctgggctctgactgtgccactgtactctagcctggcaacagatcaagaccctgagatatgattgcacagcagcacaatcatagctcactgcagccgcaaacagacatcactttttaaaggaataactgaaatgcagaaatattacaaagagaagtgcaattaacacctaggttcttctccaccaagaattatcaaccaattttaacaaattttcttaaagtatgttctccttttcaaaagcaacagaatatcacggacaaaggcaaaatgccctttatccaccatcctagttccatttttcccatacctcttctaaagagtgtagccttccattctgctttcaatgctgacataaacttacatagtttgattattaatacatatttgattgatgtatccattaaattacccctgttttctttccacagaagaacatgtggatttgcagatgctgactttggttcatgtaccagaaaatcctgatatttgtaaatagtccttaaatagatgcccagattattagtatgaggtcatccaacatgctgatatagaagggaagctgcatagcaaaaattgggatgcttctatgtacaagcaggattctgctagtttgaagaggtcactagacctcattagtaaaccatgaggccagaaaaagccagcccaagatatactacatctgcttcagctctgtgtagtcaccgcactcccataatatcctgtatttttggctaaataaataaaaaatgtataagtttgggagcacatacaaggtccttgccagataatctgtaacccatctgcaatgacgccattggtgtcagaagtgggacagacatgaagagcccaccacaatggccacattttggatagggatcagaatatcaaagtaggacacaatgagtaaaacatgcctaaaacatgagaatttgcggggagctgagtctagtggaatttatccatggttcttctcccttcatccatttggacctgacatatagtgaaagatggctgggacaaaggtagttagcacaaggcaaaattcctggaaccttttgtgtgagccaaagcagtggttagaactaaggatctccagaaaagatgaaaccccagaaggaggaaatatctgaagtttgagccaaaaatctatggatcacaaaaggatgctctcaaattagacatctgaaaaggaaacctggaatgggaaagataccaaagacccctagaatcccaggtggaacaggtggtcagcagctttccagggacaaatgataactgctgaggctttggaagtatgaggaaatgggaatggaataaagaaatgcttcaatgctcatcaagccaactctcaggcagaacaattgcaatacagagagatttacacaaagacatttaaatatatgttaaatatttcgtatgtgggaagaggaaaagataataaggataagaagtctgacttcatcaagtcaaccttcaataaaaaagtgacccatcaggaacctggccccgttacagttttaaactaaaaaattctgttttaaaatatgtgtatactttctaaaggcagcagtaactttgaaatttgttcaaattaattgcacttttccaacaaaaatggtgttcagagcatcaagtcccagaaatattttcctacttggaacagggatcttccaagaggaaaacttaaagaacttcattgagatggaaaattcaccttgggaagtatacccagaaaaagtttataaaacttctgctgaagcaagggtgttgtagtatctggatttggttgggtgtttgcgtgattaagctgggcatctcacaagttgaaaaccatacatttcctcttttccagtaggttccactgctccttagtaaacctaataaaaatgatctcaaaactgcaactgaagtgttagacagctggcctctacttcatcccagacaattttgtttaggggaagataaacaccctgaactggagccagctgagacacagggaggaagctggctttgtgcctggcttctttaaggctagaagctctgggaaaataactaatcattcctgacacccaccccgcaaccctgatttgagactgtttagaatcttggctcaaagttgtgatttctgagctgaaagccactcccccattccaatacacacactttctatttaaaaaggtgaaaaaataatgcaaaggttaagagatggtaaatggacaatcttaggcagaggaaagattcactgacaaagaaaaatgtaacagtcaaaacatccaaagctctggatctgaaaagagaagaaagactggacactgaaatggctttgagctcaaagctgcaacagcagagcagaacaagttccttgacccaggcctgttaagtgcatttgtgcaggttccacacaacaacaggcagcagccctgacctagacacctagaacatggtacccccacctccctcacacccaaccttgcactgccagatgtagcaagactgaaggggacaggtaataaatgagaaactgctcaaaaacccaagcccctgaaagtggaggccaaacacttccccaaggcagatgaagggtgaactcaaggtgtcttagagcactcgttcccagggtcaccttgtagaaatgactcaaaaggacttagggttggaaccatcatacattggtgcctcttctaccaaaatacagatactgcctagacaagaacaatggggatctttggaatcaccaccacccccgaatgaaacaattaaactgtaaaaaccagtaaattcttgaagcacatctccaccagaagtccaatgtctggtcagcccatttagattctgacaaaacatccttccttcactgcaggatctcctggggccctaaacacagttaccttgaaaagaatattgtgacagtttcttctgtgatgactgtactactgccacaacaaccaaaaccaagagttcaggcatgacgtgtttcaatccatataataacttacgtgtttacatcagactttttaattgctataacttatcatattctctatgttagttttatggagcccatttttaaacctctggaaatgggttagaaaggtctaaaataagcgccaattttaaaaactgggatatgtacatgtaataaaaatattaagtttcagctaaattatatcatagccctaatctattggtgttttttataaattggtttttgtggaacttagataccagtgtaaaaattgtagtcttacaaaaacacagtcgtacttcaattttgggggtaaaggttgaaaagttttctgatggatcttcatattaattcacttctactttctgacatgcctaattaacttctacaaaacttaaactaaatcccttctgagacactaaatctctctattctaaggcctttaaagagtgaaagcctgacactgaactggcattagtgcccccaaaataaaaagaattaaaagatctgaacacacttcaaaggttatatttgtatttttctccaagaaacaaggtttcccacacttgtgtgtgacttcaggttcctgtggtgggcagctcctgaaatggttcccaatgacccccacttcctggcattcatgcctgtgatggttaatcctatgtgtcaactcggctgggctaacagatgcccagctagctggtaagatgttatttctgggtgtgtgtgtgagggtgtttctggaagagatcagcatttgcactggtcaactgagtaaagcagatggccctccccaatgtgggtgggcatcctccaatccactgggggcccgaacagaacaaaaaggtagagaagggcgattctgctctcttggcttgagctgggacatccatcctctccttcccttgggcatcagtgctcctggttcttgggtgttcagactcaagtcagagcctacaccatcaacccccaaattctcaggccttcggacttacatcatcaactttcctgggactccagcttgcagactgtgggacttctcggcctctaaacctgcatgagccaattcctataagaaatgaatcaatctctctctctctctctctctctctctctctgcccccacctccctcccttcctctctctccctgtcatatatatatagaaagagagggagagagagggagagagggatatatatatatatacacccacattttttttttcaaacagagtttcactcttgtctcccgggcaggagtgcaatggcatagcctcagctcactgcaacctccacctcccaggttcaaacgattctcctgcctcagtctcccaagtagctgggactacaggcacacaccatcatgcccagctaattctgcatttttagtaaagacaaggtttcaccatgttggccaggttggtctcgaactactaacctcaggtgatccgcccacctcggcttcccaaagtgttggaattacaagcgtgagccaccacccccagccaatatataatatacatttaaaatgtgatatataatatatatgccctattatatattctaatatatatagcctattggttctgtttctctgcagaactctaagacaacttccttgtgcaattccttccccttgagtgtgagctgaacctagtgacttgcttctgacagaatatgacaaagtgatgtgatgtcccttcccaaattaggttacaaaggactgtgacttccatcttgctcacactctctccggctctctcacttgctcactctgacaaagccagctgccacactgtgagctgtctgatgaagtggcctgtgtggcaaggaactgagcgtggcctctagcaaacagctcatgagagacggaggtcctcaagccaagagcccgtgagtaagtgaatcccgccaacagccacggaagtgaacctggaagcagacccttccccattcaagctgaactgactgcagcctgtgaggggccctgagccacacgacccagctatgccacacagattcctgagccaaagaaatagtgagacgataaagccactgcattgggggagtgacttgttattaacagacaattaatatagctcctttagaacaggagttgggcctacttttccttttcagaaagttggtgcccaagaaagaaacatggacagccgggacctgactctggacctgacactgggcccaggcacttggaggccaattccaagatgctaaagaaaaaaagacacggtgacctcagcttctcagtaatactcactgaaacacataatatggcaatgtggcaaaattctttttaattagattaatgagttatcctattcaaactaactttacaaaatcaaagagataaacaatcataaatgcatgctgtttaaaacctctttcttttctatccctaatgccaccagctgttcccattttaccctgctgtatgccagtgttcaaacaaaacaccaaaaatatgcacccagattccgatgttcccacaacaaagggactagggctctttaaataataactactattataataatataataaataataacaaaccaagacgtgggcctgaaaatccttgttgtcactggaaaataaggactctctcaaggaggtctggaggtggtaaataagaacctggtttgaaggagcttccaatagccaaactgatcacttaagggggacacgcacaaaagcataattacagtcaatcagaggaagtcaagatcacccaaggccactagtacctgtgatgatccaacatgaagcactgttttttaaaagtcctgcttgctgatgtgaacccattcattcatgctcagttacaaagagacaaatgcgtgatccctaagggatgactacataaccacccaccaggaggtcagggaggaccaagagaaatgggtttgtggtcttgtgtctgctcctagaaccaacaggataaaagggggagtaaagcaaaatgaggggtggtctgagaagaaacaggtttccaaggtcctgggaagcaggagctggaacataactgtggaacatgtagtcggcagcactgcattcttccacagaaaaggataagctccacgacgctaagaaagttagaagtttgcaaacatcttccttcttttttttttttccgagacacagtcttgttctttcacccaggcagaagtacagtggcatgatctcagttccctgcaacctccaccacctgggttcaagcgattctcatccctcagccacccaagtagctgggattacaggcacatgctaccacacccggctaatttttgtatttatagtagagctggcatttcgtcatgttgaccaggctggtcttgaactcctggcctcaagtgatccatccacctcggcctcccaaagtgctaggattacaggcgtgagccaccactcgcccggccgtggtttgcaaacatcttttaagagcagcgcttgaactattagcgtgaagttcctcctgggtgttgatggaagccccctacaaaggcagagacaaagctggtgctgagctgttttctcctctgttcatcaaaccaaaggcgcaaaaaaaacaaaacaaaacaaaacaaaaaacgttgcatctgctcctgatccaaggcacttctactcttctgttaaatctctacatccttagcttaatgagaaaagaaatgaatgaatgatctattctctcccccacaaatccataccctaccaaaatattcagggtaaaagttattcgtgtctttaattttaatagacattgccaaattagcactcagaaaggctgtttcaattttcactactcaaaaatgaacaaagctacctaattgctcagatccttgtcaagacttgatagtcttaaacttttgcatttttgccaaattgatgaggggaaaaaatgctacttcatagatttaattcacagtctaaagagcctttcaaagagcgagagataatgctttgcaaattgctaatacaacaaactattttggaaactagcaagagataagtcatagtaacgccatttccttggtgcctgttttctgccggggaccaggcttgacaatttacaggtattatctccagctcttgcagcaatgaggcatcagtagccccattttacagatgcagaaaaaaagatgcagagcactgaagtaacttatcaaggccacatcacaagtgcattagggagctgagatttacacataagtctaacttcacaaaggcccgtggtcaaataaaagttttaacagctttagtccataaaatttcatccatcatcagggtactattctataccttttaggaaatgcagagttacacgaccatcaccaccttccagtttccaagtcaagaaagttagaggtttgcaaacatctcttgagagcagcatataaactgttctctcaggctcgcttcctataaacccctgctccatgcccaaccctaggcaacaactggtctgctgtctgtctccatagatctgccttatctgtgcatctcataaaatatacagtctcttacatccagcttcttttgtttagcataatgttctcgaggcccatccatggcgtagcctgtatcagcagttcattcctttttattcctagtcatattcccttggagggatgatggacatctggattgttttcaggttttggcttctgtgaataatgctgctacaaacattcatgctcgtgtctttctgtggacatatgttttcatttctgttgggtagattcctagaagtggaattgctggattttatggggagtgtctgtttaactttttaaagaaactgccaaactgtttaccaaagtgactccaccattttttattccctccagcatcaaacaaaaattgtcaactgaatattcaagaaatgtgagactttgcatctcttccacttatgctccaggggacgtgtttgtgtgtcacacgcactttagcagcctggcttcagtgtgagaaaaaattaagtctgccacactgggggactgcttcaatttccaggtgacttaccagtctgaaggtgcatctgatggggtttctgcacagcccttccgtgtggatatacctaggaaggactaactgaaataatgctcacatttgaagataaaataggccctaatgggccgggtgcggtggctcacacctggaatcccagcactttgggaggtcgaggcgggaggatcacaagatcgagggattgagaccatcctggctaacacggtgaaactctgtctctactaaaaatacaaaaattacctgggcatggtggcgtgcacctatggtcccagctattcgggaggctgagggaggagaattgcttgaacccaagaaatggaggttgcagtgagctgagatcacgccaccgtgctccagcccggcgacagagcagtgagactctgtctaaaaaaaaaaacaggccctaatgatcaccatgcctcactgacacctctttccctgtcccgctgtattgacacatcgattcccatttttcatggttgacttctgttacgtccctttggaatgtatatctagaatcctcactgggtccctctgtatcctctttagcacctgcaactcttaccaatagataataaataaatgccattatcctgctcatttctgcctctactggcaaataaaagtgtccagcaggaccatatgaaatgctgaaacccatgatcctaaccggtcaccctaacccacctggacacacacactattgatgaacccctgtccctgtggctgtatctgatttttgttaacccattgaaaatatgtggctttcttcctctccatactaatctgaatccattctgtaagatttcatgagacacgctaactgctttctaatatctatgtggtattgcctcctggacccaattctgtaaggtgtttgcaaatgctattatacttgtccgacatggtttgttctcaataatctcagagctttttaatttatttattggaatgccatggcccttgtttgttttcttattctttgcttgtttatcaagtgcacaaagtatctttttcccccacagccccagagtgctgtgcagttgatctccaggttagggaagagcagaggacagagccgaaaagcaaggaaggctgcacacgggagagtgtaggaagggaaacagaatgcatccaaatgttgtgtcctgacgcaatatgtagccatttgtggtttatcaacacttctaagtcagagagtaaaatatgcctaaaagtcaacattccctatttaaacccttgaatggccagatttactagtgtcatctgttggcaaatttcattggcaatctctttgtaaaagcagttgcagggaatcaagcccctgaaaagaggaaaaggaggaaaactgggtgggcatggtggctcacacctgcaatcccagcactttgggaggccgaggtaggcacatcacctgaggtcaggagttcaagaccagctggccaacatggtgaaaccccgtctctataaaaatacaaaaattagtcaggtatggtggcacacactcataatcccagctacttgggaggcggaggcaggagaattgcttgaacccaggaggcagaggttgcggtgagccaagactgcaccactgcactccagcctgggcaacagagtaagactgatctcaaaaaaaaaaaaggaaactaaaaatcatcaccaaacccagccatctcatggccagttcactatttagcataagactgatgccccacccgccttggcctgtgcacatacacctgtgctgaggtcagtaacagacaaggctcctcttgggacaaagtgcctattatgtaccaggcactcttccattcactctgcatattgcatcttatttggttaccacaaagtccagcgagacagctataattatcctcactttacaaatgagaagctggggagctgagaaggtaaatgacttgcccaagccggcataggtagaaagaagcagaggcgggatttaaactgaggacttcagatgccaaagctcatactcttttctccaaaccaggctgcctcctgagttaaattcccctgcgcccaccctcgcccccccattatagctgccgtgagactctaccatctcttcaccatcatcagtaaatatttatcaaggaccaccgcctacacagcattgctcttgtttccacagcaacacactgtcacggagtcaggggagtatcctgtgcttgaaagagtgatgctgtcatgtcctctgatcgtggctgtgaaaggtgacagctatacgactacatggaataccatctcagctggcagcctgacaccttcaagagctgtgctgagtacaagcaagaagaaattaagttgagtagaaagagagtcggttgtaacccaagaatatggtctgcttttactatgtgtttgcgattgttgctggaacagaatttaagccacgtttgcacattaattgttcttttattaggaaacaaatcaagcaatccatgacagaaagtaaaattcgactgtactgctaacagttccccagaggtatccaacggtgattattgagttaaatgactacattgctaacaattgcaattgcaagtcagtcccctataagatacatttttgctctcaatatgtggattctgaaacccactagtaaatgaattcattatccccttattcatttaactgtctctctcttcccccatcccaaatcatgttttgccacattgttaagaggctgtttctaaaggttttttgtttgtttgatttttactatcattccttccaaaaaccgtcgtggctcaagaaatatgtcttagagtaaggaaaaaggaaattgccttttgatgacaagcttccgccccgacttttggacactgagaccaacatgttacagcaaaacatattagcccaactatgttatggatgtaaccttataaattgaaattgctttcaagattgggaattttcagatcaaaagaacatggaaaacacactacttagttttaaaatgtatttgtccaaacttgccaaaagttttaaataaaatactttaaaggaaatcaagttattgtcatatttatactagatttgaaatactaacaatttctgaatttaggaataaaataagataagtccatttttaagtcaacatttacagtattcttgttttgacaaatacagatgttcatgaggaaccctggggaaaaaaaatctaatttagatggtctagttgccgttaaactggaaaggagaggacagatatatacagaaaatccccatttctacaaatgtgtgaggcttagaatgcaccagttctccaatacaagctaatcccattcgtttaaggagcccctggcacaaaggcacccacttgctaaatatatgctatatcgcaggtttgcagaaaccaccctgcccaggtagacccaaaagaaccacagatttcttcccaaaccatattccaggatttcttttctttctcctgcattctaaagagcaaacaaagaaaaggtgctcgctcctcacacttctctaaatgttttaacaaaaggctgctgaataaacacattactcatttaaaaattgaaaagaagttctattcctgatatgaaagcaaccagatttgcattttaatagttgtgggcgagcgccacctggcgggagcatccggaacgggcggcgttcagcactggacagcttcccgagccggtacgggttttaccgcttgctacccaagaacgattcgagacccgtgatggaatatttttgatcctgtttctgccgcgggaacgtgagtggtattaatgtgtggttggccggtcatgccttagaggatataaaatctgagtcacgaatcatgcctggatccccaggactgccccgggcatcctccctagtacccctccctcccctagcacacctaacacaccccccaaaatgaggaaaacaagaattgtgcaccatctttagaatggtgctgtagctgtccctcttctctcacttgctaatccaacctttcagcttcacacacctcaaaaggagtgtcttcgtcacccaacttcccagccagggaaacaggctgtcccttcacagaagtcgcctattccgcttccattttagtaccaagcaaggaaggctctaaagcatttccaacggaatgtccttccagcggcccttaacctcagacgcagcttgtgcaaagacgctgtacctccccacaggttcgttcttttgctctttctttcttcctttccttctttcggtgaaataataaatgggcacagctgttgcttagcgatccgaaaccagcctgttcctgcgtcccacgggctgatctcagcctgtccccgcaatcccagccacctcaggccggcgtggttacaccaaaagcaatcggtgctaagaaactttaaggtgattttgaacttggaagtacacctgcagcactcccttctcttccctccgccgctactcttgggggggggggggctcgggggtggaagctgcctgcggtggggcttggtgatgtgtaagaccctggactgtggtgccctccagcacccgccaacgtgcctttaggagcacggcaggcaccacccccccgcccccgctccccctactctggggaactacctctgctcaccgccttcccgtggccaaacccaaatatgagttccccgaacttttcaggagcggacgcgctcacgggtcaaatccactcccctccaagggccttaacacgggcgcccagctacctcggagaaaagccagcgggtagggcggaggtattgctctcggtcatcaacgcaaacatcccctcgggtgcctacagcggcctgcttaggggagcagcgtgttcagagcaaatggagagcttcctgtatctccgaggaaaaaagaaaagccgccgccccggcagcctcggcctgctggggacctgtcctccccactaaaagcgcgcgctgcccgaggagctgcccgggagagaacgctccaccccgggcgtcggtgccgctcctcgtctcgccgccccaaacactcaagtggcagattccgacaagtgggaggcagcaagtggaaatattcgcaacaaccgcggaaagttactccagcccggggggccggcaggaaactgaagcggggaacttcgccaaacgcgggctgccgagggacgcgaggggccgggctcgctggccggggcgcgcggggacactgcttcccgcgcctgcaagctgagacccgggttccggccatggggacccgcgcccccgcgagcccacacaactttctcctccgagggccccgcggctgggggcccgcgcgcatccaggagggagcggggagcccaggggagccgggcgggcgcactcacctgcggcgctctgagcccgggcgccgggcagtggcggcagctgcagcctcaggagcaggctgagggcgagcgcggcgaggctcgccatccgggcggcggcgggcagctcagccccttcccgcgggggccggggccgggactggggcgggcgcggggtggccccgcatcgccggcgcggccgctggctgtgcgcgcggctggctccgctcgggctcccggagccggcgctcctgcgttccaagccgaggcgcggcgcgaactgaggcgggagg

(The sequence listing continues in the following parts.)

The invention claimed is:

1. A method of treating lung cancer in a patient in need thereof, wherein the lung cancer is lung squamous cell carcinoma, the method comprising:
   detecting a G allele at rs1799977 in the nucleotide sequence of MLH1 in a sample from the patient wherein the presence of said G allele is identified as predictive of enhanced response to radiochemotherapy; and
   administering radiochemotherapy to the patient.

2. The method of claim 1, further comprising detecting at least one additional allele in at least one gene selected from the group consisting of: BRCA2, DDX11, EPHA2, FLT1, GEN1, GRINA, HEATR1, MUTYH, NUDT1, PARP10, PRPF19, SETD2, and ZNF208.

3. The method of claim 2, wherein the at least one additional allele is selected from the group consisting of: rs1801406(A>G), rs1046456(C>T), rs3754334(G>A), rs7993418(G>A), rs16981869(A>G), rs72407975(del-TAA), rs67714660(C>G), rs56261297(C>T), rs2275685(C>T), rs2275687(T>C), rs1885533(A>G), rs1885534(G>A), rs1006456(T>C), rs2794763(T>C), rs3219472(C>T), rs1062492(C>T), rs11136344(T>C), rs11136345(G>A), rs2240045(C>T), rs4082155(G>A), and rs10425763(T>C).

4. The method of claim 1, wherein the sample is a blood sample.

* * * * *